United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 17

SEQ ID NO: 263391 - DNA, 20 bp, Artificial Sequence
  Description of Artificial Sequence: Synthetic oligonucleotide
  Target: ATXN1; (+) strand; PAM type: YTN; PAM sequence: CTT
cagaggaaaaactgaatttt

SEQ ID NO: 263392 - DNA, 20 bp, Artificial Sequence
  Description of Artificial Sequence: Synthetic oligonucleotide
  Target: ATXN1; (+) strand; PAM type: YTN; PAM sequence: TTC
agaggaaaaactgaattttt

SEQ ID NO: 263393 - DNA, 20 bp, Artificial Sequence
  Description of Artificial Sequence: Synthetic oligonucleotide
  Target: ATXN1; (+) strand; PAM type: YTN; PAM sequence: CTG
aatttttcttttaaaaagcc

SEQ ID NO: 263394 - DNA, 20 bp, Artificial Sequence
  Description of Artificial Sequence: Synthetic oligonucleotide
  Target: ATXN1; (+) strand; PAM type: YTN; PAM sequence: TTT
ttcttttaaaaagccagtgg

SEQ ID NO: 263395 - DNA, 20 bp, Artificial Sequence
  Description of Artificial Sequence: Synthetic oligonucleotide
  Target: ATXN1; (+) strand; PAM type: YTN; PAM sequence: TTT
tcttttaaaaagccagtggg

SEQ ID NO: 263396 - DNA, 20 bp, Artificial Sequence
  Description of Artificial Sequence: Synthetic oligonucleotide
  Target: ATXN1; (+) strand; PAM type: YTN; PAM sequence: TTT
cttttaaaaagccagtggga

SEQ ID NO: 263397 - DNA, 20 bp, Artificial Sequence
  Description of Artificial Sequence: Synthetic oligonucleotide
  Target: ATXN1; (+) strand; PAM type: YTN; PAM sequence: TTC
ttttaaaaagccagtgggac

SEQ ID NO: 263398 - DNA, 20 bp, Artificial Sequence
  Description of Artificial Sequence: Synthetic oligonucleotide
  Target: ATXN1; (+) strand; PAM type: YTN; PAM sequence: CTT
ttaaaaagccagtgggacag

SEQ ID NO: 263399 - DNA, 20 bp, Artificial Sequence
  Description of Artificial Sequence: Synthetic oligonucleotide
  Target: ATXN1; (+) strand; PAM type: YTN; PAM sequence: TTT
taaaaagccagtgggacagt

SEQ ID NO: 263400 - DNA, 20 bp, Artificial Sequence
  Description of Artificial Sequence: Synthetic oligonucleotide
  Target: ATXN1; (+) strand; PAM type: YTN; PAM sequence: TTT
aaaaagccagtgggacagtc

SEQ ID NO: 263401 - DNA, 20 bp, Artificial Sequence
  Description of Artificial Sequence: Synthetic oligonucleotide
  Target: ATXN1; (+) strand; PAM type: YTN; PAM sequence: TTA
aaaagccagtgggacagtca

SEQ ID NO: 263402 - DNA, 20 bp, Artificial Sequence
  Description of Artificial Sequence: Synthetic oligonucleotide
  Target: ATXN1; (+) strand; PAM type: YTN; PAM sequence: TTT
ctgaaaactcatttgtgaat

SEQ ID NO: 263403 - DNA, 20 bp, Artificial Sequence
  Description of Artificial Sequence: Synthetic oligonucleotide
  Target: ATXN1; (+) strand; PAM type: YTN; PAM sequence: TTC
tgaaaactcatttgtgaatc

SEQ ID NO: 263404 - DNA, 20 bp, Artificial Sequence
  Description of Artificial Sequence: Synthetic oligonucleotide
  Target: ATXN1; (+) strand; PAM type: YTN; PAM sequence: CTG
aaaactcatttgtgaatcaa

SEQ ID NO: 263405 - DNA, 20 bp, Artificial Sequence
  Description of Artificial Sequence: Synthetic oligonucleotide
  Target: ATXN1; (+) strand; PAM type: YTN; PAM sequence: CTC
atttgtgaatcaaaaccaga

SEQ ID NO: 263406 - DNA, 20 bp, Artificial Sequence
  Description of Artificial Sequence: Synthetic oligonucleotide
  Target: ATXN1; (+) strand; PAM type: YTN; PAM sequence: TTT
gtgaatcaaaaccagagtag

SEQ ID NO: 263407 - DNA, 20 bp, Artificial Sequence
  Description of Artificial Sequence: Synthetic oligonucleotide
  Target: ATXN1; (+) strand; PAM type: YTN; PAM sequence: TTG
tgaatcaaaaccagagtaga

SEQ ID NO: 263408 - DNA, 20 bp, Artificial Sequence
  Description of Artificial Sequence: Synthetic oligonucleotide
  Target: ATXN1; (+) strand; PAM type: YTN; PAM sequence: CTG
agcattccaatgaaagggta

SEQ ID NO: 263409 - DNA, 20 bp, Artificial Sequence
  Description of Artificial Sequence: Synthetic oligonucleotide
  Target: ATXN1; (+) strand; PAM type: YTN; PAM sequence: TTC
caatgaaagggtaaaaaaag

SEQ ID NO: 263410 - DNA, 20 bp, Artificial Sequence
  Description of Artificial Sequence: Synthetic oligonucleotide
  Target: ATXN1; (+) strand; PAM type: YTN; PAM sequence: CTG
atttttttcccactctcact

SEQ ID NO: 263411 - DNA, 20 bp, Artificial Sequence
  Description of Artificial Sequence: Synthetic oligonucleotide
  Target: ATXN1; (+) strand; PAM type: YTN; PAM sequence: TTT
ttttcccactctcactggtg

SEQ ID NO: 263412 - DNA, 20 bp, Artificial Sequence
  Description of Artificial Sequence: Synthetic oligonucleotide
  Target: ATXN1; (+) strand; PAM type: YTN; PAM sequence: TTT
tttcccactctcactggtgt

SEQ ID NO: 263413 - DNA, 20 bp, Artificial Sequence
  Description of Artificial Sequence: Synthetic oligonucleotide
  Target: ATXN1; (+) strand; PAM type: YTN; PAM sequence: TTT
ttcccactctcactggtgtg

SEQ ID NO: 263414 - DNA, 20 bp, Artificial Sequence
  Description of Artificial Sequence: Synthetic oligonucleotide
  Target: ATXN1; (+) strand; PAM type: YTN; PAM sequence: TTT
tcccactctcactggtgtga

SEQ ID NO: 263415 - DNA, 20 bp, Artificial Sequence
  Description of Artificial Sequence: Synthetic oligonucleotide
  Target: ATXN1; (+) strand; PAM type: YTN; PAM sequence: TTT
cccactctcactggtgtgag

SEQ ID NO: 263416 - DNA, 20 bp, Artificial Sequence
  Description of Artificial Sequence: Synthetic oligonucleotide
  Target: ATXN1; (+) strand; PAM type: YTN; PAM sequence: TTC
ccactctcactggtgtgaga

SEQ ID NO: 263417 - DNA, 20 bp, Artificial Sequence
  Description of Artificial Sequence: Synthetic oligonucleotide
  Target: ATXN1; (+) strand; PAM type: YTN; PAM sequence: CTC
tcactggtgtgagattttaa

SEQ ID NO: 263418 - DNA, 20 bp, Artificial Sequence
  Description of Artificial Sequence: Synthetic oligonucleotide
  Target: ATXN1; (+) strand; PAM type: YTN; PAM sequence: CTC
actggtgtgagattttaaag

SEQ ID NO: 263419 - DNA, 20 bp, Artificial Sequence
  Description of Artificial Sequence: Synthetic oligonucleotide
  Target: ATXN1; (+) strand; PAM type: YTN; PAM sequence: CTG
gtgtgagattttaaagacat

SEQ ID NO: 263420 - DNA, 20 bp, Artificial Sequence
  Description of Artificial Sequence: Synthetic oligonucleotide
  Target: ATXN1; (+) strand; PAM type: YTN; PAM sequence: TTT
taaagacattccttcctgtc

SEQ ID NO: 263421 - DNA, 20 bp, Artificial Sequence
  Description of Artificial Sequence: Synthetic oligonucleotide
  Target: ATXN1; (+) strand; PAM type: YTN; PAM sequence: TTT
aaagacattccttcctgtca

SEQ ID NO: 263422 - DNA, 20 bp, Artificial Sequence
  Description of Artificial Sequence: Synthetic oligonucleotide
  Target: ATXN1; (+) strand; PAM type: YTN; PAM sequence: TTA
aagacattccttcctgtcaa

SEQ ID NO: 263423 - DNA, 20 bp, Artificial Sequence
  Description of Artificial Sequence: Synthetic oligonucleotide
  Target: ATXN1; (+) strand; PAM type: YTN; PAM sequence: TTC
cttcctgtcaaaaggatggc

SEQ ID NO: 263424 - DNA, 20 bp, Artificial Sequence
  Description of Artificial Sequence: Synthetic oligonucleotide
  Target: ATXN1; (+) strand; PAM type: YTN; PAM sequence: CTT
cctgtcaaaaggatggcgtc

SEQ ID NO: 263425 - DNA, 20 bp, Artificial Sequence
  Description of Artificial Sequence: Synthetic oligonucleotide
  Target: ATXN1; (+) strand; PAM type: YTN; PAM sequence: TTC
ctgtcaaaaggatggcgtca

SEQ ID NO: 263426 - DNA, 20 bp, Artificial Sequence
  Description of Artificial Sequence: Synthetic oligonucleotide
  Target: ATXN1; (+) strand; PAM type: YTN; PAM sequence: CTG
tcaaaaggatggcgtcaaat

SEQ ID NO: 263427 - DNA, 20 bp, Artificial Sequence
  Description of Artificial Sequence: Synthetic oligonucleotide
  Target: ATXN1; (+) strand; PAM type: YTN; PAM sequence: TTT
taagtatcgacataaacctg

SEQ ID NO: 263428 - DNA, 20 bp, Artificial Sequence
  Description of Artificial Sequence: Synthetic oligonucleotide
  Target: ATXN1; (+) strand; PAM type: YTN; PAM sequence: TTT
aagtatcgacataaacctgc

SEQ ID NO: 263429 - DNA, 20 bp, Artificial Sequence
  Description of Artificial Sequence: Synthetic oligonucleotide
  Target: ATXN1; (+) strand; PAM type: YTN; PAM sequence: TTA
agtatcgacataaacctgcc

SEQ ID NO: 263430 - DNA, 20 bp, Artificial Sequence
  Description of Artificial Sequence: Synthetic oligonucleotide
  Target: ATXN1; (+) strand; PAM type: YTN; PAM sequence: CTG
cctcttcatatccctcttgt

SEQ ID NO: 263431 - DNA, 20 bp, Artificial Sequence
  Description of Artificial Sequence: Synthetic oligonucleotide
  Target: ATXN1; (+) strand; PAM type: YTN; PAM sequence: CTC
ttcatatccctcttgttctt

SEQ ID NO: 263432 - DNA, 20 bp, Artificial Sequence
  Description of Artificial Sequence: Synthetic oligonucleotide
  Target: ATXN1; (+) strand; PAM type: YTN; PAM sequence: CTT
catatccctcttgttcttat

SEQ ID NO: 263433 - DNA, 20 bp, Artificial Sequence
  Description of Artificial Sequence: Synthetic oligonucleotide
  Target: ATXN1; (+) strand; PAM type: YTN; PAM sequence: TTC
atatccctcttgttcttata

SEQ ID NO: 263434 - DNA, 20 bp, Artificial Sequence
  Description of Artificial Sequence: Synthetic oligonucleotide
  Target: ATXN1; (+) strand; PAM type: YTN; PAM sequence: CTC
ttgttcttatagtacatcta

SEQ ID NO: 263435 - DNA, 20 bp, Artificial Sequence
  Description of Artificial Sequence: Synthetic oligonucleotide
  Target: ATXN1; (+) strand; PAM type: YTN; PAM sequence: CTT
gttcttatagtacatctatt

SEQ ID NO: 263436 - DNA, 20 bp, Artificial Sequence
  Description of Artificial Sequence: Synthetic oligonucleotide
  Target: ATXN1; (+) strand; PAM type: YTN; PAM sequence: TTG
ttcttatagtacatctattc

SEQ ID NO: 263437 - DNA, 20 bp, Artificial Sequence
  Description of Artificial Sequence: Synthetic oligonucleotide
  Target: ATXN1; (+) strand; PAM type: YTN; PAM sequence: TTC
ttatagtacatctattcttg

SEQ ID NO: 263438 - DNA, 20 bp, Artificial Sequence
  Description of Artificial Sequence: Synthetic oligonucleotide
  Target: ATXN1; (+) strand; PAM type: YTN; PAM sequence: CTT
atagtacatctattcttgtc

SEQ ID NO: 263439 - DNA, 20 bp, Artificial Sequence
  Description of Artificial Sequence: Synthetic oligonucleotide
  Target: ATXN1; (+) strand; PAM type: YTN; PAM sequence: TTA
tagtacatctattcttgtct

SEQ ID NO: 263440 - DNA, 20 bp, Artificial Sequence
  Description of Artificial Sequence: Synthetic oligonucleotide
  Target: ATXN1; (+) strand; PAM type: YTN; PAM sequence: CTA
ttcttgtctcattccaccac

SEQ ID NO: 263441 - DNA, 20 bp, Artificial Sequence
  Description of Artificial Sequence: Synthetic oligonucleotide
  Target: ATXN1; (+) strand; PAM type: YTN; PAM sequence: TTC
ttgtctcattccaccacaac

SEQ ID NO: 263442 - DNA, 20 bp, Artificial Sequence
  Description of Artificial Sequence: Synthetic oligonucleotide
  Target: ATXN1; (+) strand; PAM type: YTN; PAM sequence: CTT
gtctcattccaccacaacaa

SEQ ID NO: 263443 - DNA, 20 bp, Artificial Sequence
  Description of Artificial Sequence: Synthetic oligonucleotide
  Target: ATXN1; (+) strand; PAM type: YTN; PAM sequence: TTG
tctcattccaccacaacaag

SEQ ID NO: 263444 - DNA, 20 bp, Artificial Sequence
  Description of Artificial Sequence: Synthetic oligonucleotide
  Target: ATXN1; (+) strand; PAM type: YTN; PAM sequence: CTC
attccaccacaacaagtttt

SEQ ID NO: 263445 - DNA, 20 bp, Artificial Sequence
  Description of Artificial Sequence: Synthetic oligonucleotide
  Target: ATXN1; (+) strand; PAM type: YTN; PAM sequence: TTC
caccacaacaagttttataa

SEQ ID NO: 263446 - DNA, 20 bp, Artificial Sequence
  Description of Artificial Sequence: Synthetic oligonucleotide
  Target: ATXN1; (+) strand; PAM type: YTN; PAM sequence: TTT
tataatagcaggtaggtttg

SEQ ID NO: 263447 - DNA, 20 bp, Artificial Sequence
  Description of Artificial Sequence: Synthetic oligonucleotide
  Target: ATXN1; (+) strand; PAM type: YTN; PAM sequence: TTT
ataatagcaggtaggtttgt

SEQ ID NO: 263448 - DNA, 20 bp, Artificial Sequence
  Description of Artificial Sequence: Synthetic oligonucleotide
  Target: ATXN1; (+) strand; PAM type: YTN; PAM sequence: TTA
taatagcaggtaggtttgtg

SEQ ID NO: 263449 - DNA, 20 bp, Artificial Sequence
  Description of Artificial Sequence: Synthetic oligonucleotide
  Target: ATXN1; (+) strand; PAM type: YTN; PAM sequence: TTT
gtgcatttatcacttttatc

SEQ ID NO: 263450 - DNA, 20 bp, Artificial Sequence
  Description of Artificial Sequence: Synthetic oligonucleotide
  Target: ATXN1; (+) strand; PAM type: YTN; PAM sequence: TTG
tgcatttatcacttttatct

SEQ ID NO: 263451 - DNA, 20 bp, Artificial Sequence
  Description of Artificial Sequence: Synthetic oligonucleotide
  Target: ATXN1; (+) strand; PAM type: YTN; PAM sequence: TTT
atcacttttatcttttgaaa

SEQ ID NO: 263452 - DNA, 20 bp, Artificial Sequence
  Description of Artificial Sequence: Synthetic oligonucleotide
  Target: ATXN1; (+) strand; PAM type: YTN; PAM sequence: TTA
tcacttttatcttttgaaaa

SEQ ID NO: 263453 - DNA, 20 bp, Artificial Sequence
  Description of Artificial Sequence: Synthetic oligonucleotide
  Target: ATXN1; (+) strand; PAM type: YTN; PAM sequence: CTT
ttatcttttgaaaatgttac

SEQ ID NO: 263454 - DNA, 20 bp, Artificial Sequence
  Description of Artificial Sequence: Synthetic oligonucleotide
  Target: ATXN1; (+) strand; PAM type: YTN; PAM sequence: TTT
tatcttttgaaaatgttaca

SEQ ID NO: 263455 - DNA, 20 bp, Artificial Sequence
  Description of Artificial Sequence: Synthetic oligonucleotide
  Target: ATXN1; (+) strand; PAM type: YTN; PAM sequence: TTT
atcttttgaaaatgttacag

SEQ ID NO: 263456 - DNA, 20 bp, Artificial Sequence
  Description of Artificial Sequence: Synthetic oligonucleotide
  Target: ATXN1; (+) strand; PAM type: YTN; PAM sequence: TTA
tcttttgaaaatgttacaga

SEQ ID NO: 263457 - DNA, 20 bp, Artificial Sequence
  Description of Artificial Sequence: Synthetic oligonucleotide
  Target: ATXN1; (+) strand; PAM type: YTN; PAM sequence: CTT
ttgaaaatgttacagacaat

SEQ ID NO: 263458 - DNA, 20 bp, Artificial Sequence
  Description of Artificial Sequence: Synthetic oligonucleotide
  Target: ATXN1; (+) strand; PAM type: YTN; PAM sequence: TTT
tgaaaatgttacagacaatt

SEQ ID NO: 263459 - DNA, 20 bp, Artificial Sequence
  Description of Artificial Sequence: Synthetic oligonucleotide
  Target: ATXN1; (+) strand; PAM type: YTN; PAM sequence: TTT
gaaaatgttacagacaatta

SEQ ID NO: 263460 - DNA, 20 bp, Artificial Sequence
  Description of Artificial Sequence: Synthetic oligonucleotide
  Target: ATXN1; (+) strand; PAM type: YTN; PAM sequence: TTG
aaaatgttacagacaattaa

SEQ ID NO: 263461 - DNA, 20 bp, Artificial Sequence
  Description of Artificial Sequence: Synthetic oligonucleotide
  Target: ATXN1; (+) strand; PAM type: YTN; PAM sequence: TTA
cagacaattaattcacatta

SEQ ID NO: 263462 - DNA, 20 bp, Artificial Sequence
  Description of Artificial Sequence: Synthetic oligonucleotide
  Target: ATXN1; (+) strand; PAM type: YTN; PAM sequence: TTA
attcacattaaaactctatt

SEQ ID NO: 263463 - DNA, 20 bp, Artificial Sequence
  Description of Artificial Sequence: Synthetic oligonucleotide
  Target: ATXN1; (+) strand; PAM type: YTN; PAM sequence: TTC
acattaaaactctattactg

SEQ ID NO: 263464 - DNA, 20 bp, Artificial Sequence
  Description of Artificial Sequence: Synthetic oligonucleotide
  Target: ATXN1; (+) strand; PAM type: YTN; PAM sequence: TTA
aaactctattactgatttaa

SEQ ID NO: 263465 - DNA, 20 bp, Artificial Sequence
  Description of Artificial Sequence: Synthetic oligonucleotide
  Target: ATXN1; (+) strand; PAM type: YTN; PAM sequence: CTC
tattactgatttaaaagttc

SEQ ID NO: 263466 - DNA, 20 bp, Artificial Sequence
  Description of Artificial Sequence: Synthetic oligonucleotide
  Target: ATXN1; (+) strand; PAM type: YTN; PAM sequence: CTA
ttactgatttaaaagttcaa

SEQ ID NO: 263467 - DNA, 20 bp, Artificial Sequence
  Description of Artificial Sequence: Synthetic oligonucleotide
  Target: ATXN1; (+) strand; PAM type: YTN; PAM sequence: TTA
ctgatttaaaagttcaagat

SEQ ID NO: 263468 - DNA, 20 bp, Artificial Sequence
  Description of Artificial Sequence: Synthetic oligonucleotide
  Target: ATXN1; (+) strand; PAM type: YTN; PAM sequence: CTG
atttaaaagttcaagattta

SEQ ID NO: 263469 - DNA, 20 bp, Artificial Sequence
  Description of Artificial Sequence: Synthetic oligonucleotide
  Target: ATXN1; (+) strand; PAM type: YTN; PAM sequence: TTT
aaaagttcaagatttagaat

SEQ ID NO: 263470 - DNA, 20 bp, Artificial Sequence
  Description of Artificial Sequence: Synthetic oligonucleotide
  Target: ATXN1; (+) strand; PAM type: YTN; PAM sequence: TTA
aaagttcaagatttagaatt

SEQ ID NO: 263471 - DNA, 20 bp, Artificial Sequence
  Description of Artificial Sequence: Synthetic oligonucleotide
  Target: ATXN1; (+) strand; PAM type: YTN; PAM sequence: TTC
aagatttagaatttaaggat

SEQ ID NO: 263472 - DNA, 20 bp, Artificial Sequence
  Description of Artificial Sequence: Synthetic oligonucleotide
  Target: ATXN1; (+) strand; PAM type: YTN; PAM sequence: TTT
agaatttaaggattctgatg

SEQ ID NO: 263473 - DNA, 20 bp, Artificial Sequence
  Description of Artificial Sequence: Synthetic oligonucleotide
  Target: ATXN1; (+) strand; PAM type: YTN; PAM sequence: TTA
gaatttaaggattctgatga

SEQ ID NO: 263474 - DNA, 20 bp, Artificial Sequence
  Description of Artificial Sequence: Synthetic oligonucleotide
  Target: ATXN1; (+) strand; PAM type: YTN; PAM sequence: TTT
aaggattctgatgaaagttt

SEQ ID NO: 263475 - DNA, 20 bp, Artificial Sequence
  Description of Artificial Sequence: Synthetic oligonucleotide
  Target: ATXN1; (+) strand; PAM type: YTN; PAM sequence: TTA
aggattctgatgaaagttta

SEQ ID NO: 263476 - DNA, 20 bp, Artificial Sequence
  Description of Artificial Sequence: Synthetic oligonucleotide
  Target: ATXN1; (+) strand; PAM type: YTN; PAM sequence: TTC
tgatgaaagtttagcgtaaa

SEQ ID NO: 263477 - DNA, 20 bp, Artificial Sequence
  Description of Artificial Sequence: Synthetic oligonucleotide
  Target: ATXN1; (+) strand; PAM type: YTN; PAM sequence: CTG
atgaaagtttagcgtaaacc

SEQ ID NO: 263478 - DNA, 20 bp, Artificial Sequence
  Description of Artificial Sequence: Synthetic oligonucleotide
  Target: ATXN1; (+) strand; PAM type: YTN; PAM sequence: TTT
agcgtaaacctactttagct

SEQ ID NO: 263479 - DNA, 20 bp, Artificial Sequence
  Description of Artificial Sequence: Synthetic oligonucleotide
  Target: ATXN1; (+) strand; PAM type: YTN; PAM sequence: TTA
gcgtaaacctactttagctg

SEQ ID NO: 263480 - DNA, 20 bp, Artificial Sequence
  Description of Artificial Sequence: Synthetic oligonucleotide
  Target: ATXN1; (+) strand; PAM type: YTN; PAM sequence: CTA
ctttagctgactagattttt

SEQ ID NO: 263481 - DNA, 20 bp, Artificial Sequence
  Description of Artificial Sequence: Synthetic oligonucleotide
  Target: ATXN1; (+) strand; PAM type: YTN; PAM sequence: CTT
tagctgactagattttttaa

SEQ ID NO: 263482 - DNA, 20 bp, Artificial Sequence
  Description of Artificial Sequence: Synthetic oligonucleotide
  Target: ATXN1; (+) strand; PAM type: YTN; PAM sequence: TTT
agctgactagattttttaaa

SEQ ID NO: 263483 - DNA, 20 bp, Artificial Sequence
  Description of Artificial Sequence: Synthetic oligonucleotide
  Target: ATXN1; (+) strand; PAM type: YTN; PAM sequence: TTA
gctgactagattttttaaaa

SEQ ID NO: 263484 - DNA, 20 bp, Artificial Sequence
  Description of Artificial Sequence: Synthetic oligonucleotide
  Target: ATXN1; (+) strand; PAM type: YTN; PAM sequence: CTG
actagattttttaaaaggtt

SEQ ID NO: 263485 - DNA, 20 bp, Artificial Sequence
  Description of Artificial Sequence: Synthetic oligonucleotide
  Target: ATXN1; (+) strand; PAM type: YTN; PAM sequence: CTA
gattttttaaaaggtttagg

SEQ ID NO: 263486 - DNA, 20 bp, Artificial Sequence
  Description of Artificial Sequence: Synthetic oligonucleotide
  Target: ATXN1; (+) strand; PAM type: YTN; PAM sequence: TTT
tttaaaaggtttaggaattg

SEQ ID NO: 263487 - DNA, 20 bp, Artificial Sequence
  Description of Artificial Sequence: Synthetic oligonucleotide
  Target: ATXN1; (+) strand; PAM type: YTN; PAM sequence: TTT
ttaaaaggtttaggaattgt

SEQ ID NO: 263488 - DNA, 20 bp, Artificial Sequence
  Description of Artificial Sequence: Synthetic oligonucleotide
  Target: ATXN1; (+) strand; PAM type: YTN; PAM sequence: TTT
taaaaggtttaggaattgtt

SEQ ID NO: 263489 - DNA, 20 bp, Artificial Sequence
  Description of Artificial Sequence: Synthetic oligonucleotide
  Target: ATXN1; (+) strand; PAM type: YTN; PAM sequence: TTT
aaaaggtttaggaattgttt

SEQ ID NO: 263490 - DNA, 20 bp, Artificial Sequence
  Description of Artificial Sequence: Synthetic oligonucleotide
  Target: ATXN1; (+) strand; PAM type: YTN; PAM sequence: TTA
aaaggtttaggaattgttta

SEQ ID NO: 263491 - DNA, 20 bp, Artificial Sequence
  Description of Artificial Sequence: Synthetic oligonucleotide
  Target: ATXN1; (+) strand; PAM type: YTN; PAM sequence: TTT
aggaattgtttacctccttt

SEQ ID NO: 263492 - DNA, 20 bp, Artificial Sequence
  Description of Artificial Sequence: Synthetic oligonucleotide
  Target: ATXN1; (+) strand; PAM type: YTN; PAM sequence: TTA
ggaattgtttacctccttta

SEQ ID NO: 263493 - DNA, 20 bp, Artificial Sequence
  Description of Artificial Sequence: Synthetic oligonucleotide
  Target: ATXN1; (+) strand; PAM type: YTN; PAM sequence: TTG
tttacctcctttaagcatta

SEQ ID NO: 263494 - DNA, 20 bp, Artificial Sequence
  Description of Artificial Sequence: Synthetic oligonucleotide
  Target: ATXN1; (+) strand; PAM type: YTN; PAM sequence: TTT
acctcctttaagcattatta

SEQ ID NO: 263495 - DNA, 20 bp, Artificial Sequence
  Description of Artificial Sequence: Synthetic oligonucleotide
  Target: ATXN1; (+) strand; PAM type: YTN; PAM sequence: TTA
cctcctttaagcattattaa

SEQ ID NO: 263496 - DNA, 20 bp, Artificial Sequence
  Description of Artificial Sequence: Synthetic oligonucleotide
  Target: ATXN1; (+) strand; PAM type: YTN; PAM sequence: CTC
ctttaagcattattaaactt

SEQ ID NO: 263497 - DNA, 20 bp, Artificial Sequence
  Description of Artificial Sequence: Synthetic oligonucleotide
  Target: ATXN1; (+) strand; PAM type: YTN; PAM sequence: CTT
taagcattattaaacttact

SEQ ID NO: 263498 - DNA, 20 bp, Artificial Sequence
  Description of Artificial Sequence: Synthetic oligonucleotide
  Target: ATXN1; (+) strand; PAM type: YTN; PAM sequence: TTT
aagcattattaaacttactt

SEQ ID NO: 263499 - DNA, 20 bp, Artificial Sequence
  Description of Artificial Sequence: Synthetic oligonucleotide
  Target: ATXN1; (+) strand; PAM type: YTN; PAM sequence: TTA
agcattattaaacttacttt

SEQ ID NO: 263500 - DNA, 20 bp, Artificial Sequence
  Description of Artificial Sequence: Synthetic oligonucleotide
  Target: ATXN1; (+) strand; PAM type: YTN; PAM sequence: TTA
ttaaacttactttatcacca

SEQ ID NO: 263501 - DNA, 20 bp, Artificial Sequence
  Description of Artificial Sequence: Synthetic oligonucleotide
  Target: ATXN1; (+) strand; PAM type: YTN; PAM sequence: TTA
aacttactttatcaccatca

SEQ ID NO: 263502 - DNA, 20 bp, Artificial Sequence
  Description of Artificial Sequence: Synthetic oligonucleotide
  Target: ATXN1; (+) strand; PAM type: YTN; PAM sequence: CTT
actttatcaccatcatttgc

SEQ ID NO: 263503 - DNA, 20 bp, Artificial Sequence
  Description of Artificial Sequence: Synthetic oligonucleotide
  Target: ATXN1; (+) strand; PAM type: YTN; PAM sequence: TTA
ctttatcaccatcatttgca

SEQ ID NO: 263504 - DNA, 20 bp, Artificial Sequence
  Description of Artificial Sequence: Synthetic oligonucleotide
  Target: ATXN1; (+) strand; PAM type: YTN; PAM sequence: CTT
tatcaccatcatttgcatcc

SEQ ID NO: 263505 - DNA, 20 bp, Artificial Sequence
  Description of Artificial Sequence: Synthetic oligonucleotide
  Target: ATXN1; (+) strand; PAM type: YTN; PAM sequence: TTT
atcaccatcatttgcatcca

SEQ ID NO: 263506 - DNA, 20 bp, Artificial Sequence
  Description of Artificial Sequence: Synthetic oligonucleotide
  Target: ATXN1; (+) strand; PAM type: YTN; PAM sequence: TTA
tcaccatcatttgcatccag

SEQ ID NO: 263507 - DNA, 20 bp, Artificial Sequence
  Description of Artificial Sequence: Synthetic oligonucleotide
  Target: ATXN1; (+) strand; PAM type: YTN; PAM sequence: TTT
gcatccagacaacatgctag

SEQ ID NO: 263508 - DNA, 20 bp, Artificial Sequence
  Description of Artificial Sequence: Synthetic oligonucleotide
  Target: ATXN1; (+) strand; PAM type: YTN; PAM sequence: TTG
catccagacaacatgctagt

SEQ ID NO: 263509 - DNA, 20 bp, Artificial Sequence
  Description of Artificial Sequence: Synthetic oligonucleotide
  Target: ATXN1; (+) strand; PAM type: YTN; PAM sequence: CTA
gtcgaaagtgatttagtctt

SEQ ID NO: 263510 - DNA, 20 bp, Artificial Sequence
  Description of Artificial Sequence: Synthetic oligonucleotide
  Target: ATXN1; (+) strand; PAM type: YTN; PAM sequence: TTT
agtctttaaagtaattcttt

SEQ ID NO: 263511 - DNA, 20 bp, Artificial Sequence
  Description of Artificial Sequence: Synthetic oligonucleotide
  Target: ATXN1; (+) strand; PAM type: YTN; PAM sequence: TTA
gtctttaaagtaattcttta

SEQ ID NO: 263512 - DNA, 20 bp, Artificial Sequence
  Description of Artificial Sequence: Synthetic oligonucleotide
  Target: ATXN1; (+) strand; PAM type: YTN; PAM sequence: CTT
taaagtaattctttataaaa

SEQ ID NO: 263513 - DNA, 20 bp, Artificial Sequence
  Description of Artificial Sequence: Synthetic oligonucleotide
  Target: ATXN1; (+) strand; PAM type: YTN; PAM sequence: TTT
aaagtaattctttataaaat

SEQ ID NO: 263514 - DNA, 20 bp, Artificial Sequence
  Description of Artificial Sequence: Synthetic oligonucleotide
  Target: ATXN1; (+) strand; PAM type: YTN; PAM sequence: TTA
aagtaattctttataaaatt

SEQ ID NO: 263515 - DNA, 20 bp, Artificial Sequence
  Description of Artificial Sequence: Synthetic oligonucleotide
  Target: ATXN1; (+) strand; PAM type: YTN; PAM sequence: TTC
tttataaaattttattagat

SEQ ID NO: 263516 - DNA, 20 bp, Artificial Sequence
  Description of Artificial Sequence: Synthetic oligonucleotide
  Target: ATXN1; (+) strand; PAM type: YTN; PAM sequence: CTT
tataaaattttattagattt

SEQ ID NO: 263517 - DNA, 20 bp, Artificial Sequence
  Description of Artificial Sequence: Synthetic oligonucleotide
  Target: ATXN1; (+) strand; PAM type: YTN; PAM sequence: TTT
ataaaattttattagatttg

SEQ ID NO: 263518 - DNA, 20 bp, Artificial Sequence
  Description of Artificial Sequence: Synthetic oligonucleotide
  Target: ATXN1; (+) strand; PAM type: YTN; PAM sequence: TTA
taaaattttattagatttgg

SEQ ID NO: 263519 - DNA, 20 bp, Artificial Sequence
  Description of Artificial Sequence: Synthetic oligonucleotide
  Target: ATXN1; (+) strand; PAM type: YTN; PAM sequence: TTT
tattagatttggtgtggagg

SEQ ID NO: 263520 - DNA, 20 bp, Artificial Sequence
  Description of Artificial Sequence: Synthetic oligonucleotide
  Target: ATXN1; (+) strand; PAM type: YTN; PAM sequence: TTT
attagatttggtgtggagga

SEQ ID NO: 263521 - DNA, 20 bp, Artificial Sequence
  Description of Artificial Sequence: Synthetic oligonucleotide
  Target: ATXN1; (+) strand; PAM type: YTN; PAM sequence: TTA
ttagatttggtgtggaggaa

SEQ ID NO: 263522 - DNA, 20 bp, Artificial Sequence
  Description of Artificial Sequence: Synthetic oligonucleotide
  Target: ATXN1; (+) strand; PAM type: YTN; PAM sequence: TTA
gatttggtgtggaggaaaag

SEQ ID NO: 263523 - DNA, 20 bp, Artificial Sequence
  Description of Artificial Sequence: Synthetic oligonucleotide
  Target: ATXN1; (+) strand; PAM type: YTN; PAM sequence: TTT
ggtgtggaggaaaagttgac

SEQ ID NO: 263524 - DNA, 20 bp, Artificial Sequence
  Description of Artificial Sequence: Synthetic oligonucleotide
  Target: ATXN1; (+) strand; PAM type: YTN; PAM sequence: TTG
gtgtggaggaaaagttgacg

SEQ ID NO: 263525 - DNA, 20 bp, Artificial Sequence
  Description of Artificial Sequence: Synthetic oligonucleotide
  Target: ATXN1; (+) strand; PAM type: YTN; PAM sequence: TTG
acgtgagaaaataaaaaaac

SEQ ID NO: 263526 - DNA, 20 bp, Artificial Sequence
  Description of Artificial Sequence: Synthetic oligonucleotide
  Target: ATXN1; (+) strand; PAM type: YTN; PAM sequence: CTG
ggttcaaggtctgtttttgg

SEQ ID NO: 263527 - DNA, 20 bp, Artificial Sequence
  Description of Artificial Sequence: Synthetic oligonucleotide
  Target: ATXN1; (+) strand; PAM type: YTN; PAM sequence: TTC
aaggtctgtttttggtgtgt

SEQ ID NO: 263528 - DNA, 20 bp, Artificial Sequence
  Description of Artificial Sequence: Synthetic oligonucleotide
  Target: ATXN1; (+) strand; PAM type: YTN; PAM sequence: CTG
tttttggtgtgtttcacttg

SEQ ID NO: 263529 - DNA, 20 bp, Artificial Sequence
  Description of Artificial Sequence: Synthetic oligonucleotide
  Target: ATXN1; (+) strand; PAM type: YTN; PAM sequence: TTT
ttggtgtgtttcacttgtgt

SEQ ID NO: 263530 - DNA, 20 bp, Artificial Sequence
  Description of Artificial Sequence: Synthetic oligonucleotide
  Target: ATXN1; (+) strand; PAM type: YTN; PAM sequence: TTT
tggtgtgtttcacttgtgta

SEQ ID NO: 263531 - DNA, 20 bp, Artificial Sequence
  Description of Artificial Sequence: Synthetic oligonucleotide
  Target: ATXN1; (+) strand; PAM type: YTN; PAM sequence: TTT
ggtgtgtttcacttgtgtaa

SEQ ID NO: 263532 - DNA, 20 bp, Artificial Sequence
  Description of Artificial Sequence: Synthetic oligonucleotide
  Target: ATXN1; (+) strand; PAM type: YTN; PAM sequence: TTG
gtgtgtttcacttgtgtaat

SEQ ID NO: 263533 - DNA, 20 bp, Artificial Sequence
  Description of Artificial Sequence: Synthetic oligonucleotide
  Target: ATXN1; (+) strand; PAM type: YTN; PAM sequence: TTT
cacttgtgtaatcttacata

SEQ ID NO: 263534 - DNA, 20 bp, Artificial Sequence
  Description of Artificial Sequence: Synthetic oligonucleotide
  Target: ATXN1; (+) strand; PAM type: YTN; PAM sequence: TTC
acttgtgtaatcttacataa

SEQ ID NO: 263535 - DNA, 20 bp, Artificial Sequence
  Description of Artificial Sequence: Synthetic oligonucleotide
  Target: ATXN1; (+) strand; PAM type: YTN; PAM sequence: CTT
gtgtaatcttacataatcat

SEQ ID NO: 263536 - DNA, 20 bp, Artificial Sequence
  Description of Artificial Sequence: Synthetic oligonucleotide
  Target: ATXN1; (+) strand; PAM type: YTN; PAM sequence: TTG
tgtaatcttacataatcatg

SEQ ID NO: 263537 - DNA, 20 bp, Artificial Sequence
  Description of Artificial Sequence: Synthetic oligonucleotide
  Target: ATXN1; (+) strand; PAM type: YTN; PAM sequence: CTT
acataatcatgttacttttc

SEQ ID NO: 263538 - DNA, 20 bp, Artificial Sequence
  Description of Artificial Sequence: Synthetic oligonucleotide
  Target: ATXN1; (+) strand; PAM type: YTN; PAM sequence: TTA
cataatcatgttacttttct

SEQ ID NO: 263539 - DNA, 20 bp, Artificial Sequence
  Description of Artificial Sequence: Synthetic oligonucleotide
  Target: ATXN1; (+) strand; PAM type: YTN; PAM sequence: TTA
cttttctcagcatcagtctc

SEQ ID NO: 263540 - DNA, 20 bp, Artificial Sequence
  Description of Artificial Sequence: Synthetic oligonucleotide
  Target: ATXN1; (+) strand; PAM type: YTN; PAM sequence: CTT
ttctcagcatcagtctcatc

SEQ ID NO: 263541 - DNA, 20 bp, Artificial Sequence
  Description of Artificial Sequence: Synthetic oligonucleotide
  Target: ATXN1; (+) strand; PAM type: YTN; PAM sequence: TTT
tctcagcatcagtctcatca

SEQ ID NO: 263542 - DNA, 20 bp, Artificial Sequence
  Description of Artificial Sequence: Synthetic oligonucleotide
  Target: ATXN1; (+) strand; PAM type: YTN; PAM sequence: TTT
ctcagcatcagtctcatcat

SEQ ID NO: 263543 - DNA, 20 bp, Artificial Sequence
  Description of Artificial Sequence: Synthetic oligonucleotide
  Target: ATXN1; (+) strand; PAM type: YTN; PAM sequence: TTC
tcagcatcagtctcatcatt

SEQ ID NO: 263544 - DNA, 20 bp, Artificial Sequence
  Description of Artificial Sequence: Synthetic oligonucleotide
  Target: ATXN1; (+) strand; PAM type: YTN; PAM sequence: CTC
agcatcagtctcatcattga

SEQ ID NO: 263545 - DNA, 20 bp, Artificial Sequence
  Description of Artificial Sequence: Synthetic oligonucleotide
  Target: ATXN1; (+) strand; PAM type: YTN; PAM sequence: CTC
atcattgatagagggggtac

SEQ ID NO: 263546 - DNA, 20 bp, Artificial Sequence
  Description of Artificial Sequence: Synthetic oligonucleotide
  Target: ATXN1; (+) strand; PAM type: YTN; PAM sequence: TTG
atagagggggtacactctca

SEQ ID NO: 263547 - DNA, 20 bp, Artificial Sequence
  Description of Artificial Sequence: Synthetic oligonucleotide
  Target: ATXN1; (+) strand; PAM type: YTN; PAM sequence: CTC
tcagcactttgggatgccga

SEQ ID NO: 263548 - DNA, 20 bp, Artificial Sequence
  Description of Artificial Sequence: Synthetic oligonucleotide
  Target: ATXN1; (+) strand; PAM type: YTN; PAM sequence: CTC
agcactttgggatgccgagg

SEQ ID NO: 263549 - DNA, 20 bp, Artificial Sequence
  Description of Artificial Sequence: Synthetic oligonucleotide
  Target: ATXN1; (+) strand; PAM type: YTN; PAM sequence: CTT
tgggatgccgaggcgggtgg

SEQ ID NO: 263550 - DNA, 20 bp, Artificial Sequence
  Description of Artificial Sequence: Synthetic oligonucleotide
  Target: ATXN1; (+) strand; PAM type: YTN; PAM sequence: TTT
gggatgccgaggcgggtgga

SEQ ID NO: 263551 - DNA, 20 bp, Artificial Sequence
  Description of Artificial Sequence: Synthetic oligonucleotide
  Target: ATXN1; (+) strand; PAM type: YTN; PAM sequence: TTG
ggatgccgaggcgggtggat

SEQ ID NO: 263552 - DNA, 20 bp, Artificial Sequence
  Description of Artificial Sequence: Synthetic oligonucleotide
  Target: ATXN1; (+) strand; PAM type: YTN; PAM sequence: CTG
gctaacacggtgaaaccccg

SEQ ID NO: 263553 - DNA, 20 bp, Artificial Sequence
  Description of Artificial Sequence: Synthetic oligonucleotide
  Target: ATXN1; (+) strand; PAM type: YTN; PAM sequence: CTA
acacggtgaaaccccgtctc

SEQ ID NO: 263554 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaaat

SEQ ID NO: 263555 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaaatta

SEQ ID NO: 263556 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaaattagct

SEQ ID NO: 263557 - DNA, 20 bp, Artificial Sequence
  Description of Artificial Sequence: Synthetic oligonucleotide
  Target: ATXN1; (+) strand; PAM type: YTN; PAM sequence: TTA
gctgggcgtagtggcaggtg

SEQ ID NO: 263558 - DNA, 20 bp, Artificial Sequence
  Description of Artificial Sequence: Synthetic oligonucleotide
  Target: ATXN1; (+) strand; PAM type: YTN; PAM sequence: CTG
ggcgtagtggcaggtgcctg

SEQ ID NO: 263559 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcaggag

SEQ ID NO: 263560 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 263561 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 263562 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 263563 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcagaggtt

SEQ ID NO: 263564 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcagaggttg

SEQ ID NO: 263565 - DNA, 20 bp, Artificial Sequence
  Description of Artificial Sequence: Synthetic oligonucleotide
  Target: ATXN1; (+) strand; PAM type: YTN; PAM sequence: TTG
aagtgagccaagattgcgcc

SEQ ID NO: 263566 - DNA, 20 bp, Artificial Sequence
  Description of Artificial Sequence: Synthetic oligonucleotide
  Target: ATXN1; (+) strand; PAM type: YTN; PAM sequence: TTG
cgccactgcactccagcctg

SEQ ID NO: 263567 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacag

SEQ ID NO: 263568 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagagtga

SEQ ID NO: 263569 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagtgagactccg

SEQ ID NO: 263570 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaataaaataaa

SEQ ID NO: 263571 - DNA, 20 bp, Artificial Sequence
  Description of Artificial Sequence: Synthetic oligonucleotide
  Target: ATXN1; (+) strand; PAM type: YTN; PAM sequence: CTC
aaaaataaaataaaataaag

SEQ ID NO: 263572 - DNA, 20 bp, Artificial Sequence
  Description of Artificial Sequence: Synthetic oligonucleotide
  Target: ATXN1; (+) strand; PAM type: YTN; PAM sequence: TTG
tctaagaattgctctgagga

SEQ ID NO: 263573 - DNA, 20 bp, Artificial Sequence
  Description of Artificial Sequence: Synthetic oligonucleotide
  Target: ATXN1; (+) strand; PAM type: YTN; PAM sequence: CTA
agaattgctctgaggattac

SEQ ID NO: 263574 - DNA, 20 bp, Artificial Sequence
  Description of Artificial Sequence: Synthetic oligonucleotide
  Target: ATXN1; (+) strand; PAM type: YTN; PAM sequence: TTG
ctctgaggattacatcagtg

SEQ ID NO: 263575 - DNA, 20 bp, Artificial Sequence
  Description of Artificial Sequence: Synthetic oligonucleotide
  Target: ATXN1; (+) strand; PAM type: YTN; PAM sequence: CTC
tgaggattacatcagtgtaa

SEQ ID NO: 263576 - DNA, 20 bp, Artificial Sequence
  Description of Artificial Sequence: Synthetic oligonucleotide
  Target: ATXN1; (+) strand; PAM type: YTN; PAM sequence: CTG
aggattacatcagtgtaagg

SEQ ID NO: 263577 - DNA, 20 bp, Artificial Sequence
  Description of Artificial Sequence: Synthetic oligonucleotide
  Target: ATXN1; (+) strand; PAM type: YTN; PAM sequence: TTA
catcagtgtaaggtaatgaa

SEQ ID NO: 263578 - DNA, 20 bp, Artificial Sequence
  Description of Artificial Sequence: Synthetic oligonucleotide
  Target: ATXN1; (+) strand; PAM type: YTN; PAM sequence: CTT
tactgaaatgtatgcaaaaa

SEQ ID NO: 263579 - DNA, 20 bp, Artificial Sequence
  Description of Artificial Sequence: Synthetic oligonucleotide
  Target: ATXN1; (+) strand; PAM type: YTN; PAM sequence: TTT
actgaaatgtatgcaaaaaa

SEQ ID NO: 263580 - DNA, 20 bp, Artificial Sequence
  Description of Artificial Sequence: Synthetic oligonucleotide
  Target: ATXN1; (+) strand; PAM type: YTN; PAM sequence: TTA
ctgaaatgtatgcaaaaaat

SEQ ID NO: 263581 - DNA, 20 bp, Artificial Sequence
  Description of Artificial Sequence: Synthetic oligonucleotide
  Target: ATXN1; (+) strand; PAM type: YTN; PAM sequence: CTG
aaatgtatgcaaaaaatatc

SEQ ID NO: 263582 - DNA, 20 bp, Artificial Sequence
  Description of Artificial Sequence: Synthetic oligonucleotide
  Target: ATXN1; (+) strand; PAM type: YTN; PAM sequence: CTT
tcattatcattatcatcatc

SEQ ID NO: 263583 - DNA, 20 bp, Artificial Sequence
  Description of Artificial Sequence: Synthetic oligonucleotide
  Target: ATXN1; (+) strand; PAM type: YTN; PAM sequence: TTT
cattatcattatcatcatca

SEQ ID NO: 263584 - DNA, 20 bp, Artificial Sequence
  Description of Artificial Sequence: Synthetic oligonucleotide
  Target: ATXN1; (+) strand; PAM type: YTN; PAM sequence: TTC
attatcattatcatcatcat

SEQ ID NO: 263585 - DNA, 20 bp, Artificial Sequence
  Description of Artificial Sequence: Synthetic oligonucleotide
  Target: ATXN1; (+) strand; PAM type: YTN; PAM sequence: TTA
tcattatcatcatcatcatc

SEQ ID NO: 263586 - DNA, 20 bp, Artificial Sequence
  Description of Artificial Sequence: Synthetic oligonucleotide
  Target: ATXN1; (+) strand; PAM type: YTN; PAM sequence: TTA
tcatcatcatcatcatcttc

SEQ ID NO: 263587 - DNA, 20 bp, Artificial Sequence
  Description of Artificial Sequence: Synthetic oligonucleotide
  Target: ATXN1; (+) strand; PAM type: YTN; PAM sequence: CTT
cacctgatactttaaaaact

SEQ ID NO: 263588 - DNA, 20 bp, Artificial Sequence
  Description of Artificial Sequence: Synthetic oligonucleotide
  Target: ATXN1; (+) strand; PAM type: YTN; PAM sequence: TTC
acctgatactttaaaaactt

SEQ ID NO: 263589 - DNA, 20 bp, Artificial Sequence
  Description of Artificial Sequence: Synthetic oligonucleotide
  Target: ATXN1; (+) strand; PAM type: YTN; PAM sequence: CTG
atactttaaaaacttcaaat

SEQ ID NO: 263590 - DNA, 20 bp, Artificial Sequence
  Description of Artificial Sequence: Synthetic oligonucleotide
  Target: ATXN1; (+) strand; PAM type: YTN; PAM sequence: CTT
taaaaacttcaaatgaaaga

SEQ ID NO: 263591 - DNA, 20 bp, Artificial Sequence
  Description of Artificial Sequence: Synthetic oligonucleotide
  Target: ATXN1; (+) strand; PAM type: YTN; PAM sequence: TTT
aaaaacttcaaatgaaagag

SEQ ID NO: 263592 - DNA, 20 bp, Artificial Sequence
  Description of Artificial Sequence: Synthetic oligonucleotide
  Target: ATXN1; (+) strand; PAM type: YTN; PAM sequence: TTA
aaaacttcaaatgaaagagg

SEQ ID NO: 263593 - DNA, 20 bp, Artificial Sequence
  Description of Artificial Sequence: Synthetic oligonucleotide
  Target: ATXN1; (+) strand; PAM type: YTN; PAM sequence: CTT
caaatgaaagagggtaagaa

SEQ ID NO: 263594 - DNA, 20 bp, Artificial Sequence
  Description of Artificial Sequence: Synthetic oligonucleotide
  Target: ATXN1; (+) strand; PAM type: YTN; PAM sequence: TTC
aaatgaaagagggtaagaaa

SEQ ID NO: 263595 - DNA, 20 bp, Artificial Sequence
  Description of Artificial Sequence: Synthetic oligonucleotide
  Target: ATXN1; (+) strand; PAM type: YTN; PAM sequence: CTG
gatcccctactctgtacctg

SEQ ID NO: 263596 - DNA, 20 bp, Artificial Sequence
  Description of Artificial Sequence: Synthetic oligonucleotide
  Target: ATXN1; (+) strand; PAM type: YTN; PAM sequence: CTA
ctctgtacctggcattgtgc

SEQ ID NO: 263597 - DNA, 20 bp, Artificial Sequence
  Description of Artificial Sequence: Synthetic oligonucleotide
  Target: ATXN1; (+) strand; PAM type: YTN; PAM sequence: CTC
tgtacctggcattgtgctac

SEQ ID NO: 263598 - DNA, 20 bp, Artificial Sequence
  Description of Artificial Sequence: Synthetic oligonucleotide
  Target: ATXN1; (+) strand; PAM type: YTN; PAM sequence: CTG
tacctggcattgtgctacag

SEQ ID NO: 263599 - DNA, 20 bp, Artificial Sequence
  Description of Artificial Sequence: Synthetic oligonucleotide
  Target: ATXN1; (+) strand; PAM type: YTN; PAM sequence: CTG
gcattgtgctacaggttgtg

SEQ ID NO: 263600 - DNA, 20 bp, Artificial Sequence
  Description of Artificial Sequence: Synthetic oligonucleotide
  Target: ATXN1; (+) strand; PAM type: YTN; PAM sequence: TTG
tgctacaggttgtgcatatg

SEQ ID NO: 263601 - DNA, 20 bp, Artificial Sequence
  Description of Artificial Sequence: Synthetic oligonucleotide
  Target: ATXN1; (+) strand; PAM type: YTN; PAM sequence: CTA
caggttgtgcatatgtcact

SEQ ID NO: 263602 - DNA, 20 bp, Artificial Sequence
  Description of Artificial Sequence: Synthetic oligonucleotide
  Target: ATXN1; (+) strand; PAM type: YTN; PAM sequence: TTG
tgcatatgtcacttttaggt

SEQ ID NO: 263603 - DNA, 20 bp, Artificial Sequence
  Description of Artificial Sequence: Synthetic oligonucleotide
  Target: ATXN1; (+) strand; PAM type: YTN; PAM sequence: CTT
ttaggttacaacaacagccc

SEQ ID NO: 263604 - DNA, 20 bp, Artificial Sequence
  Description of Artificial Sequence: Synthetic oligonucleotide
  Target: ATXN1; (+) strand; PAM type: YTN; PAM sequence: TTT
taggttacaacaacagccca

SEQ ID NO: 263605 - DNA, 20 bp, Artificial Sequence
  Description of Artificial Sequence: Synthetic oligonucleotide
  Target: ATXN1; (+) strand; PAM type: YTN; PAM sequence: TTT
aggttacaacaacagcccaa

SEQ ID NO: 263606 - DNA, 20 bp, Artificial Sequence
  Description of Artificial Sequence: Synthetic oligonucleotide
  Target: ATXN1; (+) strand; PAM type: YTN; PAM sequence: TTA
ggttacaacaacagcccaac

SEQ ID NO: 263607 - DNA, 20 bp, Artificial Sequence
  Description of Artificial Sequence: Synthetic oligonucleotide
  Target: ATXN1; (+) strand; PAM type: YTN; PAM sequence: TTA
caacaacagcccaactgtct

SEQ ID NO: 263608 - DNA, 20 bp, Artificial Sequence
  Description of Artificial Sequence: Synthetic oligonucleotide
  Target: ATXN1; (+) strand; PAM type: YTN; PAM sequence: CTG
tctacacataaatttatatc

SEQ ID NO: 263609 - DNA, 20 bp, Artificial Sequence
  Description of Artificial Sequence: Synthetic oligonucleotide
  Target: ATXN1; (+) strand; PAM type: YTN; PAM sequence: CTA
cacataaatttatatctgct

SEQ ID NO: 263610 - DNA, 20 bp, Artificial Sequence
  Description of Artificial Sequence: Synthetic oligonucleotide
  Target: ATXN1; (+) strand; PAM type: YTN; PAM sequence: TTT
atatctgctgtataggaata

SEQ ID NO: 263611 - DNA, 20 bp, Artificial Sequence
  Description of Artificial Sequence: Synthetic oligonucleotide
  Target: ATXN1; (+) strand; PAM type: YTN; PAM sequence: TTA
tatctgctgtataggaataa

SEQ ID NO: 263612 - DNA, 20 bp, Artificial Sequence
  Description of Artificial Sequence: Synthetic oligonucleotide
  Target: ATXN1; (+) strand; PAM type: YTN; PAM sequence: CTG
ctgtataggaataaactata

SEQ ID NO: 263613 - DNA, 20 bp, Artificial Sequence
  Description of Artificial Sequence: Synthetic oligonucleotide
  Target: ATXN1; (+) strand; PAM type: YTN; PAM sequence: CTG
tataggaataaactatattt

SEQ ID NO: 263614 - DNA, 20 bp, Artificial Sequence
  Description of Artificial Sequence: Synthetic oligonucleotide
  Target: ATXN1; (+) strand; PAM type: YTN; PAM sequence: CTA
tatttctaattctggaaaat

SEQ ID NO: 263615 - DNA, 20 bp, Artificial Sequence
  Description of Artificial Sequence: Synthetic oligonucleotide
  Target: ATXN1; (+) strand; PAM type: YTN; PAM sequence: TTT
ctaattctggaaaatgaggt

SEQ ID NO: 263616 - DNA, 20 bp, Artificial Sequence
  Description of Artificial Sequence: Synthetic oligonucleotide
  Target: ATXN1; (+) strand; PAM type: YTN; PAM sequence: TTC
taattctggaaaatgaggtg

SEQ ID NO: 263617 - DNA, 20 bp, Artificial Sequence
  Description of Artificial Sequence: Synthetic oligonucleotide
  Target: ATXN1; (+) strand; PAM type: YTN; PAM sequence: CTA
attctggaaaatgaggtgca

SEQ ID NO: 263618 - DNA, 20 bp, Artificial Sequence
  Description of Artificial Sequence: Synthetic oligonucleotide
  Target: ATXN1; (+) strand; PAM type: YTN; PAM sequence: TTC
tggaaaatgaggtgcagaga

SEQ ID NO: 263619 - DNA, 20 bp, Artificial Sequence
  Description of Artificial Sequence: Synthetic oligonucleotide
  Target: ATXN1; (+) strand; PAM type: YTN; PAM sequence: CTG
gaaaatgaggtgcagagagg

SEQ ID NO: 263620 - DNA, 20 bp, Artificial Sequence
  Description of Artificial Sequence: Synthetic oligonucleotide
  Target: ATXN1; (+) strand; PAM type: YTN; PAM sequence: TTA
agtaacatgcttgaattcaa

SEQ ID NO: 263621 - DNA, 20 bp, Artificial Sequence
  Description of Artificial Sequence: Synthetic oligonucleotide
  Target: ATXN1; (+) strand; PAM type: YTN; PAM sequence: CTT
gaattcaagtatgcttcaat

SEQ ID NO: 263622 - DNA, 20 bp, Artificial Sequence
  Description of Artificial Sequence: Synthetic oligonucleotide
  Target: ATXN1; (+) strand; PAM type: YTN; PAM sequence: TTG
aattcaagtatgcttcaata

SEQ ID NO: 263623 - DNA, 20 bp, Artificial Sequence
  Description of Artificial Sequence: Synthetic oligonucleotide
  Target: ATXN1; (+) strand; PAM type: YTN; PAM sequence: TTC
aagtatgcttcaataattaa

SEQ ID NO: 263624 - DNA, 20 bp, Artificial Sequence
  Description of Artificial Sequence: Synthetic oligonucleotide
  Target: ATXN1; (+) strand; PAM type: YTN; PAM sequence: CTT
caataattaaatcgaagctg

SEQ ID NO: 263625 - DNA, 20 bp, Artificial Sequence
  Description of Artificial Sequence: Synthetic oligonucleotide
  Target: ATXN1; (+) strand; PAM type: YTN; PAM sequence: TTC
aataattaaatcgaagctgg

SEQ ID NO: 263626 - DNA, 20 bp, Artificial Sequence
  Description of Artificial Sequence: Synthetic oligonucleotide
  Target: ATXN1; (+) strand; PAM type: YTN; PAM sequence: TTA
aatcgaagctgggcgagatg

SEQ ID NO: 263627 - DNA, 20 bp, Artificial Sequence
  Description of Artificial Sequence: Synthetic oligonucleotide
  Target: ATXN1; (+) strand; PAM type: YTN; PAM sequence: CTG
ggcgagatggctcacacttg

SEQ ID NO: 263628 - DNA, 20 bp, Artificial Sequence
  Description of Artificial Sequence: Synthetic oligonucleotide
  Target: ATXN1; (+) strand; PAM type: YTN; PAM sequence: CTC
acacttgtaatcccagcact

SEQ ID NO: 263629 - DNA, 20 bp, Artificial Sequence
  Description of Artificial Sequence: Synthetic oligonucleotide
  Target: ATXN1; (+) strand; PAM type: YTN; PAM sequence: CTT
gtaatcccagcactttggga

SEQ ID NO: 263630 - DNA, 20 bp, Artificial Sequence
  Description of Artificial Sequence: Synthetic oligonucleotide
  Target: ATXN1; (+) strand; PAM type: YTN; PAM sequence: TTG
taatcccagcactttgggag

SEQ ID NO: 263631 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgagtcaggcgg

SEQ ID NO: 263632 - DNA, 20 bp, Artificial Sequence
  Description of Artificial Sequence: Synthetic oligonucleotide
  Target: ATXN1; (+) strand; PAM type: YTN; PAM sequence: TTT
gggaggctgagtcaggcgga

SEQ ID NO: 263633 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagtcaggcggat

SEQ ID NO: 263634 - DNA, 20 bp, Artificial Sequence
  Description of Artificial Sequence: Synthetic oligonucleotide
  Target: ATXN1; (+) strand; PAM type: YTN; PAM sequence: CTG
agtcaggcggatcacttgag

SEQ ID NO: 263635 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcaagacc

SEQ ID NO: 263636 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacca

SEQ ID NO: 263637 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacat

SEQ ID NO: 263638 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcaaaaccccg

SEQ ID NO: 263639 - DNA, 20 bp, Artificial Sequence
  Description of Artificial Sequence: Synthetic oligonucleotide
  Target: ATXN1; (+) strand; PAM type: YTN; PAM sequence: CTC
tactaaaactacaaaaaagg

SEQ ID NO: 263640 - DNA, 20 bp, Artificial Sequence
  Description of Artificial Sequence: Synthetic oligonucleotide
  Target: ATXN1; (+) strand; PAM type: YTN; PAM sequence: CTA
ctaaaactacaaaaaaggtt

SEQ ID NO: 263641 - DNA, 20 bp, Artificial Sequence
  Description of Artificial Sequence: Synthetic oligonucleotide
  Target: ATXN1; (+) strand; PAM type: YTN; PAM sequence: CTA
aaactacaaaaaaggttagc

SEQ ID NO: 263642 - DNA, 20 bp, Artificial Sequence
  Description of Artificial Sequence: Synthetic oligonucleotide
  Target: ATXN1; (+) strand; PAM type: YTN; PAM sequence: CTA
caaaaaaggttagccaggca

SEQ ID NO: 263643 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggcacgtg

SEQ ID NO: 263644 - DNA, 20 bp, Artificial Sequence
  Description of Artificial Sequence: Synthetic oligonucleotide
  Target: ATXN1; (+) strand; PAM type: YTN; PAM sequence: CTG
taattccagctactcagaca

SEQ ID NO: 263645 - DNA, 20 bp, Artificial Sequence
  Description of Artificial Sequence: Synthetic oligonucleotide
  Target: ATXN1; (+) strand; PAM type: YTN; PAM sequence: TTC
cagctactcagacaatcgct

SEQ ID NO: 263646 - DNA, 20 bp, Artificial Sequence
  Description of Artificial Sequence: Synthetic oligonucleotide
  Target: ATXN1; (+) strand; PAM type: YTN; PAM sequence: CTA
ctcagacaatcgcttgaacc

SEQ ID NO: 263647 - DNA, 20 bp, Artificial Sequence
  Description of Artificial Sequence: Synthetic oligonucleotide
  Target: ATXN1; (+) strand; PAM type: YTN; PAM sequence: CTC
agacaatcgcttgaacccag

SEQ ID NO: 263648 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaagtggaggtt

SEQ ID NO: 263649 - DNA, 20 bp, Artificial Sequence
  Description of Artificial Sequence: Synthetic oligonucleotide
  Target: ATXN1; (+) strand; PAM type: YTN; PAM sequence: TTG
aacccaggaagtggaggttg

SEQ ID NO: 263650 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatggctgg

SEQ ID NO: 263651 - DNA, 20 bp, Artificial Sequence
  Description of Artificial Sequence: Synthetic oligonucleotide
  Target: ATXN1; (+) strand; PAM type: YTN; PAM sequence: CTG
agatggctggactccagcct

SEQ ID NO: 263652 - DNA, 20 bp, Artificial Sequence
  Description of Artificial Sequence: Synthetic oligonucleotide
  Target: ATXN1; (+) strand; PAM type: YTN; PAM sequence: CTG
gactccagcctgggcaataa

SEQ ID NO: 263653 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaataagagcg

SEQ ID NO: 263654 - DNA, 20 bp, Artificial Sequence
  Description of Artificial Sequence: Synthetic oligonucleotide
  Target: ATXN1; (+) strand; PAM type: YTN; PAM sequence: CTG
ggcaataagagcgagactct

SEQ ID NO: 263655 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 263656 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 263657 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 263658 - DNA, 20 bp, Artificial Sequence
  Description of Artificial Sequence: Synthetic oligonucleotide
  Target: ATXN1; (+) strand; PAM type: YTN; PAM sequence: TTA
gatcgataaatatttactga

SEQ ID NO: 263659 - DNA, 20 bp, Artificial Sequence
  Description of Artificial Sequence: Synthetic oligonucleotide
  Target: ATXN1; (+) strand; PAM type: YTN; PAM sequence: TTT
actgagtgcttacagtgtgc

SEQ ID NO: 263660 - DNA, 20 bp, Artificial Sequence
  Description of Artificial Sequence: Synthetic oligonucleotide
  Target: ATXN1; (+) strand; PAM type: YTN; PAM sequence: TTA
ctgagtgcttacagtgtgcc

SEQ ID NO: 263661 - DNA, 20 bp, Artificial Sequence
  Description of Artificial Sequence: Synthetic oligonucleotide
  Target: ATXN1; (+) strand; PAM type: YTN; PAM sequence: CTG
agtgcttacagtgtgccaag

SEQ ID NO: 263662 - DNA, 20 bp, Artificial Sequence
  Description of Artificial Sequence: Synthetic oligonucleotide
  Target: ATXN1; (+) strand; PAM type: YTN; PAM sequence: CTT
acagtgtgccaagtactgat

SEQ ID NO: 263663 - DNA, 20 bp, Artificial Sequence
  Description of Artificial Sequence: Synthetic oligonucleotide
  Target: ATXN1; (+) strand; PAM type: YTN; PAM sequence: TTA
cagtgtgccaagtactgatt

SEQ ID NO: 263664 - DNA, 20 bp, Artificial Sequence
  Description of Artificial Sequence: Synthetic oligonucleotide
  Target: ATXN1; (+) strand; PAM type: YTN; PAM sequence: CTG
atttaggtacagggatagag

SEQ ID NO: 263665 - DNA, 20 bp, Artificial Sequence
  Description of Artificial Sequence: Synthetic oligonucleotide
  Target: ATXN1; (+) strand; PAM type: YTN; PAM sequence: TTT
aggtacagggatagagcagt

SEQ ID NO: 263666 - DNA, 20 bp, Artificial Sequence
  Description of Artificial Sequence: Synthetic oligonucleotide
  Target: ATXN1; (+) strand; PAM type: YTN; PAM sequence: TTA
ggtacagggatagagcagtg

SEQ ID NO: 263667 - DNA, 20 bp, Artificial Sequence
  Description of Artificial Sequence: Synthetic oligonucleotide
  Target: ATXN1; (+) strand; PAM type: YTN; PAM sequence: CTG
agcagacaaaatccctgcca

SEQ ID NO: 263668 - DNA, 20 bp, Artificial Sequence
  Description of Artificial Sequence: Synthetic oligonucleotide
  Target: ATXN1; (+) strand; PAM type: YTN; PAM sequence: CTG
ccatcagagagctgaccagg

SEQ ID NO: 263669 - DNA, 20 bp, Artificial Sequence
  Description of Artificial Sequence: Synthetic oligonucleotide
  Target: ATXN1; (+) strand; PAM type: YTN; PAM sequence: CTG
accaggaactgaattcttct

SEQ ID NO: 263670 - DNA, 20 bp, Artificial Sequence
  Description of Artificial Sequence: Synthetic oligonucleotide
  Target: ATXN1; (+) strand; PAM type: YTN; PAM sequence: CTG
aattcttctgaattcaaaat

SEQ ID NO: 263671 - DNA, 20 bp, Artificial Sequence
  Description of Artificial Sequence: Synthetic oligonucleotide
  Target: ATXN1; (+) strand; PAM type: YTN; PAM sequence: TTC
ttctgaattcaaaatcattg

SEQ ID NO: 263672 - DNA, 20 bp, Artificial Sequence
  Description of Artificial Sequence: Synthetic oligonucleotide
  Target: ATXN1; (+) strand; PAM type: YTN; PAM sequence: CTT
ctgaattcaaaatcattgtt

SEQ ID NO: 263673 - DNA, 20 bp, Artificial Sequence
  Description of Artificial Sequence: Synthetic oligonucleotide
  Target: ATXN1; (+) strand; PAM type: YTN; PAM sequence: TTC
tgaattcaaaatcattgttt

SEQ ID NO: 263674 - DNA, 20 bp, Artificial Sequence
  Description of Artificial Sequence: Synthetic oligonucleotide
  Target: ATXN1; (+) strand; PAM type: YTN; PAM sequence: CTG
aattcaaaatcattgttttc

SEQ ID NO: 263675 - DNA, 20 bp, Artificial Sequence
  Description of Artificial Sequence: Synthetic oligonucleotide
  Target: ATXN1; (+) strand; PAM type: YTN; PAM sequence: TTC
aaaatcattgttttccccac

SEQ ID NO: 263676 - DNA, 20 bp, Artificial Sequence
  Description of Artificial Sequence: Synthetic oligonucleotide
  Target: ATXN1; (+) strand; PAM type: YTN; PAM sequence: TTG
ttttccccactccatattgt

SEQ ID NO: 263677 - DNA, 20 bp, Artificial Sequence
  Description of Artificial Sequence: Synthetic oligonucleotide
  Target: ATXN1; (+) strand; PAM type: YTN; PAM sequence: TTT
tccccactccatattgtgcc

SEQ ID NO: 263678 - DNA, 20 bp, Artificial Sequence
  Description of Artificial Sequence: Synthetic oligonucleotide
  Target: ATXN1; (+) strand; PAM type: YTN; PAM sequence: TTT
ccccactccatattgtgcca

SEQ ID NO: 263679 - DNA, 20 bp, Artificial Sequence
  Description of Artificial Sequence: Synthetic oligonucleotide
  Target: ATXN1; (+) strand; PAM type: YTN; PAM sequence: TTC
cccactccatattgtgccag

SEQ ID NO: 263680 - DNA, 20 bp, Artificial Sequence
  Description of Artificial Sequence: Synthetic oligonucleotide
  Target: ATXN1; (+) strand; PAM type: YTN; PAM sequence: CTC
catattgtgccagtgcttgg

SEQ ID NO: 263681 - DNA, 20 bp, Artificial Sequence
  Description of Artificial Sequence: Synthetic oligonucleotide
  Target: ATXN1; (+) strand; PAM type: YTN; PAM sequence: TTG
tgccagtgcttggggcttgc

SEQ ID NO: 263682 - DNA, 20 bp, Artificial Sequence
  Description of Artificial Sequence: Synthetic oligonucleotide
  Target: ATXN1; (+) strand; PAM type: YTN; PAM sequence: CTT
ggggcttgcacttgctctct

SEQ ID NO: 263683 - DNA, 20 bp, Artificial Sequence
  Description of Artificial Sequence: Synthetic oligonucleotide
  Target: ATXN1; (+) strand; PAM type: YTN; PAM sequence: TTG
gggcttgcacttgctctctc

SEQ ID NO: 263684 - DNA, 20 bp, Artificial Sequence
  Description of Artificial Sequence: Synthetic oligonucleotide
  Target: ATXN1; (+) strand; PAM type: YTN; PAM sequence: CTT
gcacttgctctctctaaagg

SEQ ID NO: 263685 - DNA, 20 bp, Artificial Sequence
  Description of Artificial Sequence: Synthetic oligonucleotide
  Target: ATXN1; (+) strand; PAM type: YTN; PAM sequence: TTG
cacttgctctctctaaagga

SEQ ID NO: 263686 - DNA, 20 bp, Artificial Sequence
  Description of Artificial Sequence: Synthetic oligonucleotide
  Target: ATXN1; (+) strand; PAM type: YTN; PAM sequence: CTT
gctctctctaaaggaactac

SEQ ID NO: 263687 - DNA, 20 bp, Artificial Sequence
  Description of Artificial Sequence: Synthetic oligonucleotide
  Target: ATXN1; (+) strand; PAM type: YTN; PAM sequence: TTG
ctctctctaaaggaactact

SEQ ID NO: 263688 - DNA, 20 bp, Artificial Sequence
  Description of Artificial Sequence: Synthetic oligonucleotide
  Target: ATXN1; (+) strand; PAM type: YTN; PAM sequence: CTC
tctctaaaggaactacttgt

SEQ ID NO: 263689 - DNA, 20 bp, Artificial Sequence
  Description of Artificial Sequence: Synthetic oligonucleotide
  Target: ATXN1; (+) strand; PAM type: YTN; PAM sequence: CTC
tctaaaggaactacttgtat

SEQ ID NO: 263690 - DNA, 20 bp, Artificial Sequence
  Description of Artificial Sequence: Synthetic oligonucleotide
  Target: ATXN1; (+) strand; PAM type: YTN; PAM sequence: CTC
taaaggaactacttgtatag

SEQ ID NO: 263691 - DNA, 20 bp, Artificial Sequence
  Description of Artificial Sequence: Synthetic oligonucleotide
  Target: ATXN1; (+) strand; PAM type: YTN; PAM sequence: CTA
aaggaactacttgtatagaa

SEQ ID NO: 263692 - DNA, 20 bp, Artificial Sequence
  Description of Artificial Sequence: Synthetic oligonucleotide
  Target: ATXN1; (+) strand; PAM type: YTN; PAM sequence: CTA
cttgtatagaaaataacatc

SEQ ID NO: 263693 - DNA, 20 bp, Artificial Sequence
  Description of Artificial Sequence: Synthetic oligonucleotide
  Target: ATXN1; (+) strand; PAM type: YTN; PAM sequence: CTT
gtatagaaaataacatctgg

SEQ ID NO: 263694 - DNA, 20 bp, Artificial Sequence
  Description of Artificial Sequence: Synthetic oligonucleotide
  Target: ATXN1; (+) strand; PAM type: YTN; PAM sequence: TTG
tatagaaaataacatctggg

SEQ ID NO: 263695 - DNA, 20 bp, Artificial Sequence
  Description of Artificial Sequence: Synthetic oligonucleotide
  Target: ATXN1; (+) strand; PAM type: YTN; PAM sequence: CTG
ggcagcagcataattgcata

SEQ ID NO: 263696 - DNA, 20 bp, Artificial Sequence
  Description of Artificial Sequence: Synthetic oligonucleotide
  Target: ATXN1; (+) strand; PAM type: YTN; PAM sequence: TTG
cataaatggttaaccccccc

SEQ ID NO: 263697 - DNA, 20 bp, Artificial Sequence
  Description of Artificial Sequence: Synthetic oligonucleotide
  Target: ATXN1; (+) strand; PAM type: YTN; PAM sequence: TTA
accccccctgctaggggctc

SEQ ID NO: 263698 - DNA, 20 bp, Artificial Sequence
  Description of Artificial Sequence: Synthetic oligonucleotide
  Target: ATXN1; (+) strand; PAM type: YTN; PAM sequence: CTG
ctaggggctctgtagcctca

SEQ ID NO: 263699 - DNA, 20 bp, Artificial Sequence
  Description of Artificial Sequence: Synthetic oligonucleotide
  Target: ATXN1; (+) strand; PAM type: YTN; PAM sequence: CTA
ggggctctgtagcctcaggg

SEQ ID NO: 263700 - DNA, 20 bp, Artificial Sequence
  Description of Artificial Sequence: Synthetic oligonucleotide
  Target: ATXN1; (+) strand; PAM type: YTN; PAM sequence: CTC
tgtagcctcaggggtcaagg

SEQ ID NO: 263701 - DNA, 20 bp, Artificial Sequence
  Description of Artificial Sequence: Synthetic oligonucleotide
  Target: ATXN1; (+) strand; PAM type: YTN; PAM sequence: CTG
tagcctcaggggtcaaggct

SEQ ID NO: 263702 - DNA, 20 bp, Artificial Sequence
  Description of Artificial Sequence: Synthetic oligonucleotide
  Target: ATXN1; (+) strand; PAM type: YTN; PAM sequence: CTC
aggggtcaaggctgcctgag

SEQ ID NO: 263703 - DNA, 20 bp, Artificial Sequence
  Description of Artificial Sequence: Synthetic oligonucleotide
  Target: ATXN1; (+) strand; PAM type: YTN; PAM sequence: CTG
cctgagggctgaggcaatcc

SEQ ID NO: 263704 - DNA, 20 bp, Artificial Sequence
  Description of Artificial Sequence: Synthetic oligonucleotide
  Target: ATXN1; (+) strand; PAM type: YTN; PAM sequence: CTG
agggctgaggcaatccatac

SEQ ID NO: 263705 - DNA, 20 bp, Artificial Sequence
  Description of Artificial Sequence: Synthetic oligonucleotide
  Target: ATXN1; (+) strand; PAM type: YTN; PAM sequence: CTG
aggcaatccatacttggata

SEQ ID NO: 263706 - DNA, 20 bp, Artificial Sequence
  Description of Artificial Sequence: Synthetic oligonucleotide
  Target: ATXN1; (+) strand; PAM type: YTN; PAM sequence: CTT
ggatatacctgtagcccatt

SEQ ID NO: 263707 - DNA, 20 bp, Artificial Sequence
  Description of Artificial Sequence: Synthetic oligonucleotide
  Target: ATXN1; (+) strand; PAM type: YTN; PAM sequence: TTG
gatatacctgtagcccattt

SEQ ID NO: 263708 - DNA, 20 bp, Artificial Sequence
  Description of Artificial Sequence: Synthetic oligonucleotide
  Target: ATXN1; (+) strand; PAM type: YTN; PAM sequence: CTG
tagcccatttgtaacaaact

SEQ ID NO: 263709 - DNA, 20 bp, Artificial Sequence
  Description of Artificial Sequence: Synthetic oligonucleotide
  Target: ATXN1; (+) strand; PAM type: YTN; PAM sequence: TTT
gtaacaaactggcttgagaa

SEQ ID NO: 263710 - DNA, 20 bp, Artificial Sequence
  Description of Artificial Sequence: Synthetic oligonucleotide
  Target: ATXN1; (+) strand; PAM type: YTN; PAM sequence: TTG
taacaaactggcttgagaag

SEQ ID NO: 263711 - DNA, 20 bp, Artificial Sequence
  Description of Artificial Sequence: Synthetic oligonucleotide
  Target: ATXN1; (+) strand; PAM type: YTN; PAM sequence: CTG
gcttgagaagctgcattatc

SEQ ID NO: 263712 - DNA, 20 bp, Artificial Sequence
  Description of Artificial Sequence: Synthetic oligonucleotide
  Target: ATXN1; (+) strand; PAM type: YTN; PAM sequence: CTT
gagaagctgcattatctaca

SEQ ID NO: 263713 - DNA, 20 bp, Artificial Sequence
  Description of Artificial Sequence: Synthetic oligonucleotide
  Target: ATXN1; (+) strand; PAM type: YTN; PAM sequence: TTG
agaagctgcattatctacag

SEQ ID NO: 263714 - DNA, 20 bp, Artificial Sequence
  Description of Artificial Sequence: Synthetic oligonucleotide
  Target: ATXN1; (+) strand; PAM type: YTN; PAM sequence: CTG
cattatctacagtgtagcca

SEQ ID NO: 263715 - DNA, 20 bp, Artificial Sequence
  Description of Artificial Sequence: Synthetic oligonucleotide
  Target: ATXN1; (+) strand; PAM type: YTN; PAM sequence: TTA
tctacagtgtagccaatgat

SEQ ID NO: 263716 - DNA, 20 bp, Artificial Sequence
  Description of Artificial Sequence: Synthetic oligonucleotide
  Target: ATXN1; (+) strand; PAM type: YTN; PAM sequence: CTA
cagtgtagccaatgattcag

SEQ ID NO: 263717 - DNA, 20 bp, Artificial Sequence
  Description of Artificial Sequence: Synthetic oligonucleotide
  Target: ATXN1; (+) strand; PAM type: YTN; PAM sequence: TTC
aggaatatccctaatttgta

SEQ ID NO: 263718 - DNA, 20 bp, Artificial Sequence
  Description of Artificial Sequence: Synthetic oligonucleotide
  Target: ATXN1; (+) strand; PAM type: YTN; PAM sequence: CTA
atttgtactgatttcctccc

SEQ ID NO: 263719 - DNA, 20 bp, Artificial Sequence
  Description of Artificial Sequence: Synthetic oligonucleotide
  Target: ATXN1; (+) strand; PAM type: YTN; PAM sequence: TTT
gtactgatttcctcccatgt

SEQ ID NO: 263720 - DNA, 20 bp, Artificial Sequence
  Description of Artificial Sequence: Synthetic oligonucleotide
  Target: ATXN1; (+) strand; PAM type: YTN; PAM sequence: TTG
tactgatttcctcccatgtt

SEQ ID NO: 263721 - DNA, 20 bp, Artificial Sequence
  Description of Artificial Sequence: Synthetic oligonucleotide
  Target: ATXN1; (+) strand; PAM type: YTN; PAM sequence: CTG
atttcctcccatgttaatta

SEQ ID NO: 263722 - DNA, 20 bp, Artificial Sequence
  Description of Artificial Sequence: Synthetic oligonucleotide
  Target: ATXN1; (+) strand; PAM type: YTN; PAM sequence: TTT
cctcccatgttaattattat

SEQ ID NO: 263723 - DNA, 20 bp, Artificial Sequence
  Description of Artificial Sequence: Synthetic oligonucleotide
  Target: ATXN1; (+) strand; PAM type: YTN; PAM sequence: TTC
ctcccatgttaattattatt

SEQ ID NO: 263724 - DNA, 20 bp, Artificial Sequence
  Description of Artificial Sequence: Synthetic oligonucleotide
  Target: ATXN1; (+) strand; PAM type: YTN; PAM sequence: CTC
ccatgttaattattattgct

SEQ ID NO: 263725 - DNA, 20 bp, Artificial Sequence
  Description of Artificial Sequence: Synthetic oligonucleotide
  Target: ATXN1; (+) strand; PAM type: YTN; PAM sequence: TTA
attattattgctacacagta

SEQ ID NO: 263726 - DNA, 20 bp, Artificial Sequence
  Description of Artificial Sequence: Synthetic oligonucleotide
  Target: ATXN1; (+) strand; PAM type: YTN; PAM sequence: TTA
ttattgctacacagtacatg

SEQ ID NO: 263727 - DNA, 20 bp, Artificial Sequence
  Description of Artificial Sequence: Synthetic oligonucleotide
  Target: ATXN1; (+) strand; PAM type: YTN; PAM sequence: TTA
ttgctacacagtacatgtaa

SEQ ID NO: 263728 - DNA, 20 bp, Artificial Sequence
  Description of Artificial Sequence: Synthetic oligonucleotide
  Target: ATXN1; (+) strand; PAM type: YTN; PAM sequence: TTG
ctacacagtacatgtaattg

SEQ ID NO: 263729 - DNA, 20 bp, Artificial Sequence
  Description of Artificial Sequence: Synthetic oligonucleotide
  Target: ATXN1; (+) strand; PAM type: YTN; PAM sequence: CTA
cacagtacatgtaattgtat

SEQ ID NO: 263730 - DNA, 20 bp, Artificial Sequence
  Description of Artificial Sequence: Synthetic oligonucleotide
  Target: ATXN1; (+) strand; PAM type: YTN; PAM sequence: TTG
tattatacagagactggaac

SEQ ID NO: 263731 - DNA, 20 bp, Artificial Sequence
  Description of Artificial Sequence: Synthetic oligonucleotide
  Target: ATXN1; (+) strand; PAM type: YTN; PAM sequence: TTA
tacagagactggaacagact

SEQ ID NO: 263732 - DNA, 20 bp, Artificial Sequence
  Description of Artificial Sequence: Synthetic oligonucleotide
  Target: ATXN1; (+) strand; PAM type: YTN; PAM sequence: CTG
gaacagactttccactctct

SEQ ID NO: 263733 - DNA, 20 bp, Artificial Sequence
  Description of Artificial Sequence: Synthetic oligonucleotide
  Target: ATXN1; (+) strand; PAM type: YTN; PAM sequence: CTT
tccactctcttactgccata

SEQ ID NO: 263734 - DNA, 20 bp, Artificial Sequence
  Description of Artificial Sequence: Synthetic oligonucleotide
  Target: ATXN1; (+) strand; PAM type: YTN; PAM sequence: TTT
ccactctcttactgccatag

SEQ ID NO: 263735 - DNA, 20 bp, Artificial Sequence
  Description of Artificial Sequence: Synthetic oligonucleotide
  Target: ATXN1; (+) strand; PAM type: YTN; PAM sequence: TTC
cactctcttactgccataga

SEQ ID NO: 263736 - DNA, 20 bp, Artificial Sequence
  Description of Artificial Sequence: Synthetic oligonucleotide
  Target: ATXN1; (+) strand; PAM type: YTN; PAM sequence: CTC
tcttactgccatagacttag

SEQ ID NO: 263737 - DNA, 20 bp, Artificial Sequence
  Description of Artificial Sequence: Synthetic oligonucleotide
  Target: ATXN1; (+) strand; PAM type: YTN; PAM sequence: CTC
ttactgccatagacttagtg

SEQ ID NO: 263738 - DNA, 20 bp, Artificial Sequence
  Description of Artificial Sequence: Synthetic oligonucleotide
  Target: ATXN1; (+) strand; PAM type: YTN; PAM sequence: CTT
actgccatagacttagtgct

SEQ ID NO: 263739 - DNA, 20 bp, Artificial Sequence
  Description of Artificial Sequence: Synthetic oligonucleotide
  Target: ATXN1; (+) strand; PAM type: YTN; PAM sequence: TTA
ctgccatagacttagtgctt

SEQ ID NO: 263740 - DNA, 20 bp, Artificial Sequence
  Description of Artificial Sequence: Synthetic oligonucleotide
  Target: ATXN1; (+) strand; PAM type: YTN; PAM sequence: CTG
ccatagacttagtgcttttg

SEQ ID NO: 263741 - DNA, 20 bp, Artificial Sequence
  Description of Artificial Sequence: Synthetic oligonucleotide
  Target: ATXN1; (+) strand; PAM type: YTN; PAM sequence: CTT
agtgcttttggcaggtcagc

SEQ ID NO: 263742 - DNA, 20 bp, Artificial Sequence
  Description of Artificial Sequence: Synthetic oligonucleotide
  Target: ATXN1; (+) strand; PAM type: YTN; PAM sequence: TTA
gtgcttttggcaggtcagca

SEQ ID NO: 263743 - DNA, 20 bp, Artificial Sequence
  Description of Artificial Sequence: Synthetic oligonucleotide
  Target: ATXN1; (+) strand; PAM type: YTN; PAM sequence: CTT
ttggcaggtcagcaagatga

SEQ ID NO: 263744 - DNA, 20 bp, Artificial Sequence
  Description of Artificial Sequence: Synthetic oligonucleotide
  Target: ATXN1; (+) strand; PAM type: YTN; PAM sequence: TTT
tggcaggtcagcaagatgag

SEQ ID NO: 263745 - DNA, 20 bp, Artificial Sequence
  Description of Artificial Sequence: Synthetic oligonucleotide
  Target: ATXN1; (+) strand; PAM type: YTN; PAM sequence: TTT
ggcaggtcagcaagatgagg

SEQ ID NO: 263746 - DNA, 20 bp, Artificial Sequence
  Description of Artificial Sequence: Synthetic oligonucleotide
  Target: ATXN1; (+) strand; PAM type: YTN; PAM sequence: TTG
gcaggtcagcaagatgaggt

SEQ ID NO: 263747 - DNA, 20 bp, Artificial Sequence
  Description of Artificial Sequence: Synthetic oligonucleotide
  Target: ATXN1; (+) strand; PAM type: YTN; PAM sequence: CTT
tgtagtcagcagacaaaact

SEQ ID NO: 263748 - DNA, 20 bp, Artificial Sequence
  Description of Artificial Sequence: Synthetic oligonucleotide
  Target: ATXN1; (+) strand; PAM type: YTN; PAM sequence: TTT
gtagtcagcagacaaaacta

SEQ ID NO: 263749 - DNA, 20 bp, Artificial Sequence
  Description of Artificial Sequence: Synthetic oligonucleotide
  Target: ATXN1; (+) strand; PAM type: YTN; PAM sequence: TTG
tagtcagcagacaaaactaa

SEQ ID NO: 263750 - DNA, 20 bp, Artificial Sequence
  Description of Artificial Sequence: Synthetic oligonucleotide
  Target: ATXN1; (+) strand; PAM type: YTN; PAM sequence: CTA
aacagccatcagaaacattt

SEQ ID NO: 263751 - DNA, 20 bp, Artificial Sequence
  Description of Artificial Sequence: Synthetic oligonucleotide
  Target: ATXN1; (+) strand; PAM type: YTN; PAM sequence: TTT
ttaaaatatgctattaaatt

SEQ ID NO: 263752 - DNA, 20 bp, Artificial Sequence
  Description of Artificial Sequence: Synthetic oligonucleotide
  Target: ATXN1; (+) strand; PAM type: YTN; PAM sequence: TTT
taaaatatgctattaaatta

SEQ ID NO: 263753 - DNA, 20 bp, Artificial Sequence
  Description of Artificial Sequence: Synthetic oligonucleotide
  Target: ATXN1; (+) strand; PAM type: YTN; PAM sequence: TTT
aaaatatgctattaaattat

SEQ ID NO: 263754 - DNA, 20 bp, Artificial Sequence
  Description of Artificial Sequence: Synthetic oligonucleotide
  Target: ATXN1; (+) strand; PAM type: YTN; PAM sequence: TTA
aaatatgctattaaattatt

SEQ ID NO: 263755 - DNA, 20 bp, Artificial Sequence
  Description of Artificial Sequence: Synthetic oligonucleotide
  Target: ATXN1; (+) strand; PAM type: YTN; PAM sequence: CTA
ttaaattattatagtagaca

SEQ ID NO: 263756 - DNA, 20 bp, Artificial Sequence
  Description of Artificial Sequence: Synthetic oligonucleotide
  Target: ATXN1; (+) strand; PAM type: YTN; PAM sequence: TTA
aattattatagtagacagca

SEQ ID NO: 263757 - DNA, 20 bp, Artificial Sequence
  Description of Artificial Sequence: Synthetic oligonucleotide
  Target: ATXN1; (+) strand; PAM type: YTN; PAM sequence: TTA
ttatagtagacagcaaaacc

SEQ ID NO: 263758 - DNA, 20 bp, Artificial Sequence
  Description of Artificial Sequence: Synthetic oligonucleotide
  Target: ATXN1; (+) strand; PAM type: YTN; PAM sequence: TTA
tagtagacagcaaaaccaag

SEQ ID NO: 263759 - DNA, 20 bp, Artificial Sequence
  Description of Artificial Sequence: Synthetic oligonucleotide
  Target: ATXN1; (+) strand; PAM type: YTN; PAM sequence: TTA
atgcaaaagaaccaagagat

SEQ ID NO: 263760 - DNA, 20 bp, Artificial Sequence
  Description of Artificial Sequence: Synthetic oligonucleotide
  Target: ATXN1; (+) strand; PAM type: YTN; PAM sequence: TTT
cttaatcttatcaccagttc

SEQ ID NO: 263761 - DNA, 20 bp, Artificial Sequence
  Description of Artificial Sequence: Synthetic oligonucleotide
  Target: ATXN1; (+) strand; PAM type: YTN; PAM sequence: TTC
ttaatcttatcaccagttca

SEQ ID NO: 263762 - DNA, 20 bp, Artificial Sequence
  Description of Artificial Sequence: Synthetic oligonucleotide
  Target: ATXN1; (+) strand; PAM type: YTN; PAM sequence: CTT
aatcttatcaccagttcaga

SEQ ID NO: 263763 - DNA, 20 bp, Artificial Sequence
  Description of Artificial Sequence: Synthetic oligonucleotide
  Target: ATXN1; (+) strand; PAM type: YTN; PAM sequence: TTA
atcttatcaccagttcagat

SEQ ID NO: 263764 - DNA, 20 bp, Artificial Sequence
  Description of Artificial Sequence: Synthetic oligonucleotide
  Target: ATXN1; (+) strand; PAM type: YTN; PAM sequence: CTT
atcaccagttcagattcaga

SEQ ID NO: 263765 - DNA, 20 bp, Artificial Sequence
  Description of Artificial Sequence: Synthetic oligonucleotide
  Target: ATXN1; (+) strand; PAM type: YTN; PAM sequence: TTA
tcaccagttcagattcagaa

SEQ ID NO: 263766 - DNA, 20 bp, Artificial Sequence
  Description of Artificial Sequence: Synthetic oligonucleotide
  Target: ATXN1; (+) strand; PAM type: YTN; PAM sequence: TTC
agattcagaaaaagaactaa

SEQ ID NO: 263767 - DNA, 20 bp, Artificial Sequence
  Description of Artificial Sequence: Synthetic oligonucleotide
  Target: ATXN1; (+) strand; PAM type: YTN; PAM sequence: TTC
agaaaaagaactaaaagctg

SEQ ID NO: 263768 - DNA, 20 bp, Artificial Sequence
  Description of Artificial Sequence: Synthetic oligonucleotide
  Target: ATXN1; (+) strand; PAM type: YTN; PAM sequence: CTA
aaagctgtgatctgggagct

SEQ ID NO: 263769 - DNA, 20 bp, Artificial Sequence
  Description of Artificial Sequence: Synthetic oligonucleotide
  Target: ATXN1; (+) strand; PAM type: YTN; PAM sequence: CTG
tgatctgggagcttggatat

SEQ ID NO: 263770 - DNA, 20 bp, Artificial Sequence
  Description of Artificial Sequence: Synthetic oligonucleotide
  Target: ATXN1; (+) strand; PAM type: YTN; PAM sequence: CTG
ggagcttggatattatagca

SEQ ID NO: 263771 - DNA, 20 bp, Artificial Sequence
  Description of Artificial Sequence: Synthetic oligonucleotide
  Target: ATXN1; (+) strand; PAM type: YTN; PAM sequence: CTT
ggatattatagcaattaagc

SEQ ID NO: 263772 - DNA, 20 bp, Artificial Sequence
  Description of Artificial Sequence: Synthetic oligonucleotide
  Target: ATXN1; (+) strand; PAM type: YTN; PAM sequence: TTG
gatattatagcaattaagca

SEQ ID NO: 263773 - DNA, 20 bp, Artificial Sequence
  Description of Artificial Sequence: Synthetic oligonucleotide
  Target: ATXN1; (+) strand; PAM type: YTN; PAM sequence: TTA
tagcaattaagcagcttgga

SEQ ID NO: 263774 - DNA, 20 bp, Artificial Sequence
  Description of Artificial Sequence: Synthetic oligonucleotide
  Target: ATXN1; (+) strand; PAM type: YTN; PAM sequence: TTA
agcagcttggatataaaaag

SEQ ID NO: 263775 - DNA, 20 bp, Artificial Sequence
  Description of Artificial Sequence: Synthetic oligonucleotide
  Target: ATXN1; (+) strand; PAM type: YTN; PAM sequence: CTT
ggatataaaaagaggtagat

SEQ ID NO: 263776 - DNA, 20 bp, Artificial Sequence
  Description of Artificial Sequence: Synthetic oligonucleotide
  Target: ATXN1; (+) strand; PAM type: YTN; PAM sequence: TTG
gatataaaaagaggtagata

SEQ ID NO: 263777 - DNA, 20 bp, Artificial Sequence
  Description of Artificial Sequence: Synthetic oligonucleotide
  Target: ATXN1; (+) strand; PAM type: YTN; PAM sequence: CTC
accttcagggggactcagca

SEQ ID NO: 263778 - DNA, 20 bp, Artificial Sequence
  Description of Artificial Sequence: Synthetic oligonucleotide
  Target: ATXN1; (+) strand; PAM type: YTN; PAM sequence: CTT
cagggggactcagcagtgac

SEQ ID NO: 263779 - DNA, 20 bp, Artificial Sequence
  Description of Artificial Sequence: Synthetic oligonucleotide
  Target: ATXN1; (+) strand; PAM type: YTN; PAM sequence: TTC
agggggactcagcagtgacc

SEQ ID NO: 263780 - DNA, 20 bp, Artificial Sequence
  Description of Artificial Sequence: Synthetic oligonucleotide
  Target: ATXN1; (+) strand; PAM type: YTN; PAM sequence: CTC
agcagtgaccaccactgtta

SEQ ID NO: 263781 - DNA, 20 bp, Artificial Sequence
  Description of Artificial Sequence: Synthetic oligonucleotide
  Target: ATXN1; (+) strand; PAM type: YTN; PAM sequence: CTG
ttatgtatggaaaggagtaa

SEQ ID NO: 263782 - DNA, 20 bp, Artificial Sequence
  Description of Artificial Sequence: Synthetic oligonucleotide
  Target: ATXN1; (+) strand; PAM type: YTN; PAM sequence: TTA
tgtatggaaaggagtaaagg

SEQ ID NO: 263783 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggaaacatgtggc

SEQ ID NO: 263784 - DNA, 20 bp, Artificial Sequence
  Description of Artificial Sequence: Synthetic oligonucleotide
  Target: ATXN1; (+) strand; PAM type: YTN; PAM sequence: TTG
aggtcaggaaacatgtggca

SEQ ID NO: 263785 - DNA, 20 bp, Artificial Sequence
  Description of Artificial Sequence: Synthetic oligonucleotide
  Target: ATXN1; (+) strand; PAM type: YTN; PAM sequence: TTG
ggttgggaagactgtattta

SEQ ID NO: 263786 - DNA, 20 bp, Artificial Sequence
  Description of Artificial Sequence: Synthetic oligonucleotide
  Target: ATXN1; (+) strand; PAM type: YTN; PAM sequence: TTG
ggaagactgtatttactgag

SEQ ID NO: 263787 - DNA, 20 bp, Artificial Sequence
  Description of Artificial Sequence: Synthetic oligonucleotide
  Target: ATXN1; (+) strand; PAM type: YTN; PAM sequence: CTG
tatttactgaggatctgaag

SEQ ID NO: 263788 - DNA, 20 bp, Artificial Sequence
  Description of Artificial Sequence: Synthetic oligonucleotide
  Target: ATXN1; (+) strand; PAM type: YTN; PAM sequence: TTT
actgaggatctgaagtgtgg

SEQ ID NO: 263789 - DNA, 20 bp, Artificial Sequence
  Description of Artificial Sequence: Synthetic oligonucleotide
  Target: ATXN1; (+) strand; PAM type: YTN; PAM sequence: TTA
ctgaggatctgaagtgtggc

SEQ ID NO: 263790 - DNA, 20 bp, Artificial Sequence
  Description of Artificial Sequence: Synthetic oligonucleotide
  Target: ATXN1; (+) strand; PAM type: YTN; PAM sequence: CTG
aggatctgaagtgtggcaaa

SEQ ID NO: 263791 - DNA, 20 bp, Artificial Sequence
  Description of Artificial Sequence: Synthetic oligonucleotide
  Target: ATXN1; (+) strand; PAM type: YTN; PAM sequence: CTG
aagtgtggcaaatgctctag

SEQ ID NO: 263792 - DNA, 20 bp, Artificial Sequence
  Description of Artificial Sequence: Synthetic oligonucleotide
  Target: ATXN1; (+) strand; PAM type: YTN; PAM sequence: CTC
taggagacagaaggaaggaa

SEQ ID NO: 263793 - DNA, 20 bp, Artificial Sequence
  Description of Artificial Sequence: Synthetic oligonucleotide
  Target: ATXN1; (+) strand; PAM type: YTN; PAM sequence: CTA
ggagacagaaggaaggaagg

SEQ ID NO: 263794 - DNA, 20 bp, Artificial Sequence
  Description of Artificial Sequence: Synthetic oligonucleotide
  Target: ATXN1; (+) strand; PAM type: YTN; PAM sequence: CTC
tacaagtaacacccaatcta

SEQ ID NO: 263795 - DNA, 20 bp, Artificial Sequence
  Description of Artificial Sequence: Synthetic oligonucleotide
  Target: ATXN1; (+) strand; PAM type: YTN; PAM sequence: CTA
caagtaacacccaatctaac

SEQ ID NO: 263796 - DNA, 20 bp, Artificial Sequence
  Description of Artificial Sequence: Synthetic oligonucleotide
  Target: ATXN1; (+) strand; PAM type: YTN; PAM sequence: CTA
accaggtagtaagactcatc

SEQ ID NO: 263797 - DNA, 20 bp, Artificial Sequence
  Description of Artificial Sequence: Synthetic oligonucleotide
  Target: ATXN1; (+) strand; PAM type: YTN; PAM sequence: CTC
atcttgatgtaaaaaagaag

SEQ ID NO: 263798 - DNA, 20 bp, Artificial Sequence
  Description of Artificial Sequence: Synthetic oligonucleotide
  Target: ATXN1; (+) strand; PAM type: YTN; PAM sequence: CTT
gatgtaaaaaagaagtaacc

SEQ ID NO: 263799 - DNA, 20 bp, Artificial Sequence
  Description of Artificial Sequence: Synthetic oligonucleotide
  Target: ATXN1; (+) strand; PAM type: YTN; PAM sequence: TTG
atgtaaaaaagaagtaacca

SEQ ID NO: 263800 - DNA, 20 bp, Artificial Sequence
  Description of Artificial Sequence: Synthetic oligonucleotide
  Target: ATXN1; (+) strand; PAM type: YTN; PAM sequence: CTG
tagaaaacttcactattaga

SEQ ID NO: 263801 - DNA, 20 bp, Artificial Sequence
  Description of Artificial Sequence: Synthetic oligonucleotide
  Target: ATXN1; (+) strand; PAM type: YTN; PAM sequence: CTT
cactattagaaaacaaacaa

SEQ ID NO: 263802 - DNA, 20 bp, Artificial Sequence
  Description of Artificial Sequence: Synthetic oligonucleotide
  Target: ATXN1; (+) strand; PAM type: YTN; PAM sequence: TTC
actattagaaaacaaacaac

SEQ ID NO: 263803 - DNA, 20 bp, Artificial Sequence
  Description of Artificial Sequence: Synthetic oligonucleotide
  Target: ATXN1; (+) strand; PAM type: YTN; PAM sequence: CTA
ttagaaaacaaacaacccag

SEQ ID NO: 263804 - DNA, 20 bp, Artificial Sequence
  Description of Artificial Sequence: Synthetic oligonucleotide
  Target: ATXN1; (+) strand; PAM type: YTN; PAM sequence: TTA
gaaaacaaacaacccagttt

SEQ ID NO: 263805 - DNA, 20 bp, Artificial Sequence
  Description of Artificial Sequence: Synthetic oligonucleotide
  Target: ATXN1; (+) strand; PAM type: YTN; PAM sequence: TTT
ttaaaatggacaaaagacct

SEQ ID NO: 263806 - DNA, 20 bp, Artificial Sequence
  Description of Artificial Sequence: Synthetic oligonucleotide
  Target: ATXN1; (+) strand; PAM type: YTN; PAM sequence: TTT
taaaatggacaaaagacctg

SEQ ID NO: 263807 - DNA, 20 bp, Artificial Sequence
  Description of Artificial Sequence: Synthetic oligonucleotide
  Target: ATXN1; (+) strand; PAM type: YTN; PAM sequence: TTT
aaaatggacaaaagacctga

SEQ ID NO: 263808 - DNA, 20 bp, Artificial Sequence
  Description of Artificial Sequence: Synthetic oligonucleotide
  Target: ATXN1; (+) strand; PAM type: YTN; PAM sequence: TTA
aaatggacaaaagacctgac

SEQ ID NO: 263809 - DNA, 20 bp, Artificial Sequence
  Description of Artificial Sequence: Synthetic oligonucleotide
  Target: ATXN1; (+) strand; PAM type: YTN; PAM sequence: CTG
accagacaccttaccaaatt

SEQ ID NO: 263810 - DNA, 20 bp, Artificial Sequence
  Description of Artificial Sequence: Synthetic oligonucleotide
  Target: ATXN1; (+) strand; PAM type: YTN; PAM sequence: CTT
accaaattagacatagagat

SEQ ID NO: 263811 - DNA, 20 bp, Artificial Sequence
  Description of Artificial Sequence: Synthetic oligonucleotide
  Target: ATXN1; (+) strand; PAM type: YTN; PAM sequence: TTA
ccaaattagacatagagatg

SEQ ID NO: 263812 - DNA, 20 bp, Artificial Sequence
  Description of Artificial Sequence: Synthetic oligonucleotide
  Target: ATXN1; (+) strand; PAM type: YTN; PAM sequence: TTA
gacatagagatggcaagtaa

SEQ ID NO: 263813 - DNA, 20 bp, Artificial Sequence
  Description of Artificial Sequence: Synthetic oligonucleotide
  Target: ATXN1; (+) strand; PAM type: YTN; PAM sequence: CTC
cacattatgaatcactaggg

SEQ ID NO: 263814 - DNA, 20 bp, Artificial Sequence
  Description of Artificial Sequence: Synthetic oligonucleotide
  Target: ATXN1; (+) strand; PAM type: YTN; PAM sequence: TTA
tgaatcactagggaactgtg

SEQ ID NO: 263815 - DNA, 20 bp, Artificial Sequence
  Description of Artificial Sequence: Synthetic oligonucleotide
  Target: ATXN1; (+) strand; PAM type: YTN; PAM sequence: CTA
gggaactgtgaattaaaaca

SEQ ID NO: 263816 - DNA, 20 bp, Artificial Sequence
  Description of Artificial Sequence: Synthetic oligonucleotide
  Target: ATXN1; (+) strand; PAM type: YTN; PAM sequence: CTG
tgaattaaaacaaacacaag

SEQ ID NO: 263817 - DNA, 20 bp, Artificial Sequence
  Description of Artificial Sequence: Synthetic oligonucleotide
  Target: ATXN1; (+) strand; PAM type: YTN; PAM sequence: TTA
aaacaaacacaagataccac

SEQ ID NO: 263818 - DNA, 20 bp, Artificial Sequence
  Description of Artificial Sequence: Synthetic oligonucleotide
  Target: ATXN1; (+) strand; PAM type: YTN; PAM sequence: CTA
tgaaaatggccaaaatccaa

SEQ ID NO: 263819 - DNA, 20 bp, Artificial Sequence
  Description of Artificial Sequence: Synthetic oligonucleotide
  Target: ATXN1; (+) strand; PAM type: YTN; PAM sequence: CTG
ccaacagcagatgctggcaa

SEQ ID NO: 263820 - DNA, 20 bp, Artificial Sequence
  Description of Artificial Sequence: Synthetic oligonucleotide
  Target: ATXN1; (+) strand; PAM type: YTN; PAM sequence: CTG
gcaaggatgcagagccatag

SEQ ID NO: 263821 - DNA, 20 bp, Artificial Sequence
  Description of Artificial Sequence: Synthetic oligonucleotide
  Target: ATXN1; (+) strand; PAM type: YTN; PAM sequence: CTC
tcaagtcattgcgggtggga

SEQ ID NO: 263822 - DNA, 20 bp, Artificial Sequence
  Description of Artificial Sequence: Synthetic oligonucleotide
  Target: ATXN1; (+) strand; PAM type: YTN; PAM sequence: CTC
aagtcattgcgggtgggaat

SEQ ID NO: 263823 - DNA, 20 bp, Artificial Sequence
  Description of Artificial Sequence: Synthetic oligonucleotide
  Target: ATXN1; (+) strand; PAM type: YTN; PAM sequence: TTG
cgggtgggaatgcaaatagt

SEQ ID NO: 263824 - DNA, 20 bp, Artificial Sequence
  Description of Artificial Sequence: Synthetic oligonucleotide
  Target: ATXN1; (+) strand; PAM type: YTN; PAM sequence: CTA
cttgggaaaacagtttggca

SEQ ID NO: 263825 - DNA, 20 bp, Artificial Sequence
  Description of Artificial Sequence: Synthetic oligonucleotide
  Target: ATXN1; (+) strand; PAM type: YTN; PAM sequence: CTT
gggaaaacagtttggcagtt

SEQ ID NO: 263826 - DNA, 20 bp, Artificial Sequence
  Description of Artificial Sequence: Synthetic oligonucleotide
  Target: ATXN1; (+) strand; PAM type: YTN; PAM sequence: TTG
ggaaaacagtttggcagttt

SEQ ID NO: 263827 - DNA, 20 bp, Artificial Sequence
  Description of Artificial Sequence: Synthetic oligonucleotide
  Target: ATXN1; (+) strand; PAM type: YTN; PAM sequence: TTT
ggcagtttcctacaaagcta

SEQ ID NO: 263828 - DNA, 20 bp, Artificial Sequence
  Description of Artificial Sequence: Synthetic oligonucleotide
  Target: ATXN1; (+) strand; PAM type: YTN; PAM sequence: TTG
gcagtttcctacaaagctaa

SEQ ID NO: 263829 - DNA, 20 bp, Artificial Sequence
  Description of Artificial Sequence: Synthetic oligonucleotide
  Target: ATXN1; (+) strand; PAM type: YTN; PAM sequence: TTT
cctacaaagctaaacatact

SEQ ID NO: 263830 - DNA, 20 bp, Artificial Sequence
  Description of Artificial Sequence: Synthetic oligonucleotide
  Target: ATXN1; (+) strand; PAM type: YTN; PAM sequence: TTC
ctacaaagctaaacatactc

SEQ ID NO: 263831 - DNA, 20 bp, Artificial Sequence
  Description of Artificial Sequence: Synthetic oligonucleotide
  Target: ATXN1; (+) strand; PAM type: YTN; PAM sequence: CTA
caaagctaaacatactctta

SEQ ID NO: 263832 - DNA, 20 bp, Artificial Sequence
  Description of Artificial Sequence: Synthetic oligonucleotide
  Target: ATXN1; (+) strand; PAM type: YTN; PAM sequence: CTA
aacatactcttaacatgcaa

SEQ ID NO: 263833 - DNA, 20 bp, Artificial Sequence
  Description of Artificial Sequence: Synthetic oligonucleotide
  Target: ATXN1; (+) strand; PAM type: YTN; PAM sequence: CTC
ttaacatgcaatgtggcaag

SEQ ID NO: 263834 - DNA, 20 bp, Artificial Sequence
  Description of Artificial Sequence: Synthetic oligonucleotide
  Target: ATXN1; (+) strand; PAM type: YTN; PAM sequence: CTT
aacatgcaatgtggcaagca

SEQ ID NO: 263835 - DNA, 20 bp, Artificial Sequence
  Description of Artificial Sequence: Synthetic oligonucleotide
  Target: ATXN1; (+) strand; PAM type: YTN; PAM sequence: TTA
acatgcaatgtggcaagcat

SEQ ID NO: 263836 - DNA, 20 bp, Artificial Sequence
  Description of Artificial Sequence: Synthetic oligonucleotide
  Target: ATXN1; (+) strand; PAM type: YTN; PAM sequence: CTC
cttggtatctacacaaataa

SEQ ID NO: 263837 - DNA, 20 bp, Artificial Sequence
  Description of Artificial Sequence: Synthetic oligonucleotide
  Target: ATXN1; (+) strand; PAM type: YTN; PAM sequence: CTT
ggtatctacacaaataaact

SEQ ID NO: 263838 - DNA, 20 bp, Artificial Sequence
  Description of Artificial Sequence: Synthetic oligonucleotide
  Target: ATXN1; (+) strand; PAM type: YTN; PAM sequence: TTG
gtatctacacaaataaacta

SEQ ID NO: 263839 - DNA, 20 bp, Artificial Sequence
  Description of Artificial Sequence: Synthetic oligonucleotide
  Target: ATXN1; (+) strand; PAM type: YTN; PAM sequence: CTA
cacaaataaactaaaaactt

SEQ ID NO: 263840 - DNA, 20 bp, Artificial Sequence
  Description of Artificial Sequence: Synthetic oligonucleotide
  Target: ATXN1; (+) strand; PAM type: YTN; PAM sequence: CTA
aaaacttaagtccacacaaa

SEQ ID NO: 263841 - DNA, 20 bp, Artificial Sequence
  Description of Artificial Sequence: Synthetic oligonucleotide
  Target: ATXN1; (+) strand; PAM type: YTN; PAM sequence: CTT
aagtccacacaaaaacctgc

SEQ ID NO: 263842 - DNA, 20 bp, Artificial Sequence
  Description of Artificial Sequence: Synthetic oligonucleotide
  Target: ATXN1; (+) strand; PAM type: YTN; PAM sequence: TTA
agtccacacaaaaacctgca

SEQ ID NO: 263843 - DNA, 20 bp, Artificial Sequence
  Description of Artificial Sequence: Synthetic oligonucleotide
  Target: ATXN1; (+) strand; PAM type: YTN; PAM sequence: CTG
cactcaaatgtttatagcag

SEQ ID NO: 263844 - DNA, 20 bp, Artificial Sequence
  Description of Artificial Sequence: Synthetic oligonucleotide
  Target: ATXN1; (+) strand; PAM type: YTN; PAM sequence: CTC
aaatgtttatagcagcttca

SEQ ID NO: 263845 - DNA, 20 bp, Artificial Sequence
  Description of Artificial Sequence: Synthetic oligonucleotide
  Target: ATXN1; (+) strand; PAM type: YTN; PAM sequence: TTT
atagcagcttcattcataat

SEQ ID NO: 263846 - DNA, 20 bp, Artificial Sequence
  Description of Artificial Sequence: Synthetic oligonucleotide
  Target: ATXN1; (+) strand; PAM type: YTN; PAM sequence: TTA
tagcagcttcattcataatc

SEQ ID NO: 263847 - DNA, 20 bp, Artificial Sequence
  Description of Artificial Sequence: Synthetic oligonucleotide
  Target: ATXN1; (+) strand; PAM type: YTN; PAM sequence: CTT
cattcataatcgtgaatggg

SEQ ID NO: 263848 - DNA, 20 bp, Artificial Sequence
  Description of Artificial Sequence: Synthetic oligonucleotide
  Target: ATXN1; (+) strand; PAM type: YTN; PAM sequence: TTC
attcataatcgtgaatgggt

SEQ ID NO: 263849 - DNA, 20 bp, Artificial Sequence
  Description of Artificial Sequence: Synthetic oligonucleotide
  Target: ATXN1; (+) strand; PAM type: YTN; PAM sequence: TTC
ataatcgtgaatgggtacat

SEQ ID NO: 263850 - DNA, 20 bp, Artificial Sequence
  Description of Artificial Sequence: Synthetic oligonucleotide
  Target: ATXN1; (+) strand; PAM type: YTN; PAM sequence: CTG
tggtacatccatacaataga

SEQ ID NO: 263851 - DNA, 20 bp, Artificial Sequence
  Description of Artificial Sequence: Synthetic oligonucleotide
  Target: ATXN1; (+) strand; PAM type: YTN; PAM sequence: TTA
ttcagcactaaaaacaaata

SEQ ID NO: 263852 - DNA, 20 bp, Artificial Sequence
  Description of Artificial Sequence: Synthetic oligonucleotide
  Target: ATXN1; (+) strand; PAM type: YTN; PAM sequence: TTC
agcactaaaaacaaataagc

SEQ ID NO: 263853 - DNA, 20 bp, Artificial Sequence
  Description of Artificial Sequence: Synthetic oligonucleotide
  Target: ATXN1; (+) strand; PAM type: YTN; PAM sequence: CTA
aaaacaaataagctttcagg

SEQ ID NO: 263854 - DNA, 20 bp, Artificial Sequence
  Description of Artificial Sequence: Synthetic oligonucleotide
  Target: ATXN1; (+) strand; PAM type: YTN; PAM sequence: CTT
tcaggccataaaaatgagag

SEQ ID NO: 263855 - DNA, 20 bp, Artificial Sequence
  Description of Artificial Sequence: Synthetic oligonucleotide
  Target: ATXN1; (+) strand; PAM type: YTN; PAM sequence: TTT
caggccataaaaatgagagg

SEQ ID NO: 263856 - DNA, 20 bp, Artificial Sequence
  Description of Artificial Sequence: Synthetic oligonucleotide
  Target: ATXN1; (+) strand; PAM type: YTN; PAM sequence: TTC
aggccataaaaatgagaggt

SEQ ID NO: 263857 - DNA, 20 bp, Artificial Sequence
  Description of Artificial Sequence: Synthetic oligonucleotide
  Target: ATXN1; (+) strand; PAM type: YTN; PAM sequence: CTG
gacttcctgggttgagtggg

SEQ ID NO: 263858 - DNA, 20 bp, Artificial Sequence
  Description of Artificial Sequence: Synthetic oligonucleotide
  Target: ATXN1; (+) strand; PAM type: YTN; PAM sequence: CTT
cctgggttgagtggggactt

SEQ ID NO: 263859 - DNA, 20 bp, Artificial Sequence
  Description of Artificial Sequence: Synthetic oligonucleotide
  Target: ATXN1; (+) strand; PAM type: YTN; PAM sequence: TTC
ctgggttgagtggggacttg

SEQ ID NO: 263860 - DNA, 20 bp, Artificial Sequence
  Description of Artificial Sequence: Synthetic oligonucleotide
  Target: ATXN1; (+) strand; PAM type: YTN; PAM sequence: CTG
ggttgagtggggacttgggg

SEQ ID NO: 263861 - DNA, 20 bp, Artificial Sequence
  Description of Artificial Sequence: Synthetic oligonucleotide
  Target: ATXN1; (+) strand; PAM type: YTN; PAM sequence: TTG
agtggggacttggggaaatt

SEQ ID NO: 263862 - DNA, 20 bp, Artificial Sequence
  Description of Artificial Sequence: Synthetic oligonucleotide
  Target: ATXN1; (+) strand; PAM type: YTN; PAM sequence: CTT
ggggaaatttcccgtcctac

SEQ ID NO: 263863 - DNA, 20 bp, Artificial Sequence
  Description of Artificial Sequence: Synthetic oligonucleotide
  Target: ATXN1; (+) strand; PAM type: YTN; PAM sequence: TTG
gggaaatttcccgtcctaca

SEQ ID NO: 263864 - DNA, 20 bp, Artificial Sequence
  Description of Artificial Sequence: Synthetic oligonucleotide
  Target: ATXN1; (+) strand; PAM type: YTN; PAM sequence: TTT
cccgtcctacaaaaggattg

SEQ ID NO: 263865 - DNA, 20 bp, Artificial Sequence
  Description of Artificial Sequence: Synthetic oligonucleotide
  Target: ATXN1; (+) strand; PAM type: YTN; PAM sequence: TTC
ccgtcctacaaaaggattgt

SEQ ID NO: 263866 - DNA, 20 bp, Artificial Sequence
  Description of Artificial Sequence: Synthetic oligonucleotide
  Target: ATXN1; (+) strand; PAM type: YTN; PAM sequence: CTA
caaaaggattgtaaaacaca

SEQ ID NO: 263867 - DNA, 20 bp, Artificial Sequence
  Description of Artificial Sequence: Synthetic oligonucleotide
  Target: ATXN1; (+) strand; PAM type: YTN; PAM sequence: TTG
taaaacacaccaatcaggaa

SEQ ID NO: 263868 - DNA, 20 bp, Artificial Sequence
  Description of Artificial Sequence: Synthetic oligonucleotide
  Target: ATXN1; (+) strand; PAM type: YTN; PAM sequence: CTT
tcctgtcttataagaggttt

SEQ ID NO: 263869 - DNA, 20 bp, Artificial Sequence
  Description of Artificial Sequence: Synthetic oligonucleotide
  Target: ATXN1; (+) strand; PAM type: YTN; PAM sequence: TTT
cctgtcttataagaggtttg

SEQ ID NO: 263870 - DNA, 20 bp, Artificial Sequence
  Description of Artificial Sequence: Synthetic oligonucleotide
  Target: ATXN1; (+) strand; PAM type: YTN; PAM sequence: TTC
ctgtcttataagaggtttgt

SEQ ID NO: 263871 - DNA, 20 bp, Artificial Sequence
  Description of Artificial Sequence: Synthetic oligonucleotide
  Target: ATXN1; (+) strand; PAM type: YTN; PAM sequence: CTG
tcttataagaggtttgtaaa

SEQ ID NO: 263872 - DNA, 20 bp, Artificial Sequence
  Description of Artificial Sequence: Synthetic oligonucleotide
  Target: ATXN1; (+) strand; PAM type: YTN; PAM sequence: CTT
ataagaggtttgtaaagcgc

SEQ ID NO: 263873 - DNA, 20 bp, Artificial Sequence
  Description of Artificial Sequence: Synthetic oligonucleotide
  Target: ATXN1; (+) strand; PAM type: YTN; PAM sequence: TTA
taagaggtttgtaaagcgca

SEQ ID NO: 263874 - DNA, 20 bp, Artificial Sequence
  Description of Artificial Sequence: Synthetic oligonucleotide
  Target: ATXN1; (+) strand; PAM type: YTN; PAM sequence: TTT
gtaaagcgcaccaatcagca

SEQ ID NO: 263875 - DNA, 20 bp, Artificial Sequence
  Description of Artificial Sequence: Synthetic oligonucleotide
  Target: ATXN1; (+) strand; PAM type: YTN; PAM sequence: TTG
taaagcgcaccaatcagcac

SEQ ID NO: 263876 - DNA, 20 bp, Artificial Sequence
  Description of Artificial Sequence: Synthetic oligonucleotide
  Target: ATXN1; (+) strand; PAM type: YTN; PAM sequence: CTT
ggtaaaatgcaccaatcaac

SEQ ID NO: 263877 - DNA, 20 bp, Artificial Sequence
  Description of Artificial Sequence: Synthetic oligonucleotide
  Target: ATXN1; (+) strand; PAM type: YTN; PAM sequence: TTG
gtaaaatgcaccaatcaacg

SEQ ID NO: 263878 - DNA, 20 bp, Artificial Sequence
  Description of Artificial Sequence: Synthetic oligonucleotide
  Target: ATXN1; (+) strand; PAM type: YTN; PAM sequence: CTC
tgtaaaatgcaccaatcaac

SEQ ID NO: 263879 - DNA, 20 bp, Artificial Sequence
  Description of Artificial Sequence: Synthetic oligonucleotide
  Target: ATXN1; (+) strand; PAM type: YTN; PAM sequence: CTG
taaaatgcaccaatcaacgc

SEQ ID NO: 263880 - DNA, 20 bp, Artificial Sequence
  Description of Artificial Sequence: Synthetic oligonucleotide
  Target: ATXN1; (+) strand; PAM type: YTN; PAM sequence: CTC
tgtaaaatgcaccaatcagc

SEQ ID NO: 263881 - DNA, 20 bp, Artificial Sequence
  Description of Artificial Sequence: Synthetic oligonucleotide
  Target: ATXN1; (+) strand; PAM type: YTN; PAM sequence: CTG
taaaatgcaccaatcagcag

SEQ ID NO: 263882 - DNA, 20 bp, Artificial Sequence
  Description of Artificial Sequence: Synthetic oligonucleotide
  Target: ATXN1; (+) strand; PAM type: YTN; PAM sequence: TTG
aaaaaaatggcactctgata

SEQ ID NO: 263883 - DNA, 20 bp, Artificial Sequence
  Description of Artificial Sequence: Synthetic oligonucleotide
  Target: ATXN1; (+) strand; PAM type: YTN; PAM sequence: CTC
tgataggacagaaacagaat

SEQ ID NO: 263884 - DNA, 20 bp, Artificial Sequence
  Description of Artificial Sequence: Synthetic oligonucleotide
  Target: ATXN1; (+) strand; PAM type: YTN; PAM sequence: CTG
ataggacagaaacagaatat

SEQ ID NO: 263885 - DNA, 20 bp, Artificial Sequence
  Description of Artificial Sequence: Synthetic oligonucleotide
  Target: ATXN1; (+) strand; PAM type: YTN; PAM sequence: TTT
gggtccccttccacgctggg

SEQ ID NO: 263886 - DNA, 20 bp, Artificial Sequence
  Description of Artificial Sequence: Synthetic oligonucleotide
  Target: ATXN1; (+) strand; PAM type: YTN; PAM sequence: TTG
ggtccccttccacgctgggg

SEQ ID NO: 263887 - DNA, 20 bp, Artificial Sequence
  Description of Artificial Sequence: Synthetic oligonucleotide
  Target: ATXN1; (+) strand; PAM type: YTN; PAM sequence: CTT
ccacgctggggaagctttgt

SEQ ID NO: 263888 - DNA, 20 bp, Artificial Sequence
  Description of Artificial Sequence: Synthetic oligonucleotide
  Target: ATXN1; (+) strand; PAM type: YTN; PAM sequence: TTC
cacgctggggaagctttgtc

SEQ ID NO: 263889 - DNA, 20 bp, Artificial Sequence
  Description of Artificial Sequence: Synthetic oligonucleotide
  Target: ATXN1; (+) strand; PAM type: YTN; PAM sequence: CTG
gggaagctttgtcctgtcgc

SEQ ID NO: 263890 - DNA, 20 bp, Artificial Sequence
  Description of Artificial Sequence: Synthetic oligonucleotide
  Target: ATXN1; (+) strand; PAM type: YTN; PAM sequence: CTT
tgtcctgtcgctcttcacag

SEQ ID NO: 263891 - DNA, 20 bp, Artificial Sequence
  Description of Artificial Sequence: Synthetic oligonucleotide
  Target: ATXN1; (+) strand; PAM type: YTN; PAM sequence: TTT
gtcctgtcgctcttcacagt

SEQ ID NO: 263892 - DNA, 20 bp, Artificial Sequence
  Description of Artificial Sequence: Synthetic oligonucleotide
  Target: ATXN1; (+) strand; PAM type: YTN; PAM sequence: TTG
tcctgtcgctcttcacagtt

SEQ ID NO: 263893 - DNA, 20 bp, Artificial Sequence
  Description of Artificial Sequence: Synthetic oligonucleotide
  Target: ATXN1; (+) strand; PAM type: YTN; PAM sequence: CTG
tcgctcttcacagttaacct

SEQ ID NO: 263894 - DNA, 20 bp, Artificial Sequence
  Description of Artificial Sequence: Synthetic oligonucleotide
  Target: ATXN1; (+) strand; PAM type: YTN; PAM sequence: CTC
ttcacagttaaccttgctac

SEQ ID NO: 263895 - DNA, 20 bp, Artificial Sequence
  Description of Artificial Sequence: Synthetic oligonucleotide
  Target: ATXN1; (+) strand; PAM type: YTN; PAM sequence: CTT
cacagttaaccttgctactg

SEQ ID NO: 263896 - DNA, 20 bp, Artificial Sequence
  Description of Artificial Sequence: Synthetic oligonucleotide
  Target: ATXN1; (+) strand; PAM type: YTN; PAM sequence: TTC
acagttaaccttgctactgc

SEQ ID NO: 263897 - DNA, 20 bp, Artificial Sequence
  Description of Artificial Sequence: Synthetic oligonucleotide
  Target: ATXN1; (+) strand; PAM type: YTN; PAM sequence: TTA
accttgctactgctcactct

SEQ ID NO: 263898 - DNA, 20 bp, Artificial Sequence
  Description of Artificial Sequence: Synthetic oligonucleotide
  Target: ATXN1; (+) strand; PAM type: YTN; PAM sequence: CTT
gctactgctcactctttggg

SEQ ID NO: 263899 - DNA, 20 bp, Artificial Sequence
  Description of Artificial Sequence: Synthetic oligonucleotide
  Target: ATXN1; (+) strand; PAM type: YTN; PAM sequence: TTG
ctactgctcactctttgggt

SEQ ID NO: 263900 - DNA, 20 bp, Artificial Sequence
  Description of Artificial Sequence: Synthetic oligonucleotide
  Target: ATXN1; (+) strand; PAM type: YTN; PAM sequence: CTA
ctgctcactctttgggtctg

SEQ ID NO: 263901 - DNA, 20 bp, Artificial Sequence
  Description of Artificial Sequence: Synthetic oligonucleotide
  Target: ATXN1; (+) strand; PAM type: YTN; PAM sequence: CTG
ctcactctttgggtctgtgc

SEQ ID NO: 263902 - DNA, 20 bp, Artificial Sequence
  Description of Artificial Sequence: Synthetic oligonucleotide
  Target: ATXN1; (+) strand; PAM type: YTN; PAM sequence: CTC
actctttgggtctgtgccat

SEQ ID NO: 263903 - DNA, 20 bp, Artificial Sequence
  Description of Artificial Sequence: Synthetic oligonucleotide
  Target: ATXN1; (+) strand; PAM type: YTN; PAM sequence: CTC
tttgggtctgtgccatcttt

SEQ ID NO: 263904 - DNA, 20 bp, Artificial Sequence
  Description of Artificial Sequence: Synthetic oligonucleotide
  Target: ATXN1; (+) strand; PAM type: YTN; PAM sequence: CTT
tgggtctgtgccatctttaa

SEQ ID NO: 263905 - DNA, 20 bp, Artificial Sequence
  Description of Artificial Sequence: Synthetic oligonucleotide
  Target: ATXN1; (+) strand; PAM type: YTN; PAM sequence: TTT
gggtctgtgccatctttaag

SEQ ID NO: 263906 - DNA, 20 bp, Artificial Sequence
  Description of Artificial Sequence: Synthetic oligonucleotide
  Target: ATXN1; (+) strand; PAM type: YTN; PAM sequence: TTG
ggtctgtgccatctttaaga

SEQ ID NO: 263907 - DNA, 20 bp, Artificial Sequence
  Description of Artificial Sequence: Synthetic oligonucleotide
  Target: ATXN1; (+) strand; PAM type: YTN; PAM sequence: CTG
tgccatctttaagagctgta

SEQ ID NO: 263908 - DNA, 20 bp, Artificial Sequence
  Description of Artificial Sequence: Synthetic oligonucleotide
  Target: ATXN1; (+) strand; PAM type: YTN; PAM sequence: CTT
taagagctgtaacactcacc

SEQ ID NO: 263909 - DNA, 20 bp, Artificial Sequence
  Description of Artificial Sequence: Synthetic oligonucleotide
  Target: ATXN1; (+) strand; PAM type: YTN; PAM sequence: TTT
aagagctgtaacactcaccg

SEQ ID NO: 263910 - DNA, 20 bp, Artificial Sequence
  Description of Artificial Sequence: Synthetic oligonucleotide
  Target: ATXN1; (+) strand; PAM type: YTN; PAM sequence: TTA
agagctgtaacactcaccgt

SEQ ID NO: 263911 - DNA, 20 bp, Artificial Sequence
  Description of Artificial Sequence: Synthetic oligonucleotide
  Target: ATXN1; (+) strand; PAM type: YTN; PAM sequence: CTG
taacactcaccgtgaaggtc

SEQ ID NO: 263912 - DNA, 20 bp, Artificial Sequence
  Description of Artificial Sequence: Synthetic oligonucleotide
  Target: ATXN1; (+) strand; PAM type: YTN; PAM sequence: CTC
accgtgaaggtccgtgcctc

SEQ ID NO: 263913 - DNA, 20 bp, Artificial Sequence
  Description of Artificial Sequence: Synthetic oligonucleotide
  Target: ATXN1; (+) strand; PAM type: YTN; PAM sequence: CTC
cattcttgaagtcagcgaga

SEQ ID NO: 263914 - DNA, 20 bp, Artificial Sequence
  Description of Artificial Sequence: Synthetic oligonucleotide
  Target: ATXN1; (+) strand; PAM type: YTN; PAM sequence: TTC
ttgaagtcagcgagaccatg

SEQ ID NO: 263915 - DNA, 20 bp, Artificial Sequence
  Description of Artificial Sequence: Synthetic oligonucleotide
  Target: ATXN1; (+) strand; PAM type: YTN; PAM sequence: CTT
gaagtcagcgagaccatgaa

SEQ ID NO: 263916 - DNA, 20 bp, Artificial Sequence
  Description of Artificial Sequence: Synthetic oligonucleotide
  Target: ATXN1; (+) strand; PAM type: YTN; PAM sequence: TTG
aagtcagcgagaccatgaat

SEQ ID NO: 263917 - DNA, 20 bp, Artificial Sequence
  Description of Artificial Sequence: Synthetic oligonucleotide
  Target: ATXN1; (+) strand; PAM type: YTN; PAM sequence: CTG
gaaccaactctggacacatc

SEQ ID NO: 263918 - DNA, 20 bp, Artificial Sequence
  Description of Artificial Sequence: Synthetic oligonucleotide
  Target: ATXN1; (+) strand; PAM type: YTN; PAM sequence: CTC
tggacacatcttgggggatc

SEQ ID NO: 263919 - DNA, 20 bp, Artificial Sequence
  Description of Artificial Sequence: Synthetic oligonucleotide
  Target: ATXN1; (+) strand; PAM type: YTN; PAM sequence: CTG
gacacatcttgggggatcct

SEQ ID NO: 263920 - DNA, 20 bp, Artificial Sequence
  Description of Artificial Sequence: Synthetic oligonucleotide
  Target: ATXN1; (+) strand; PAM type: YTN; PAM sequence: CTT
gggggatcctcccagatatt

SEQ ID NO: 263921 - DNA, 20 bp, Artificial Sequence
  Description of Artificial Sequence: Synthetic oligonucleotide
  Target: ATXN1; (+) strand; PAM type: YTN; PAM sequence: TTG
ggggatcctcccagatattg

SEQ ID NO: 263922 - DNA, 20 bp, Artificial Sequence
  Description of Artificial Sequence: Synthetic oligonucleotide
  Target: ATXN1; (+) strand; PAM type: YTN; PAM sequence: CTC
ccagatattgcaacgtggtg

SEQ ID NO: 263923 - DNA, 20 bp, Artificial Sequence
  Description of Artificial Sequence: Synthetic oligonucleotide
  Target: ATXN1; (+) strand; PAM type: YTN; PAM sequence: TTG
caacgtggtgagtaccatca

SEQ ID NO: 263924 - DNA, 20 bp, Artificial Sequence
  Description of Artificial Sequence: Synthetic oligonucleotide
  Target: ATXN1; (+) strand; PAM type: YTN; PAM sequence: CTT
ttgcttgctattctgtccta

SEQ ID NO: 263925 - DNA, 20 bp, Artificial Sequence
  Description of Artificial Sequence: Synthetic oligonucleotide
  Target: ATXN1; (+) strand; PAM type: YTN; PAM sequence: TTT
tgcttgctattctgtcctat

SEQ ID NO: 263926 - DNA, 20 bp, Artificial Sequence
  Description of Artificial Sequence: Synthetic oligonucleotide
  Target: ATXN1; (+) strand; PAM type: YTN; PAM sequence: TTT
gcttgctattctgtcctatt

SEQ ID NO: 263927 - DNA, 20 bp, Artificial Sequence
  Description of Artificial Sequence: Synthetic oligonucleotide
  Target: ATXN1; (+) strand; PAM type: YTN; PAM sequence: TTG
cttgctattctgtcctattt

SEQ ID NO: 263928 - DNA, 20 bp, Artificial Sequence
  Description of Artificial Sequence: Synthetic oligonucleotide
  Target: ATXN1; (+) strand; PAM type: YTN; PAM sequence: CTT
gctattctgtcctatttttc

SEQ ID NO: 263929 - DNA, 20 bp, Artificial Sequence
  Description of Artificial Sequence: Synthetic oligonucleotide
  Target: ATXN1; (+) strand; PAM type: YTN; PAM sequence: TTG
ctattctgtcctatttttcc

SEQ ID NO: 263930 - DNA, 20 bp, Artificial Sequence
  Description of Artificial Sequence: Synthetic oligonucleotide
  Target: ATXN1; (+) strand; PAM type: YTN; PAM sequence: CTA
ttctgtcctatttttcctta

SEQ ID NO: 263931 - DNA, 20 bp, Artificial Sequence
  Description of Artificial Sequence: Synthetic oligonucleotide
  Target: ATXN1; (+) strand; PAM type: YTN; PAM sequence: TTC
tgtcctatttttccttagaa

SEQ ID NO: 263932 - DNA, 20 bp, Artificial Sequence
  Description of Artificial Sequence: Synthetic oligonucleotide
  Target: ATXN1; (+) strand; PAM type: YTN; PAM sequence: CTG
tcctatttttccttagaatt

SEQ ID NO: 263933 - DNA, 20 bp, Artificial Sequence
  Description of Artificial Sequence: Synthetic oligonucleotide
  Target: ATXN1; (+) strand; PAM type: YTN; PAM sequence: CTA
tttttccttagaattcaggg

SEQ ID NO: 263934 - DNA, 20 bp, Artificial Sequence
  Description of Artificial Sequence: Synthetic oligonucleotide
  Target: ATXN1; (+) strand; PAM type: YTN; PAM sequence: TTT
ttccttagaattcaggggct

SEQ ID NO: 263935 - DNA, 20 bp, Artificial Sequence
  Description of Artificial Sequence: Synthetic oligonucleotide
  Target: ATXN1; (+) strand; PAM type: YTN; PAM sequence: TTT
tccttagaattcaggggcta

SEQ ID NO: 263936 - DNA, 20 bp, Artificial Sequence
  Description of Artificial Sequence: Synthetic oligonucleotide
  Target: ATXN1; (+) strand; PAM type: YTN; PAM sequence: TTT
ccttagaattcaggggctaa

SEQ ID NO: 263937 - DNA, 20 bp, Artificial Sequence
  Description of Artificial Sequence: Synthetic oligonucleotide
  Target: ATXN1; (+) strand; PAM type: YTN; PAM sequence: TTC
cttagaattcaggggctaaa

SEQ ID NO: 263938 - DNA, 20 bp, Artificial Sequence
  Description of Artificial Sequence: Synthetic oligonucleotide
  Target: ATXN1; (+) strand; PAM type: YTN; PAM sequence: CTT
agaattcaggggctaaaact

SEQ ID NO: 263939 - DNA, 20 bp, Artificial Sequence
  Description of Artificial Sequence: Synthetic oligonucleotide
  Target: ATXN1; (+) strand; PAM type: YTN; PAM sequence: TTA
gaattcaggggctaaaacta

SEQ ID NO: 263940 - DNA, 20 bp, Artificial Sequence
  Description of Artificial Sequence: Synthetic oligonucleotide
  Target: ATXN1; (+) strand; PAM type: YTN; PAM sequence: TTC
aggggctaaaactaggcacc

SEQ ID NO: 263941 - DNA, 20 bp, Artificial Sequence
  Description of Artificial Sequence: Synthetic oligonucleotide
  Target: ATXN1; (+) strand; PAM type: YTN; PAM sequence: CTA
aaactaggcacctgtcagcc

SEQ ID NO: 263942 - DNA, 20 bp, Artificial Sequence
  Description of Artificial Sequence: Synthetic oligonucleotide
  Target: ATXN1; (+) strand; PAM type: YTN; PAM sequence: CTA
ggcacctgtcagccagttaa

SEQ ID NO: 263943 - DNA, 20 bp, Artificial Sequence
  Description of Artificial Sequence: Synthetic oligonucleotide
  Target: ATXN1; (+) strand; PAM type: YTN; PAM sequence: CTG
tcagccagttaaaagcaact

SEQ ID NO: 263944 - DNA, 20 bp, Artificial Sequence
  Description of Artificial Sequence: Synthetic oligonucleotide
  Target: ATXN1; (+) strand; PAM type: YTN; PAM sequence: TTA
aaagcaactagcatggccac

SEQ ID NO: 263945 - DNA, 20 bp, Artificial Sequence
  Description of Artificial Sequence: Synthetic oligonucleotide
  Target: ATXN1; (+) strand; PAM type: YTN; PAM sequence: CTA
gcatggccacaggactaagg

SEQ ID NO: 263946 - DNA, 20 bp, Artificial Sequence
  Description of Artificial Sequence: Synthetic oligonucleotide
  Target: ATXN1; (+) strand; PAM type: YTN; PAM sequence: CTA
aggacatggatgtcaggctc

SEQ ID NO: 263947 - DNA, 20 bp, Artificial Sequence
  Description of Artificial Sequence: Synthetic oligonucleotide
  Target: ATXN1; (+) strand; PAM type: YTN; PAM sequence: CTC
tctgggaaagggctcactaa

SEQ ID NO: 263948 - DNA, 20 bp, Artificial Sequence
  Description of Artificial Sequence: Synthetic oligonucleotide
  Target: ATXN1; (+) strand; PAM type: YTN; PAM sequence: CTC
tgggaaagggctcactaaca

SEQ ID NO: 263949 - DNA, 20 bp, Artificial Sequence
  Description of Artificial Sequence: Synthetic oligonucleotide
  Target: ATXN1; (+) strand; PAM type: YTN; PAM sequence: CTG
ggaaagggctcactaacaac

SEQ ID NO: 263950 - DNA, 20 bp, Artificial Sequence
  Description of Artificial Sequence: Synthetic oligonucleotide
  Target: ATXN1; (+) strand; PAM type: YTN; PAM sequence: CTC
actaacaacccccgactgtt

SEQ ID NO: 263951 - DNA, 20 bp, Artificial Sequence
  Description of Artificial Sequence: Synthetic oligonucleotide
  Target: ATXN1; (+) strand; PAM type: YTN; PAM sequence: CTA
acaacccccgactgtttgga

SEQ ID NO: 263952 - DNA, 20 bp, Artificial Sequence
  Description of Artificial Sequence: Synthetic oligonucleotide
  Target: ATXN1; (+) strand; PAM type: YTN; PAM sequence: CTG
tttggagtcaggagcattgg

SEQ ID NO: 263953 - DNA, 20 bp, Artificial Sequence
  Description of Artificial Sequence: Synthetic oligonucleotide
  Target: ATXN1; (+) strand; PAM type: YTN; PAM sequence: TTT
ggagtcaggagcattggttt

SEQ ID NO: 263954 - DNA, 20 bp, Artificial Sequence
  Description of Artificial Sequence: Synthetic oligonucleotide
  Target: ATXN1; (+) strand; PAM type: YTN; PAM sequence: TTG
gagtcaggagcattggtttg

SEQ ID NO: 263955 - DNA, 20 bp, Artificial Sequence
  Description of Artificial Sequence: Synthetic oligonucleotide
  Target: ATXN1; (+) strand; PAM type: YTN; PAM sequence: TTG
gtttgcctggaaccagcttc

SEQ ID NO: 263956 - DNA, 20 bp, Artificial Sequence
  Description of Artificial Sequence: Synthetic oligonucleotide
  Target: ATXN1; (+) strand; PAM type: YTN; PAM sequence: TTT
gcctggaaccagcttctgct

SEQ ID NO: 263957 - DNA, 20 bp, Artificial Sequence
  Description of Artificial Sequence: Synthetic oligonucleotide
  Target: ATXN1; (+) strand; PAM type: YTN; PAM sequence: TTG
cctggaaccagcttctgctt

SEQ ID NO: 263958 - DNA, 20 bp, Artificial Sequence
  Description of Artificial Sequence: Synthetic oligonucleotide
  Target: ATXN1; (+) strand; PAM type: YTN; PAM sequence: CTG
gaaccagcttctgcttttcc

SEQ ID NO: 263959 - DNA, 20 bp, Artificial Sequence
  Description of Artificial Sequence: Synthetic oligonucleotide
  Target: ATXN1; (+) strand; PAM type: YTN; PAM sequence: CTT
ctgcttttcctgcacttccg

SEQ ID NO: 263960 - DNA, 20 bp, Artificial Sequence
  Description of Artificial Sequence: Synthetic oligonucleotide
  Target: ATXN1; (+) strand; PAM type: YTN; PAM sequence: TTC
tgcttttcctgcacttccgg

SEQ ID NO: 263961 - DNA, 20 bp, Artificial Sequence
  Description of Artificial Sequence: Synthetic oligonucleotide
  Target: ATXN1; (+) strand; PAM type: YTN; PAM sequence: CTG
cttttcctgcacttccgggc

SEQ ID NO: 263962 - DNA, 20 bp, Artificial Sequence
  Description of Artificial Sequence: Synthetic oligonucleotide
  Target: ATXN1; (+) strand; PAM type: YTN; PAM sequence: CTT
ttcctgcacttccgggctaa

SEQ ID NO: 263963 - DNA, 20 bp, Artificial Sequence
  Description of Artificial Sequence: Synthetic oligonucleotide
  Target: ATXN1; (+) strand; PAM type: YTN; PAM sequence: TTT
tcctgcacttccgggctaag

SEQ ID NO: 263964 - DNA, 20 bp, Artificial Sequence
  Description of Artificial Sequence: Synthetic oligonucleotide
  Target: ATXN1; (+) strand; PAM type: YTN; PAM sequence: TTT
cctgcacttccgggctaagc

SEQ ID NO: 263965 - DNA, 20 bp, Artificial Sequence
  Description of Artificial Sequence: Synthetic oligonucleotide
  Target: ATXN1; (+) strand; PAM type: YTN; PAM sequence: TTC
ctgcacttccgggctaagcc

SEQ ID NO: 263966 - DNA, 20 bp, Artificial Sequence
  Description of Artificial Sequence: Synthetic oligonucleotide
  Target: ATXN1; (+) strand; PAM type: YTN; PAM sequence: CTG
cacttccgggctaagcctag

SEQ ID NO: 263967 - DNA, 20 bp, Artificial Sequence
  Description of Artificial Sequence: Synthetic oligonucleotide
  Target: ATXN1; (+) strand; PAM type: YTN; PAM sequence: CTT
ccgggctaagcctagggtcg

SEQ ID NO: 263968 - DNA, 20 bp, Artificial Sequence
  Description of Artificial Sequence: Synthetic oligonucleotide
  Target: ATXN1; (+) strand; PAM type: YTN; PAM sequence: TTC
cgggctaagcctagggtcga

SEQ ID NO: 263969 - DNA, 20 bp, Artificial Sequence
  Description of Artificial Sequence: Synthetic oligonucleotide
  Target: ATXN1; (+) strand; PAM type: YTN; PAM sequence: CTA
agcctagggtcgacagagag

SEQ ID NO: 263970 - DNA, 20 bp, Artificial Sequence
  Description of Artificial Sequence: Synthetic oligonucleotide
  Target: ATXN1; (+) strand; PAM type: YTN; PAM sequence: CTA
gggtcgacagagaggaaagc

SEQ ID NO: 263971 - DNA, 20 bp, Artificial Sequence
  Description of Artificial Sequence: Synthetic oligonucleotide
  Target: ATXN1; (+) strand; PAM type: YTN; PAM sequence: TTC
agctccggggtctcaacaaa

SEQ ID NO: 263972 - DNA, 20 bp, Artificial Sequence
  Description of Artificial Sequence: Synthetic oligonucleotide
  Target: ATXN1; (+) strand; PAM type: YTN; PAM sequence: CTC
cggggtctcaacaaaaagtt

SEQ ID NO: 263973 - DNA, 20 bp, Artificial Sequence
  Description of Artificial Sequence: Synthetic oligonucleotide
  Target: ATXN1; (+) strand; PAM type: YTN; PAM sequence: CTC
aacaaaaagttggttggccc

SEQ ID NO: 263974 - DNA, 20 bp, Artificial Sequence
  Description of Artificial Sequence: Synthetic oligonucleotide
  Target: ATXN1; (+) strand; PAM type: YTN; PAM sequence: TTG
gttggccctgcagccatgag

SEQ ID NO: 263975 - DNA, 20 bp, Artificial Sequence
  Description of Artificial Sequence: Synthetic oligonucleotide
  Target: ATXN1; (+) strand; PAM type: YTN; PAM sequence: TTG
gccctgcagccatgagcaga

SEQ ID NO: 263976 - DNA, 20 bp, Artificial Sequence
  Description of Artificial Sequence: Synthetic oligonucleotide
  Target: ATXN1; (+) strand; PAM type: YTN; PAM sequence: CTG
cagccatgagcagaactctc

SEQ ID NO: 263977 - DNA, 20 bp, Artificial Sequence
  Description of Artificial Sequence: Synthetic oligonucleotide
  Target: ATXN1; (+) strand; PAM type: YTN; PAM sequence: CTC
tcaaagttacatagcccaaa

SEQ ID NO: 263978 - DNA, 20 bp, Artificial Sequence
  Description of Artificial Sequence: Synthetic oligonucleotide
  Target: ATXN1; (+) strand; PAM type: YTN; PAM sequence: CTC
aaagttacatagcccaaaca

SEQ ID NO: 263979 - DNA, 20 bp, Artificial Sequence
  Description of Artificial Sequence: Synthetic oligonucleotide
  Target: ATXN1; (+) strand; PAM type: YTN; PAM sequence: TTA
catagcccaaacaagactca

SEQ ID NO: 263980 - DNA, 20 bp, Artificial Sequence
  Description of Artificial Sequence: Synthetic oligonucleotide
  Target: ATXN1; (+) strand; PAM type: YTN; PAM sequence: CTC
acccatctatcctatctatc

SEQ ID NO: 263981 - DNA, 20 bp, Artificial Sequence
  Description of Artificial Sequence: Synthetic oligonucleotide
  Target: ATXN1; (+) strand; PAM type: YTN; PAM sequence: CTA
tcctatctatcctgaccctt

SEQ ID NO: 263982 - DNA, 20 bp, Artificial Sequence
  Description of Artificial Sequence: Synthetic oligonucleotide
  Target: ATXN1; (+) strand; PAM type: YTN; PAM sequence: CTA
tctatcctgacccttgcctc

SEQ ID NO: 263983 - DNA, 20 bp, Artificial Sequence
  Description of Artificial Sequence: Synthetic oligonucleotide
  Target: ATXN1; (+) strand; PAM type: YTN; PAM sequence: CTA
tcctgacccttgcctcctgg

SEQ ID NO: 263984 - DNA, 20 bp, Artificial Sequence
  Description of Artificial Sequence: Synthetic oligonucleotide
  Target: ATXN1; (+) strand; PAM type: YTN; PAM sequence: CTG
acccttgcctcctgggtcct

SEQ ID NO: 263985 - DNA, 20 bp, Artificial Sequence
  Description of Artificial Sequence: Synthetic oligonucleotide
  Target: ATXN1; (+) strand; PAM type: YTN; PAM sequence: CTT
gcctcctgggtcctaacacc

SEQ ID NO: 263986 - DNA, 20 bp, Artificial Sequence
  Description of Artificial Sequence: Synthetic oligonucleotide
  Target: ATXN1; (+) strand; PAM type: YTN; PAM sequence: TTG
cctcctgggtcctaacacct

SEQ ID NO: 263987 - DNA, 20 bp, Artificial Sequence
  Description of Artificial Sequence: Synthetic oligonucleotide
  Target: ATXN1; (+) strand; PAM type: YTN; PAM sequence: CTC
ctgggtcctaacacctgtca

SEQ ID NO: 263988 - DNA, 20 bp, Artificial Sequence
  Description of Artificial Sequence: Synthetic oligonucleotide
  Target: ATXN1; (+) strand; PAM type: YTN; PAM sequence: CTG
ggtcctaacacctgtcagac

SEQ ID NO: 263989 - DNA, 20 bp, Artificial Sequence
  Description of Artificial Sequence: Synthetic oligonucleotide
  Target: ATXN1; (+) strand; PAM type: YTN; PAM sequence: CTA
acacctgtcagacaaacttt

SEQ ID NO: 263990 - DNA, 20 bp, Artificial Sequence
  Description of Artificial Sequence: Synthetic oligonucleotide
  Target: ATXN1; (+) strand; PAM type: YTN; PAM sequence: CTG
tcagacaaactttctcccgc

SEQ ID NO: 263991 - DNA, 20 bp, Artificial Sequence
  Description of Artificial Sequence: Synthetic oligonucleotide
  Target: ATXN1; (+) strand; PAM type: YTN; PAM sequence: CTT
tctcccgcctctcttctcca

SEQ ID NO: 263992 - DNA, 20 bp, Artificial Sequence
  Description of Artificial Sequence: Synthetic oligonucleotide
  Target: ATXN1; (+) strand; PAM type: YTN; PAM sequence: TTT
ctcccgcctctcttctccaa

SEQ ID NO: 263993 - DNA, 20 bp, Artificial Sequence
  Description of Artificial Sequence: Synthetic oligonucleotide
  Target: ATXN1; (+) strand; PAM type: YTN; PAM sequence: TTC
tcccgcctctcttctccaag

SEQ ID NO: 263994 - DNA, 20 bp, Artificial Sequence
  Description of Artificial Sequence: Synthetic oligonucleotide
  Target: ATXN1; (+) strand; PAM type: YTN; PAM sequence: CTC
ccgcctctcttctccaaggt

SEQ ID NO: 263995 - DNA, 20 bp, Artificial Sequence
  Description of Artificial Sequence: Synthetic oligonucleotide
  Target: ATXN1; (+) strand; PAM type: YTN; PAM sequence: CTC
tcttctccaaggttagtctt

SEQ ID NO: 263996 - DNA, 20 bp, Artificial Sequence
  Description of Artificial Sequence: Synthetic oligonucleotide
  Target: ATXN1; (+) strand; PAM type: YTN; PAM sequence: CTC
ttctccaaggttagtcttgc

SEQ ID NO: 263997 - DNA, 20 bp, Artificial Sequence
  Description of Artificial Sequence: Synthetic oligonucleotide
  Target: ATXN1; (+) strand; PAM type: YTN; PAM sequence: CTT
ctccaaggttagtcttgctt

SEQ ID NO: 263998 - DNA, 20 bp, Artificial Sequence
  Description of Artificial Sequence: Synthetic oligonucleotide
  Target: ATXN1; (+) strand; PAM type: YTN; PAM sequence: TTC
tccaaggttagtcttgcttc

SEQ ID NO: 263999 - DNA, 20 bp, Artificial Sequence
  Description of Artificial Sequence: Synthetic oligonucleotide
  Target: ATXN1; (+) strand; PAM type: YTN; PAM sequence: CTC
caaggttagtcttgcttcta

SEQ ID NO: 264000 - DNA, 20 bp, Artificial Sequence
  Description of Artificial Sequence: Synthetic oligonucleotide
  Target: ATXN1; (+) strand; PAM type: YTN; PAM sequence: TTA
gtcttgcttctaaaaaccac

SEQ ID NO: 264001 - DNA, 20 bp, Artificial Sequence
  Description of Artificial Sequence: Synthetic oligonucleotide
  Target: ATXN1; (+) strand; PAM type: YTN; PAM sequence: CTT
gcttctaaaaaccactccct

SEQ ID NO: 264002 - DNA, 20 bp, Artificial Sequence
  Description of Artificial Sequence: Synthetic oligonucleotide
  Target: ATXN1; (+) strand; PAM type: YTN; PAM sequence: TTG
cttctaaaaaccactccctg

SEQ ID NO: 264003 - DNA, 20 bp, Artificial Sequence
  Description of Artificial Sequence: Synthetic oligonucleotide
  Target: ATXN1; (+) strand; PAM type: YTN; PAM sequence: CTT
ctaaaaaccactccctgtcc

SEQ ID NO: 264004 - DNA, 20 bp, Artificial Sequence
  Description of Artificial Sequence: Synthetic oligonucleotide
  Target: ATXN1; (+) strand; PAM type: YTN; PAM sequence: TTC
taaaaaccactccctgtccc

SEQ ID NO: 264005 - DNA, 20 bp, Artificial Sequence
  Description of Artificial Sequence: Synthetic oligonucleotide
  Target: ATXN1; (+) strand; PAM type: YTN; PAM sequence: CTA
aaaaccactccctgtccctg

SEQ ID NO: 264006 - DNA, 20 bp, Artificial Sequence
  Description of Artificial Sequence: Synthetic oligonucleotide
  Target: ATXN1; (+) strand; PAM type: YTN; PAM sequence: CTC
cctgtccctggtgctcttcc

SEQ ID NO: 264007 - DNA, 20 bp, Artificial Sequence
  Description of Artificial Sequence: Synthetic oligonucleotide
  Target: ATXN1; (+) strand; PAM type: YTN; PAM sequence: CTG
tccctggtgctcttccagtt

SEQ ID NO: 264008 - DNA, 20 bp, Artificial Sequence
  Description of Artificial Sequence: Synthetic oligonucleotide
  Target: ATXN1; (+) strand; PAM type: YTN; PAM sequence: CTG
gtgctcttccagtttctcct

SEQ ID NO: 264009 - DNA, 20 bp, Artificial Sequence
  Description of Artificial Sequence: Synthetic oligonucleotide
  Target: ATXN1; (+) strand; PAM type: YTN; PAM sequence: CTC
ttccagtttctcctataagg

SEQ ID NO: 264010 - DNA, 20 bp, Artificial Sequence
  Description of Artificial Sequence: Synthetic oligonucleotide
  Target: ATXN1; (+) strand; PAM type: YTN; PAM sequence: CTT
ccagtttctcctataaggat

SEQ ID NO: 264011 - DNA, 20 bp, Artificial Sequence
  Description of Artificial Sequence: Synthetic oligonucleotide
  Target: ATXN1; (+) strand; PAM type: YTN; PAM sequence: TTC
cagtttctcctataaggatg

SEQ ID NO: 264012 - DNA, 20 bp, Artificial Sequence
  Description of Artificial Sequence: Synthetic oligonucleotide
  Target: ATXN1; (+) strand; PAM type: YTN; PAM sequence: TTT
ctcctataaggatgatttct

SEQ ID NO: 264013 - DNA, 20 bp, Artificial Sequence
  Description of Artificial Sequence: Synthetic oligonucleotide
  Target: ATXN1; (+) strand; PAM type: YTN; PAM sequence: TTC
tcctataaggatgatttcta

SEQ ID NO: 264014 - DNA, 20 bp, Artificial Sequence
  Description of Artificial Sequence: Synthetic oligonucleotide
  Target: ATXN1; (+) strand; PAM type: YTN; PAM sequence: CTC
ctataaggatgatttctaat

SEQ ID NO: 264015 - DNA, 20 bp, Artificial Sequence
  Description of Artificial Sequence: Synthetic oligonucleotide
  Target: ATXN1; (+) strand; PAM type: YTN; PAM sequence: CTA
taaggatgatttctaatata

SEQ ID NO: 264016 - DNA, 20 bp, Artificial Sequence
  Description of Artificial Sequence: Synthetic oligonucleotide
  Target: ATXN1; (+) strand; PAM type: YTN; PAM sequence: TTT
ctaatataaatttcaggact

SEQ ID NO: 264017 - DNA, 20 bp, Artificial Sequence
  Description of Artificial Sequence: Synthetic oligonucleotide
  Target: ATXN1; (+) strand; PAM type: YTN; PAM sequence: TTC
taatataaatttcaggactc

SEQ ID NO: 264018 - DNA, 20 bp, Artificial Sequence
  Description of Artificial Sequence: Synthetic oligonucleotide
  Target: ATXN1; (+) strand; PAM type: YTN; PAM sequence: CTA
atataaatttcaggactctg

SEQ ID NO: 264019 - DNA, 20 bp, Artificial Sequence
  Description of Artificial Sequence: Synthetic oligonucleotide
  Target: ATXN1; (+) strand; PAM type: YTN; PAM sequence: TTT
caggactctgctcccttctt

SEQ ID NO: 264020 - DNA, 20 bp, Artificial Sequence
  Description of Artificial Sequence: Synthetic oligonucleotide
  Target: ATXN1; (+) strand; PAM type: YTN; PAM sequence: TTC
aggactctgctcccttcttt

SEQ ID NO: 264021 - DNA, 20 bp, Artificial Sequence
  Description of Artificial Sequence: Synthetic oligonucleotide
  Target: ATXN1; (+) strand; PAM type: YTN; PAM sequence: CTC
tgctcccttctttaggcacc

SEQ ID NO: 264022 - DNA, 20 bp, Artificial Sequence
  Description of Artificial Sequence: Synthetic oligonucleotide
  Target: ATXN1; (+) strand; PAM type: YTN; PAM sequence: CTG
ctcccttctttaggcaccca

SEQ ID NO: 264023 - DNA, 20 bp, Artificial Sequence
  Description of Artificial Sequence: Synthetic oligonucleotide
  Target: ATXN1; (+) strand; PAM type: YTN; PAM sequence: CTC
ccttctttaggcacccaggc

SEQ ID NO: 264024 - DNA, 20 bp, Artificial Sequence
  Description of Artificial Sequence: Synthetic oligonucleotide
  Target: ATXN1; (+) strand; PAM type: YTN; PAM sequence: CTT
ctttaggcacccaggctcac

SEQ ID NO: 264025 - DNA, 20 bp, Artificial Sequence
  Description of Artificial Sequence: Synthetic oligonucleotide
  Target: ATXN1; (+) strand; PAM type: YTN; PAM sequence: TTC
tttaggcacccaggctcacc

SEQ ID NO: 264026 - DNA, 20 bp, Artificial Sequence
  Description of Artificial Sequence: Synthetic oligonucleotide
  Target: ATXN1; (+) strand; PAM type: YTN; PAM sequence: CTT
taggcacccaggctcaccaa

SEQ ID NO: 264027 - DNA, 20 bp, Artificial Sequence
  Description of Artificial Sequence: Synthetic oligonucleotide
  Target: ATXN1; (+) strand; PAM type: YTN; PAM sequence: TTT
aggcacccaggctcaccaat

SEQ ID NO: 264028 - DNA, 20 bp, Artificial Sequence
  Description of Artificial Sequence: Synthetic oligonucleotide
  Target: ATXN1; (+) strand; PAM type: YTN; PAM sequence: TTA
ggcacccaggctcaccaatc

SEQ ID NO: 264029 - DNA, 20 bp, Artificial Sequence
  Description of Artificial Sequence: Synthetic oligonucleotide
  Target: ATXN1; (+) strand; PAM type: YTN; PAM sequence: CTC
accaatcagaaagacataat

SEQ ID NO: 264030 - DNA, 20 bp, Artificial Sequence
  Description of Artificial Sequence: Synthetic oligonucleotide
  Target: ATXN1; (+) strand; PAM type: YTN; PAM sequence: TTT
ttgtccaaagccctgttgtg

SEQ ID NO: 264031 - DNA, 20 bp, Artificial Sequence
  Description of Artificial Sequence: Synthetic oligonucleotide
  Target: ATXN1; (+) strand; PAM type: YTN; PAM sequence: TTT
tgtccaaagccctgttgtgg

SEQ ID NO: 264032 - DNA, 20 bp, Artificial Sequence
  Description of Artificial Sequence: Synthetic oligonucleotide
  Target: ATXN1; (+) strand; PAM type: YTN; PAM sequence: TTT
gtccaaagccctgttgtggg

SEQ ID NO: 264033 - DNA, 20 bp, Artificial Sequence
  Description of Artificial Sequence: Synthetic oligonucleotide
  Target: ATXN1; (+) strand; PAM type: YTN; PAM sequence: TTG
tccaaagccctgttgtgggg

SEQ ID NO: 264034 - DNA, 20 bp, Artificial Sequence
  Description of Artificial Sequence: Synthetic oligonucleotide
  Target: ATXN1; (+) strand; PAM type: YTN; PAM sequence: CTG
ttgtgggggactatctggaa

SEQ ID NO: 264035 - DNA, 20 bp, Artificial Sequence
  Description of Artificial Sequence: Synthetic oligonucleotide
  Target: ATXN1; (+) strand; PAM type: YTN; PAM sequence: TTG
tgggggactatctggaattt

SEQ ID NO: 264036 - DNA, 20 bp, Artificial Sequence
  Description of Artificial Sequence: Synthetic oligonucleotide
  Target: ATXN1; (+) strand; PAM type: YTN; PAM sequence: CTA
tctggaattttaggatccct

SEQ ID NO: 264037 - DNA, 20 bp, Artificial Sequence
  Description of Artificial Sequence: Synthetic oligonucleotide
  Target: ATXN1; (+) strand; PAM type: YTN; PAM sequence: CTG
gaattttaggatccctcctc

SEQ ID NO: 264038 - DNA, 20 bp, Artificial Sequence
  Description of Artificial Sequence: Synthetic oligonucleotide
  Target: ATXN1; (+) strand; PAM type: YTN; PAM sequence: TTT
taggatccctcctcagacta

SEQ ID NO: 264039 - DNA, 20 bp, Artificial Sequence
  Description of Artificial Sequence: Synthetic oligonucleotide
  Target: ATXN1; (+) strand; PAM type: YTN; PAM sequence: TTT
aggatccctcctcagactag

SEQ ID NO: 264040 - DNA, 20 bp, Artificial Sequence
  Description of Artificial Sequence: Synthetic oligonucleotide
  Target: ATXN1; (+) strand; PAM type: YTN; PAM sequence: TTA
ggatccctcctcagactagc

SEQ ID NO: 264041 - DNA, 20 bp, Artificial Sequence
  Description of Artificial Sequence: Synthetic oligonucleotide
  Target: ATXN1; (+) strand; PAM type: YTN; PAM sequence: CTC
ctcagactagcagacctaac

SEQ ID NO: 264042 - DNA, 20 bp, Artificial Sequence
  Description of Artificial Sequence: Synthetic oligonucleotide
  Target: ATXN1; (+) strand; PAM type: YTN; PAM sequence: CTC
agactagcagacctaacaaa

SEQ ID NO: 264043 - DNA, 20 bp, Artificial Sequence
  Description of Artificial Sequence: Synthetic oligonucleotide
  Target: ATXN1; (+) strand; PAM type: YTN; PAM sequence: CTA
gcagacctaacaaaggctat

SEQ ID NO: 264044 - DNA, 20 bp, Artificial Sequence
  Description of Artificial Sequence: Synthetic oligonucleotide
  Target: ATXN1; (+) strand; PAM type: YTN; PAM sequence: CTA
acaaaggctattcccaaagc

SEQ ID NO: 264045 - DNA, 20 bp, Artificial Sequence
  Description of Artificial Sequence: Synthetic oligonucleotide
  Target: ATXN1; (+) strand; PAM type: YTN; PAM sequence: CTA
ttcccaaagctaggatagga

SEQ ID NO: 264046 - DNA, 20 bp, Artificial Sequence
  Description of Artificial Sequence: Synthetic oligonucleotide
  Target: ATXN1; (+) strand; PAM type: YTN; PAM sequence: TTC
ccaaagctaggataggagga

SEQ ID NO: 264047 - DNA, 20 bp, Artificial Sequence
  Description of Artificial Sequence: Synthetic oligonucleotide
  Target: ATXN1; (+) strand; PAM type: YTN; PAM sequence: CTA
ggataggaggagactcagaa

SEQ ID NO: 264048 - DNA, 20 bp, Artificial Sequence
  Description of Artificial Sequence: Synthetic oligonucleotide
  Target: ATXN1; (+) strand; PAM type: YTN; PAM sequence: CTC
agaaattatatccttcctat

SEQ ID NO: 264049 - DNA, 20 bp, Artificial Sequence
  Description of Artificial Sequence: Synthetic oligonucleotide
  Target: ATXN1; (+) strand; PAM type: YTN; PAM sequence: TTA
tatccttcctattcatatga

SEQ ID NO: 264050 - DNA, 20 bp, Artificial Sequence
  Description of Artificial Sequence: Synthetic oligonucleotide
  Target: ATXN1; (+) strand; PAM type: YTN; PAM sequence: CTT
cctattcatatgataagtga

SEQ ID NO: 264051 - DNA, 20 bp, Artificial Sequence
  Description of Artificial Sequence: Synthetic oligonucleotide
  Target: ATXN1; (+) strand; PAM type: YTN; PAM sequence: TTC
ctattcatatgataagtgag

SEQ ID NO: 264052 - DNA, 20 bp, Artificial Sequence
  Description of Artificial Sequence: Synthetic oligonucleotide
  Target: ATXN1; (+) strand; PAM type: YTN; PAM sequence: CTA
ttcatatgataagtgaggac

SEQ ID NO: 264053 - DNA, 20 bp, Artificial Sequence
  Description of Artificial Sequence: Synthetic oligonucleotide
  Target: ATXN1; (+) strand; PAM type: YTN; PAM sequence: TTC
atatgataagtgaggacaaa

SEQ ID NO: 264054 - DNA, 20 bp, Artificial Sequence
  Description of Artificial Sequence: Synthetic oligonucleotide
  Target: ATXN1; (+) strand; PAM type: YTN; PAM sequence: CTC
ttccaaccctggagatccct

SEQ ID NO: 264055 - DNA, 20 bp, Artificial Sequence
  Description of Artificial Sequence: Synthetic oligonucleotide
  Target: ATXN1; (+) strand; PAM type: YTN; PAM sequence: CTT
ccaaccctggagatcccttc

SEQ ID NO: 264056 - DNA, 20 bp, Artificial Sequence
  Description of Artificial Sequence: Synthetic oligonucleotide
  Target: ATXN1; (+) strand; PAM type: YTN; PAM sequence: TTC
caaccctggagatcccttcc

SEQ ID NO: 264057 - DNA, 20 bp, Artificial Sequence
  Description of Artificial Sequence: Synthetic oligonucleotide
  Target: ATXN1; (+) strand; PAM type: YTN; PAM sequence: CTG
gagatcccttccttccctca

SEQ ID NO: 264058 - DNA, 20 bp, Artificial Sequence
  Description of Artificial Sequence: Synthetic oligonucleotide
  Target: ATXN1; (+) strand; PAM type: YTN; PAM sequence: CTT
ccttccctcagggtatggcc

SEQ ID NO: 264059 - DNA, 20 bp, Artificial Sequence
  Description of Artificial Sequence: Synthetic oligonucleotide
  Target: ATXN1; (+) strand; PAM type: YTN; PAM sequence: TTC
cttccctcagggtatggccc

SEQ ID NO: 264060 - DNA, 20 bp, Artificial Sequence
  Description of Artificial Sequence: Synthetic oligonucleotide
  Target: ATXN1; (+) strand; PAM type: YTN; PAM sequence: CTT
ccctcagggtatggccctcc

SEQ ID NO: 264061 - DNA, 20 bp, Artificial Sequence
  Description of Artificial Sequence: Synthetic oligonucleotide
  Target: ATXN1; (+) strand; PAM type: YTN; PAM sequence: TTC
cctcagggtatggccctcca

SEQ ID NO: 264062 - DNA, 20 bp, Artificial Sequence
  Description of Artificial Sequence: Synthetic oligonucleotide
  Target: ATXN1; (+) strand; PAM type: YTN; PAM sequence: CTC
agggtatggccctccactcc

SEQ ID NO: 264063 - DNA, 20 bp, Artificial Sequence
  Description of Artificial Sequence: Synthetic oligonucleotide
  Target: ATXN1; (+) strand; PAM type: YTN; PAM sequence: CTC
cactccattttgaggcatat

SEQ ID NO: 264064 - DNA, 20 bp, Artificial Sequence
  Description of Artificial Sequence: Synthetic oligonucleotide
  Target: ATXN1; (+) strand; PAM type: YTN; PAM sequence: CTC
cattttgaggcatattatct

SEQ ID NO: 264065 - DNA, 20 bp, Artificial Sequence
  Description of Artificial Sequence: Synthetic oligonucleotide
  Target: ATXN1; (+) strand; PAM type: YTN; PAM sequence: TTT
tgaggcatattatctttata

SEQ ID NO: 264066 - DNA, 20 bp, Artificial Sequence
  Description of Artificial Sequence: Synthetic oligonucleotide
  Target: ATXN1; (+) strand; PAM type: YTN; PAM sequence: TTT
gaggcatattatctttatag

SEQ ID NO: 264067 - DNA, 20 bp, Artificial Sequence
  Description of Artificial Sequence: Synthetic oligonucleotide
  Target: ATXN1; (+) strand; PAM type: YTN; PAM sequence: TTG
aggcatattatctttatagt

SEQ ID NO: 264068 - DNA, 20 bp, Artificial Sequence
  Description of Artificial Sequence: Synthetic oligonucleotide
  Target: ATXN1; (+) strand; PAM type: YTN; PAM sequence: TTA
tctttatagtacaagggtaa

SEQ ID NO: 264069 - DNA, 20 bp, Artificial Sequence
  Description of Artificial Sequence: Synthetic oligonucleotide
  Target: ATXN1; (+) strand; PAM type: YTN; PAM sequence: CTT
tatagtacaagggtaaggtc

SEQ ID NO: 264070 - DNA, 20 bp, Artificial Sequence
  Description of Artificial Sequence: Synthetic oligonucleotide
  Target: ATXN1; (+) strand; PAM type: YTN; PAM sequence: TTT
atagtacaagggtaaggtcc

SEQ ID NO: 264071 - DNA, 20 bp, Artificial Sequence
  Description of Artificial Sequence: Synthetic oligonucleotide
  Target: ATXN1; (+) strand; PAM type: YTN; PAM sequence: TTA
tagtacaagggtaaggtcct

SEQ ID NO: 264072 - DNA, 20 bp, Artificial Sequence
  Description of Artificial Sequence: Synthetic oligonucleotide
  Target: ATXN1; (+) strand; PAM type: YTN; PAM sequence: CTA
ataacaacaggagaaaacac

SEQ ID NO: 264073 - DNA, 20 bp, Artificial Sequence
  Description of Artificial Sequence: Synthetic oligonucleotide
  Target: ATXN1; (+) strand; PAM type: YTN; PAM sequence: CTT
aggactctaacaggttttca

SEQ ID NO: 264074 - DNA, 20 bp, Artificial Sequence
  Description of Artificial Sequence: Synthetic oligonucleotide
  Target: ATXN1; (+) strand; PAM type: YTN; PAM sequence: TTA
ggactctaacaggttttcaa

SEQ ID NO: 264075 - DNA, 20 bp, Artificial Sequence
  Description of Artificial Sequence: Synthetic oligonucleotide
  Target: ATXN1; (+) strand; PAM type: YTN; PAM sequence: CTC
taacaggttttcaagaatgc

SEQ ID NO: 264076 - DNA, 20 bp, Artificial Sequence
  Description of Artificial Sequence: Synthetic oligonucleotide
  Target: ATXN1; (+) strand; PAM type: YTN; PAM sequence: CTA
acaggttttcaagaatgcat

SEQ ID NO: 264077 - DNA, 20 bp, Artificial Sequence
  Description of Artificial Sequence: Synthetic oligonucleotide
  Target: ATXN1; (+) strand; PAM type: YTN; PAM sequence: TTT
tcaagaatgcattggtaagg

SEQ ID NO: 264078 - DNA, 20 bp, Artificial Sequence
  Description of Artificial Sequence: Synthetic oligonucleotide
  Target: ATXN1; (+) strand; PAM type: YTN; PAM sequence: TTT
caagaatgcattggtaaggg

SEQ ID NO: 264079 - DNA, 20 bp, Artificial Sequence
  Description of Artificial Sequence: Synthetic oligonucleotide
  Target: ATXN1; (+) strand; PAM type: YTN; PAM sequence: TTC
aagaatgcattggtaagggc

SEQ ID NO: 264080 - DNA, 20 bp, Artificial Sequence
  Description of Artificial Sequence: Synthetic oligonucleotide
  Target: ATXN1; (+) strand; PAM type: YTN; PAM sequence: TTG
gtaagggccactaaatctga

SEQ ID NO: 264081 - DNA, 20 bp, Artificial Sequence
  Description of Artificial Sequence: Synthetic oligonucleotide
  Target: ATXN1; (+) strand; PAM type: YTN; PAM sequence: CTA
aatctgacttttctcagtcc

SEQ ID NO: 264082 - DNA, 20 bp, Artificial Sequence
  Description of Artificial Sequence: Synthetic oligonucleotide
  Target: ATXN1; (+) strand; PAM type: YTN; PAM sequence: CTG
acttttctcagtcctctttg

SEQ ID NO: 264083 - DNA, 20 bp, Artificial Sequence
  Description of Artificial Sequence: Synthetic oligonucleotide
  Target: ATXN1; (+) strand; PAM type: YTN; PAM sequence: CTT
ttctcagtcctctttgtggt

SEQ ID NO: 264084 - DNA, 20 bp, Artificial Sequence
  Description of Artificial Sequence: Synthetic oligonucleotide
  Target: ATXN1; (+) strand; PAM type: YTN; PAM sequence: TTT
tctcagtcctctttgtggtc

SEQ ID NO: 264085 - DNA, 20 bp, Artificial Sequence
  Description of Artificial Sequence: Synthetic oligonucleotide
  Target: ATXN1; (+) strand; PAM type: YTN; PAM sequence: TTT
ctcagtcctctttgtggtct

SEQ ID NO: 264086 - DNA, 20 bp, Artificial Sequence
  Description of Artificial Sequence: Synthetic oligonucleotide
  Target: ATXN1; (+) strand; PAM type: YTN; PAM sequence: TTC
tcagtcctctttgtggtcta

SEQ ID NO: 264087 - DNA, 20 bp, Artificial Sequence
  Description of Artificial Sequence: Synthetic oligonucleotide
  Target: ATXN1; (+) strand; PAM type: YTN; PAM sequence: CTC
agtcctctttgtggtctaaa

SEQ ID NO: 264088 - DNA, 20 bp, Artificial Sequence
  Description of Artificial Sequence: Synthetic oligonucleotide
  Target: ATXN1; (+) strand; PAM type: YTN; PAM sequence: CTC
tttgtggtctaaagacgaaa

SEQ ID NO: 264089 - DNA, 20 bp, Artificial Sequence
  Description of Artificial Sequence: Synthetic oligonucleotide
  Target: ATXN1; (+) strand; PAM type: YTN; PAM sequence: CTT
tgtggtctaaagacgaaagg

SEQ ID NO: 264090 - DNA, 20 bp, Artificial Sequence
  Description of Artificial Sequence: Synthetic oligonucleotide
  Target: ATXN1; (+) strand; PAM type: YTN; PAM sequence: TTT
gtggtctaaagacgaaaggc

SEQ ID NO: 264091 - DNA, 20 bp, Artificial Sequence
  Description of Artificial Sequence: Synthetic oligonucleotide
  Target: ATXN1; (+) strand; PAM type: YTN; PAM sequence: TTG
tggtctaaagacgaaaggca

SEQ ID NO: 264092 - DNA, 20 bp, Artificial Sequence
  Description of Artificial Sequence: Synthetic oligonucleotide
  Target: ATXN1; (+) strand; PAM type: YTN; PAM sequence: CTA
aagacgaaaggcaagggtgc

SEQ ID NO: 264093 - DNA, 20 bp, Artificial Sequence
  Description of Artificial Sequence: Synthetic oligonucleotide
  Target: ATXN1; (+) strand; PAM type: YTN; PAM sequence: TTT
ttgagaatccattggtaagg

SEQ ID NO: 264094 - DNA, 20 bp, Artificial Sequence
  Description of Artificial Sequence: Synthetic oligonucleotide
  Target: ATXN1; (+) strand; PAM type: YTN; PAM sequence: TTT
tgagaatccattggtaaggg

SEQ ID NO: 264095 - DNA, 20 bp, Artificial Sequence
  Description of Artificial Sequence: Synthetic oligonucleotide
  Target: ATXN1; (+) strand; PAM type: YTN; PAM sequence: TTT
gagaatccattggtaagggc

SEQ ID NO: 264096 - DNA, 20 bp, Artificial Sequence
  Description of Artificial Sequence: Synthetic oligonucleotide
  Target: ATXN1; (+) strand; PAM type: YTN; PAM sequence: TTG
agaatccattggtaagggcc

SEQ ID NO: 264097 - DNA, 20 bp, Artificial Sequence
  Description of Artificial Sequence: Synthetic oligonucleotide
  Target: ATXN1; (+) strand; PAM type: YTN; PAM sequence: TTG
gtaagggccactaaatctga

SEQ ID NO: 264098 - DNA, 20 bp, Artificial Sequence
  Description of Artificial Sequence: Synthetic oligonucleotide
  Target: ATXN1; (+) strand; PAM type: YTN; PAM sequence: CTA
aatctgaccttcctcagtcc

SEQ ID NO: 264099 - DNA, 20 bp, Artificial Sequence
  Description of Artificial Sequence: Synthetic oligonucleotide
  Target: ATXN1; (+) strand; PAM type: YTN; PAM sequence: CTG
accttcctcagtcctttttg

SEQ ID NO: 264100 - DNA, 20 bp, Artificial Sequence
  Description of Artificial Sequence: Synthetic oligonucleotide
  Target: ATXN1; (+) strand; PAM type: YTN; PAM sequence: CTT
cctcagtcctttttgtggtc

SEQ ID NO: 264101 - DNA, 20 bp, Artificial Sequence
  Description of Artificial Sequence: Synthetic oligonucleotide
  Target: ATXN1; (+) strand; PAM type: YTN; PAM sequence: TTC
ctcagtcctttttgtggtct

SEQ ID NO: 264102 - DNA, 20 bp, Artificial Sequence
  Description of Artificial Sequence: Synthetic oligonucleotide
  Target: ATXN1; (+) strand; PAM type: YTN; PAM sequence: CTC
agtcctttttgtggtctagg

SEQ ID NO: 264103 - DNA, 20 bp, Artificial Sequence
  Description of Artificial Sequence: Synthetic oligonucleotide
  Target: ATXN1; (+) strand; PAM type: YTN; PAM sequence: CTT
tttgtggtctaggaggaaaa

SEQ ID NO: 264104 - DNA, 20 bp, Artificial Sequence
  Description of Artificial Sequence: Synthetic oligonucleotide
  Target: ATXN1; (+) strand; PAM type: YTN; PAM sequence: TTT
ttgtggtctaggaggaaaac

SEQ ID NO: 264105 - DNA, 20 bp, Artificial Sequence
  Description of Artificial Sequence: Synthetic oligonucleotide
  Target: ATXN1; (+) strand; PAM type: YTN; PAM sequence: TTT
tgtggtctaggaggaaaact

SEQ ID NO: 264106 - DNA, 20 bp, Artificial Sequence
  Description of Artificial Sequence: Synthetic oligonucleotide
  Target: ATXN1; (+) strand; PAM type: YTN; PAM sequence: TTT
gtggtctaggaggaaaacta

SEQ ID NO: 264107 - DNA, 20 bp, Artificial Sequence
  Description of Artificial Sequence: Synthetic oligonucleotide
  Target: ATXN1; (+) strand; PAM type: YTN; PAM sequence: TTG
tggtctaggaggaaaactag

SEQ ID NO: 264108 - DNA, 20 bp, Artificial Sequence
  Description of Artificial Sequence: Synthetic oligonucleotide
  Target: ATXN1; (+) strand; PAM type: YTN; PAM sequence: CTA
ggaggaaaactagtgtttcc

SEQ ID NO: 264109 - DNA, 20 bp, Artificial Sequence
  Description of Artificial Sequence: Synthetic oligonucleotide
  Target: ATXN1; (+) strand; PAM type: YTN; PAM sequence: CTA
gtgtttccgctgctgctttg

SEQ ID NO: 264110 - DNA, 20 bp, Artificial Sequence
  Description of Artificial Sequence: Synthetic oligonucleotide
  Target: ATXN1; (+) strand; PAM type: YTN; PAM sequence: TTT
ccgctgctgctttggtgagc

SEQ ID NO: 264111 - DNA, 20 bp, Artificial Sequence
  Description of Artificial Sequence: Synthetic oligonucleotide
  Target: ATXN1; (+) strand; PAM type: YTN; PAM sequence: TTC
cgctgctgctttggtgagca

SEQ ID NO: 264112 - DNA, 20 bp, Artificial Sequence
  Description of Artificial Sequence: Synthetic oligonucleotide
  Target: ATXN1; (+) strand; PAM type: YTN; PAM sequence: CTG
ctgctttggtgagcacagct

SEQ ID NO: 264113 - DNA, 20 bp, Artificial Sequence
  Description of Artificial Sequence: Synthetic oligonucleotide
  Target: ATXN1; (+) strand; PAM type: YTN; PAM sequence: CTG
ctttggtgagcacagctatt

SEQ ID NO: 264114 - DNA, 20 bp, Artificial Sequence
  Description of Artificial Sequence: Synthetic oligonucleotide
  Target: ATXN1; (+) strand; PAM type: YTN; PAM sequence: CTT
tggtgagcacagctattccg

SEQ ID NO: 264115 - DNA, 20 bp, Artificial Sequence
  Description of Artificial Sequence: Synthetic oligonucleotide
  Target: ATXN1; (+) strand; PAM type: YTN; PAM sequence: TTT
ggtgagcacagctattccga

SEQ ID NO: 264116 - DNA, 20 bp, Artificial Sequence
  Description of Artificial Sequence: Synthetic oligonucleotide
  Target: ATXN1; (+) strand; PAM type: YTN; PAM sequence: TTG
gtgagcacagctattccgaa

SEQ ID NO: 264117 - DNA, 20 bp, Artificial Sequence
  Description of Artificial Sequence: Synthetic oligonucleotide
  Target: ATXN1; (+) strand; PAM type: YTN; PAM sequence: CTA
ttccgaacagcaggatccag

SEQ ID NO: 264118 - DNA, 20 bp, Artificial Sequence
  Description of Artificial Sequence: Synthetic oligonucleotide
  Target: ATXN1; (+) strand; PAM type: YTN; PAM sequence: TTC
cgaacagcaggatccaggga

SEQ ID NO: 264119 - DNA, 20 bp, Artificial Sequence
  Description of Artificial Sequence: Synthetic oligonucleotide
  Target: ATXN1; (+) strand; PAM type: YTN; PAM sequence: CTG
ttgtgggttcttgggcaggg

SEQ ID NO: 264120 - DNA, 20 bp, Artificial Sequence
  Description of Artificial Sequence: Synthetic oligonucleotide
  Target: ATXN1; (+) strand; PAM type: YTN; PAM sequence: TTG
tgggttcttgggcagggaga

SEQ ID NO: 264121 - DNA, 20 bp, Artificial Sequence
  Description of Artificial Sequence: Synthetic oligonucleotide
  Target: ATXN1; (+) strand; PAM type: YTN; PAM sequence: TTC
ttgggcagggagaagagaaa

SEQ ID NO: 264122 - DNA, 20 bp, Artificial Sequence
  Description of Artificial Sequence: Synthetic oligonucleotide
  Target: ATXN1; (+) strand; PAM type: YTN; PAM sequence: CTT
gggcagggagaagagaaaaa

SEQ ID NO: 264123 - DNA, 20 bp, Artificial Sequence
  Description of Artificial Sequence: Synthetic oligonucleotide
  Target: ATXN1; (+) strand; PAM type: YTN; PAM sequence: TTG
ggcagggagaagagaaaaaa

SEQ ID NO: 264124 - DNA, 20 bp, Artificial Sequence
  Description of Artificial Sequence: Synthetic oligonucleotide
  Target: ATXN1; (+) strand; PAM type: YTN; PAM sequence: CTG
caggcggttttttctttcag

SEQ ID NO: 264125 - DNA, 20 bp, Artificial Sequence
  Description of Artificial Sequence: Synthetic oligonucleotide
  Target: ATXN1; (+) strand; PAM type: YTN; PAM sequence: TTT
tttctttcagatgggaaaca

SEQ ID NO: 264126 - DNA, 20 bp, Artificial Sequence
  Description of Artificial Sequence: Synthetic oligonucleotide
  Target: ATXN1; (+) strand; PAM type: YTN; PAM sequence: TTT
ttctttcagatgggaaacac

SEQ ID NO: 264127 - DNA, 20 bp, Artificial Sequence
  Description of Artificial Sequence: Synthetic oligonucleotide
  Target: ATXN1; (+) strand; PAM type: YTN; PAM sequence: TTT
tctttcagatgggaaacacc

SEQ ID NO: 264128 - DNA, 20 bp, Artificial Sequence
  Description of Artificial Sequence: Synthetic oligonucleotide
  Target: ATXN1; (+) strand; PAM type: YTN; PAM sequence: TTT
ctttcagatgggaaacaccc

SEQ ID NO: 264129 - DNA, 20 bp, Artificial Sequence
  Description of Artificial Sequence: Synthetic oligonucleotide
  Target: ATXN1; (+) strand; PAM type: YTN; PAM sequence: TTC
tttcagatgggaaacaccca

SEQ ID NO: 264130 - DNA, 20 bp, Artificial Sequence
  Description of Artificial Sequence: Synthetic oligonucleotide
  Target: ATXN1; (+) strand; PAM type: YTN; PAM sequence: CTT
tcagatgggaaacacccagg

SEQ ID NO: 264131 - DNA, 20 bp, Artificial Sequence
  Description of Artificial Sequence: Synthetic oligonucleotide
  Target: ATXN1; (+) strand; PAM type: YTN; PAM sequence: TTT
cagatgggaaacacccaggc

SEQ ID NO: 264132 - DNA, 20 bp, Artificial Sequence
  Description of Artificial Sequence: Synthetic oligonucleotide
  Target: ATXN1; (+) strand; PAM type: YTN; PAM sequence: TTC
agatgggaaacacccaggca

SEQ ID NO: 264133 - DNA, 20 bp, Artificial Sequence
  Description of Artificial Sequence: Synthetic oligonucleotide
  Target: ATXN1; (+) strand; PAM type: YTN; PAM sequence: CTC
acccttgaaacgcatcctaa

SEQ ID NO: 264134 - DNA, 20 bp, Artificial Sequence
  Description of Artificial Sequence: Synthetic oligonucleotide
  Target: ATXN1; (+) strand; PAM type: YTN; PAM sequence: CTT
gaaacgcatcctaagccatt

SEQ ID NO: 264135 - DNA, 20 bp, Artificial Sequence
  Description of Artificial Sequence: Synthetic oligonucleotide
  Target: ATXN1; (+) strand; PAM type: YTN; PAM sequence: TTG
aaacgcatcctaagccattg

SEQ ID NO: 264136 - DNA, 20 bp, Artificial Sequence
  Description of Artificial Sequence: Synthetic oligonucleotide
  Target: ATXN1; (+) strand; PAM type: YTN; PAM sequence: CTA
agccattgggaccaatttgt

SEQ ID NO: 264137 - DNA, 20 bp, Artificial Sequence
  Description of Artificial Sequence: Synthetic oligonucleotide
  Target: ATXN1; (+) strand; PAM type: YTN; PAM sequence: TTG
ggaccaatttgtcccgcaaa

SEQ ID NO: 264138 - DNA, 20 bp, Artificial Sequence
  Description of Artificial Sequence: Synthetic oligonucleotide
  Target: ATXN1; (+) strand; PAM type: YTN; PAM sequence: TTT
gtcccgcaaaccctgaaaaa

SEQ ID NO: 264139 - DNA, 20 bp, Artificial Sequence
  Description of Artificial Sequence: Synthetic oligonucleotide
  Target: ATXN1; (+) strand; PAM type: YTN; PAM sequence: TTG
tcccgcaaaccctgaaaaag

SEQ ID NO: 264140 - DNA, 20 bp, Artificial Sequence
  Description of Artificial Sequence: Synthetic oligonucleotide
  Target: ATXN1; (+) strand; PAM type: YTN; PAM sequence: CTG
aaaaagaagcggcttatttt

SEQ ID NO: 264141 - DNA, 20 bp, Artificial Sequence
  Description of Artificial Sequence: Synthetic oligonucleotide
  Target: ATXN1; (+) strand; PAM type: YTN; PAM sequence: CTT
attttttctgcactacggtc

SEQ ID NO: 264142 - DNA, 20 bp, Artificial Sequence
  Description of Artificial Sequence: Synthetic oligonucleotide
  Target: ATXN1; (+) strand; PAM type: YTN; PAM sequence: TTA
ttttttctgcactacggtct

SEQ ID NO: 264143 - DNA, 20 bp, Artificial Sequence
  Description of Artificial Sequence: Synthetic oligonucleotide
  Target: ATXN1; (+) strand; PAM type: YTN; PAM sequence: TTT
tttctgcactacggtctggc

SEQ ID NO: 264144 - DNA, 20 bp, Artificial Sequence
  Description of Artificial Sequence: Synthetic oligonucleotide
  Target: ATXN1; (+) strand; PAM type: YTN; PAM sequence: TTT
ttctgcactacggtctggcc

SEQ ID NO: 264145 - DNA, 20 bp, Artificial Sequence
  Description of Artificial Sequence: Synthetic oligonucleotide
  Target: ATXN1; (+) strand; PAM type: YTN; PAM sequence: TTT
tctgcactacggtctggcct

SEQ ID NO: 264146 - DNA, 20 bp, Artificial Sequence
  Description of Artificial Sequence: Synthetic oligonucleotide
  Target: ATXN1; (+) strand; PAM type: YTN; PAM sequence: TTT
ctgcactacggtctggcctt

SEQ ID NO: 264147 - DNA, 20 bp, Artificial Sequence
  Description of Artificial Sequence: Synthetic oligonucleotide
  Target: ATXN1; (+) strand; PAM type: YTN; PAM sequence: TTC
tgcactacggtctggcctta

SEQ ID NO: 264148 - DNA, 20 bp, Artificial Sequence
  Description of Artificial Sequence: Synthetic oligonucleotide
  Target: ATXN1; (+) strand; PAM type: YTN; PAM sequence: CTG
cactacggtctggccttaat

SEQ ID NO: 264149 - DNA, 20 bp, Artificial Sequence
  Description of Artificial Sequence: Synthetic oligonucleotide
  Target: ATXN1; (+) strand; PAM type: YTN; PAM sequence: CTA
cggtctggccttaatattat

SEQ ID NO: 264150 - DNA, 20 bp, Artificial Sequence
  Description of Artificial Sequence: Synthetic oligonucleotide
  Target: ATXN1; (+) strand; PAM type: YTN; PAM sequence: CTG
gccttaatattatctctcta

SEQ ID NO: 264151 - DNA, 20 bp, Artificial Sequence
  Description of Artificial Sequence: Synthetic oligonucleotide
  Target: ATXN1; (+) strand; PAM type: YTN; PAM sequence: CTT
aatattatctctctaatagg

SEQ ID NO: 264152 - DNA, 20 bp, Artificial Sequence
  Description of Artificial Sequence: Synthetic oligonucleotide
  Target: ATXN1; (+) strand; PAM type: YTN; PAM sequence: TTA
atattatctctctaataggg

SEQ ID NO: 264153 - DNA, 20 bp, Artificial Sequence
  Description of Artificial Sequence: Synthetic oligonucleotide
  Target: ATXN1; (+) strand; PAM type: YTN; PAM sequence: TTA
tctctctaatagggaaaaat

SEQ ID NO: 264154 - DNA, 20 bp, Artificial Sequence
  Description of Artificial Sequence: Synthetic oligonucleotide
  Target: ATXN1; (+) strand; PAM type: YTN; PAM sequence: CTC
tctaatagggaaaaatggtc

SEQ ID NO: 264155 - DNA, 20 bp, Artificial Sequence
  Description of Artificial Sequence: Synthetic oligonucleotide
  Target: ATXN1; (+) strand; PAM type: YTN; PAM sequence: CTC
taatagggaaaaatggtcac

SEQ ID NO: 264156 - DNA, 20 bp, Artificial Sequence
  Description of Artificial Sequence: Synthetic oligonucleotide
  Target: ATXN1; (+) strand; PAM type: YTN; PAM sequence: CTA
atagggaaaaatggtcacct

SEQ ID NO: 264157 - DNA, 20 bp, Artificial Sequence
  Description of Artificial Sequence: Synthetic oligonucleotide
  Target: ATXN1; (+) strand; PAM type: YTN; PAM sequence: CTG
agggaagtataaattacaac

SEQ ID NO: 264158 - DNA, 20 bp, Artificial Sequence
  Description of Artificial Sequence: Synthetic oligonucleotide
  Target: ATXN1; (+) strand; PAM type: YTN; PAM sequence: TTA
caacactattctgcaggttg

SEQ ID NO: 264159 - DNA, 20 bp, Artificial Sequence
  Description of Artificial Sequence: Synthetic oligonucleotide
  Target: ATXN1; (+) strand; PAM type: YTN; PAM sequence: CTA
ttctgcaggttgaccttttc

SEQ ID NO: 264160 - DNA, 20 bp, Artificial Sequence
  Description of Artificial Sequence: Synthetic oligonucleotide
  Target: ATXN1; (+) strand; PAM type: YTN; PAM sequence: TTC
tgcaggttgaccttttctgt

SEQ ID NO: 264161 - DNA, 20 bp, Artificial Sequence
  Description of Artificial Sequence: Synthetic oligonucleotide
  Target: ATXN1; (+) strand; PAM type: YTN; PAM sequence: CTG
caggttgaccttttctgtaa

SEQ ID NO: 264162 - DNA, 20 bp, Artificial Sequence
  Description of Artificial Sequence: Synthetic oligonucleotide
  Target: ATXN1; (+) strand; PAM type: YTN; PAM sequence: TTG
accttttctgtaagagggaa

SEQ ID NO: 264163 - DNA, 20 bp, Artificial Sequence
  Description of Artificial Sequence: Synthetic oligonucleotide
  Target: ATXN1; (+) strand; PAM type: YTN; PAM sequence: CTT
ttctgtaagagggaagggaa

SEQ ID NO: 264164 - DNA, 20 bp, Artificial Sequence
  Description of Artificial Sequence: Synthetic oligonucleotide
  Target: ATXN1; (+) strand; PAM type: YTN; PAM sequence: TTT
tctgtaagagggaagggaaa

SEQ ID NO: 264165 - DNA, 20 bp, Artificial Sequence
  Description of Artificial Sequence: Synthetic oligonucleotide
  Target: ATXN1; (+) strand; PAM type: YTN; PAM sequence: TTT
ctgtaagagggaagggaaat

SEQ ID NO: 264166 - DNA, 20 bp, Artificial Sequence
  Description of Artificial Sequence: Synthetic oligonucleotide
  Target: ATXN1; (+) strand; PAM type: YTN; PAM sequence: TTC
tgtaagagggaagggaaatg

SEQ ID NO: 264167 - DNA, 20 bp, Artificial Sequence
  Description of Artificial Sequence: Synthetic oligonucleotide
  Target: ATXN1; (+) strand; PAM type: YTN; PAM sequence: CTG
taagagggaagggaaatgga

SEQ ID NO: 264168 - DNA, 20 bp, Artificial Sequence
  Description of Artificial Sequence: Synthetic oligonucleotide
  Target: ATXN1; (+) strand; PAM type: YTN; PAM sequence: CTT
atgtccaagctttcttttta

SEQ ID NO: 264169 - DNA, 20 bp, Artificial Sequence
  Description of Artificial Sequence: Synthetic oligonucleotide
  Target: ATXN1; (+) strand; PAM type: YTN; PAM sequence: TTA
tgtccaagctttctttttac

SEQ ID NO: 264170 - DNA, 20 bp, Artificial Sequence
  Description of Artificial Sequence: Synthetic oligonucleotide
  Target: ATXN1; (+) strand; PAM type: YTN; PAM sequence: CTT
tctttttactgaaggataat

SEQ ID NO: 264171 - DNA, 20 bp, Artificial Sequence
  Description of Artificial Sequence: Synthetic oligonucleotide
  Target: ATXN1; (+) strand; PAM type: YTN; PAM sequence: TTT
ctttttactgaaggataatc

SEQ ID NO: 264172 - DNA, 20 bp, Artificial Sequence
  Description of Artificial Sequence: Synthetic oligonucleotide
  Target: ATXN1; (+) strand; PAM type: YTN; PAM sequence: TTC
tttttactgaaggataatcc

SEQ ID NO: 264173 - DNA, 20 bp, Artificial Sequence
  Description of Artificial Sequence: Synthetic oligonucleotide
  Target: ATXN1; (+) strand; PAM type: YTN; PAM sequence: CTT
tttactgaaggataatccac

SEQ ID NO: 264174 - DNA, 20 bp, Artificial Sequence
  Description of Artificial Sequence: Synthetic oligonucleotide
  Target: ATXN1; (+) strand; PAM type: YTN; PAM sequence: TTT
ttactgaaggataatccaca

SEQ ID NO: 264175 - DNA, 20 bp, Artificial Sequence
  Description of Artificial Sequence: Synthetic oligonucleotide
  Target: ATXN1; (+) strand; PAM type: YTN; PAM sequence: TTT
tactgaaggataatccacaa

SEQ ID NO: 264176 - DNA, 20 bp, Artificial Sequence
  Description of Artificial Sequence: Synthetic oligonucleotide
  Target: ATXN1; (+) strand; PAM type: YTN; PAM sequence: TTT
actgaaggataatccacaac

SEQ ID NO: 264177 - DNA, 20 bp, Artificial Sequence
  Description of Artificial Sequence: Synthetic oligonucleotide
  Target: ATXN1; (+) strand; PAM type: YTN; PAM sequence: TTA
ctgaaggataatccacaact

SEQ ID NO: 264178 - DNA, 20 bp, Artificial Sequence
  Description of Artificial Sequence: Synthetic oligonucleotide
  Target: ATXN1; (+) strand; PAM type: YTN; PAM sequence: CTG
aaggataatccacaactatg

SEQ ID NO: 264179 - DNA, 20 bp, Artificial Sequence
  Description of Artificial Sequence: Synthetic oligonucleotide
  Target: ATXN1; (+) strand; PAM type: YTN; PAM sequence: CTA
tgcaaagctggcgatttaca

SEQ ID NO: 264180 - DNA, 20 bp, Artificial Sequence
  Description of Artificial Sequence: Synthetic oligonucleotide
  Target: ATXN1; (+) strand; PAM type: YTN; PAM sequence: CTG
gcgatttacattccacagga

SEQ ID NO: 264181 - DNA, 20 bp, Artificial Sequence
  Description of Artificial Sequence: Synthetic oligonucleotide
  Target: ATXN1; (+) strand; PAM type: YTN; PAM sequence: TTT
acattccacaggaggacctc

SEQ ID NO: 264182 - DNA, 20 bp, Artificial Sequence
  Description of Artificial Sequence: Synthetic oligonucleotide
  Target: ATXN1; (+) strand; PAM type: YTN; PAM sequence: TTA
cattccacaggaggacctct

SEQ ID NO: 264183 - DNA, 20 bp, Artificial Sequence
  Description of Artificial Sequence: Synthetic oligonucleotide
  Target: ATXN1; (+) strand; PAM type: YTN; PAM sequence: TTC
cacaggaggacctctcagat

SEQ ID NO: 264184 - DNA, 20 bp, Artificial Sequence
  Description of Artificial Sequence: Synthetic oligonucleotide
  Target: ATXN1; (+) strand; PAM type: YTN; PAM sequence: CTC
tcagattacctccatatcct

SEQ ID NO: 264185 - DNA, 20 bp, Artificial Sequence
  Description of Artificial Sequence: Synthetic oligonucleotide
  Target: ATXN1; (+) strand; PAM type: YTN; PAM sequence: CTC
agattacctccatatcctag

SEQ ID NO: 264186 - DNA, 20 bp, Artificial Sequence
  Description of Artificial Sequence: Synthetic oligonucleotide
  Target: ATXN1; (+) strand; PAM type: YTN; PAM sequence: TTA
cctccatatcctagcctccc

SEQ ID NO: 264187 - DNA, 20 bp, Artificial Sequence
  Description of Artificial Sequence: Synthetic oligonucleotide
  Target: ATXN1; (+) strand; PAM type: YTN; PAM sequence: CTC
catatcctagcctccctaca

SEQ ID NO: 264188 - DNA, 20 bp, Artificial Sequence
  Description of Artificial Sequence: Synthetic oligonucleotide
  Target: ATXN1; (+) strand; PAM type: YTN; PAM sequence: CTA
gcctccctacagctcccctt

SEQ ID NO: 264189 - DNA, 20 bp, Artificial Sequence
  Description of Artificial Sequence: Synthetic oligonucleotide
  Target: ATXN1; (+) strand; PAM type: YTN; PAM sequence: CTC
cctacagctccccttcctat

SEQ ID NO: 264190 - DNA, 20 bp, Artificial Sequence
  Description of Artificial Sequence: Synthetic oligonucleotide
  Target: ATXN1; (+) strand; PAM type: YTN; PAM sequence: CTA
cagctccccttcctattaat

SEQ ID NO: 264191 - DNA, 20 bp, Artificial Sequence
  Description of Artificial Sequence: Synthetic oligonucleotide
  Target: ATXN1; (+) strand; PAM type: YTN; PAM sequence: CTC
cccttcctattaatgatgag

SEQ ID NO: 264192 - DNA, 20 bp, Artificial Sequence
  Description of Artificial Sequence: Synthetic oligonucleotide
  Target: ATXN1; (+) strand; PAM type: YTN; PAM sequence: CTT
cctattaatgatgagcctcc

SEQ ID NO: 264193 - DNA, 20 bp, Artificial Sequence
  Description of Artificial Sequence: Synthetic oligonucleotide
  Target: ATXN1; (+) strand; PAM type: YTN; PAM sequence: TTC
ctattaatgatgagcctcct

SEQ ID NO: 264194 - DNA, 20 bp, Artificial Sequence
  Description of Artificial Sequence: Synthetic oligonucleotide
  Target: ATXN1; (+) strand; PAM type: YTN; PAM sequence: CTA
ttaatgatgagcctcctcta

SEQ ID NO: 264195 - DNA, 20 bp, Artificial Sequence
  Description of Artificial Sequence: Synthetic oligonucleotide
  Target: ATXN1; (+) strand; PAM type: YTN; PAM sequence: TTA
atgatgagcctcctctaatc

SEQ ID NO: 264196 - DNA, 20 bp, Artificial Sequence
  Description of Artificial Sequence: Synthetic oligonucleotide
  Target: ATXN1; (+) strand; PAM type: YTN; PAM sequence: CTC
ctctaatctcctccatccag

SEQ ID NO: 264197 - DNA, 20 bp, Artificial Sequence
  Description of Artificial Sequence: Synthetic oligonucleotide
  Target: ATXN1; (+) strand; PAM type: YTN; PAM sequence: CTC
taatctcctccatccagaag

SEQ ID NO: 264198 - DNA, 20 bp, Artificial Sequence
  Description of Artificial Sequence: Synthetic oligonucleotide
  Target: ATXN1; (+) strand; PAM type: YTN; PAM sequence: CTA
atctcctccatccagaagga

SEQ ID NO: 264199 - DNA, 20 bp, Artificial Sequence
  Description of Artificial Sequence: Synthetic oligonucleotide
  Target: ATXN1; (+) strand; PAM type: YTN; PAM sequence: CTC
ctccatccagaaggaaacaa

SEQ ID NO: 264200 - DNA, 20 bp, Artificial Sequence
  Description of Artificial Sequence: Synthetic oligonucleotide
  Target: ATXN1; (+) strand; PAM type: YTN; PAM sequence: CTC
catccagaaggaaacaagca

SEQ ID NO: 264201 - DNA, 20 bp, Artificial Sequence
  Description of Artificial Sequence: Synthetic oligonucleotide
  Target: ATXN1; (+) strand; PAM type: YTN; PAM sequence: TTT
ccaaaggaccaccaaacccc

SEQ ID NO: 264202 - DNA, 20 bp, Artificial Sequence
  Description of Artificial Sequence: Synthetic oligonucleotide
  Target: ATXN1; (+) strand; PAM type: YTN; PAM sequence: TTC
caaaggaccaccaaacccct

SEQ ID NO: 264203 - DNA, 20 bp, Artificial Sequence
  Description of Artificial Sequence: Synthetic oligonucleotide
  Target: ATXN1; (+) strand; PAM type: YTN; PAM sequence: CTC
aggctatcagttatgtctcc

SEQ ID NO: 264204 - DNA, 20 bp, Artificial Sequence
  Description of Artificial Sequence: Synthetic oligonucleotide
  Target: ATXN1; (+) strand; PAM type: YTN; PAM sequence: CTA
tcagttatgtctcctttaag

SEQ ID NO: 264205 - DNA, 20 bp, Artificial Sequence
  Description of Artificial Sequence: Synthetic oligonucleotide
  Target: ATXN1; (+) strand; PAM type: YTN; PAM sequence: TTA
tgtctcctttaagctgtagg

SEQ ID NO: 264206 - DNA, 20 bp, Artificial Sequence
  Description of Artificial Sequence: Synthetic oligonucleotide
  Target: ATXN1; (+) strand; PAM type: YTN; PAM sequence: CTC
ctttaagctgtagggggagg

SEQ ID NO: 264207 - DNA, 20 bp, Artificial Sequence
  Description of Artificial Sequence: Synthetic oligonucleotide
  Target: ATXN1; (+) strand; PAM type: YTN; PAM sequence: CTT
taagctgtagggggagggga

SEQ ID NO: 264208 - DNA, 20 bp, Artificial Sequence
  Description of Artificial Sequence: Synthetic oligonucleotide
  Target: ATXN1; (+) strand; PAM type: YTN; PAM sequence: TTT
aagctgtagggggaggggaa

SEQ ID NO: 264209 - DNA, 20 bp, Artificial Sequence
  Description of Artificial Sequence: Synthetic oligonucleotide
  Target: ATXN1; (+) strand; PAM type: YTN; PAM sequence: TTA
agctgtagggggaggggaat

SEQ ID NO: 264210 - DNA, 20 bp, Artificial Sequence
  Description of Artificial Sequence: Synthetic oligonucleotide
  Target: ATXN1; (+) strand; PAM type: YTN; PAM sequence: CTG
tagggggaggggaatttggc

SEQ ID NO: 264211 - DNA, 20 bp, Artificial Sequence
  Description of Artificial Sequence: Synthetic oligonucleotide
  Target: ATXN1; (+) strand; PAM type: YTN; PAM sequence: TTT
ggcccaacatgggaccttct

SEQ ID NO: 264212 - DNA, 20 bp, Artificial Sequence
  Description of Artificial Sequence: Synthetic oligonucleotide
  Target: ATXN1; (+) strand; PAM type: YTN; PAM sequence: TTG
gcccaacatgggaccttctc

SEQ ID NO: 264213 - DNA, 20 bp, Artificial Sequence
  Description of Artificial Sequence: Synthetic oligonucleotide
  Target: ATXN1; (+) strand; PAM type: YTN; PAM sequence: CTT
ctctctctctgaattaaagc

SEQ ID NO: 264214 - DNA, 20 bp, Artificial Sequence
  Description of Artificial Sequence: Synthetic oligonucleotide
  Target: ATXN1; (+) strand; PAM type: YTN; PAM sequence: TTC
tctctctctgaattaaagca

SEQ ID NO: 264215 - DNA, 20 bp, Artificial Sequence
  Description of Artificial Sequence: Synthetic oligonucleotide
  Target: ATXN1; (+) strand; PAM type: YTN; PAM sequence: CTC
tctctctgaattaaagcaga

SEQ ID NO: 264216 - DNA, 20 bp, Artificial Sequence
  Description of Artificial Sequence: Synthetic oligonucleotide
  Target: ATXN1; (+) strand; PAM type: YTN; PAM sequence: CTC
tctctgaattaaagcagatc

SEQ ID NO: 264217 - DNA, 20 bp, Artificial Sequence
  Description of Artificial Sequence: Synthetic oligonucleotide
  Target: ATXN1; (+) strand; PAM type: YTN; PAM sequence: CTC
tctgaattaaagcagatcaa

SEQ ID NO: 264218 - DNA, 20 bp, Artificial Sequence
  Description of Artificial Sequence: Synthetic oligonucleotide
  Target: ATXN1; (+) strand; PAM type: YTN; PAM sequence: CTC
tgaattaaagcagatcaagg

SEQ ID NO: 264219 - DNA, 20 bp, Artificial Sequence
  Description of Artificial Sequence: Synthetic oligonucleotide
  Target: ATXN1; (+) strand; PAM type: YTN; PAM sequence: CTG
aattaaagcagatcaaggta

SEQ ID NO: 264220 - DNA, 20 bp, Artificial Sequence
  Description of Artificial Sequence: Synthetic oligonucleotide
  Target: ATXN1; (+) strand; PAM type: YTN; PAM sequence: TTA
aagcagatcaaggtagacct

SEQ ID NO: 264221 - DNA, 20 bp, Artificial Sequence
  Description of Artificial Sequence: Synthetic oligonucleotide
  Target: ATXN1; (+) strand; PAM type: YTN; PAM sequence: CTG
ggaaagttttcagatgatcc

SEQ ID NO: 264222 - DNA, 20 bp, Artificial Sequence
  Description of Artificial Sequence: Synthetic oligonucleotide
  Target: ATXN1; (+) strand; PAM type: YTN; PAM sequence: TTT
tcagatgatcctggtaggta

SEQ ID NO: 264223 - DNA, 20 bp, Artificial Sequence
  Description of Artificial Sequence: Synthetic oligonucleotide
  Target: ATXN1; (+) strand; PAM type: YTN; PAM sequence: TTT
cagatgatcctggtaggtat

SEQ ID NO: 264224 - DNA, 20 bp, Artificial Sequence
  Description of Artificial Sequence: Synthetic oligonucleotide
  Target: ATXN1; (+) strand; PAM type: YTN; PAM sequence: TTC
agatgatcctggtaggtata

SEQ ID NO: 264225 - DNA, 20 bp, Artificial Sequence
  Description of Artificial Sequence: Synthetic oligonucleotide
  Target: ATXN1; (+) strand; PAM type: YTN; PAM sequence: CTG
gtaggtatatagatgtccta

SEQ ID NO: 264226 - DNA, 20 bp, Artificial Sequence
  Description of Artificial Sequence: Synthetic oligonucleotide
  Target: ATXN1; (+) strand; PAM type: YTN; PAM sequence: CTA
cagggtccagggcaaacctt

SEQ ID NO: 264227 - DNA, 20 bp, Artificial Sequence
  Description of Artificial Sequence: Synthetic oligonucleotide
  Target: ATXN1; (+) strand; PAM type: YTN; PAM sequence: CTT
cgacctcacttggagagatg

SEQ ID NO: 264228 - DNA, 20 bp, Artificial Sequence
  Description of Artificial Sequence: Synthetic oligonucleotide
  Target: ATXN1; (+) strand; PAM type: YTN; PAM sequence: TTC
gacctcacttggagagatgt

SEQ ID NO: 264229 - DNA, 20 bp, Artificial Sequence
  Description of Artificial Sequence: Synthetic oligonucleotide
  Target: ATXN1; (+) strand; PAM type: YTN; PAM sequence: CTC
acttggagagatgtcatgct

SEQ ID NO: 264230 - DNA, 20 bp, Artificial Sequence
  Description of Artificial Sequence: Synthetic oligonucleotide
  Target: ATXN1; (+) strand; PAM type: YTN; PAM sequence: CTT
ggagagatgtcatgctattg

SEQ ID NO: 264231 - DNA, 20 bp, Artificial Sequence
  Description of Artificial Sequence: Synthetic oligonucleotide
  Target: ATXN1; (+) strand; PAM type: YTN; PAM sequence: TTG
gagagatgtcatgctattgt

SEQ ID NO: 264232 - DNA, 20 bp, Artificial Sequence
  Description of Artificial Sequence: Synthetic oligonucleotide
  Target: ATXN1; (+) strand; PAM type: YTN; PAM sequence: CTA
ttgttagatcaaaccctggc

SEQ ID NO: 264233 - DNA, 20 bp, Artificial Sequence
  Description of Artificial Sequence: Synthetic oligonucleotide
  Target: ATXN1; (+) strand; PAM type: YTN; PAM sequence: TTG
ttagatcaaaccctggcctt

SEQ ID NO: 264234 - DNA, 20 bp, Artificial Sequence
  Description of Artificial Sequence: Synthetic oligonucleotide
  Target: ATXN1; (+) strand; PAM type: YTN; PAM sequence: TTA
gatcaaaccctggcctttaa

SEQ ID NO: 264235 - DNA, 20 bp, Artificial Sequence
  Description of Artificial Sequence: Synthetic oligonucleotide
  Target: ATXN1; (+) strand; PAM type: YTN; PAM sequence: CTG
gcctttaatgaaaagaatgc

SEQ ID NO: 264236 - DNA, 20 bp, Artificial Sequence
  Description of Artificial Sequence: Synthetic oligonucleotide
  Target: ATXN1; (+) strand; PAM type: YTN; PAM sequence: CTT
taatgaaaagaatgcagctt

SEQ ID NO: 264237 - DNA, 20 bp, Artificial Sequence
  Description of Artificial Sequence: Synthetic oligonucleotide
  Target: ATXN1; (+) strand; PAM type: YTN; PAM sequence: TTT
aatgaaaagaatgcagcttt

SEQ ID NO: 264238 - DNA, 20 bp, Artificial Sequence
  Description of Artificial Sequence: Synthetic oligonucleotide
  Target: ATXN1; (+) strand; PAM type: YTN; PAM sequence: TTA
atgaaaagaatgcagcttta

SEQ ID NO: 264239 - DNA, 20 bp, Artificial Sequence
  Description of Artificial Sequence: Synthetic oligonucleotide
  Target: ATXN1; (+) strand; PAM type: YTN; PAM sequence: CTT
tagctgcagcccgagaattt

SEQ ID NO: 264240 - DNA, 20 bp, Artificial Sequence
  Description of Artificial Sequence: Synthetic oligonucleotide
  Target: ATXN1; (+) strand; PAM type: YTN; PAM sequence: TTT
agctgcagcccgagaatttg

SEQ ID NO: 264241 - DNA, 20 bp, Artificial Sequence
  Description of Artificial Sequence: Synthetic oligonucleotide
  Target: ATXN1; (+) strand; PAM type: YTN; PAM sequence: TTA
gctgcagcccgagaatttgg

SEQ ID NO: 264242 - DNA, 20 bp, Artificial Sequence
  Description of Artificial Sequence: Synthetic oligonucleotide
  Target: ATXN1; (+) strand; PAM type: YTN; PAM sequence: CTG
cagcccgagaatttggagat

SEQ ID NO: 264243 - DNA, 20 bp, Artificial Sequence
  Description of Artificial Sequence: Synthetic oligonucleotide
  Target: ATXN1; (+) strand; PAM type: YTN; PAM sequence: TTT
ggagatacctggtatcttag

SEQ ID NO: 264244 - DNA, 20 bp, Artificial Sequence
  Description of Artificial Sequence: Synthetic oligonucleotide
  Target: ATXN1; (+) strand; PAM type: YTN; PAM sequence: TTG
gagatacctggtatcttagt

SEQ ID NO: 264245 - DNA, 20 bp, Artificial Sequence
  Description of Artificial Sequence: Synthetic oligonucleotide
  Target: ATXN1; (+) strand; PAM type: YTN; PAM sequence: CTG
gtatcttagtcaagtaaatg

SEQ ID NO: 264246 - DNA, 20 bp, Artificial Sequence
  Description of Artificial Sequence: Synthetic oligonucleotide
  Target: ATXN1; (+) strand; PAM type: YTN; PAM sequence: CTT
agtcaagtaaatgacaaaat

SEQ ID NO: 264247 - DNA, 20 bp, Artificial Sequence
  Description of Artificial Sequence: Synthetic oligonucleotide
  Target: ATXN1; (+) strand; PAM type: YTN; PAM sequence: TTA
gtcaagtaaatgacaaaatg

SEQ ID NO: 264248 - DNA, 20 bp, Artificial Sequence
  Description of Artificial Sequence: Synthetic oligonucleotide
  Target: ATXN1; (+) strand; PAM type: YTN; PAM sequence: TTC
cctaatgggcagcaagccat

SEQ ID NO: 264249 - DNA, 20 bp, Artificial Sequence
  Description of Artificial Sequence: Synthetic oligonucleotide
  Target: ATXN1; (+) strand; PAM type: YTN; PAM sequence: CTA
atgggcagcaagccatcccc

SEQ ID NO: 264250 - DNA, 20 bp, Artificial Sequence
  Description of Artificial Sequence: Synthetic oligonucleotide
  Target: ATXN1; (+) strand; PAM type: YTN; PAM sequence: TTA
tggatccccactgggaccta

SEQ ID NO: 264251 - DNA, 20 bp, Artificial Sequence
  Description of Artificial Sequence: Synthetic oligonucleotide
  Target: ATXN1; (+) strand; PAM type: YTN; PAM sequence: CTG
ggacctagactcagatcatg

SEQ ID NO: 264252 - DNA, 20 bp, Artificial Sequence
  Description of Artificial Sequence: Synthetic oligonucleotide
  Target: ATXN1; (+) strand; PAM type: YTN; PAM sequence: CTA
gactcagatcatgggaactg

SEQ ID NO: 264253 - DNA, 20 bp, Artificial Sequence
  Description of Artificial Sequence: Synthetic oligonucleotide
  Target: ATXN1; (+) strand; PAM type: YTN; PAM sequence: CTC
agatcatgggaactggagtc

SEQ ID NO: 264254 - DNA, 20 bp, Artificial Sequence
  Description of Artificial Sequence: Synthetic oligonucleotide
  Target: ATXN1; (+) strand; PAM type: YTN; PAM sequence: CTG
gagtcgcaaacatctgttga

SEQ ID NO: 264255 - DNA, 20 bp, Artificial Sequence
  Description of Artificial Sequence: Synthetic oligonucleotide
  Target: ATXN1; (+) strand; PAM type: YTN; PAM sequence: CTG
ttgacctgtattccagaagg

SEQ ID NO: 264256 - DNA, 20 bp, Artificial Sequence
  Description of Artificial Sequence: Synthetic oligonucleotide
  Target: ATXN1; (+) strand; PAM type: YTN; PAM sequence: TTG
acctgtattccagaaggact

SEQ ID NO: 264257 - DNA, 20 bp, Artificial Sequence
  Description of Artificial Sequence: Synthetic oligonucleotide
  Target: ATXN1; (+) strand; PAM type: YTN; PAM sequence: CTG
tattccagaaggactaagga

SEQ ID NO: 264258 - DNA, 20 bp, Artificial Sequence
  Description of Artificial Sequence: Synthetic oligonucleotide
  Target: ATXN1; (+) strand; PAM type: YTN; PAM sequence: TTC
cagaaggactaaggagaatt

SEQ ID NO: 264259 - DNA, 20 bp, Artificial Sequence
  Description of Artificial Sequence: Synthetic oligonucleotide
  Target: ATXN1; (+) strand; PAM type: YTN; PAM sequence: CTA
aggagaattaggaaaaagcc

SEQ ID NO: 264260 - DNA, 20 bp, Artificial Sequence
  Description of Artificial Sequence: Synthetic oligonucleotide
  Target: ATXN1; (+) strand; PAM type: YTN; PAM sequence: TTA
ggaaaaagcccatgaattat

SEQ ID NO: 264261 - DNA, 20 bp, Artificial Sequence
  Description of Artificial Sequence: Synthetic oligonucleotide
  Target: ATXN1; (+) strand; PAM type: YTN; PAM sequence: TTA
ttcaatgatgtccaccataa

SEQ ID NO: 264262 - DNA, 20 bp, Artificial Sequence
  Description of Artificial Sequence: Synthetic oligonucleotide
  Target: ATXN1; (+) strand; PAM type: YTN; PAM sequence: TTC
aatgatgtccaccataactc

SEQ ID NO: 264263 - DNA, 20 bp, Artificial Sequence
  Description of Artificial Sequence: Synthetic oligonucleotide
  Target: ATXN1; (+) strand; PAM type: YTN; PAM sequence: CTC
agggaaaggaagaaaatcct

SEQ ID NO: 264264 - DNA, 20 bp, Artificial Sequence
  Description of Artificial Sequence: Synthetic oligonucleotide
  Target: ATXN1; (+) strand; PAM type: YTN; PAM sequence: CTA
ctgccttcctcaagcagcta

SEQ ID NO: 264265 - DNA, 20 bp, Artificial Sequence
  Description of Artificial Sequence: Synthetic oligonucleotide
  Target: ATXN1; (+) strand; PAM type: YTN; PAM sequence: CTG
ccttcctcaagcagctatgg

SEQ ID NO: 264266 - DNA, 20 bp, Artificial Sequence
  Description of Artificial Sequence: Synthetic oligonucleotide
  Target: ATXN1; (+) strand; PAM type: YTN; PAM sequence: CTT
cctcaagcagctatgggagg

SEQ ID NO: 264267 - DNA, 20 bp, Artificial Sequence
  Description of Artificial Sequence: Synthetic oligonucleotide
  Target: ATXN1; (+) strand; PAM type: YTN; PAM sequence: TTC
ctcaagcagctatgggaggc

SEQ ID NO: 264268 - DNA, 20 bp, Artificial Sequence
  Description of Artificial Sequence: Synthetic oligonucleotide
  Target: ATXN1; (+) strand; PAM type: YTN; PAM sequence: CTC
aagcagctatgggaggcctt

SEQ ID NO: 264269 - DNA, 20 bp, Artificial Sequence
  Description of Artificial Sequence: Synthetic oligonucleotide
  Target: ATXN1; (+) strand; PAM type: YTN; PAM sequence: CTA
tgggaggccttaagaaaata

SEQ ID NO: 264270 - DNA, 20 bp, Artificial Sequence
  Description of Artificial Sequence: Synthetic oligonucleotide
  Target: ATXN1; (+) strand; PAM type: YTN; PAM sequence: CTT
aagaaaatatactcccctgt

SEQ ID NO: 264271 - DNA, 20 bp, Artificial Sequence
  Description of Artificial Sequence: Synthetic oligonucleotide
  Target: ATXN1; (+) strand; PAM type: YTN; PAM sequence: TTA
agaaaatatactcccctgtc

SEQ ID NO: 264272 - DNA, 20 bp, Artificial Sequence
  Description of Artificial Sequence: Synthetic oligonucleotide
  Target: ATXN1; (+) strand; PAM type: YTN; PAM sequence: CTC
ccctgtcacccaactccctc

SEQ ID NO: 264273 - DNA, 20 bp, Artificial Sequence
  Description of Artificial Sequence: Synthetic oligonucleotide
  Target: ATXN1; (+) strand; PAM type: YTN; PAM sequence: CTG
tcacccaactccctcgaggg

SEQ ID NO: 264274 - DNA, 20 bp, Artificial Sequence
  Description of Artificial Sequence: Synthetic oligonucleotide
  Target: ATXN1; (+) strand; PAM type: YTN; PAM sequence: CTC
cctcgagggtcaattgatcc

SEQ ID NO: 264275 - DNA, 20 bp, Artificial Sequence
  Description of Artificial Sequence: Synthetic oligonucleotide
  Target: ATXN1; (+) strand; PAM type: YTN; PAM sequence: CTC
gagggtcaattgatcctaaa

SEQ ID NO: 264276 - DNA, 20 bp, Artificial Sequence
  Description of Artificial Sequence: Synthetic oligonucleotide
  Target: ATXN1; (+) strand; PAM type: YTN; PAM sequence: TTG
atcctaaaagatgtttatta

SEQ ID NO: 264277 - DNA, 20 bp, Artificial Sequence
  Description of Artificial Sequence: Synthetic oligonucleotide
  Target: ATXN1; (+) strand; PAM type: YTN; PAM sequence: CTA
aaagatgtttattacccaat

SEQ ID NO: 264278 - DNA, 20 bp, Artificial Sequence
  Description of Artificial Sequence: Synthetic oligonucleotide
  Target: ATXN1; (+) strand; PAM type: YTN; PAM sequence: TTT
attacccaatcagctgagat

SEQ ID NO: 264279 - DNA, 20 bp, Artificial Sequence
  Description of Artificial Sequence: Synthetic oligonucleotide
  Target: ATXN1; (+) strand; PAM type: YTN; PAM sequence: TTA
ttacccaatcagctgagata

SEQ ID NO: 264280 - DNA, 20 bp, Artificial Sequence
  Description of Artificial Sequence: Synthetic oligonucleotide
  Target: ATXN1; (+) strand; PAM type: YTN; PAM sequence: TTA
cccaatcagctgagatatca

SEQ ID NO: 264281 - DNA, 20 bp, Artificial Sequence
  Description of Artificial Sequence: Synthetic oligonucleotide
  Target: ATXN1; (+) strand; PAM type: YTN; PAM sequence: CTG
agatatcaggagaaagctcc

SEQ ID NO: 264282 - DNA, 20 bp, Artificial Sequence
  Description of Artificial Sequence: Synthetic oligonucleotide
  Target: ATXN1; (+) strand; PAM type: YTN; PAM sequence: CTC
caaaagcgagcccttggccc

SEQ ID NO: 264283 - DNA, 20 bp, Artificial Sequence
  Description of Artificial Sequence: Synthetic oligonucleotide
  Target: ATXN1; (+) strand; PAM type: YTN; PAM sequence: CTT
ggccctgaacaaaatctgga

SEQ ID NO: 264284 - DNA, 20 bp, Artificial Sequence
  Description of Artificial Sequence: Synthetic oligonucleotide
  Target: ATXN1; (+) strand; PAM type: YTN; PAM sequence: TTG
gccctgaacaaaatctggag

SEQ ID NO: 264285 - DNA, 20 bp, Artificial Sequence
  Description of Artificial Sequence: Synthetic oligonucleotide
  Target: ATXN1; (+) strand; PAM type: YTN; PAM sequence: CTG
aacaaaatctggaggcatta

SEQ ID NO: 264286 - DNA, 20 bp, Artificial Sequence
  Description of Artificial Sequence: Synthetic oligonucleotide
  Target: ATXN1; (+) strand; PAM type: YTN; PAM sequence: CTG
gaggcattattaaacctggc

SEQ ID NO: 264287 - DNA, 20 bp, Artificial Sequence
  Description of Artificial Sequence: Synthetic oligonucleotide
  Target: ATXN1; (+) strand; PAM type: YTN; PAM sequence: TTA
ttaaacctggcaaccgcggt

SEQ ID NO: 264288 - DNA, 20 bp, Artificial Sequence
  Description of Artificial Sequence: Synthetic oligonucleotide
  Target: ATXN1; (+) strand; PAM type: YTN; PAM sequence: TTA
aacctggcaaccgcggtgtt

SEQ ID NO: 264289 - DNA, 20 bp, Artificial Sequence
  Description of Artificial Sequence: Synthetic oligonucleotide
  Target: ATXN1; (+) strand; PAM type: YTN; PAM sequence: CTG
gcaaccgcggtgttctctaa

SEQ ID NO: 264290 - DNA, 20 bp, Artificial Sequence
  Description of Artificial Sequence: Synthetic oligonucleotide
  Target: ATXN1; (+) strand; PAM type: YTN; PAM sequence: TTC
tctaataggaaccaagagga

SEQ ID NO: 264291 - DNA, 20 bp, Artificial Sequence
  Description of Artificial Sequence: Synthetic oligonucleotide
  Target: ATXN1; (+) strand; PAM type: YTN; PAM sequence: CTC
taataggaaccaagaggaac

SEQ ID NO: 264292 - DNA, 20 bp, Artificial Sequence
  Description of Artificial Sequence: Synthetic oligonucleotide
  Target: ATXN1; (+) strand; PAM type: YTN; PAM sequence: CTA
ataggaaccaagaggaacag

SEQ ID NO: 264293 - DNA, 20 bp, Artificial Sequence
  Description of Artificial Sequence: Synthetic oligonucleotide
  Target: ATXN1; (+) strand; PAM type: YTN; PAM sequence: CTC
agtcatggccctcagacaaa

SEQ ID NO: 264294 - DNA, 20 bp, Artificial Sequence
  Description of Artificial Sequence: Synthetic oligonucleotide
  Target: ATXN1; (+) strand; PAM type: YTN; PAM sequence: CTC
agacaaacaaaccttggtgg

SEQ ID NO: 264295 - DNA, 20 bp, Artificial Sequence
  Description of Artificial Sequence: Synthetic oligonucleotide
  Target: ATXN1; (+) strand; PAM type: YTN; PAM sequence: CTT
ggtggttcagagaggacaga

SEQ ID NO: 264296 - DNA, 20 bp, Artificial Sequence
  Description of Artificial Sequence: Synthetic oligonucleotide
  Target: ATXN1; (+) strand; PAM type: YTN; PAM sequence: TTG
gtggttcagagaggacagaa

SEQ ID NO: 264297 - DNA, 20 bp, Artificial Sequence
  Description of Artificial Sequence: Synthetic oligonucleotide
  Target: ATXN1; (+) strand; PAM type: YTN; PAM sequence: TTC
agagaggacagaaaatggag

SEQ ID NO: 264298 - DNA, 20 bp, Artificial Sequence
  Description of Artificial Sequence: Synthetic oligonucleotide
  Target: ATXN1; (+) strand; PAM type: YTN; PAM sequence: CTT
gttatcagtgtggtttgcaa

SEQ ID NO: 264299 - DNA, 20 bp, Artificial Sequence
  Description of Artificial Sequence: Synthetic oligonucleotide
  Target: ATXN1; (+) strand; PAM type: YTN; PAM sequence: TTG
ttatcagtgtggtttgcaag

SEQ ID NO: 264300 - DNA, 20 bp, Artificial Sequence
  Description of Artificial Sequence: Synthetic oligonucleotide
  Target: ATXN1; (+) strand; PAM type: YTN; PAM sequence: TTA
tcagtgtggtttgcaaggac

SEQ ID NO: 264301 - DNA, 20 bp, Artificial Sequence
  Description of Artificial Sequence: Synthetic oligonucleotide
  Target: ATXN1; (+) strand; PAM type: YTN; PAM sequence: TTT
gcaaggacaccttaaaaaag

SEQ ID NO: 264302 - DNA, 20 bp, Artificial Sequence
  Description of Artificial Sequence: Synthetic oligonucleotide
  Target: ATXN1; (+) strand; PAM type: YTN; PAM sequence: TTG
caaggacaccttaaaaaaga

SEQ ID NO: 264303 - DNA, 20 bp, Artificial Sequence
  Description of Artificial Sequence: Synthetic oligonucleotide
  Target: ATXN1; (+) strand; PAM type: YTN; PAM sequence: CTT
aaaaaagactgtccaacaag

SEQ ID NO: 264304 - DNA, 20 bp, Artificial Sequence
  Description of Artificial Sequence: Synthetic oligonucleotide
  Target: ATXN1; (+) strand; PAM type: YTN; PAM sequence: TTA
aaaaagactgtccaacaaga

SEQ ID NO: 264305 - DNA, 20 bp, Artificial Sequence
  Description of Artificial Sequence: Synthetic oligonucleotide
  Target: ATXN1; (+) strand; PAM type: YTN; PAM sequence: CTG
tccaacaagaaacaagctac

SEQ ID NO: 264306 - DNA, 20 bp, Artificial Sequence
  Description of Artificial Sequence: Synthetic oligonucleotide
  Target: ATXN1; (+) strand; PAM type: YTN; PAM sequence: CTA
ctccctcacccatgtccact

SEQ ID NO: 264307 - DNA, 20 bp, Artificial Sequence
  Description of Artificial Sequence: Synthetic oligonucleotide
  Target: ATXN1; (+) strand; PAM type: YTN; PAM sequence: CTC
cctcacccatgtccactatg

SEQ ID NO: 264308 - DNA, 20 bp, Artificial Sequence
  Description of Artificial Sequence: Synthetic oligonucleotide
  Target: ATXN1; (+) strand; PAM type: YTN; PAM sequence: CTC
acccatgtccactatgccaa

SEQ ID NO: 264309 - DNA, 20 bp, Artificial Sequence
  Description of Artificial Sequence: Synthetic oligonucleotide
  Target: ATXN1; (+) strand; PAM type: YTN; PAM sequence: CTA
tgccaaggcaatcactagac

SEQ ID NO: 264310 - DNA, 20 bp, Artificial Sequence
  Description of Artificial Sequence: Synthetic oligonucleotide
  Target: ATXN1; (+) strand; PAM type: YTN; PAM sequence: CTA
gacggggtactgccccagag

SEQ ID NO: 264311 - DNA, 20 bp, Artificial Sequence
  Description of Artificial Sequence: Synthetic oligonucleotide
  Target: ATXN1; (+) strand; PAM type: YTN; PAM sequence: CTG
ccccagaggacaaaggttct

SEQ ID NO: 264312 - DNA, 20 bp, Artificial Sequence
  Description of Artificial Sequence: Synthetic oligonucleotide
  Target: ATXN1; (+) strand; PAM type: YTN; PAM sequence: TTC
tccgggccagaagcccccaa

SEQ ID NO: 264313 - DNA, 20 bp, Artificial Sequence
  Description of Artificial Sequence: Synthetic oligonucleotide
  Target: ATXN1; (+) strand; PAM type: YTN; PAM sequence: CTC
cgggccagaagcccccaacc

SEQ ID NO: 264314 - DNA, 20 bp, Artificial Sequence
  Description of Artificial Sequence: Synthetic oligonucleotide
  Target: ATXN1; (+) strand; PAM type: YTN; PAM sequence: CTG
agggtgcctggtgcaagcac

SEQ ID NO: 264315 - DNA, 20 bp, Artificial Sequence
  Description of Artificial Sequence: Synthetic oligonucleotide
  Target: ATXN1; (+) strand; PAM type: YTN; PAM sequence: CTG
gtgcaagcaccagctcatgt

SEQ ID NO: 264316 - DNA, 20 bp, Artificial Sequence
  Description of Artificial Sequence: Synthetic oligonucleotide
  Target: ATXN1; (+) strand; PAM type: YTN; PAM sequence: CTC
atgtcatcaccctcactgag

SEQ ID NO: 264317 - DNA, 20 bp, Artificial Sequence
  Description of Artificial Sequence: Synthetic oligonucleotide
  Target: ATXN1; (+) strand; PAM type: YTN; PAM sequence: CTC
actgagccctgggcaagttt

SEQ ID NO: 264318 - DNA, 20 bp, Artificial Sequence
  Description of Artificial Sequence: Synthetic oligonucleotide
  Target: ATXN1; (+) strand; PAM type: YTN; PAM sequence: CTG
agccctgggcaagtttagcc

SEQ ID NO: 264319 - DNA, 20 bp, Artificial Sequence
  Description of Artificial Sequence: Synthetic oligonucleotide
  Target: ATXN1; (+) strand; PAM type: YTN; PAM sequence: CTG
ggcaagtttagccattgagg

SEQ ID NO: 264320 - DNA, 20 bp, Artificial Sequence
  Description of Artificial Sequence: Synthetic oligonucleotide
  Target: ATXN1; (+) strand; PAM type: YTN; PAM sequence: TTT
agccattgagggccaggaaa

SEQ ID NO: 264321 - DNA, 20 bp, Artificial Sequence
  Description of Artificial Sequence: Synthetic oligonucleotide
  Target: ATXN1; (+) strand; PAM type: YTN; PAM sequence: TTA
gccattgagggccaggaaat

SEQ ID NO: 264322 - DNA, 20 bp, Artificial Sequence
  Description of Artificial Sequence: Synthetic oligonucleotide
  Target: ATXN1; (+) strand; PAM type: YTN; PAM sequence: TTG
agggccaggaaattgacttc

SEQ ID NO: 264323 - DNA, 20 bp, Artificial Sequence
  Description of Artificial Sequence: Synthetic oligonucleotide
  Target: ATXN1; (+) strand; PAM type: YTN; PAM sequence: TTG
acttcctcctggacactggc

SEQ ID NO: 264324 - DNA, 20 bp, Artificial Sequence
  Description of Artificial Sequence: Synthetic oligonucleotide
  Target: ATXN1; (+) strand; PAM type: YTN; PAM sequence: CTT
cctcctggacactggcatgg

SEQ ID NO: 264325 - DNA, 20 bp, Artificial Sequence
  Description of Artificial Sequence: Synthetic oligonucleotide
  Target: ATXN1; (+) strand; PAM type: YTN; PAM sequence: TTC
ctcctggacactggcatggc

SEQ ID NO: 264326 - DNA, 20 bp, Artificial Sequence
  Description of Artificial Sequence: Synthetic oligonucleotide
  Target: ATXN1; (+) strand; PAM type: YTN; PAM sequence: CTC
ctggacactggcatggcctt

SEQ ID NO: 264327 - DNA, 20 bp, Artificial Sequence
  Description of Artificial Sequence: Synthetic oligonucleotide
  Target: ATXN1; (+) strand; PAM type: YTN; PAM sequence: CTG
gacactggcatggccttctc

SEQ ID NO: 264328 - DNA, 20 bp, Artificial Sequence
  Description of Artificial Sequence: Synthetic oligonucleotide
  Target: ATXN1; (+) strand; PAM type: YTN; PAM sequence: CTG
gcatggccttctcagtgtta

SEQ ID NO: 264329 - DNA, 20 bp, Artificial Sequence
  Description of Artificial Sequence: Synthetic oligonucleotide
  Target: ATXN1; (+) strand; PAM type: YTN; PAM sequence: CTT
ctcagtgttaatctcctgcc

SEQ ID NO: 264330 - DNA, 20 bp, Artificial Sequence
  Description of Artificial Sequence: Synthetic oligonucleotide
  Target: ATXN1; (+) strand; PAM type: YTN; PAM sequence: TTC
tcagtgttaatctcctgccc

SEQ ID NO: 264331 - DNA, 20 bp, Artificial Sequence
  Description of Artificial Sequence: Synthetic oligonucleotide
  Target: ATXN1; (+) strand; PAM type: YTN; PAM sequence: CTC
agtgttaatctcctgcccca

SEQ ID NO: 264332 - DNA, 20 bp, Artificial Sequence
  Description of Artificial Sequence: Synthetic oligonucleotide
  Target: ATXN1; (+) strand; PAM type: YTN; PAM sequence: TTA
atctcctgccccagacagct

SEQ ID NO: 264333 - DNA, 20 bp, Artificial Sequence
  Description of Artificial Sequence: Synthetic oligonucleotide
  Target: ATXN1; (+) strand; PAM type: YTN; PAM sequence: CTC
ctgccccagacagctgtcct

SEQ ID NO: 264334 - DNA, 20 bp, Artificial Sequence
  Description of Artificial Sequence: Synthetic oligonucleotide
  Target: ATXN1; (+) strand; PAM type: YTN; PAM sequence: CTG
ccccagacagctgtcctcaa

SEQ ID NO: 264335 - DNA, 20 bp, Artificial Sequence
  Description of Artificial Sequence: Synthetic oligonucleotide
  Target: ATXN1; (+) strand; PAM type: YTN; PAM sequence: CTG
tcctcaagatccattaccat

SEQ ID NO: 264336 - DNA, 20 bp, Artificial Sequence
  Description of Artificial Sequence: Synthetic oligonucleotide
  Target: ATXN1; (+) strand; PAM type: YTN; PAM sequence: CTC
aagatccattaccatccaag

SEQ ID NO: 264337 - DNA, 20 bp, Artificial Sequence
  Description of Artificial Sequence: Synthetic oligonucleotide
  Target: ATXN1; (+) strand; PAM type: YTN; PAM sequence: TTA
ccatccaaggaatcctggga

SEQ ID NO: 264338 - DNA, 20 bp, Artificial Sequence
  Description of Artificial Sequence: Synthetic oligonucleotide
  Target: ATXN1; (+) strand; PAM type: YTN; PAM sequence: CTG
ggacagcctgtaaccaggta

SEQ ID NO: 264339 - DNA, 20 bp, Artificial Sequence
  Description of Artificial Sequence: Synthetic oligonucleotide
  Target: ATXN1; (+) strand; PAM type: YTN; PAM sequence: CTG
taaccaggtatttctcccac

SEQ ID NO: 264340 - DNA, 20 bp, Artificial Sequence
  Description of Artificial Sequence: Synthetic oligonucleotide
  Target: ATXN1; (+) strand; PAM type: YTN; PAM sequence: TTT
ctcccacctcctcagttgta

SEQ ID NO: 264341 - DNA, 20 bp, Artificial Sequence
  Description of Artificial Sequence: Synthetic oligonucleotide
  Target: ATXN1; (+) strand; PAM type: YTN; PAM sequence: TTC
tcccacctcctcagttgtaa

SEQ ID NO: 264342 - DNA, 20 bp, Artificial Sequence
  Description of Artificial Sequence: Synthetic oligonucleotide
  Target: ATXN1; (+) strand; PAM type: YTN; PAM sequence: CTC
ccacctcctcagttgtaatt

SEQ ID NO: 264343 - DNA, 20 bp, Artificial Sequence
  Description of Artificial Sequence: Synthetic oligonucleotide
  Target: ATXN1; (+) strand; PAM type: YTN; PAM sequence: CTC
ctcagttgtaattgggagac

SEQ ID NO: 264344 - DNA, 20 bp, Artificial Sequence
  Description of Artificial Sequence: Synthetic oligonucleotide
  Target: ATXN1; (+) strand; PAM type: YTN; PAM sequence: CTC
agttgtaattgggagacttt

SEQ ID NO: 264345 - DNA, 20 bp, Artificial Sequence
  Description of Artificial Sequence: Synthetic oligonucleotide
  Target: ATXN1; (+) strand; PAM type: YTN; PAM sequence: TTG
taattgggagactttgctct

SEQ ID NO: 264346 - DNA, 20 bp, Artificial Sequence
  Description of Artificial Sequence: Synthetic oligonucleotide
  Target: ATXN1; (+) strand; PAM type: YTN; PAM sequence: TTG
ggagactttgctcttttcac

SEQ ID NO: 264347 - DNA, 20 bp, Artificial Sequence
  Description of Artificial Sequence: Synthetic oligonucleotide
  Target: ATXN1; (+) strand; PAM type: YTN; PAM sequence: CTT
tgctcttttcacatgctttt

SEQ ID NO: 264348 - DNA, 20 bp, Artificial Sequence
  Description of Artificial Sequence: Synthetic oligonucleotide
  Target: ATXN1; (+) strand; PAM type: YTN; PAM sequence: TTT
gctcttttcacatgcttttc

SEQ ID NO: 264349 - DNA, 20 bp, Artificial Sequence
  Description of Artificial Sequence: Synthetic oligonucleotide
  Target: ATXN1; (+) strand; PAM type: YTN; PAM sequence: TTG
ctcttttcacatgcttttct

SEQ ID NO: 264350 - DNA, 20 bp, Artificial Sequence
  Description of Artificial Sequence: Synthetic oligonucleotide
  Target: ATXN1; (+) strand; PAM type: YTN; PAM sequence: CTC
ttttcacatgcttttcttat

SEQ ID NO: 264351 - DNA, 20 bp, Artificial Sequence
  Description of Artificial Sequence: Synthetic oligonucleotide
  Target: ATXN1; (+) strand; PAM type: YTN; PAM sequence: CTT
ttcacatgcttttcttatgc

SEQ ID NO: 264352 - DNA, 20 bp, Artificial Sequence
  Description of Artificial Sequence: Synthetic oligonucleotide
  Target: ATXN1; (+) strand; PAM type: YTN; PAM sequence: TTT
tcacatgcttttcttatgcc

SEQ ID NO: 264353 - DNA, 20 bp, Artificial Sequence
  Description of Artificial Sequence: Synthetic oligonucleotide
  Target: ATXN1; (+) strand; PAM type: YTN; PAM sequence: TTT
cacatgcttttcttatgcct

SEQ ID NO: 264354 - DNA, 20 bp, Artificial Sequence
  Description of Artificial Sequence: Synthetic oligonucleotide
  Target: ATXN1; (+) strand; PAM type: YTN; PAM sequence: TTC
acatgcttttcttatgcctg

SEQ ID NO: 264355 - DNA, 20 bp, Artificial Sequence
  Description of Artificial Sequence: Synthetic oligonucleotide
  Target: ATXN1; (+) strand; PAM type: YTN; PAM sequence: CTT
ttcttatgcctgaaagcccc

SEQ ID NO: 264356 - DNA, 20 bp, Artificial Sequence
  Description of Artificial Sequence: Synthetic oligonucleotide
  Target: ATXN1; (+) strand; PAM type: YTN; PAM sequence: TTT
tcttatgcctgaaagcccca

SEQ ID NO: 264357 - DNA, 20 bp, Artificial Sequence
  Description of Artificial Sequence: Synthetic oligonucleotide
  Target: ATXN1; (+) strand; PAM type: YTN; PAM sequence: TTT
cttatgcctgaaagccccac

SEQ ID NO: 264358 - DNA, 20 bp, Artificial Sequence
  Description of Artificial Sequence: Synthetic oligonucleotide
  Target: ATXN1; (+) strand; PAM type: YTN; PAM sequence: TTC
ttatgcctgaaagccccaca

SEQ ID NO: 264359 - DNA, 20 bp, Artificial Sequence
  Description of Artificial Sequence: Synthetic oligonucleotide
  Target: ATXN1; (+) strand; PAM type: YTN; PAM sequence: CTT
atgcctgaaagccccacacc

SEQ ID NO: 264360 - DNA, 20 bp, Artificial Sequence
  Description of Artificial Sequence: Synthetic oligonucleotide
  Target: ATXN1; (+) strand; PAM type: YTN; PAM sequence: TTA
tgcctgaaagccccacaccc

SEQ ID NO: 264361 - DNA, 20 bp, Artificial Sequence
  Description of Artificial Sequence: Synthetic oligonucleotide
  Target: ATXN1; (+) strand; PAM type: YTN; PAM sequence: CTG
aaagccccacacccttatta

SEQ ID NO: 264362 - DNA, 20 bp, Artificial Sequence
  Description of Artificial Sequence: Synthetic oligonucleotide
  Target: ATXN1; (+) strand; PAM type: YTN; PAM sequence: CTT
attagggagggacatattag

SEQ ID NO: 264363 - DNA, 20 bp, Artificial Sequence
  Description of Artificial Sequence: Synthetic oligonucleotide
  Target: ATXN1; (+) strand; PAM type: YTN; PAM sequence: TTA
ttagggagggacatattagc

SEQ ID NO: 264364 - DNA, 20 bp, Artificial Sequence
  Description of Artificial Sequence: Synthetic oligonucleotide
  Target: ATXN1; (+) strand; PAM type: YTN; PAM sequence: TTA
gggagggacatattagccaa

SEQ ID NO: 264365 - DNA, 20 bp, Artificial Sequence
  Description of Artificial Sequence: Synthetic oligonucleotide
  Target: ATXN1; (+) strand; PAM type: YTN; PAM sequence: TTA
gccaaagctggagccattaa

SEQ ID NO: 264366 - DNA, 20 bp, Artificial Sequence
  Description of Artificial Sequence: Synthetic oligonucleotide
  Target: ATXN1; (+) strand; PAM type: YTN; PAM sequence: CTG
gagccattaactatatgaat

SEQ ID NO: 264367 - DNA, 20 bp, Artificial Sequence
  Description of Artificial Sequence: Synthetic oligonucleotide
  Target: ATXN1; (+) strand; PAM type: YTN; PAM sequence: TTA
actatatgaatatggggaac

SEQ ID NO: 264368 - DNA, 20 bp, Artificial Sequence
  Description of Artificial Sequence: Synthetic oligonucleotide
  Target: ATXN1; (+) strand; PAM type: YTN; PAM sequence: CTA
tatgaatatggggaacaagt

SEQ ID NO: 264369 - DNA, 20 bp, Artificial Sequence
  Description of Artificial Sequence: Synthetic oligonucleotide
  Target: ATXN1; (+) strand; PAM type: YTN; PAM sequence: TTA
cccatttgttgtcccctact

SEQ ID NO: 264370 - DNA, 20 bp, Artificial Sequence
  Description of Artificial Sequence: Synthetic oligonucleotide
  Target: ATXN1; (+) strand; PAM type: YTN; PAM sequence: TTT
gttgtcccctacttgaggag

SEQ ID NO: 264371 - DNA, 20 bp, Artificial Sequence
  Description of Artificial Sequence: Synthetic oligonucleotide
  Target: ATXN1; (+) strand; PAM type: YTN; PAM sequence: TTG
ttgtcccctacttgaggagg

SEQ ID NO: 264372 - DNA, 20 bp, Artificial Sequence
  Description of Artificial Sequence: Synthetic oligonucleotide
  Target: ATXN1; (+) strand; PAM type: YTN; PAM sequence: TTG
tcccctacttgaggagggaa

SEQ ID NO: 264373 - DNA, 20 bp, Artificial Sequence
  Description of Artificial Sequence: Synthetic oligonucleotide
  Target: ATXN1; (+) strand; PAM type: YTN; PAM sequence: CTA
cttgaggagggaatcaaccc

SEQ ID NO: 264374 - DNA, 20 bp, Artificial Sequence
  Description of Artificial Sequence: Synthetic oligonucleotide
  Target: ATXN1; (+) strand; PAM type: YTN; PAM sequence: CTT
gaggagggaatcaaccctga

SEQ ID NO: 264375 - DNA, 20 bp, Artificial Sequence
  Description of Artificial Sequence: Synthetic oligonucleotide
  Target: ATXN1; (+) strand; PAM type: YTN; PAM sequence: TTG
aggagggaatcaaccctgaa

SEQ ID NO: 264376 - DNA, 20 bp, Artificial Sequence
  Description of Artificial Sequence: Synthetic oligonucleotide
  Target: ATXN1; (+) strand; PAM type: YTN; PAM sequence: CTG
aagtctgggcattggaagga

SEQ ID NO: 264377 - DNA, 20 bp, Artificial Sequence
  Description of Artificial Sequence: Synthetic oligonucleotide
  Target: ATXN1; (+) strand; PAM type: YTN; PAM sequence: CTG
ggcattggaaggacaattcg

SEQ ID NO: 264378 - DNA, 20 bp, Artificial Sequence
  Description of Artificial Sequence: Synthetic oligonucleotide
  Target: ATXN1; (+) strand; PAM type: YTN; PAM sequence: TTG
gaaggacaattcggaaaggc

SEQ ID NO: 264379 - DNA, 20 bp, Artificial Sequence
  Description of Artificial Sequence: Synthetic oligonucleotide
  Target: ATXN1; (+) strand; PAM type: YTN; PAM sequence: TTC
ggaaaggcaaaaaatgccca

SEQ ID NO: 264380 - DNA, 20 bp, Artificial Sequence
  Description of Artificial Sequence: Synthetic oligonucleotide
  Target: ATXN1; (+) strand; PAM type: YTN; PAM sequence: CTA
taagaccccaccacttttcc

SEQ ID NO: 264381 - DNA, 20 bp, Artificial Sequence
  Description of Artificial Sequence: Synthetic oligonucleotide
  Target: ATXN1; (+) strand; PAM type: YTN; PAM sequence: CTT
ttccttatcaaaggcaatat

SEQ ID NO: 264382 - DNA, 20 bp, Artificial Sequence
  Description of Artificial Sequence: Synthetic oligonucleotide
  Target: ATXN1; (+) strand; PAM type: YTN; PAM sequence: TTT
tccttatcaaaggcaatatc

SEQ ID NO: 264383 - DNA, 20 bp, Artificial Sequence
  Description of Artificial Sequence: Synthetic oligonucleotide
  Target: ATXN1; (+) strand; PAM type: YTN; PAM sequence: TTT
ccttatcaaaggcaatatct

SEQ ID NO: 264384 - DNA, 20 bp, Artificial Sequence
  Description of Artificial Sequence: Synthetic oligonucleotide
  Target: ATXN1; (+) strand; PAM type: YTN; PAM sequence: TTC
cttatcaaaggcaatatctc

SEQ ID NO: 264385 - DNA, 20 bp, Artificial Sequence
  Description of Artificial Sequence: Synthetic oligonucleotide
  Target: ATXN1; (+) strand; PAM type: YTN; PAM sequence: CTT
atcaaaggcaatatctctta

SEQ ID NO: 264386 - DNA, 20 bp, Artificial Sequence
  Description of Artificial Sequence: Synthetic oligonucleotide
  Target: ATXN1; (+) strand; PAM type: YTN; PAM sequence: TTA
tcaaaggcaatatctcttaa

SEQ ID NO: 264387 - DNA, 20 bp, Artificial Sequence
  Description of Artificial Sequence: Synthetic oligonucleotide
  Target: ATXN1; (+) strand; PAM type: YTN; PAM sequence: CTC
ttaaggcctgaagctcataa

SEQ ID NO: 264388 - DNA, 20 bp, Artificial Sequence
  Description of Artificial Sequence: Synthetic oligonucleotide
  Target: ATXN1; (+) strand; PAM type: YTN; PAM sequence: CTT
aaggcctgaagctcataaag

SEQ ID NO: 264389 - DNA, 20 bp, Artificial Sequence
  Description of Artificial Sequence: Synthetic oligonucleotide
  Target: ATXN1; (+) strand; PAM type: YTN; PAM sequence: TTA
aggcctgaagctcataaagg

SEQ ID NO: 264390 - DNA, 20 bp, Artificial Sequence
  Description of Artificial Sequence: Synthetic oligonucleotide
  Target: ATXN1; (+) strand; PAM type: YTN; PAM sequence: CTG
aagctcataaaggattacag

SEQ ID NO: 264391 - DNA, 20 bp, Artificial Sequence
  Description of Artificial Sequence: Synthetic oligonucleotide
  Target: ATXN1; (+) strand; PAM type: YTN; PAM sequence: CTC
ataaaggattacaggatatt

SEQ ID NO: 264392 - DNA, 20 bp, Artificial Sequence
  Description of Artificial Sequence: Synthetic oligonucleotide
  Target: ATXN1; (+) strand; PAM type: YTN; PAM sequence: TTA
caggatattgttatacattt

SEQ ID NO: 264393 - DNA, 20 bp, Artificial Sequence
  Description of Artificial Sequence: Synthetic oligonucleotide
  Target: ATXN1; (+) strand; PAM type: YTN; PAM sequence: TTG
ttatacatttaaaagttcga

SEQ ID NO: 264394 - DNA, 20 bp, Artificial Sequence
  Description of Artificial Sequence: Synthetic oligonucleotide
  Target: ATXN1; (+) strand; PAM type: YTN; PAM sequence: TTA
tacatttaaaagttcgaggc

SEQ ID NO: 264395 - DNA, 20 bp, Artificial Sequence
  Description of Artificial Sequence: Synthetic oligonucleotide
  Target: ATXN1; (+) strand; PAM type: YTN; PAM sequence: TTT
aaaagttcgaggcttagtaa

SEQ ID NO: 264396 - DNA, 20 bp, Artificial Sequence
  Description of Artificial Sequence: Synthetic oligonucleotide
  Target: ATXN1; (+) strand; PAM type: YTN; PAM sequence: TTA
aaagttcgaggcttagtaag

SEQ ID NO: 264397 - DNA, 20 bp, Artificial Sequence
  Description of Artificial Sequence: Synthetic oligonucleotide
  Target: ATXN1; (+) strand; PAM type: YTN; PAM sequence: TTC
gaggcttagtaagaaaatgc

SEQ ID NO: 264398 - DNA, 20 bp, Artificial Sequence
  Description of Artificial Sequence: Synthetic oligonucleotide
  Target: ATXN1; (+) strand; PAM type: YTN; PAM sequence: CTT
agtaagaaaatgcagtagcc

SEQ ID NO: 264399 - DNA, 20 bp, Artificial Sequence
  Description of Artificial Sequence: Synthetic oligonucleotide
  Target: ATXN1; (+) strand; PAM type: YTN; PAM sequence: TTA
gtaagaaaatgcagtagccc

SEQ ID NO: 264400 - DNA, 20 bp, Artificial Sequence
  Description of Artificial Sequence: Synthetic oligonucleotide
  Target: ATXN1; (+) strand; PAM type: YTN; PAM sequence: CTG
caacaccccaattctaggag

SEQ ID NO: 264401 - DNA, 20 bp, Artificial Sequence
  Description of Artificial Sequence: Synthetic oligonucleotide
  Target: ATXN1; (+) strand; PAM type: YTN; PAM sequence: TTC
taggagtacaaaaactgaat

SEQ ID NO: 264402 - DNA, 20 bp, Artificial Sequence
  Description of Artificial Sequence: Synthetic oligonucleotide
  Target: ATXN1; (+) strand; PAM type: YTN; PAM sequence: CTA
ggagtacaaaaactgaatcg

SEQ ID NO: 264403 - DNA, 20 bp, Artificial Sequence
  Description of Artificial Sequence: Synthetic oligonucleotide
  Target: ATXN1; (+) strand; PAM type: YTN; PAM sequence: CTG
aatcgtcagtggagactagt

SEQ ID NO: 264404 - DNA, 20 bp, Artificial Sequence
  Description of Artificial Sequence: Synthetic oligonucleotide
  Target: ATXN1; (+) strand; PAM type: YTN; PAM sequence: CTA
gtgcaagatcctagactcat

SEQ ID NO: 264405 - DNA, 20 bp, Artificial Sequence
  Description of Artificial Sequence: Synthetic oligonucleotide
  Target: ATXN1; (+) strand; PAM type: YTN; PAM sequence: CTA
gactcatcagtgaggaagta

SEQ ID NO: 264406 - DNA, 20 bp, Artificial Sequence
  Description of Artificial Sequence: Synthetic oligonucleotide
  Target: ATXN1; (+) strand; PAM type: YTN; PAM sequence: CTC
atcagtgaggaagtaattcc

SEQ ID NO: 264407 - DNA, 20 bp, Artificial Sequence
  Description of Artificial Sequence: Synthetic oligonucleotide
  Target: ATXN1; (+) strand; PAM type: YTN; PAM sequence: TTC
ctctatatccggttgtaccc

SEQ ID NO: 264408 - DNA, 20 bp, Artificial Sequence
  Description of Artificial Sequence: Synthetic oligonucleotide
  Target: ATXN1; (+) strand; PAM type: YTN; PAM sequence: CTC
tatatccggttgtacccaac

SEQ ID NO: 264409 - DNA, 20 bp, Artificial Sequence
  Description of Artificial Sequence: Synthetic oligonucleotide
  Target: ATXN1; (+) strand; PAM type: YTN; PAM sequence: CTA
tatccggttgtacccaaccc

SEQ ID NO: 264410 - DNA, 20 bp, Artificial Sequence
  Description of Artificial Sequence: Synthetic oligonucleotide
  Target: ATXN1; (+) strand; PAM type: YTN; PAM sequence: TTG
tacccaacccctataccctg

SEQ ID NO: 264411 - DNA, 20 bp, Artificial Sequence
  Description of Artificial Sequence: Synthetic oligonucleotide
  Target: ATXN1; (+) strand; PAM type: YTN; PAM sequence: CTA
taccctgctctctcaaatac

SEQ ID NO: 264412 - DNA, 20 bp, Artificial Sequence
  Description of Artificial Sequence: Synthetic oligonucleotide
  Target: ATXN1; (+) strand; PAM type: YTN; PAM sequence: CTG
ctctctcaaataccaaagga

SEQ ID NO: 264413 - DNA, 20 bp, Artificial Sequence
  Description of Artificial Sequence: Synthetic oligonucleotide
  Target: ATXN1; (+) strand; PAM type: YTN; PAM sequence: CTC
tctcaaataccaaaggaagc

SEQ ID NO: 264414 - DNA, 20 bp, Artificial Sequence
  Description of Artificial Sequence: Synthetic oligonucleotide
  Target: ATXN1; (+) strand; PAM type: YTN; PAM sequence: CTC
tcaaataccaaaggaagcag

SEQ ID NO: 264415 - DNA, 20 bp, Artificial Sequence
  Description of Artificial Sequence: Synthetic oligonucleotide
  Target: ATXN1; (+) strand; PAM type: YTN; PAM sequence: CTC
aaataccaaaggaagcagaa

SEQ ID NO: 264416 - DNA, 20 bp, Artificial Sequence
  Description of Artificial Sequence: Synthetic oligonucleotide
  Target: ATXN1; (+) strand; PAM type: YTN; PAM sequence: TTT
cactgttctggacctcaagg

SEQ ID NO: 264417 - DNA, 20 bp, Artificial Sequence
  Description of Artificial Sequence: Synthetic oligonucleotide
  Target: ATXN1; (+) strand; PAM type: YTN; PAM sequence: TTC
actgttctggacctcaagga

SEQ ID NO: 264418 - DNA, 20 bp, Artificial Sequence
  Description of Artificial Sequence: Synthetic oligonucleotide
  Target: ATXN1; (+) strand; PAM type: YTN; PAM sequence: CTG
ttctggacctcaaggatgct

SEQ ID NO: 264419 - DNA, 20 bp, Artificial Sequence
  Description of Artificial Sequence: Synthetic oligonucleotide
  Target: ATXN1; (+) strand; PAM type: YTN; PAM sequence: TTC
tggacctcaaggatgctgcc

SEQ ID NO: 264420 - DNA, 20 bp, Artificial Sequence
  Description of Artificial Sequence: Synthetic oligonucleotide
  Target: ATXN1; (+) strand; PAM type: YTN; PAM sequence: CTG
gacctcaaggatgctgcctt

SEQ ID NO: 264421 - DNA, 20 bp, Artificial Sequence
  Description of Artificial Sequence: Synthetic oligonucleotide
  Target: ATXN1; (+) strand; PAM type: YTN; PAM sequence: CTC
aaggatgctgccttctgcgt

SEQ ID NO: 264422 - DNA, 20 bp, Artificial Sequence
  Description of Artificial Sequence: Synthetic oligonucleotide
  Target: ATXN1; (+) strand; PAM type: YTN; PAM sequence: CTG
ccttctgcgttcctctgcac

SEQ ID NO: 264423 - DNA, 20 bp, Artificial Sequence
  Description of Artificial Sequence: Synthetic oligonucleotide
  Target: ATXN1; (+) strand; PAM type: YTN; PAM sequence: CTT
ctgcgttcctctgcacttgg

SEQ ID NO: 264424 - DNA, 20 bp, Artificial Sequence
  Description of Artificial Sequence: Synthetic oligonucleotide
  Target: ATXN1; (+) strand; PAM type: YTN; PAM sequence: TTC
tgcgttcctctgcacttgga

SEQ ID NO: 264425 - DNA, 20 bp, Artificial Sequence
  Description of Artificial Sequence: Synthetic oligonucleotide
  Target: ATXN1; (+) strand; PAM type: YTN; PAM sequence: CTG
cgttcctctgcacttggact

SEQ ID NO: 264426 - DNA, 20 bp, Artificial Sequence
  Description of Artificial Sequence: Synthetic oligonucleotide
  Target: ATXN1; (+) strand; PAM type: YTN; PAM sequence: TTC
ctctgcacttggactcccag

SEQ ID NO: 264427 - DNA, 20 bp, Artificial Sequence
  Description of Artificial Sequence: Synthetic oligonucleotide
  Target: ATXN1; (+) strand; PAM type: YTN; PAM sequence: CTC
tgcacttggactcccagttt

SEQ ID NO: 264428 - DNA, 20 bp, Artificial Sequence
  Description of Artificial Sequence: Synthetic oligonucleotide
  Target: ATXN1; (+) strand; PAM type: YTN; PAM sequence: CTG
cacttggactcccagtttct

SEQ ID NO: 264429 - DNA, 20 bp, Artificial Sequence
  Description of Artificial Sequence: Synthetic oligonucleotide
  Target: ATXN1; (+) strand; PAM type: YTN; PAM sequence: CTT
ggactcccagtttctctttg

SEQ ID NO: 264430 - DNA, 20 bp, Artificial Sequence
  Description of Artificial Sequence: Synthetic oligonucleotide
  Target: ATXN1; (+) strand; PAM type: YTN; PAM sequence: TTG
gactcccagtttctctttgc

SEQ ID NO: 264431 - DNA, 20 bp, Artificial Sequence
  Description of Artificial Sequence: Synthetic oligonucleotide
  Target: ATXN1; (+) strand; PAM type: YTN; PAM sequence: CTC
ccagtttctctttgcctttg

SEQ ID NO: 264432 - DNA, 20 bp, Artificial Sequence
  Description of Artificial Sequence: Synthetic oligonucleotide
  Target: ATXN1; (+) strand; PAM type: YTN; PAM sequence: TTT
ctctttgcctttgaggatcc

SEQ ID NO: 264433 - DNA, 20 bp, Artificial Sequence
  Description of Artificial Sequence: Synthetic oligonucleotide
  Target: ATXN1; (+) strand; PAM type: YTN; PAM sequence: TTC
tctttgcctttgaggatccc

SEQ ID NO: 264434 - DNA, 20 bp, Artificial Sequence
  Description of Artificial Sequence: Synthetic oligonucleotide
  Target: ATXN1; (+) strand; PAM type: YTN; PAM sequence: CTC
tttgcctttgaggatcccac

SEQ ID NO: 264435 - DNA, 20 bp, Artificial Sequence
  Description of Artificial Sequence: Synthetic oligonucleotide
  Target: ATXN1; (+) strand; PAM type: YTN; PAM sequence: CTT
tgcctttgaggatcccacag

SEQ ID NO: 264436 - DNA, 20 bp, Artificial Sequence
  Description of Artificial Sequence: Synthetic oligonucleotide
  Target: ATXN1; (+) strand; PAM type: YTN; PAM sequence: TTT
gcctttgaggatcccacaga

SEQ ID NO: 264437 - DNA, 20 bp, Artificial Sequence
  Description of Artificial Sequence: Synthetic oligonucleotide
  Target: ATXN1; (+) strand; PAM type: YTN; PAM sequence: TTG
cctttgaggatcccacagac

SEQ ID NO: 264438 - DNA, 20 bp, Artificial Sequence
  Description of Artificial Sequence: Synthetic oligonucleotide
  Target: ATXN1; (+) strand; PAM type: YTN; PAM sequence: CTT
tgaggatcccacagaccaca

SEQ ID NO: 264439 - DNA, 20 bp, Artificial Sequence
  Description of Artificial Sequence: Synthetic oligonucleotide
  Target: ATXN1; (+) strand; PAM type: YTN; PAM sequence: TTT
gaggatcccacagaccacaa

SEQ ID NO: 264440 - DNA, 20 bp, Artificial Sequence
  Description of Artificial Sequence: Synthetic oligonucleotide
  Target: ATXN1; (+) strand; PAM type: YTN; PAM sequence: TTG
aggatcccacagaccacaaa

SEQ ID NO: 264441 - DNA, 20 bp, Artificial Sequence
  Description of Artificial Sequence: Synthetic oligonucleotide
  Target: ATXN1; (+) strand; PAM type: YTN; PAM sequence: CTT
acatggacggtcttgcctca

SEQ ID NO: 264442 - DNA, 20 bp, Artificial Sequence
  Description of Artificial Sequence: Synthetic oligonucleotide
  Target: ATXN1; (+) strand; PAM type: YTN; PAM sequence: TTA
catggacggtcttgcctcaa

SEQ ID NO: 264443 - DNA, 20 bp, Artificial Sequence
  Description of Artificial Sequence: Synthetic oligonucleotide
  Target: ATXN1; (+) strand; PAM type: YTN; PAM sequence: CTT
gcctcaagggtttagggata

SEQ ID NO: 264444 - DNA, 20 bp, Artificial Sequence
  Description of Artificial Sequence: Synthetic oligonucleotide
  Target: ATXN1; (+) strand; PAM type: YTN; PAM sequence: TTG
cctcaagggtttagggatag

SEQ ID NO: 264445 - DNA, 20 bp, Artificial Sequence
  Description of Artificial Sequence: Synthetic oligonucleotide
  Target: ATXN1; (+) strand; PAM type: YTN; PAM sequence: CTC
aagggtttagggatagccct

SEQ ID NO: 264446 - DNA, 20 bp, Artificial Sequence
  Description of Artificial Sequence: Synthetic oligonucleotide
  Target: ATXN1; (+) strand; PAM type: YTN; PAM sequence: TTT
agggatagccctcatctgtt

SEQ ID NO: 264447 - DNA, 20 bp, Artificial Sequence
  Description of Artificial Sequence: Synthetic oligonucleotide
  Target: ATXN1; (+) strand; PAM type: YTN; PAM sequence: TTA
gggatagccctcatctgttt

SEQ ID NO: 264448 - DNA, 20 bp, Artificial Sequence
  Description of Artificial Sequence: Synthetic oligonucleotide
  Target: ATXN1; (+) strand; PAM type: YTN; PAM sequence: CTC
atctgtttggtcaggcactg

SEQ ID NO: 264449 - DNA, 20 bp, Artificial Sequence
  Description of Artificial Sequence: Synthetic oligonucleotide
  Target: ATXN1; (+) strand; PAM type: YTN; PAM sequence: CTG
tttggtcaggcactgtccca

SEQ ID NO: 264450 - DNA, 20 bp, Artificial Sequence
  Description of Artificial Sequence: Synthetic oligonucleotide
  Target: ATXN1; (+) strand; PAM type: YTN; PAM sequence: TTT
ggtcaggcactgtcccaaga

SEQ ID NO: 264451 - DNA, 20 bp, Artificial Sequence
  Description of Artificial Sequence: Synthetic oligonucleotide
  Target: ATXN1; (+) strand; PAM type: YTN; PAM sequence: TTG
gtcaggcactgtcccaagat

SEQ ID NO: 264452 - DNA, 20 bp, Artificial Sequence
  Description of Artificial Sequence: Synthetic oligonucleotide
  Target: ATXN1; (+) strand; PAM type: YTN; PAM sequence: CTG
tcccaagatctaggccactt

SEQ ID NO: 264453 - DNA, 20 bp, Artificial Sequence
  Description of Artificial Sequence: Synthetic oligonucleotide
  Target: ATXN1; (+) strand; PAM type: YTN; PAM sequence: CTA
ggccacttctcaagtccagg

SEQ ID NO: 264454 - DNA, 20 bp, Artificial Sequence
  Description of Artificial Sequence: Synthetic oligonucleotide
  Target: ATXN1; (+) strand; PAM type: YTN; PAM sequence: CTT
ctcaagtccaggcatgctgg

SEQ ID NO: 264455 - DNA, 20 bp, Artificial Sequence
  Description of Artificial Sequence: Synthetic oligonucleotide
  Target: ATXN1; (+) strand; PAM type: YTN; PAM sequence: TTC
tcaagtccaggcatgctggt

SEQ ID NO: 264456 - DNA, 20 bp, Artificial Sequence
  Description of Artificial Sequence: Synthetic oligonucleotide
  Target: ATXN1; (+) strand; PAM type: YTN; PAM sequence: CTC
aagtccaggcatgctggtcc

SEQ ID NO: 264457 - DNA, 20 bp, Artificial Sequence
  Description of Artificial Sequence: Synthetic oligonucleotide
  Target: ATXN1; (+) strand; PAM type: YTN; PAM sequence: CTG
gtccttcagtatgtggatga

SEQ ID NO: 264458 - DNA, 20 bp, Artificial Sequence
  Description of Artificial Sequence: Synthetic oligonucleotide
  Target: ATXN1; (+) strand; PAM type: YTN; PAM sequence: CTT
cagtatgtggatgatttact

SEQ ID NO: 264459 - DNA, 20 bp, Artificial Sequence
  Description of Artificial Sequence: Synthetic oligonucleotide
  Target: ATXN1; (+) strand; PAM type: YTN; PAM sequence: TTC
agtatgtggatgatttactt

SEQ ID NO: 264460 - DNA, 20 bp, Artificial Sequence
  Description of Artificial Sequence: Synthetic oligonucleotide
  Target: ATXN1; (+) strand; PAM type: YTN; PAM sequence: TTT
acttttggctaccagttcgg

SEQ ID NO: 264461 - DNA, 20 bp, Artificial Sequence
  Description of Artificial Sequence: Synthetic oligonucleotide
  Target: ATXN1; (+) strand; PAM type: YTN; PAM sequence: TTA
cttttggctaccagttcgga

SEQ ID NO: 264462 - DNA, 20 bp, Artificial Sequence
  Description of Artificial Sequence: Synthetic oligonucleotide
  Target: ATXN1; (+) strand; PAM type: YTN; PAM sequence: CTT
ttggctaccagttcggaagc

SEQ ID NO: 264463 - DNA, 20 bp, Artificial Sequence
  Description of Artificial Sequence: Synthetic oligonucleotide
  Target: ATXN1; (+) strand; PAM type: YTN; PAM sequence: TTT
tggctaccagttcggaagct

SEQ ID NO: 264464 - DNA, 20 bp, Artificial Sequence
  Description of Artificial Sequence: Synthetic oligonucleotide
  Target: ATXN1; (+) strand; PAM type: YTN; PAM sequence: TTT
ggctaccagttcggaagctt

SEQ ID NO: 264465 - DNA, 20 bp, Artificial Sequence
  Description of Artificial Sequence: Synthetic oligonucleotide
  Target: ATXN1; (+) strand; PAM type: YTN; PAM sequence: TTG
gctaccagttcggaagcttc

SEQ ID NO: 264466 - DNA, 20 bp, Artificial Sequence
  Description of Artificial Sequence: Synthetic oligonucleotide
  Target: ATXN1; (+) strand; PAM type: YTN; PAM sequence: CTA
ccagttcggaagcttcatgc

SEQ ID NO: 264467 - DNA, 20 bp, Artificial Sequence
  Description of Artificial Sequence: Synthetic oligonucleotide
  Target: ATXN1; (+) strand; PAM type: YTN; PAM sequence: TTC
ggaagcttcatgccagcagg

SEQ ID NO: 264468 - DNA, 20 bp, Artificial Sequence
  Description of Artificial Sequence: Synthetic oligonucleotide
  Target: ATXN1; (+) strand; PAM type: YTN; PAM sequence: CTT
catgccagcaggctactcta

SEQ ID NO: 264469 - DNA, 20 bp, Artificial Sequence
  Description of Artificial Sequence: Synthetic oligonucleotide
  Target: ATXN1; (+) strand; PAM type: YTN; PAM sequence: TTC
atgccagcaggctactctag

SEQ ID NO: 264470 - DNA, 20 bp, Artificial Sequence
  Description of Artificial Sequence: Synthetic oligonucleotide
  Target: ATXN1; (+) strand; PAM type: YTN; PAM sequence: CTA
ctctagatctcttgaacttt

SEQ ID NO: 264471 - DNA, 20 bp, Artificial Sequence
  Description of Artificial Sequence: Synthetic oligonucleotide
  Target: ATXN1; (+) strand; PAM type: YTN; PAM sequence: CTC
tagatctcttgaactttcta

SEQ ID NO: 264472 - DNA, 20 bp, Artificial Sequence
  Description of Artificial Sequence: Synthetic oligonucleotide
  Target: ATXN1; (+) strand; PAM type: YTN; PAM sequence: CTA
gatctcttgaactttctagc

SEQ ID NO: 264473 - DNA, 20 bp, Artificial Sequence
  Description of Artificial Sequence: Synthetic oligonucleotide
  Target: ATXN1; (+) strand; PAM type: YTN; PAM sequence: CTC
ttgaactttctagctaatca

SEQ ID NO: 264474 - DNA, 20 bp, Artificial Sequence
  Description of Artificial Sequence: Synthetic oligonucleotide
  Target: ATXN1; (+) strand; PAM type: YTN; PAM sequence: CTT
gaactttctagctaatcaag

SEQ ID NO: 264475 - DNA, 20 bp, Artificial Sequence
  Description of Artificial Sequence: Synthetic oligonucleotide
  Target: ATXN1; (+) strand; PAM type: YTN; PAM sequence: TTG
aactttctagctaatcaagg

SEQ ID NO: 264476 - DNA, 20 bp, Artificial Sequence
  Description of Artificial Sequence: Synthetic oligonucleotide
  Target: ATXN1; (+) strand; PAM type: YTN; PAM sequence: CTT
tctagctaatcaagggtaca

SEQ ID NO: 264477 - DNA, 20 bp, Artificial Sequence
  Description of Artificial Sequence: Synthetic oligonucleotide
  Target: ATXN1; (+) strand; PAM type: YTN; PAM sequence: TTT
ctagctaatcaagggtacaa

SEQ ID NO: 264478 - DNA, 20 bp, Artificial Sequence
  Description of Artificial Sequence: Synthetic oligonucleotide
  Target: ATXN1; (+) strand; PAM type: YTN; PAM sequence: TTC
tagctaatcaagggtacaag

SEQ ID NO: 264479 - DNA, 20 bp, Artificial Sequence
  Description of Artificial Sequence: Synthetic oligonucleotide
  Target: ATXN1; (+) strand; PAM type: YTN; PAM sequence: CTA
gctaatcaagggtacaaggc

SEQ ID NO: 264480 - DNA, 20 bp, Artificial Sequence
  Description of Artificial Sequence: Synthetic oligonucleotide
  Target: ATXN1; (+) strand; PAM type: YTN; PAM sequence: CTA
atcaagggtacaaggcatct

SEQ ID NO: 264481 - DNA, 20 bp, Artificial Sequence
  Description of Artificial Sequence: Synthetic oligonucleotide
  Target: ATXN1; (+) strand; PAM type: YTN; PAM sequence: CTA
aatcgaaggcccagctctgc

SEQ ID NO: 264482 - DNA, 20 bp, Artificial Sequence
  Description of Artificial Sequence: Synthetic oligonucleotide
  Target: ATXN1; (+) strand; PAM type: YTN; PAM sequence: CTC
tgcctacaacaagtcaaata

SEQ ID NO: 264483 - DNA, 20 bp, Artificial Sequence
  Description of Artificial Sequence: Synthetic oligonucleotide
  Target: ATXN1; (+) strand; PAM type: YTN; PAM sequence: CTG
cctacaacaagtcaaatatc

SEQ ID NO: 264484 - DNA, 20 bp, Artificial Sequence
  Description of Artificial Sequence: Synthetic oligonucleotide
  Target: ATXN1; (+) strand; PAM type: YTN; PAM sequence: CTA
caacaagtcaaatatctaag

SEQ ID NO: 264485 - DNA, 20 bp, Artificial Sequence
  Description of Artificial Sequence: Synthetic oligonucleotide
  Target: ATXN1; (+) strand; PAM type: YTN; PAM sequence: CTA
agcctaatcctagccagagg

SEQ ID NO: 264486 - DNA, 20 bp, Artificial Sequence
  Description of Artificial Sequence: Synthetic oligonucleotide
  Target: ATXN1; (+) strand; PAM type: YTN; PAM sequence: CTA
atcctagccagaggaaccag

SEQ ID NO: 264487 - DNA, 20 bp, Artificial Sequence
  Description of Artificial Sequence: Synthetic oligonucleotide
  Target: ATXN1; (+) strand; PAM type: YTN; PAM sequence: CTA
gccagaggaaccagggccct

SEQ ID NO: 264488 - DNA, 20 bp, Artificial Sequence
  Description of Artificial Sequence: Synthetic oligonucleotide
  Target: ATXN1; (+) strand; PAM type: YTN; PAM sequence: CTC
agcaaagaacaaatacagcc

SEQ ID NO: 264489 - DNA, 20 bp, Artificial Sequence
  Description of Artificial Sequence: Synthetic oligonucleotide
  Target: ATXN1; (+) strand; PAM type: YTN; PAM sequence: CTA
tactggcttgtccttgccct

SEQ ID NO: 264490 - DNA, 20 bp, Artificial Sequence
  Description of Artificial Sequence: Synthetic oligonucleotide
  Target: ATXN1; (+) strand; PAM type: YTN; PAM sequence: CTG
gcttgtccttgccctaacac

SEQ ID NO: 264491 - DNA, 20 bp, Artificial Sequence
  Description of Artificial Sequence: Synthetic oligonucleotide
  Target: ATXN1; (+) strand; PAM type: YTN; PAM sequence: CTT
gtccttgccctaacacatta

SEQ ID NO: 264492 - DNA, 20 bp, Artificial Sequence
  Description of Artificial Sequence: Synthetic oligonucleotide
  Target: ATXN1; (+) strand; PAM type: YTN; PAM sequence: TTG
tccttgccctaacacattaa

SEQ ID NO: 264493 - DNA, 20 bp, Artificial Sequence
  Description of Artificial Sequence: Synthetic oligonucleotide
  Target: ATXN1; (+) strand; PAM type: YTN; PAM sequence: CTT
gccctaacacattaaaacag

SEQ ID NO: 264494 - DNA, 20 bp, Artificial Sequence
  Description of Artificial Sequence: Synthetic oligonucleotide
  Target: ATXN1; (+) strand; PAM type: YTN; PAM sequence: TTG
ccctaacacattaaaacagt

SEQ ID NO: 264495 - DNA, 20 bp, Artificial Sequence
  Description of Artificial Sequence: Synthetic oligonucleotide
  Target: ATXN1; (+) strand; PAM type: YTN; PAM sequence: CTA
acacattaaaacagttgtgg

SEQ ID NO: 264496 - DNA, 20 bp, Artificial Sequence
  Description of Artificial Sequence: Synthetic oligonucleotide
  Target: ATXN1; (+) strand; PAM type: YTN; PAM sequence: TTA
aaacagttgtgggggttcct

SEQ ID NO: 264497 - DNA, 20 bp, Artificial Sequence
  Description of Artificial Sequence: Synthetic oligonucleotide
  Target: ATXN1; (+) strand; PAM type: YTN; PAM sequence: TTG
tgggggttccttgggatcac

SEQ ID NO: 264498 - DNA, 20 bp, Artificial Sequence
  Description of Artificial Sequence: Synthetic oligonucleotide
  Target: ATXN1; (+) strand; PAM type: YTN; PAM sequence: TTC
cttgggatcactggctttta

SEQ ID NO: 264499 - DNA, 20 bp, Artificial Sequence
  Description of Artificial Sequence: Synthetic oligonucleotide
  Target: ATXN1; (+) strand; PAM type: YTN; PAM sequence: CTT
gggatcactggcttttaccg

SEQ ID NO: 264500 - DNA, 20 bp, Artificial Sequence
  Description of Artificial Sequence: Synthetic oligonucleotide
  Target: ATXN1; (+) strand; PAM type: YTN; PAM sequence: TTG
ggatcactggcttttaccga

SEQ ID NO: 264501 - DNA, 20 bp, Artificial Sequence
  Description of Artificial Sequence: Synthetic oligonucleotide
  Target: ATXN1; (+) strand; PAM type: YTN; PAM sequence: CTG
gcttttaccgactatggatc

SEQ ID NO: 264502 - DNA, 20 bp, Artificial Sequence
  Description of Artificial Sequence: Synthetic oligonucleotide
  Target: ATXN1; (+) strand; PAM type: YTN; PAM sequence: CTT
ttaccgactatggatccccg

SEQ ID NO: 264503 - DNA, 20 bp, Artificial Sequence
  Description of Artificial Sequence: Synthetic oligonucleotide
  Target: ATXN1; (+) strand; PAM type: YTN; PAM sequence: TTT
taccgactatggatccccgg

SEQ ID NO: 264504 - DNA, 20 bp, Artificial Sequence
  Description of Artificial Sequence: Synthetic oligonucleotide
  Target: ATXN1; (+) strand; PAM type: YTN; PAM sequence: TTT
accgactatggatccccgga

SEQ ID NO: 264505 - DNA, 20 bp, Artificial Sequence
  Description of Artificial Sequence: Synthetic oligonucleotide
  Target: ATXN1; (+) strand; PAM type: YTN; PAM sequence: TTA
ccgactatggatccccggat

SEQ ID NO: 264506 - DNA, 20 bp, Artificial Sequence
  Description of Artificial Sequence: Synthetic oligonucleotide
  Target: ATXN1; (+) strand; PAM type: YTN; PAM sequence: CTA
tggatccccggatacagcga

SEQ ID NO: 264507 - DNA, 20 bp, Artificial Sequence
  Description of Artificial Sequence: Synthetic oligonucleotide
  Target: ATXN1; (+) strand; PAM type: YTN; PAM sequence: CTC
tatactctaatcaaggagac

SEQ ID NO: 264508 - DNA, 20 bp, Artificial Sequence
  Description of Artificial Sequence: Synthetic oligonucleotide
  Target: ATXN1; (+) strand; PAM type: YTN; PAM sequence: CTA
tactctaatcaaggagaccg

SEQ ID NO: 264509 - DNA, 20 bp, Artificial Sequence
  Description of Artificial Sequence: Synthetic oligonucleotide
  Target: ATXN1; (+) strand; PAM type: YTN; PAM sequence: CTC
taatcaaggagaccgagagg

SEQ ID NO: 264510 - DNA, 20 bp, Artificial Sequence
  Description of Artificial Sequence: Synthetic oligonucleotide
  Target: ATXN1; (+) strand; PAM type: YTN; PAM sequence: CTA
atcaaggagaccgagagggc

SEQ ID NO: 264511 - DNA, 20 bp, Artificial Sequence
  Description of Artificial Sequence: Synthetic oligonucleotide
  Target: ATXN1; (+) strand; PAM type: YTN; PAM sequence: TTC
atctagtagaatgggaacca

SEQ ID NO: 264512 - DNA, 20 bp, Artificial Sequence
  Description of Artificial Sequence: Synthetic oligonucleotide
  Target: ATXN1; (+) strand; PAM type: YTN; PAM sequence: CTA
gtagaatgggaaccagaggc

SEQ ID NO: 264513 - DNA, 20 bp, Artificial Sequence
  Description of Artificial Sequence: Synthetic oligonucleotide
  Target: ATXN1; (+) strand; PAM type: YTN; PAM sequence: CTT
caaaaccttaaagcaggccc

SEQ ID NO: 264514 - DNA, 20 bp, Artificial Sequence
  Description of Artificial Sequence: Synthetic oligonucleotide
  Target: ATXN1; (+) strand; PAM type: YTN; PAM sequence: TTC
aaaaccttaaagcaggccct

SEQ ID NO: 264515 - DNA, 20 bp, Artificial Sequence
  Description of Artificial Sequence: Synthetic oligonucleotide
  Target: ATXN1; (+) strand; PAM type: YTN; PAM sequence: CTT
aaagcaggccctagtacaaa

SEQ ID NO: 264516 - DNA, 20 bp, Artificial Sequence
  Description of Artificial Sequence: Synthetic oligonucleotide
  Target: ATXN1; (+) strand; PAM type: YTN; PAM sequence: TTA
aagcaggccctagtacaaac

SEQ ID NO: 264517 - DNA, 20 bp, Artificial Sequence
  Description of Artificial Sequence: Synthetic oligonucleotide
  Target: ATXN1; (+) strand; PAM type: YTN; PAM sequence: CTA
gtacaaactcaagacttaag

SEQ ID NO: 264518 - DNA, 20 bp, Artificial Sequence
  Description of Artificial Sequence: Synthetic oligonucleotide
  Target: ATXN1; (+) strand; PAM type: YTN; PAM sequence: CTC
aagacttaagccttccccag

SEQ ID NO: 264519 - DNA, 20 bp, Artificial Sequence
  Description of Artificial Sequence: Synthetic oligonucleotide
  Target: ATXN1; (+) strand; PAM type: YTN; PAM sequence: CTT
aagccttccccaggacaaaa

SEQ ID NO: 264520 - DNA, 20 bp, Artificial Sequence
  Description of Artificial Sequence: Synthetic oligonucleotide
  Target: ATXN1; (+) strand; PAM type: YTN; PAM sequence: TTA
agccttccccaggacaaaac

SEQ ID NO: 264521 - DNA, 20 bp, Artificial Sequence
  Description of Artificial Sequence: Synthetic oligonucleotide
  Target: ATXN1; (+) strand; PAM type: YTN; PAM sequence: CTT
ccccaggacaaaacttctct

SEQ ID NO: 264522 - DNA, 20 bp, Artificial Sequence
  Description of Artificial Sequence: Synthetic oligonucleotide
  Target: ATXN1; (+) strand; PAM type: YTN; PAM sequence: TTC
cccaggacaaaacttctctt

SEQ ID NO: 264523 - DNA, 20 bp, Artificial Sequence
  Description of Artificial Sequence: Synthetic oligonucleotide
  Target: ATXN1; (+) strand; PAM type: YTN; PAM sequence: CTT
ctctttatacctcacagaga

SEQ ID NO: 264524 - DNA, 20 bp, Artificial Sequence
  Description of Artificial Sequence: Synthetic oligonucleotide
  Target: ATXN1; (+) strand; PAM type: YTN; PAM sequence: TTC
tctttatacctcacagagag

SEQ ID NO: 264525 - DNA, 20 bp, Artificial Sequence
  Description of Artificial Sequence: Synthetic oligonucleotide
  Target: ATXN1; (+) strand; PAM type: YTN; PAM sequence: CTC
tttatacctcacagagagag

SEQ ID NO: 264526 - DNA, 20 bp, Artificial Sequence
  Description of Artificial Sequence: Synthetic oligonucleotide
  Target: ATXN1; (+) strand; PAM type: YTN; PAM sequence: CTT
tatacctcacagagagagcg

SEQ ID NO: 264527 - DNA, 20 bp, Artificial Sequence
  Description of Artificial Sequence: Synthetic oligonucleotide
  Target: ATXN1; (+) strand; PAM type: YTN; PAM sequence: TTT
atacctcacagagagagcgg

SEQ ID NO: 264528 - DNA, 20 bp, Artificial Sequence
  Description of Artificial Sequence: Synthetic oligonucleotide
  Target: ATXN1; (+) strand; PAM type: YTN; PAM sequence: TTA
tacctcacagagagagcggg

SEQ ID NO: 264529 - DNA, 20 bp, Artificial Sequence
  Description of Artificial Sequence: Synthetic oligonucleotide
  Target: ATXN1; (+) strand; PAM type: YTN; PAM sequence: CTC
acagagagagcgggaatagc

SEQ ID NO: 264530 - DNA, 20 bp, Artificial Sequence
  Description of Artificial Sequence: Synthetic oligonucleotide
  Target: ATXN1; (+) strand; PAM type: YTN; PAM sequence: CTC
ttggagtccttactcagact

SEQ ID NO: 264531 - DNA, 20 bp, Artificial Sequence
  Description of Artificial Sequence: Synthetic oligonucleotide
  Target: ATXN1; (+) strand; PAM type: YTN; PAM sequence: CTT
ggagtccttactcagacttg

SEQ ID NO: 264532 - DNA, 20 bp, Artificial Sequence
  Description of Artificial Sequence: Synthetic oligonucleotide
  Target: ATXN1; (+) strand; PAM type: YTN; PAM sequence: TTG
gagtccttactcagacttgt

SEQ ID NO: 264533 - DNA, 20 bp, Artificial Sequence
  Description of Artificial Sequence: Synthetic oligonucleotide
  Target: ATXN1; (+) strand; PAM type: YTN; PAM sequence: CTT
actcagacttgtaggacaac

SEQ ID NO: 264534 - DNA, 20 bp, Artificial Sequence
  Description of Artificial Sequence: Synthetic oligonucleotide
  Target: ATXN1; (+) strand; PAM type: YTN; PAM sequence: TTA
ctcagacttgtaggacaacc

SEQ ID NO: 264535 - DNA, 20 bp, Artificial Sequence
  Description of Artificial Sequence: Synthetic oligonucleotide
  Target: ATXN1; (+) strand; PAM type: YTN; PAM sequence: CTC
agacttgtaggacaacccca

SEQ ID NO: 264536 - DNA, 20 bp, Artificial Sequence
  Description of Artificial Sequence: Synthetic oligonucleotide
  Target: ATXN1; (+) strand; PAM type: YTN; PAM sequence: CTT
gtaggacaaccccacaacca

SEQ ID NO: 264537 - DNA, 20 bp, Artificial Sequence
  Description of Artificial Sequence: Synthetic oligonucleotide
  Target: ATXN1; (+) strand; PAM type: YTN; PAM sequence: TTG
taggacaaccccacaaccag

SEQ ID NO: 264538 - DNA, 20 bp, Artificial Sequence
  Description of Artificial Sequence: Synthetic oligonucleotide
  Target: ATXN1; (+) strand; PAM type: YTN; PAM sequence: CTA
agtaaggaaattgatgtagt

SEQ ID NO: 264539 - DNA, 20 bp, Artificial Sequence
  Description of Artificial Sequence: Synthetic oligonucleotide
  Target: ATXN1; (+) strand; PAM type: YTN; PAM sequence: TTG
atgtagtagcaaaaggctgg

SEQ ID NO: 264540 - DNA, 20 bp, Artificial Sequence
  Description of Artificial Sequence: Synthetic oligonucleotide
  Target: ATXN1; (+) strand; PAM type: YTN; PAM sequence: CTG
gcctcactgtttacgggtag

SEQ ID NO: 264541 - DNA, 20 bp, Artificial Sequence
  Description of Artificial Sequence: Synthetic oligonucleotide
  Target: ATXN1; (+) strand; PAM type: YTN; PAM sequence: CTC
actgtttacgggtagttgtg

SEQ ID NO: 264542 - DNA, 20 bp, Artificial Sequence
  Description of Artificial Sequence: Synthetic oligonucleotide
  Target: ATXN1; (+) strand; PAM type: YTN; PAM sequence: CTG
tttacgggtagttgtggcag

SEQ ID NO: 264543 - DNA, 20 bp, Artificial Sequence
  Description of Artificial Sequence: Synthetic oligonucleotide
  Target: ATXN1; (+) strand; PAM type: YTN; PAM sequence: TTT
acgggtagttgtggcagtgg

SEQ ID NO: 264544 - DNA, 20 bp, Artificial Sequence
  Description of Artificial Sequence: Synthetic oligonucleotide
  Target: ATXN1; (+) strand; PAM type: YTN; PAM sequence: TTA
cgggtagttgtggcagtggc

SEQ ID NO: 264545 - DNA, 20 bp, Artificial Sequence
  Description of Artificial Sequence: Synthetic oligonucleotide
  Target: ATXN1; (+) strand; PAM type: YTN; PAM sequence: TTG
tggcagtggctatcttagtg

SEQ ID NO: 264546 - DNA, 20 bp, Artificial Sequence
  Description of Artificial Sequence: Synthetic oligonucleotide
  Target: ATXN1; (+) strand; PAM type: YTN; PAM sequence: CTA
tcttagtgtcagaggctatc

SEQ ID NO: 264547 - DNA, 20 bp, Artificial Sequence
  Description of Artificial Sequence: Synthetic oligonucleotide
  Target: ATXN1; (+) strand; PAM type: YTN; PAM sequence: CTT
agtgtcagaggctatcaaaa

SEQ ID NO: 264548 - DNA, 20 bp, Artificial Sequence
  Description of Artificial Sequence: Synthetic oligonucleotide
  Target: ATXN1; (+) strand; PAM type: YTN; PAM sequence: TTA
gtgtcagaggctatcaaaat

SEQ ID NO: 264549 - DNA, 20 bp, Artificial Sequence
  Description of Artificial Sequence: Synthetic oligonucleotide
  Target: ATXN1; (+) strand; PAM type: YTN; PAM sequence: CTA
tcaaaataatacaaggaaag

SEQ ID NO: 264550 - DNA, 20 bp, Artificial Sequence
  Description of Artificial Sequence: Synthetic oligonucleotide
  Target: ATXN1; (+) strand; PAM type: YTN; PAM sequence: CTC
accatctagactactcatga

SEQ ID NO: 264551 - DNA, 20 bp, Artificial Sequence
  Description of Artificial Sequence: Synthetic oligonucleotide
  Target: ATXN1; (+) strand; PAM type: YTN; PAM sequence: CTA
gactactcatgatgtaaatg

SEQ ID NO: 264552 - DNA, 20 bp, Artificial Sequence
  Description of Artificial Sequence: Synthetic oligonucleotide
  Target: ATXN1; (+) strand; PAM type: YTN; PAM sequence: CTA
ctcatgatgtaaatggcata

SEQ ID NO: 264553 - DNA, 20 bp, Artificial Sequence
  Description of Artificial Sequence: Synthetic oligonucleotide
  Target: ATXN1; (+) strand; PAM type: YTN; PAM sequence: CTC
atgatgtaaatggcatacca

SEQ ID NO: 264554 - DNA, 20 bp, Artificial Sequence
  Description of Artificial Sequence: Synthetic oligonucleotide
  Target: ATXN1; (+) strand; PAM type: YTN; PAM sequence: TTT
atggctatcagaaaaccacc

SEQ ID NO: 264555 - DNA, 20 bp, Artificial Sequence
  Description of Artificial Sequence: Synthetic oligonucleotide
  Target: ATXN1; (+) strand; PAM type: YTN; PAM sequence: TTA
tggctatcagaaaaccacct

SEQ ID NO: 264556 - DNA, 20 bp, Artificial Sequence
  Description of Artificial Sequence: Synthetic oligonucleotide
  Target: ATXN1; (+) strand; PAM type: YTN; PAM sequence: CTA
tcagaaaaccacctactcag

SEQ ID NO: 264557 - DNA, 20 bp, Artificial Sequence
  Description of Artificial Sequence: Synthetic oligonucleotide
  Target: ATXN1; (+) strand; PAM type: YTN; PAM sequence: CTA
ctcaggtaccaggcgctact

SEQ ID NO: 264558 - DNA, 20 bp, Artificial Sequence
  Description of Artificial Sequence: Synthetic oligonucleotide
  Target: ATXN1; (+) strand; PAM type: YTN; PAM sequence: CTC
aggtaccaggcgctactcat

SEQ ID NO: 264559 - DNA, 20 bp, Artificial Sequence
  Description of Artificial Sequence: Synthetic oligonucleotide
  Target: ATXN1; (+) strand; PAM type: YTN; PAM sequence: CTA
ctcattcagggactggtgct

SEQ ID NO: 264560 - DNA, 20 bp, Artificial Sequence
  Description of Artificial Sequence: Synthetic oligonucleotide
  Target: ATXN1; (+) strand; PAM type: YTN; PAM sequence: CTC
attcagggactggtgcttga

SEQ ID NO: 264561 - DNA, 20 bp, Artificial Sequence
  Description of Artificial Sequence: Synthetic oligonucleotide
  Target: ATXN1; (+) strand; PAM type: YTN; PAM sequence: TTC
agggactggtgcttgaaata

SEQ ID NO: 264562 - DNA, 20 bp, Artificial Sequence
  Description of Artificial Sequence: Synthetic oligonucleotide
  Target: ATXN1; (+) strand; PAM type: YTN; PAM sequence: CTG
gtgcttgaaatacacacgtg

SEQ ID NO: 264563 - DNA, 20 bp, Artificial Sequence
  Description of Artificial Sequence: Synthetic oligonucleotide
  Target: ATXN1; (+) strand; PAM type: YTN; PAM sequence: CTT
gaaatacacacgtgtgcagc

SEQ ID NO: 264564 - DNA, 20 bp, Artificial Sequence
  Description of Artificial Sequence: Synthetic oligonucleotide
  Target: ATXN1; (+) strand; PAM type: YTN; PAM sequence: TTG
aaatacacacgtgtgcagcc

SEQ ID NO: 264565 - DNA, 20 bp, Artificial Sequence
  Description of Artificial Sequence: Synthetic oligonucleotide
  Target: ATXN1; (+) strand; PAM type: YTN; PAM sequence: CTC
aaccctgctacttttctccc

SEQ ID NO: 264566 - DNA, 20 bp, Artificial Sequence
  Description of Artificial Sequence: Synthetic oligonucleotide
  Target: ATXN1; (+) strand; PAM type: YTN; PAM sequence: CTG
ctacttttctcccagaggat

SEQ ID NO: 264567 - DNA, 20 bp, Artificial Sequence
  Description of Artificial Sequence: Synthetic oligonucleotide
  Target: ATXN1; (+) strand; PAM type: YTN; PAM sequence: CTA
cttttctcccagaggatgga

SEQ ID NO: 264568 - DNA, 20 bp, Artificial Sequence
  Description of Artificial Sequence: Synthetic oligonucleotide
  Target: ATXN1; (+) strand; PAM type: YTN; PAM sequence: CTT
ttctcccagaggatggagaa

SEQ ID NO: 264569 - DNA, 20 bp, Artificial Sequence
  Description of Artificial Sequence: Synthetic oligonucleotide
  Target: ATXN1; (+) strand; PAM type: YTN; PAM sequence: TTT
tctcccagaggatggagaac

SEQ ID NO: 264570 - DNA, 20 bp, Artificial Sequence
  Description of Artificial Sequence: Synthetic oligonucleotide
  Target: ATXN1; (+) strand; PAM type: YTN; PAM sequence: TTT
ctcccagaggatggagaacc

SEQ ID NO: 264571 - DNA, 20 bp, Artificial Sequence
  Description of Artificial Sequence: Synthetic oligonucleotide
  Target: ATXN1; (+) strand; PAM type: YTN; PAM sequence: TTC
tcccagaggatggagaacca

SEQ ID NO: 264572 - DNA, 20 bp, Artificial Sequence
  Description of Artificial Sequence: Synthetic oligonucleotide
  Target: ATXN1; (+) strand; PAM type: YTN; PAM sequence: CTC
ccagaggatggagaaccaat

SEQ ID NO: 264573 - DNA, 20 bp, Artificial Sequence
  Description of Artificial Sequence: Synthetic oligonucleotide
  Target: ATXN1; (+) strand; PAM type: YTN; PAM sequence: CTG
ccaacaaattgtagcccaga

SEQ ID NO: 264574 - DNA, 20 bp, Artificial Sequence
  Description of Artificial Sequence: Synthetic oligonucleotide
  Target: ATXN1; (+) strand; PAM type: YTN; PAM sequence: TTG
tagcccagacttatgcttcc

SEQ ID NO: 264575 - DNA, 20 bp, Artificial Sequence
  Description of Artificial Sequence: Synthetic oligonucleotide
  Target: ATXN1; (+) strand; PAM type: YTN; PAM sequence: CTT
atgcttcccaacaggatctc

SEQ ID NO: 264576 - DNA, 20 bp, Artificial Sequence
  Description of Artificial Sequence: Synthetic oligonucleotide
  Target: ATXN1; (+) strand; PAM type: YTN; PAM sequence: TTA
tgcttcccaacaggatctct

SEQ ID NO: 264577 - DNA, 20 bp, Artificial Sequence
  Description of Artificial Sequence: Synthetic oligonucleotide
  Target: ATXN1; (+) strand; PAM type: YTN; PAM sequence: CTT
cccaacaggatctcttagaa

SEQ ID NO: 264578 - DNA, 20 bp, Artificial Sequence
  Description of Artificial Sequence: Synthetic oligonucleotide
  Target: ATXN1; (+) strand; PAM type: YTN; PAM sequence: TTC
ccaacaggatctcttagaag

SEQ ID NO: 264579 - DNA, 20 bp, Artificial Sequence
  Description of Artificial Sequence: Synthetic oligonucleotide
  Target: ATXN1; (+) strand; PAM type: YTN; PAM sequence: CTC
ttagaagtacccttagctaa

SEQ ID NO: 264580 - DNA, 20 bp, Artificial Sequence
  Description of Artificial Sequence: Synthetic oligonucleotide
  Target: ATXN1; (+) strand; PAM type: YTN; PAM sequence: CTT
agaagtacccttagctaatc

SEQ ID NO: 264581 - DNA, 20 bp, Artificial Sequence
  Description of Artificial Sequence: Synthetic oligonucleotide
  Target: ATXN1; (+) strand; PAM type: YTN; PAM sequence: TTA
gaagtacccttagctaatcc

SEQ ID NO: 264582 - DNA, 20 bp, Artificial Sequence
  Description of Artificial Sequence: Synthetic oligonucleotide
  Target: ATXN1; (+) strand; PAM type: YTN; PAM sequence: CTT
agctaatcctgaccttaacc

SEQ ID NO: 264583 - DNA, 20 bp, Artificial Sequence
  Description of Artificial Sequence: Synthetic oligonucleotide
  Target: ATXN1; (+) strand; PAM type: YTN; PAM sequence: TTA
gctaatcctgaccttaacct

SEQ ID NO: 264584 - DNA, 20 bp, Artificial Sequence
  Description of Artificial Sequence: Synthetic oligonucleotide
  Target: ATXN1; (+) strand; PAM type: YTN; PAM sequence: CTA
atcctgaccttaacctatat

SEQ ID NO: 264585 - DNA, 20 bp, Artificial Sequence
  Description of Artificial Sequence: Synthetic oligonucleotide
  Target: ATXN1; (+) strand; PAM type: YTN; PAM sequence: CTG
accttaacctatataccgat

SEQ ID NO: 264586 - DNA, 20 bp, Artificial Sequence
  Description of Artificial Sequence: Synthetic oligonucleotide
  Target: ATXN1; (+) strand; PAM type: YTN; PAM sequence: CTT
aacctatataccgatggaag

SEQ ID NO: 264587 - DNA, 20 bp, Artificial Sequence
  Description of Artificial Sequence: Synthetic oligonucleotide
  Target: ATXN1; (+) strand; PAM type: YTN; PAM sequence: TTA
acctatataccgatggaagt

SEQ ID NO: 264588 - DNA, 20 bp, Artificial Sequence
  Description of Artificial Sequence: Synthetic oligonucleotide
  Target: ATXN1; (+) strand; PAM type: YTN; PAM sequence: CTA
tataccgatggaagttcatt

SEQ ID NO: 264589 - DNA, 20 bp, Artificial Sequence
  Description of Artificial Sequence: Synthetic oligonucleotide
  Target: ATXN1; (+) strand; PAM type: YTN; PAM sequence: TTC
atttgtggagaatgggatat

SEQ ID NO: 264590 - DNA, 20 bp, Artificial Sequence
  Description of Artificial Sequence: Synthetic oligonucleotide
  Target: ATXN1; (+) strand; PAM type: YTN; PAM sequence: TTT
gtggagaatgggatatgaag

SEQ ID NO: 264591 - DNA, 20 bp, Artificial Sequence
  Description of Artificial Sequence: Synthetic oligonucleotide
  Target: ATXN1; (+) strand; PAM type: YTN; PAM sequence: TTG
tggagaatgggatatgaagg

SEQ ID NO: 264592 - DNA, 20 bp, Artificial Sequence
  Description of Artificial Sequence: Synthetic oligonucleotide
  Target: ATXN1; (+) strand; PAM type: YTN; PAM sequence: TTA
tgccatagttagtgatgtaa

SEQ ID NO: 264593 - DNA, 20 bp, Artificial Sequence
  Description of Artificial Sequence: Synthetic oligonucleotide
  Target: ATXN1; (+) strand; PAM type: YTN; PAM sequence: TTA
gtgatgtaacagtacttgaa

SEQ ID NO: 264594 - DNA, 20 bp, Artificial Sequence
  Description of Artificial Sequence: Synthetic oligonucleotide
  Target: ATXN1; (+) strand; PAM type: YTN; PAM sequence: CTT
gaaagtaagtctcttccccc

SEQ ID NO: 264595 - DNA, 20 bp, Artificial Sequence
  Description of Artificial Sequence: Synthetic oligonucleotide
  Target: ATXN1; (+) strand; PAM type: YTN; PAM sequence: TTG
aaagtaagtctcttcccccc

SEQ ID NO: 264596 - DNA, 20 bp, Artificial Sequence
  Description of Artificial Sequence: Synthetic oligonucleotide
  Target: ATXN1; (+) strand; PAM type: YTN; PAM sequence: CTC
ttccccccacggaccagcgc

SEQ ID NO: 264597 - DNA, 20 bp, Artificial Sequence
  Description of Artificial Sequence: Synthetic oligonucleotide
  Target: ATXN1; (+) strand; PAM type: YTN; PAM sequence: CTT
ccccccacggaccagcgcct

SEQ ID NO: 264598 - DNA, 20 bp, Artificial Sequence
  Description of Artificial Sequence: Synthetic oligonucleotide
  Target: ATXN1; (+) strand; PAM type: YTN; PAM sequence: TTC
cccccacggaccagcgccta

SEQ ID NO: 264599 - DNA, 20 bp, Artificial Sequence
  Description of Artificial Sequence: Synthetic oligonucleotide
  Target: ATXN1; (+) strand; PAM type: YTN; PAM sequence: CTA
gttagcagaacttacccaag

SEQ ID NO: 264600 - DNA, 20 bp, Artificial Sequence
  Description of Artificial Sequence: Synthetic oligonucleotide
  Target: ATXN1; (+) strand; PAM type: YTN; PAM sequence: TTA
gcagaacttacccaagcctt

SEQ ID NO: 264601 - DNA, 20 bp, Artificial Sequence
  Description of Artificial Sequence: Synthetic oligonucleotide
  Target: ATXN1; (+) strand; PAM type: YTN; PAM sequence: CTT
acccaagccttagaaccggg

SEQ ID NO: 264602 - DNA, 20 bp, Artificial Sequence
  Description of Artificial Sequence: Synthetic oligonucleotide
  Target: ATXN1; (+) strand; PAM type: YTN; PAM sequence: TTA
cccaagccttagaaccggga

SEQ ID NO: 264603 - DNA, 20 bp, Artificial Sequence
  Description of Artificial Sequence: Synthetic oligonucleotide
  Target: ATXN1; (+) strand; PAM type: YTN; PAM sequence: CTT
agaaccgggaaaggaaaaaa

SEQ ID NO: 264604 - DNA, 20 bp, Artificial Sequence
  Description of Artificial Sequence: Synthetic oligonucleotide
  Target: ATXN1; (+) strand; PAM type: YTN; PAM sequence: TTA
gaaccgggaaaggaaaaaag

SEQ ID NO: 264605 - DNA, 20 bp, Artificial Sequence
  Description of Artificial Sequence: Synthetic oligonucleotide
  Target: ATXN1; (+) strand; PAM type: YTN; PAM sequence: CTT
atctaatcctacatgcccat

SEQ ID NO: 264606 - DNA, 20 bp, Artificial Sequence
  Description of Artificial Sequence: Synthetic oligonucleotide
  Target: ATXN1; (+) strand; PAM type: YTN; PAM sequence: TTA
tctaatcctacatgcccatg

SEQ ID NO: 264607 - DNA, 20 bp, Artificial Sequence
  Description of Artificial Sequence: Synthetic oligonucleotide
  Target: ATXN1; (+) strand; PAM type: YTN; PAM sequence: CTA
atcctacatgcccatgctgc

SEQ ID NO: 264608 - DNA, 20 bp, Artificial Sequence
  Description of Artificial Sequence: Synthetic oligonucleotide
  Target: ATXN1; (+) strand; PAM type: YTN; PAM sequence: CTA
catgcccatgctgcaatatg

SEQ ID NO: 264609 - DNA, 20 bp, Artificial Sequence
  Description of Artificial Sequence: Synthetic oligonucleotide
  Target: ATXN1; (+) strand; PAM type: YTN; PAM sequence: CTG
caatatggaaagaaagggag

SEQ ID NO: 264610 - DNA, 20 bp, Artificial Sequence
  Description of Artificial Sequence: Synthetic oligonucleotide
  Target: ATXN1; (+) strand; PAM type: YTN; PAM sequence: TTC
ctaacctctgggggaacccc

SEQ ID NO: 264611 - DNA, 20 bp, Artificial Sequence
  Description of Artificial Sequence: Synthetic oligonucleotide
  Target: ATXN1; (+) strand; PAM type: YTN; PAM sequence: CTA
acctctgggggaacccccat

SEQ ID NO: 264612 - DNA, 20 bp, Artificial Sequence
  Description of Artificial Sequence: Synthetic oligonucleotide
  Target: ATXN1; (+) strand; PAM type: YTN; PAM sequence: CTC
tgggggaacccccattaaat

SEQ ID NO: 264613 - DNA, 20 bp, Artificial Sequence
  Description of Artificial Sequence: Synthetic oligonucleotide
  Target: ATXN1; (+) strand; PAM type: YTN; PAM sequence: CTG
ggggaacccccattaaatac

SEQ ID NO: 264614 - DNA, 20 bp, Artificial Sequence
  Description of Artificial Sequence: Synthetic oligonucleotide
  Target: ATXN1; (+) strand; PAM type: YTN; PAM sequence: TTA
aataccacaaggaaattatg

SEQ ID NO: 264615 - DNA, 20 bp, Artificial Sequence
  Description of Artificial Sequence: Synthetic oligonucleotide
  Target: ATXN1; (+) strand; PAM type: YTN; PAM sequence: TTA
tggagttattgcacacagtg

SEQ ID NO: 264616 - DNA, 20 bp, Artificial Sequence
  Description of Artificial Sequence: Synthetic oligonucleotide
  Target: ATXN1; (+) strand; PAM type: YTN; PAM sequence: TTA
ttgcacacagtgcaaaaacc

SEQ ID NO: 264617 - DNA, 20 bp, Artificial Sequence
  Description of Artificial Sequence: Synthetic oligonucleotide
  Target: ATXN1; (+) strand; PAM type: YTN; PAM sequence: TTG
cacacagtgcaaaaacccaa

SEQ ID NO: 264618 - DNA, 20 bp, Artificial Sequence
  Description of Artificial Sequence: Synthetic oligonucleotide
  Target: ATXN1; (+) strand; PAM type: YTN; PAM sequence: TTA
cactgctgaagccatcaaaa

SEQ ID NO: 264619 - DNA, 20 bp, Artificial Sequence
  Description of Artificial Sequence: Synthetic oligonucleotide
  Target: ATXN1; (+) strand; PAM type: YTN; PAM sequence: CTG
ctgaagccatcaaaaaggtg

SEQ ID NO: 264620 - DNA, 20 bp, Artificial Sequence
  Description of Artificial Sequence: Synthetic oligonucleotide
  Target: ATXN1; (+) strand; PAM type: YTN; PAM sequence: CTG
aagccatcaaaaaggtgaag

SEQ ID NO: 264621 - DNA, 20 bp, Artificial Sequence
  Description of Artificial Sequence: Synthetic oligonucleotide
  Target: ATXN1; (+) strand; PAM type: YTN; PAM sequence: CTG
ggcagatgctgaggccaaaa

SEQ ID NO: 264622 - DNA, 20 bp, Artificial Sequence
  Description of Artificial Sequence: Synthetic oligonucleotide
  Target: ATXN1; (+) strand; PAM type: YTN; PAM sequence: CTG
aggccaaaattgctgccagg

SEQ ID NO: 264623 - DNA, 20 bp, Artificial Sequence
  Description of Artificial Sequence: Synthetic oligonucleotide
  Target: ATXN1; (+) strand; PAM type: YTN; PAM sequence: TTG
ctgccaggcagaacctccca

SEQ ID NO: 264624 - DNA, 20 bp, Artificial Sequence
  Description of Artificial Sequence: Synthetic oligonucleotide
  Target: ATXN1; (+) strand; PAM type: YTN; PAM sequence: CTG
ccaggcagaacctcccatta

SEQ ID NO: 264625 - DNA, 20 bp, Artificial Sequence
  Description of Artificial Sequence: Synthetic oligonucleotide
  Target: ATXN1; (+) strand; PAM type: YTN; PAM sequence: CTC
ccattagaaatacctatgga

SEQ ID NO: 264626 - DNA, 20 bp, Artificial Sequence
  Description of Artificial Sequence: Synthetic oligonucleotide
  Target: ATXN1; (+) strand; PAM type: YTN; PAM sequence: TTA
gaaatacctatggaaggacc

SEQ ID NO: 264627 - DNA, 20 bp, Artificial Sequence
  Description of Artificial Sequence: Synthetic oligonucleotide
  Target: ATXN1; (+) strand; PAM type: YTN; PAM sequence: CTA
tggaaggacccatggtatgg

SEQ ID NO: 264628 - DNA, 20 bp, Artificial Sequence
  Description of Artificial Sequence: Synthetic oligonucleotide
  Target: ATXN1; (+) strand; PAM type: YTN; PAM sequence: CTC
caagagattaagccccagta

SEQ ID NO: 264629 - DNA, 20 bp, Artificial Sequence
  Description of Artificial Sequence: Synthetic oligonucleotide
  Target: ATXN1; (+) strand; PAM type: YTN; PAM sequence: TTA
agccccagtactccctgatc

SEQ ID NO: 264630 - DNA, 20 bp, Artificial Sequence
  Description of Artificial Sequence: Synthetic oligonucleotide
  Target: ATXN1; (+) strand; PAM type: YTN; PAM sequence: CTC
cctgatcgaaacagaatggg

SEQ ID NO: 264631 - DNA, 20 bp, Artificial Sequence
  Description of Artificial Sequence: Synthetic oligonucleotide
  Target: ATXN1; (+) strand; PAM type: YTN; PAM sequence: CTG
atcgaaacagaatggggact

SEQ ID NO: 264632 - DNA, 20 bp, Artificial Sequence
  Description of Artificial Sequence: Synthetic oligonucleotide
  Target: ATXN1; (+) strand; PAM type: YTN; PAM sequence: CTT
tcacgggggcatagttttct

SEQ ID NO: 264633 - DNA, 20 bp, Artificial Sequence
  Description of Artificial Sequence: Synthetic oligonucleotide
  Target: ATXN1; (+) strand; PAM type: YTN; PAM sequence: TTT
cacgggggcatagttttctc

SEQ ID NO: 264634 - DNA, 20 bp, Artificial Sequence
  Description of Artificial Sequence: Synthetic oligonucleotide
  Target: ATXN1; (+) strand; PAM type: YTN; PAM sequence: TTC
acgggggcatagttttctcc

SEQ ID NO: 264635 - DNA, 20 bp, Artificial Sequence
  Description of Artificial Sequence: Synthetic oligonucleotide
  Target: ATXN1; (+) strand; PAM type: YTN; PAM sequence: TTT
tctccccttggggtggttaa

SEQ ID NO: 264636 - DNA, 20 bp, Artificial Sequence
  Description of Artificial Sequence: Synthetic oligonucleotide
  Target: ATXN1; (+) strand; PAM type: YTN; PAM sequence: TTT
ctccccttggggtggttaac

SEQ ID NO: 264637 - DNA, 20 bp, Artificial Sequence
  Description of Artificial Sequence: Synthetic oligonucleotide
  Target: ATXN1; (+) strand; PAM type: YTN; PAM sequence: TTC
tccccttggggtggttaacg

SEQ ID NO: 264638 - DNA, 20 bp, Artificial Sequence
  Description of Artificial Sequence: Synthetic oligonucleotide
  Target: ATXN1; (+) strand; PAM type: YTN; PAM sequence: CTC
cccttggggtggttaacggc

SEQ ID NO: 264639 - DNA, 20 bp, Artificial Sequence
  Description of Artificial Sequence: Synthetic oligonucleotide
  Target: ATXN1; (+) strand; PAM type: YTN; PAM sequence: CTT
ggggtggttaacggcagaag

SEQ ID NO: 264640 - DNA, 20 bp, Artificial Sequence
  Description of Artificial Sequence: Synthetic oligonucleotide
  Target: ATXN1; (+) strand; PAM type: YTN; PAM sequence: TTG
gggtggttaacggcagaaga

SEQ ID NO: 264641 - DNA, 20 bp, Artificial Sequence
  Description of Artificial Sequence: Synthetic oligonucleotide
  Target: ATXN1; (+) strand; PAM type: YTN; PAM sequence: TTA
acggcagaagagggaaaggt

SEQ ID NO: 264642 - DNA, 20 bp, Artificial Sequence
  Description of Artificial Sequence: Synthetic oligonucleotide
  Target: ATXN1; (+) strand; PAM type: YTN; PAM sequence: CTC
atatccgaagccagccagtg

SEQ ID NO: 264643 - DNA, 20 bp, Artificial Sequence
  Description of Artificial Sequence: Synthetic oligonucleotide
  Target: ATXN1; (+) strand; PAM type: YTN; PAM sequence: CTT
aagaccccctgccaaacttt

SEQ ID NO: 264644 - DNA, 20 bp, Artificial Sequence
  Description of Artificial Sequence: Synthetic oligonucleotide
  Target: ATXN1; (+) strand; PAM type: YTN; PAM sequence: TTA
agaccccctgccaaactttt

SEQ ID NO: 264645 - DNA, 20 bp, Artificial Sequence
  Description of Artificial Sequence: Synthetic oligonucleotide
  Target: ATXN1; (+) strand; PAM type: YTN; PAM sequence: CTG
ccaaacttttcacatgggtt

SEQ ID NO: 264646 - DNA, 20 bp, Artificial Sequence
  Description of Artificial Sequence: Synthetic oligonucleotide
  Target: ATXN1; (+) strand; PAM type: YTN; PAM sequence: CTT
ttcacatgggtttgagaaca

SEQ ID NO: 264647 - DNA, 20 bp, Artificial Sequence
  Description of Artificial Sequence: Synthetic oligonucleotide
  Target: ATXN1; (+) strand; PAM type: YTN; PAM sequence: TTT
tcacatgggtttgagaacac

SEQ ID NO: 264648 - DNA, 20 bp, Artificial Sequence
  Description of Artificial Sequence: Synthetic oligonucleotide
  Target: ATXN1; (+) strand; PAM type: YTN; PAM sequence: TTT
cacatgggtttgagaacact

SEQ ID NO: 264649 - DNA, 20 bp, Artificial Sequence
  Description of Artificial Sequence: Synthetic oligonucleotide
  Target: ATXN1; (+) strand; PAM type: YTN; PAM sequence: TTC
acatgggtttgagaacactc

SEQ ID NO: 264650 - DNA, 20 bp, Artificial Sequence
  Description of Artificial Sequence: Synthetic oligonucleotide
  Target: ATXN1; (+) strand; PAM type: YTN; PAM sequence: TTT
gagaacactcatcaaatggc

SEQ ID NO: 264651 - DNA, 20 bp, Artificial Sequence
  Description of Artificial Sequence: Synthetic oligonucleotide
  Target: ATXN1; (+) strand; PAM type: YTN; PAM sequence: TTG
agaacactcatcaaatggcc

SEQ ID NO: 264652 - DNA, 20 bp, Artificial Sequence
  Description of Artificial Sequence: Synthetic oligonucleotide
  Target: ATXN1; (+) strand; PAM type: YTN; PAM sequence: CTC
atcaaatggccaaatcccta

SEQ ID NO: 264653 - DNA, 20 bp, Artificial Sequence
  Description of Artificial Sequence: Synthetic oligonucleotide
  Target: ATXN1; (+) strand; PAM type: YTN; PAM sequence: CTA
tttatggggccatatctcct

SEQ ID NO: 264654 - DNA, 20 bp, Artificial Sequence
  Description of Artificial Sequence: Synthetic oligonucleotide
  Target: ATXN1; (+) strand; PAM type: YTN; PAM sequence: TTT
atggggccatatctcctcca

SEQ ID NO: 264655 - DNA, 20 bp, Artificial Sequence
  Description of Artificial Sequence: Synthetic oligonucleotide
  Target: ATXN1; (+) strand; PAM type: YTN; PAM sequence: TTA
tggggccatatctcctccag

SEQ ID NO: 264656 - DNA, 20 bp, Artificial Sequence
  Description of Artificial Sequence: Synthetic oligonucleotide
  Target: ATXN1; (+) strand; PAM type: YTN; PAM sequence: CTC
ctccagaccatccaacaagt

SEQ ID NO: 264657 - DNA, 20 bp, Artificial Sequence
  Description of Artificial Sequence: Synthetic oligonucleotide
  Target: ATXN1; (+) strand; PAM type: YTN; PAM sequence: CTC
cagaccatccaacaagtagt

SEQ ID NO: 264658 - DNA, 20 bp, Artificial Sequence
  Description of Artificial Sequence: Synthetic oligonucleotide
  Target: ATXN1; (+) strand; PAM type: YTN; PAM sequence: CTG
tgaggtgtgccaaaggaaaa

SEQ ID NO: 264659 - DNA, 20 bp, Artificial Sequence
  Description of Artificial Sequence: Synthetic oligonucleotide
  Target: ATXN1; (+) strand; PAM type: YTN; PAM sequence: CTC
ttggtccatcgtaaggcccc

SEQ ID NO: 264660 - DNA, 20 bp, Artificial Sequence
  Description of Artificial Sequence: Synthetic oligonucleotide
  Target: ATXN1; (+) strand; PAM type: YTN; PAM sequence: CTT
ggtccatcgtaaggcccctt

SEQ ID NO: 264661 - DNA, 20 bp, Artificial Sequence
  Description of Artificial Sequence: Synthetic oligonucleotide
  Target: ATXN1; (+) strand; PAM type: YTN; PAM sequence: TTG
gtccatcgtaaggccccttt

SEQ ID NO: 264662 - DNA, 20 bp, Artificial Sequence
  Description of Artificial Sequence: Synthetic oligonucleotide
  Target: ATXN1; (+) strand; PAM type: YTN; PAM sequence: CTT
ttggggaacaaagaataggt

SEQ ID NO: 264663 - DNA, 20 bp, Artificial Sequence
  Description of Artificial Sequence: Synthetic oligonucleotide
  Target: ATXN1; (+) strand; PAM type: YTN; PAM sequence: TTT
tggggaacaaagaataggtc

SEQ ID NO: 264664 - DNA, 20 bp, Artificial Sequence
  Description of Artificial Sequence: Synthetic oligonucleotide
  Target: ATXN1; (+) strand; PAM type: YTN; PAM sequence: TTT
ggggaacaaagaataggtca

SEQ ID NO: 264665 - DNA, 20 bp, Artificial Sequence
  Description of Artificial Sequence: Synthetic oligonucleotide
  Target: ATXN1; (+) strand; PAM type: YTN; PAM sequence: TTG
gggaacaaagaataggtcac

SEQ ID NO: 264666 - DNA, 20 bp, Artificial Sequence
  Description of Artificial Sequence: Synthetic oligonucleotide
  Target: ATXN1; (+) strand; PAM type: YTN; PAM sequence: CTA
tcctggagaggactggcagt

SEQ ID NO: 264667 - DNA, 20 bp, Artificial Sequence
  Description of Artificial Sequence: Synthetic oligonucleotide
  Target: ATXN1; (+) strand; PAM type: YTN; PAM sequence: CTG
gagaggactggcagttagac

SEQ ID NO: 264668 - DNA, 20 bp, Artificial Sequence
  Description of Artificial Sequence: Synthetic oligonucleotide
  Target: ATXN1; (+) strand; PAM type: YTN; PAM sequence: CTG
gcagttagacttcacccata

SEQ ID NO: 264669 - DNA, 20 bp, Artificial Sequence
  Description of Artificial Sequence: Synthetic oligonucleotide
  Target: ATXN1; (+) strand; PAM type: YTN; PAM sequence: TTA
gacttcacccatatgcctaa

SEQ ID NO: 264670 - DNA, 20 bp, Artificial Sequence
  Description of Artificial Sequence: Synthetic oligonucleotide
  Target: ATXN1; (+) strand; PAM type: YTN; PAM sequence: CTT
cacccatatgcctaagtcaa

SEQ ID NO: 264671 - DNA, 20 bp, Artificial Sequence
  Description of Artificial Sequence: Synthetic oligonucleotide
  Target: ATXN1; (+) strand; PAM type: YTN; PAM sequence: TTC
acccatatgcctaagtcaag

SEQ ID NO: 264672 - DNA, 20 bp, Artificial Sequence
  Description of Artificial Sequence: Synthetic oligonucleotide
  Target: ATXN1; (+) strand; PAM type: YTN; PAM sequence: CTA
agtcaaggggatttcaatac

SEQ ID NO: 264673 - DNA, 20 bp, Artificial Sequence
  Description of Artificial Sequence: Synthetic oligonucleotide
  Target: ATXN1; (+) strand; PAM type: YTN; PAM sequence: TTT
caatacttgttggtctgtgt

SEQ ID NO: 264674 - DNA, 20 bp, Artificial Sequence
  Description of Artificial Sequence: Synthetic oligonucleotide
  Target: ATXN1; (+) strand; PAM type: YTN; PAM sequence: TTC
aatacttgttggtctgtgtt

SEQ ID NO: 264675 - DNA, 20 bp, Artificial Sequence
  Description of Artificial Sequence: Synthetic oligonucleotide
  Target: ATXN1; (+) strand; PAM type: YTN; PAM sequence: CTT
gttggtctgtgttgaccaac

SEQ ID NO: 264676 - DNA, 20 bp, Artificial Sequence
  Description of Artificial Sequence: Synthetic oligonucleotide
  Target: ATXN1; (+) strand; PAM type: YTN; PAM sequence: TTG
ttggtctgtgttgaccaacc

SEQ ID NO: 264677 - DNA, 20 bp, Artificial Sequence
  Description of Artificial Sequence: Synthetic oligonucleotide
  Target: ATXN1; (+) strand; PAM type: YTN; PAM sequence: TTG
gtctgtgttgaccaaccaaa

SEQ ID NO: 264678 - DNA, 20 bp, Artificial Sequence
  Description of Artificial Sequence: Synthetic oligonucleotide
  Target: ATXN1; (+) strand; PAM type: YTN; PAM sequence: CTG
tgttgaccaaccaaattgga

SEQ ID NO: 264679 - DNA, 20 bp, Artificial Sequence
  Description of Artificial Sequence: Synthetic oligonucleotide
  Target: ATXN1; (+) strand; PAM type: YTN; PAM sequence: TTG
accaaccaaattggatagaa

SEQ ID NO: 264680 - DNA, 20 bp, Artificial Sequence
  Description of Artificial Sequence: Synthetic oligonucleotide
  Target: ATXN1; (+) strand; PAM type: YTN; PAM sequence: TTG
gatagaagccttcccctgca

SEQ ID NO: 264681 - DNA, 20 bp, Artificial Sequence
  Description of Artificial Sequence: Synthetic oligonucleotide
  Target: ATXN1; (+) strand; PAM type: YTN; PAM sequence: CTT
cccctgcaagacggagaagg

SEQ ID NO: 264682 - DNA, 20 bp, Artificial Sequence
  Description of Artificial Sequence: Synthetic oligonucleotide
  Target: ATXN1; (+) strand; PAM type: YTN; PAM sequence: TTC
ccctgcaagacggagaaggc

SEQ ID NO: 264683 - DNA, 20 bp, Artificial Sequence
  Description of Artificial Sequence: Synthetic oligonucleotide
  Target: ATXN1; (+) strand; PAM type: YTN; PAM sequence: CTG
caagacggagaaggctcagg

SEQ ID NO: 264684 - DNA, 20 bp, Artificial Sequence
  Description of Artificial Sequence: Synthetic oligonucleotide
  Target: ATXN1; (+) strand; PAM type: YTN; PAM sequence: CTC
aggaagtggttaaagtacta

SEQ ID NO: 264685 - DNA, 20 bp, Artificial Sequence
  Description of Artificial Sequence: Synthetic oligonucleotide
  Target: ATXN1; (+) strand; PAM type: YTN; PAM sequence: TTA
aagtactaactcatgaaata

SEQ ID NO: 264686 - DNA, 20 bp, Artificial Sequence
  Description of Artificial Sequence: Synthetic oligonucleotide
  Target: ATXN1; (+) strand; PAM type: YTN; PAM sequence: CTA
actcatgaaataattcccag

SEQ ID NO: 264687 - DNA, 20 bp, Artificial Sequence
  Description of Artificial Sequence: Synthetic oligonucleotide
  Target: ATXN1; (+) strand; PAM type: YTN; PAM sequence: CTC
atgaaataattcccagattt

SEQ ID NO: 264688 - DNA, 20 bp, Artificial Sequence
  Description of Artificial Sequence: Synthetic oligonucleotide
  Target: ATXN1; (+) strand; PAM type: YTN; PAM sequence: TTC
ccagatttgggcttccccaa

SEQ ID NO: 264689 - DNA, 20 bp, Artificial Sequence
  Description of Artificial Sequence: Synthetic oligonucleotide
  Target: ATXN1; (+) strand; PAM type: YTN; PAM sequence: TTT
gggcttccccaaagcttaca

SEQ ID NO: 264690 - DNA, 20 bp, Artificial Sequence
  Description of Artificial Sequence: Synthetic oligonucleotide
  Target: ATXN1; (+) strand; PAM type: YTN; PAM sequence: TTG
ggcttccccaaagcttacaa

SEQ ID NO: 264691 - DNA, 20 bp, Artificial Sequence
  Description of Artificial Sequence: Synthetic oligonucleotide
  Target: ATXN1; (+) strand; PAM type: YTN; PAM sequence: CTT
ccccaaagcttacaaaacga

SEQ ID NO: 264692 - DNA, 20 bp, Artificial Sequence
  Description of Artificial Sequence: Synthetic oligonucleotide
  Target: ATXN1; (+) strand; PAM type: YTN; PAM sequence: TTC
cccaaagcttacaaaacgac

SEQ ID NO: 264693 - DNA, 20 bp, Artificial Sequence
  Description of Artificial Sequence: Synthetic oligonucleotide
  Target: ATXN1; (+) strand; PAM type: YTN; PAM sequence: CTT
acaaaacgacaatggtccgg

SEQ ID NO: 264694 - DNA, 20 bp, Artificial Sequence
  Description of Artificial Sequence: Synthetic oligonucleotide
  Target: ATXN1; (+) strand; PAM type: YTN; PAM sequence: TTA
caaaacgacaatggtccggc

SEQ ID NO: 264695 - DNA, 20 bp, Artificial Sequence
  Description of Artificial Sequence: Synthetic oligonucleotide
  Target: ATXN1; (+) strand; PAM type: YTN; PAM sequence: CTC
ttaaagccacggtaactcag

SEQ ID NO: 264696 - DNA, 20 bp, Artificial Sequence
  Description of Artificial Sequence: Synthetic oligonucleotide
  Target: ATXN1; (+) strand; PAM type: YTN; PAM sequence: CTT
aaagccacggtaactcaggg

SEQ ID NO: 264697 - DNA, 20 bp, Artificial Sequence
  Description of Artificial Sequence: Synthetic oligonucleotide
  Target: ATXN1; (+) strand; PAM type: YTN; PAM sequence: TTA
aagccacggtaactcaggga

SEQ ID NO: 264698 - DNA, 20 bp, Artificial Sequence
  Description of Artificial Sequence: Synthetic oligonucleotide
  Target: ATXN1; (+) strand; PAM type: YTN; PAM sequence: CTC
agggaatttccagggcacta

SEQ ID NO: 264699 - DNA, 20 bp, Artificial Sequence
  Description of Artificial Sequence: Synthetic oligonucleotide
  Target: ATXN1; (+) strand; PAM type: YTN; PAM sequence: TTT
ccagggcactagggatacaa

SEQ ID NO: 264700 - DNA, 20 bp, Artificial Sequence
  Description of Artificial Sequence: Synthetic oligonucleotide
  Target: ATXN1; (+) strand; PAM type: YTN; PAM sequence: TTC
cagggcactagggatacaat

SEQ ID NO: 264701 - DNA, 20 bp, Artificial Sequence
  Description of Artificial Sequence: Synthetic oligonucleotide
  Target: ATXN1; (+) strand; PAM type: YTN; PAM sequence: CTA
gggatacaatatcactttca

SEQ ID NO: 264702 - DNA, 20 bp, Artificial Sequence
  Description of Artificial Sequence: Synthetic oligonucleotide
  Target: ATXN1; (+) strand; PAM type: YTN; PAM sequence: CTT
tcactgtgcctggaggccac

SEQ ID NO: 264703 - DNA, 20 bp, Artificial Sequence
  Description of Artificial Sequence: Synthetic oligonucleotide
  Target: ATXN1; (+) strand; PAM type: YTN; PAM sequence: TTT
cactgtgcctggaggccaca

SEQ ID NO: 264704 - DNA, 20 bp, Artificial Sequence
  Description of Artificial Sequence: Synthetic oligonucleotide
  Target: ATXN1; (+) strand; PAM type: YTN; PAM sequence: TTC
actgtgcctggaggccacaa

SEQ ID NO: 264705 - DNA, 20 bp, Artificial Sequence
  Description of Artificial Sequence: Synthetic oligonucleotide
  Target: ATXN1; (+) strand; PAM type: YTN; PAM sequence: CTG
tgcctggaggccacaatcct

SEQ ID NO: 264706 - DNA, 20 bp, Artificial Sequence
  Description of Artificial Sequence: Synthetic oligonucleotide
  Target: ATXN1; (+) strand; PAM type: YTN; PAM sequence: CTG
gaggccacaatcctcaggga

SEQ ID NO: 264707 - DNA, 20 bp, Artificial Sequence
  Description of Artificial Sequence: Synthetic oligonucleotide
  Target: ATXN1; (+) strand; PAM type: YTN; PAM sequence: CTC
agggaaggctgagaaggcaa

SEQ ID NO: 264708 - DNA, 20 bp, Artificial Sequence
  Description of Artificial Sequence: Synthetic oligonucleotide
  Target: ATXN1; (+) strand; PAM type: YTN; PAM sequence: CTG
agaaggcaaacgaaacactc

SEQ ID NO: 264709 - DNA, 20 bp, Artificial Sequence
  Description of Artificial Sequence: Synthetic oligonucleotide
  Target: ATXN1; (+) strand; PAM type: YTN; PAM sequence: CTC
aagaggcacttaaggaaacg

SEQ ID NO: 264710 - DNA, 20 bp, Artificial Sequence
  Description of Artificial Sequence: Synthetic oligonucleotide
  Target: ATXN1; (+) strand; PAM type: YTN; PAM sequence: CTT
aaggaaacgaacacaagaaa

SEQ ID NO: 264711 - DNA, 20 bp, Artificial Sequence
  Description of Artificial Sequence: Synthetic oligonucleotide
  Target: ATXN1; (+) strand; PAM type: YTN; PAM sequence: TTA
aggaaacgaacacaagaaac

SEQ ID NO: 264712 - DNA, 20 bp, Artificial Sequence
  Description of Artificial Sequence: Synthetic oligonucleotide
  Target: ATXN1; (+) strand; PAM type: YTN; PAM sequence: CTC
atctcccatggcctactctc

SEQ ID NO: 264713 - DNA, 20 bp, Artificial Sequence
  Description of Artificial Sequence: Synthetic oligonucleotide
  Target: ATXN1; (+) strand; PAM type: YTN; PAM sequence: CTC
ccatggcctactctcttgcc

SEQ ID NO: 264714 - DNA, 20 bp, Artificial Sequence
  Description of Artificial Sequence: Synthetic oligonucleotide
  Target: ATXN1; (+) strand; PAM type: YTN; PAM sequence: CTA
ctctcttgcccatggccttg

SEQ ID NO: 264715 - DNA, 20 bp, Artificial Sequence
  Description of Artificial Sequence: Synthetic oligonucleotide
  Target: ATXN1; (+) strand; PAM type: YTN; PAM sequence: CTC
tcttgcccatggccttgttg

SEQ ID NO: 264716 - DNA, 20 bp, Artificial Sequence
  Description of Artificial Sequence: Synthetic oligonucleotide
  Target: ATXN1; (+) strand; PAM type: YTN; PAM sequence: CTC
ttgcccatggccttgttgag

SEQ ID NO: 264717 - DNA, 20 bp, Artificial Sequence
  Description of Artificial Sequence: Synthetic oligonucleotide
  Target: ATXN1; (+) strand; PAM type: YTN; PAM sequence: CTT
gcccatggccttgttgagaa

SEQ ID NO: 264718 - DNA, 20 bp, Artificial Sequence
  Description of Artificial Sequence: Synthetic oligonucleotide
  Target: ATXN1; (+) strand; PAM type: YTN; PAM sequence: TTG
cccatggccttgttgagaat

SEQ ID NO: 264719 - DNA, 20 bp, Artificial Sequence
  Description of Artificial Sequence: Synthetic oligonucleotide
  Target: ATXN1; (+) strand; PAM type: YTN; PAM sequence: CTT
gttgagaatccaaaattctc

SEQ ID NO: 264720 - DNA, 20 bp, Artificial Sequence
  Description of Artificial Sequence: Synthetic oligonucleotide
  Target: ATXN1; (+) strand; PAM type: YTN; PAM sequence: TTG
ttgagaatccaaaattctcc

SEQ ID NO: 264721 - DNA, 20 bp, Artificial Sequence
  Description of Artificial Sequence: Synthetic oligonucleotide
  Target: ATXN1; (+) strand; PAM type: YTN; PAM sequence: TTG
agaatccaaaattctcctca

SEQ ID NO: 264722 - DNA, 20 bp, Artificial Sequence
  Description of Artificial Sequence: Synthetic oligonucleotide
  Target: ATXN1; (+) strand; PAM type: YTN; PAM sequence: TTC
tcctcacaaaatggggctca

SEQ ID NO: 264723 - DNA, 20 bp, Artificial Sequence
  Description of Artificial Sequence: Synthetic oligonucleotide
  Target: ATXN1; (+) strand; PAM type: YTN; PAM sequence: CTC
ctcacaaaatggggctcagt

SEQ ID NO: 264724 - DNA, 20 bp, Artificial Sequence
  Description of Artificial Sequence: Synthetic oligonucleotide
  Target: ATXN1; (+) strand; PAM type: YTN; PAM sequence: CTC
acaaaatggggctcagtcca

SEQ ID NO: 264725 - DNA, 20 bp, Artificial Sequence
  Description of Artificial Sequence: Synthetic oligonucleotide
  Target: ATXN1; (+) strand; PAM type: YTN; PAM sequence: CTC
agtccatatgaagtgctgta

SEQ ID NO: 264726 - DNA, 20 bp, Artificial Sequence
  Description of Artificial Sequence: Synthetic oligonucleotide
  Target: ATXN1; (+) strand; PAM type: YTN; PAM sequence: CTG
tatggatgaccttttctcac

SEQ ID NO: 264727 - DNA, 20 bp, Artificial Sequence
  Description of Artificial Sequence: Synthetic oligonucleotide
  Target: ATXN1; (+) strand; PAM type: YTN; PAM sequence: CTT
ttctcacaaatgacctccta

SEQ ID NO: 264728 - DNA, 20 bp, Artificial Sequence
  Description of Artificial Sequence: Synthetic oligonucleotide
  Target: ATXN1; (+) strand; PAM type: YTN; PAM sequence: TTT
tctcacaaatgacctcctac

SEQ ID NO: 264729 - DNA, 20 bp, Artificial Sequence
  Description of Artificial Sequence: Synthetic oligonucleotide
  Target: ATXN1; (+) strand; PAM type: YTN; PAM sequence: TTT
ctcacaaatgacctcctact

SEQ ID NO: 264730 - DNA, 20 bp, Artificial Sequence
  Description of Artificial Sequence: Synthetic oligonucleotide
  Target: ATXN1; (+) strand; PAM type: YTN; PAM sequence: TTC
tcacaaatgacctcctactt

SEQ ID NO: 264731 - DNA, 20 bp, Artificial Sequence
  Description of Artificial Sequence: Synthetic oligonucleotide
  Target: ATXN1; (+) strand; PAM type: YTN; PAM sequence: CTC
acaaatgacctcctacttga

SEQ ID NO: 264732 - DNA, 20 bp, Artificial Sequence
  Description of Artificial Sequence: Synthetic oligonucleotide
  Target: ATXN1; (+) strand; PAM type: YTN; PAM sequence: CTC
ctacttgatcaggaaacggc

SEQ ID NO: 264733 - DNA, 20 bp, Artificial Sequence
  Description of Artificial Sequence: Synthetic oligonucleotide
  Target: ATXN1; (+) strand; PAM type: YTN; PAM sequence: CTA
cttgatcaggaaacggccaa

SEQ ID NO: 264734 - DNA, 20 bp, Artificial Sequence
  Description of Artificial Sequence: Synthetic oligonucleotide
  Target: ATXN1; (+) strand; PAM type: YTN; PAM sequence: CTT
gatcaggaaacggccaagtt

SEQ ID NO: 264735 - DNA, 20 bp, Artificial Sequence
  Description of Artificial Sequence: Synthetic oligonucleotide
  Target: ATXN1; (+) strand; PAM type: YTN; PAM sequence: TTG
atcaggaaacggccaagttg

SEQ ID NO: 264736 - DNA, 20 bp, Artificial Sequence
  Description of Artificial Sequence: Synthetic oligonucleotide
  Target: ATXN1; (+) strand; PAM type: YTN; PAM sequence: TTG
gtcaaagatataacttcttt

SEQ ID NO: 264737 - DNA, 20 bp, Artificial Sequence
  Description of Artificial Sequence: Synthetic oligonucleotide
  Target: ATXN1; (+) strand; PAM type: YTN; PAM sequence: CTT
ctttggcaaaataccaacaa

SEQ ID NO: 264738 - DNA, 20 bp, Artificial Sequence
  Description of Artificial Sequence: Synthetic oligonucleotide
  Target: ATXN1; (+) strand; PAM type: YTN; PAM sequence: TTC
tttggcaaaataccaacaaa

SEQ ID NO: 264739 - DNA, 20 bp, Artificial Sequence
  Description of Artificial Sequence: Synthetic oligonucleotide
  Target: ATXN1; (+) strand; PAM type: YTN; PAM sequence: CTT
tggcaaaataccaacaaaac

SEQ ID NO: 264740 - DNA, 20 bp, Artificial Sequence
  Description of Artificial Sequence: Synthetic oligonucleotide
  Target: ATXN1; (+) strand; PAM type: YTN; PAM sequence: TTT
ggcaaaataccaacaaaacg

SEQ ID NO: 264741 - DNA, 20 bp, Artificial Sequence
  Description of Artificial Sequence: Synthetic oligonucleotide
  Target: ATXN1; (+) strand; PAM type: YTN; PAM sequence: TTG
gcaaaataccaacaaaacgt

SEQ ID NO: 264742 - DNA, 20 bp, Artificial Sequence
  Description of Artificial Sequence: Synthetic oligonucleotide
  Target: ATXN1; (+) strand; PAM type: YTN; PAM sequence: TTA
aaaacctacccaaaggatgt

SEQ ID NO: 264743 - DNA, 20 bp, Artificial Sequence
  Description of Artificial Sequence: Synthetic oligonucleotide
  Target: ATXN1; (+) strand; PAM type: YTN; PAM sequence: CTA
cccaaaggatgtcacagaga

SEQ ID NO: 264744 - DNA, 20 bp, Artificial Sequence
  Description of Artificial Sequence: Synthetic oligonucleotide
  Target: ATXN1; (+) strand; PAM type: YTN; PAM sequence: TTG
ttccaaccaggagatttact

SEQ ID NO: 264745 - DNA, 20 bp, Artificial Sequence
  Description of Artificial Sequence: Synthetic oligonucleotide
  Target: ATXN1; (+) strand; PAM type: YTN; PAM sequence: TTC
caaccaggagatttactgtt

SEQ ID NO: 264746 - DNA, 20 bp, Artificial Sequence
  Description of Artificial Sequence: Synthetic oligonucleotide
  Target: ATXN1; (+) strand; PAM type: YTN; PAM sequence: TTT
actgttggtcaagtccctcc

SEQ ID NO: 264747 - DNA, 20 bp, Artificial Sequence
  Description of Artificial Sequence: Synthetic oligonucleotide
  Target: ATXN1; (+) strand; PAM type: YTN; PAM sequence: TTA
ctgttggtcaagtccctccc

SEQ ID NO: 264748 - DNA, 20 bp, Artificial Sequence
  Description of Artificial Sequence: Synthetic oligonucleotide
  Target: ATXN1; (+) strand; PAM type: YTN; PAM sequence: CTG
ttggtcaagtccctcccctc

SEQ ID NO: 264749 - DNA, 20 bp, Artificial Sequence
  Description of Artificial Sequence: Synthetic oligonucleotide
  Target: ATXN1; (+) strand; PAM type: YTN; PAM sequence: TTG
gtcaagtccctcccctcttc

SEQ ID NO: 264750 - DNA, 20 bp, Artificial Sequence
  Description of Artificial Sequence: Synthetic oligonucleotide
  Target: ATXN1; (+) strand; PAM type: YTN; PAM sequence: CTC
ccctcttcctcctcatctat

SEQ ID NO: 264751 - DNA, 20 bp, Artificial Sequence
  Description of Artificial Sequence: Synthetic oligonucleotide
  Target: ATXN1; (+) strand; PAM type: YTN; PAM sequence: CTC
ttcctcctcatctatggatt

SEQ ID NO: 264752 - DNA, 20 bp, Artificial Sequence
  Description of Artificial Sequence: Synthetic oligonucleotide
  Target: ATXN1; (+) strand; PAM type: YTN; PAM sequence: CTT
cctcctcatctatggattcc

SEQ ID NO: 264753 - DNA, 20 bp, Artificial Sequence
  Description of Artificial Sequence: Synthetic oligonucleotide
  Target: ATXN1; (+) strand; PAM type: YTN; PAM sequence: TTC
ctcctcatctatggattcct

SEQ ID NO: 264754 - DNA, 20 bp, Artificial Sequence
  Description of Artificial Sequence: Synthetic oligonucleotide
  Target: ATXN1; (+) strand; PAM type: YTN; PAM sequence: CTC
ctcatctatggattccttgt

SEQ ID NO: 264755 - DNA, 20 bp, Artificial Sequence
  Description of Artificial Sequence: Synthetic oligonucleotide
  Target: ATXN1; (+) strand; PAM type: YTN; PAM sequence: CTC
atctatggattccttgtggg

SEQ ID NO: 264756 - DNA, 20 bp, Artificial Sequence
  Description of Artificial Sequence: Synthetic oligonucleotide
  Target: ATXN1; (+) strand; PAM type: YTN; PAM sequence: CTA
tggattccttgtgggaagga

SEQ ID NO: 264757 - DNA, 20 bp, Artificial Sequence
  Description of Artificial Sequence: Synthetic oligonucleotide
  Target: ATXN1; (+) strand; PAM type: YTN; PAM sequence: TTC
cttgtgggaaggaccatact

SEQ ID NO: 264758 - DNA, 20 bp, Artificial Sequence
  Description of Artificial Sequence: Synthetic oligonucleotide
  Target: ATXN1; (+) strand; PAM type: YTN; PAM sequence: CTT
gtgggaaggaccatactcag

SEQ ID NO: 264759 - DNA, 20 bp, Artificial Sequence
  Description of Artificial Sequence: Synthetic oligonucleotide
  Target: ATXN1; (+) strand; PAM type: YTN; PAM sequence: TTG
tgggaaggaccatactcagt

SEQ ID NO: 264760 - DNA, 20 bp, Artificial Sequence
  Description of Artificial Sequence: Synthetic oligonucleotide
  Target: ATXN1; (+) strand; PAM type: YTN; PAM sequence: CTC
agtaatcctctctaccccca

SEQ ID NO: 264761 - DNA, 20 bp, Artificial Sequence
  Description of Artificial Sequence: Synthetic oligonucleotide
  Target: ATXN1; (+) strand; PAM type: YTN; PAM sequence: CTC
tctacccccactgcagttaa

SEQ ID NO: 264762 - DNA, 20 bp, Artificial Sequence
  Description of Artificial Sequence: Synthetic oligonucleotide
  Target: ATXN1; (+) strand; PAM type: YTN; PAM sequence: CTC
tacccccactgcagttaagg

SEQ ID NO: 264763 - DNA, 20 bp, Artificial Sequence
  Description of Artificial Sequence: Synthetic oligonucleotide
  Target: ATXN1; (+) strand; PAM type: YTN; PAM sequence: CTA
cccccactgcagttaaggtg

SEQ ID NO: 264764 - DNA, 20 bp, Artificial Sequence
  Description of Artificial Sequence: Synthetic oligonucleotide
  Target: ATXN1; (+) strand; PAM type: YTN; PAM sequence: CTG
cagttaaggtggcaggagtg

SEQ ID NO: 264765 - DNA, 20 bp, Artificial Sequence
  Description of Artificial Sequence: Synthetic oligonucleotide
  Target: ATXN1; (+) strand; PAM type: YTN; PAM sequence: TTA
aggtggcaggagtggaatct

SEQ ID NO: 264766 - DNA, 20 bp, Artificial Sequence
  Description of Artificial Sequence: Synthetic oligonucleotide
  Target: ATXN1; (+) strand; PAM type: YTN; PAM sequence: CTT
ggattcactacatgcgagtt

SEQ ID NO: 264767 - DNA, 20 bp, Artificial Sequence
  Description of Artificial Sequence: Synthetic oligonucleotide
  Target: ATXN1; (+) strand; PAM type: YTN; PAM sequence: TTG
gattcactacatgcgagtta

SEQ ID NO: 264768 - DNA, 20 bp, Artificial Sequence
  Description of Artificial Sequence: Synthetic oligonucleotide
  Target: ATXN1; (+) strand; PAM type: YTN; PAM sequence: TTC
actacatgcgagttaaactt

SEQ ID NO: 264769 - DNA, 20 bp, Artificial Sequence
  Description of Artificial Sequence: Synthetic oligonucleotide
  Target: ATXN1; (+) strand; PAM type: YTN; PAM sequence: CTA
catgcgagttaaactttgga

SEQ ID NO: 264770 - DNA, 20 bp, Artificial Sequence
  Description of Artificial Sequence: Synthetic oligonucleotide
  Target: ATXN1; (+) strand; PAM type: YTN; PAM sequence: TTA
aactttggacaccccctgaa

SEQ ID NO: 264771 - DNA, 20 bp, Artificial Sequence
  Description of Artificial Sequence: Synthetic oligonucleotide
  Target: ATXN1; (+) strand; PAM type: YTN; PAM sequence: CTT
tggacaccccctgaagaacc

SEQ ID NO: 264772 - DNA, 20 bp, Artificial Sequence
  Description of Artificial Sequence: Synthetic oligonucleotide
  Target: ATXN1; (+) strand; PAM type: YTN; PAM sequence: TTT
ggacaccccctgaagaacct

SEQ ID NO: 264773 - DNA, 20 bp, Artificial Sequence
  Description of Artificial Sequence: Synthetic oligonucleotide
  Target: ATXN1; (+) strand; PAM type: YTN; PAM sequence: TTG
gacaccccctgaagaacctg

SEQ ID NO: 264774 - DNA, 20 bp, Artificial Sequence
  Description of Artificial Sequence: Synthetic oligonucleotide
  Target: ATXN1; (+) strand; PAM type: YTN; PAM sequence: CTG
aagaacctgtaggaccatca

SEQ ID NO: 264775 - DNA, 20 bp, Artificial Sequence
  Description of Artificial Sequence: Synthetic oligonucleotide
  Target: ATXN1; (+) strand; PAM type: YTN; PAM sequence: CTG
taggaccatcagctcaggag

SEQ ID NO: 264776 - DNA, 20 bp, Artificial Sequence
  Description of Artificial Sequence: Synthetic oligonucleotide
  Target: ATXN1; (+) strand; PAM type: YTN; PAM sequence: CTC
aggagtcccaagatcagcca

SEQ ID NO: 264777 - DNA, 20 bp, Artificial Sequence
  Description of Artificial Sequence: Synthetic oligonucleotide
  Target: ATXN1; (+) strand; PAM type: YTN; PAM sequence: CTC
gataaacctgtgaaccattg

SEQ ID NO: 264778 - DNA, 20 bp, Artificial Sequence
  Description of Artificial Sequence: Synthetic oligonucleotide
  Target: ATXN1; (+) strand; PAM type: YTN; PAM sequence: CTG
tgaaccattggaagatttgt

SEQ ID NO: 264779 - DNA, 20 bp, Artificial Sequence
  Description of Artificial Sequence: Synthetic oligonucleotide
  Target: ATXN1; (+) strand; PAM type: YTN; PAM sequence: TTG
gaagatttgtgtctcctatt

SEQ ID NO: 264780 - DNA, 20 bp, Artificial Sequence
  Description of Artificial Sequence: Synthetic oligonucleotide
  Target: ATXN1; (+) strand; PAM type: YTN; PAM sequence: TTT
gtgtctcctatttcagaagg

SEQ ID NO: 264781 - DNA, 20 bp, Artificial Sequence
  Description of Artificial Sequence: Synthetic oligonucleotide
  Target: ATXN1; (+) strand; PAM type: YTN; PAM sequence: TTG
tgtctcctatttcagaagga

SEQ ID NO: 264782 - DNA, 20 bp, Artificial Sequence
  Description of Artificial Sequence: Synthetic oligonucleotide
  Target: ATXN1; (+) strand; PAM type: YTN; PAM sequence: CTC
ctatttcagaaggaaacatc

SEQ ID NO: 264783 - DNA, 20 bp, Artificial Sequence
  Description of Artificial Sequence: Synthetic oligonucleotide
  Target: ATXN1; (+) strand; PAM type: YTN; PAM sequence: CTA
tttcagaaggaaacatccca

SEQ ID NO: 264784 - DNA, 20 bp, Artificial Sequence
  Description of Artificial Sequence: Synthetic oligonucleotide
  Target: ATXN1; (+) strand; PAM type: YTN; PAM sequence: TTT
cagaaggaaacatcccagac

SEQ ID NO: 264785 - DNA, 20 bp, Artificial Sequence
  Description of Artificial Sequence: Synthetic oligonucleotide
  Target: ATXN1; (+) strand; PAM type: YTN; PAM sequence: TTC
agaaggaaacatcccagact

SEQ ID NO: 264786 - DNA, 20 bp, Artificial Sequence
  Description of Artificial Sequence: Synthetic oligonucleotide
  Target: ATXN1; (+) strand; PAM type: YTN; PAM sequence: CTA
aaaaggcccctatagctgat

SEQ ID NO: 264787 - DNA, 20 bp, Artificial Sequence
  Description of Artificial Sequence: Synthetic oligonucleotide
  Target: ATXN1; (+) strand; PAM type: YTN; PAM sequence: CTA
tagctgatcctaaggaaaaa

SEQ ID NO: 264788 - DNA, 20 bp, Artificial Sequence
  Description of Artificial Sequence: Synthetic oligonucleotide
  Target: ATXN1; (+) strand; PAM type: YTN; PAM sequence: CTG
atcctaaggaaaaactcttt

SEQ ID NO: 264789 - DNA, 20 bp, Artificial Sequence
  Description of Artificial Sequence: Synthetic oligonucleotide
  Target: ATXN1; (+) strand; PAM type: YTN; PAM sequence: CTA
aggaaaaactctttcctatt

SEQ ID NO: 264790 - DNA, 20 bp, Artificial Sequence
  Description of Artificial Sequence: Synthetic oligonucleotide
  Target: ATXN1; (+) strand; PAM type: YTN; PAM sequence: CTC
tttcctatttaaaaaggata

SEQ ID NO: 264791 - DNA, 20 bp, Artificial Sequence
  Description of Artificial Sequence: Synthetic oligonucleotide
  Target: ATXN1; (+) strand; PAM type: YTN; PAM sequence: CTT
tcctatttaaaaaggataag

SEQ ID NO: 264792 - DNA, 20 bp, Artificial Sequence
  Description of Artificial Sequence: Synthetic oligonucleotide
  Target: ATXN1; (+) strand; PAM type: YTN; PAM sequence: TTT
cctatttaaaaaggataagt

SEQ ID NO: 264793 - DNA, 20 bp, Artificial Sequence
  Description of Artificial Sequence: Synthetic oligonucleotide
  Target: ATXN1; (+) strand; PAM type: YTN; PAM sequence: TTC
ctatttaaaaaggataagtg

SEQ ID NO: 264794 - DNA, 20 bp, Artificial Sequence
  Description of Artificial Sequence: Synthetic oligonucleotide
  Target: ATXN1; (+) strand; PAM type: YTN; PAM sequence: CTA
tttaaaaaggataagtgaaa

SEQ ID NO: 264795 - DNA, 20 bp, Artificial Sequence
  Description of Artificial Sequence: Synthetic oligonucleotide
  Target: ATXN1; (+) strand; PAM type: YTN; PAM sequence: TTT
aaaaaggataagtgaaaacc

SEQ ID NO: 264796 - DNA, 20 bp, Artificial Sequence
  Description of Artificial Sequence: Synthetic oligonucleotide
  Target: ATXN1; (+) strand; PAM type: YTN; PAM sequence: TTA
aaaaggataagtgaaaacct

SEQ ID NO: 264797 - DNA, 20 bp, Artificial Sequence
  Description of Artificial Sequence: Synthetic oligonucleotide
  Target: ATXN1; (+) strand; PAM type: YTN; PAM sequence: CTA
cataatctttaacaccactc

SEQ ID NO: 264798 - DNA, 20 bp, Artificial Sequence
  Description of Artificial Sequence: Synthetic oligonucleotide
  Target: ATXN1; (+) strand; PAM type: YTN; PAM sequence: CTT
taacaccactccttgcccct

SEQ ID NO: 264799 - DNA, 20 bp, Artificial Sequence
  Description of Artificial Sequence: Synthetic oligonucleotide
  Target: ATXN1; (+) strand; PAM type: YTN; PAM sequence: TTT
aacaccactccttgcccctt

SEQ ID NO: 264800 - DNA, 20 bp, Artificial Sequence
  Description of Artificial Sequence: Synthetic oligonucleotide
  Target: ATXN1; (+) strand; PAM type: YTN; PAM sequence: TTA
acaccactccttgccccttt

SEQ ID NO: 264801 - DNA, 20 bp, Artificial Sequence
  Description of Artificial Sequence: Synthetic oligonucleotide
  Target: ATXN1; (+) strand; PAM type: YTN; PAM sequence: CTC
cttgcccctttaatggaatc

SEQ ID NO: 264802 - DNA, 20 bp, Artificial Sequence
  Description of Artificial Sequence: Synthetic oligonucleotide
  Target: ATXN1; (+) strand; PAM type: YTN; PAM sequence: CTT
gcccctttaatggaatcctt

SEQ ID NO: 264803 - DNA, 20 bp, Artificial Sequence
  Description of Artificial Sequence: Synthetic oligonucleotide
  Target: ATXN1; (+) strand; PAM type: YTN; PAM sequence: TTG
cccctttaatggaatccttt

SEQ ID NO: 264804 - DNA, 20 bp, Artificial Sequence
  Description of Artificial Sequence: Synthetic oligonucleotide
  Target: ATXN1; (+) strand; PAM type: YTN; PAM sequence: CTT
taatggaatccttttacagt

SEQ ID NO: 264805 - DNA, 20 bp, Artificial Sequence
  Description of Artificial Sequence: Synthetic oligonucleotide
  Target: ATXN1; (+) strand; PAM type: YTN; PAM sequence: TTT
aatggaatccttttacagtt

SEQ ID NO: 264806 - DNA, 20 bp, Artificial Sequence
  Description of Artificial Sequence: Synthetic oligonucleotide
  Target: ATXN1; (+) strand; PAM type: YTN; PAM sequence: TTA
atggaatccttttacagttt

SEQ ID NO: 264807 - DNA, 20 bp, Artificial Sequence
  Description of Artificial Sequence: Synthetic oligonucleotide
  Target: ATXN1; (+) strand; PAM type: YTN; PAM sequence: CTT
ttacagtttcatcacattat

SEQ ID NO: 264808 - DNA, 20 bp, Artificial Sequence
  Description of Artificial Sequence: Synthetic oligonucleotide
  Target: ATXN1; (+) strand; PAM type: YTN; PAM sequence: TTT
tacagtttcatcacattatt

SEQ ID NO: 264809 - DNA, 20 bp, Artificial Sequence
  Description of Artificial Sequence: Synthetic oligonucleotide
  Target: ATXN1; (+) strand; PAM type: YTN; PAM sequence: TTT
acagtttcatcacattatta

SEQ ID NO: 264810 - DNA, 20 bp, Artificial Sequence
  Description of Artificial Sequence: Synthetic oligonucleotide
  Target: ATXN1; (+) strand; PAM type: YTN; PAM sequence: TTA
cagtttcatcacattattaa

SEQ ID NO: 264811 - DNA, 20 bp, Artificial Sequence
  Description of Artificial Sequence: Synthetic oligonucleotide
  Target: ATXN1; (+) strand; PAM type: YTN; PAM sequence: TTT
catcacattattaagcagta

SEQ ID NO: 264812 - DNA, 20 bp, Artificial Sequence
  Description of Artificial Sequence: Synthetic oligonucleotide
  Target: ATXN1; (+) strand; PAM type: YTN; PAM sequence: TTC
atcacattattaagcagtat

SEQ ID NO: 264813 - DNA, 20 bp, Artificial Sequence
  Description of Artificial Sequence: Synthetic oligonucleotide
  Target: ATXN1; (+) strand; PAM type: YTN; PAM sequence: TTA
ttaagcagtatactaaccat

SEQ ID NO: 264814 - DNA, 20 bp, Artificial Sequence
  Description of Artificial Sequence: Synthetic oligonucleotide
  Target: ATXN1; (+) strand; PAM type: YTN; PAM sequence: TTA
agcagtatactaaccattct

SEQ ID NO: 264815 - DNA, 20 bp, Artificial Sequence
  Description of Artificial Sequence: Synthetic oligonucleotide
  Target: ATXN1; (+) strand; PAM type: YTN; PAM sequence: CTA
accattctctttgcagcagg

SEQ ID NO: 264816 - DNA, 20 bp, Artificial Sequence
  Description of Artificial Sequence: Synthetic oligonucleotide
  Target: ATXN1; (+) strand; PAM type: YTN; PAM sequence: TTC
tctttgcagcaggactatat

SEQ ID NO: 264817 - DNA, 20 bp, Artificial Sequence
  Description of Artificial Sequence: Synthetic oligonucleotide
  Target: ATXN1; (+) strand; PAM type: YTN; PAM sequence: CTC
tttgcagcaggactatatac

SEQ ID NO: 264818 - DNA, 20 bp, Artificial Sequence
  Description of Artificial Sequence: Synthetic oligonucleotide
  Target: ATXN1; (+) strand; PAM type: YTN; PAM sequence: CTT
tgcagcaggactatatactg

SEQ ID NO: 264819 - DNA, 20 bp, Artificial Sequence
  Description of Artificial Sequence: Synthetic oligonucleotide
  Target: ATXN1; (+) strand; PAM type: YTN; PAM sequence: TTT
gcagcaggactatatactgt

SEQ ID NO: 264820 - DNA, 20 bp, Artificial Sequence
  Description of Artificial Sequence: Synthetic oligonucleotide
  Target: ATXN1; (+) strand; PAM type: YTN; PAM sequence: TTG
cagcaggactatatactgta

SEQ ID NO: 264821 - DNA, 20 bp, Artificial Sequence
  Description of Artificial Sequence: Synthetic oligonucleotide
  Target: ATXN1; (+) strand; PAM type: YTN; PAM sequence: CTA
tatactgtagctcctgccgg

SEQ ID NO: 264822 - DNA, 20 bp, Artificial Sequence
  Description of Artificial Sequence: Synthetic oligonucleotide
  Target: ATXN1; (+) strand; PAM type: YTN; PAM sequence: CTG
tagctcctgccgggacaaaa

SEQ ID NO: 264823 - DNA, 20 bp, Artificial Sequence
  Description of Artificial Sequence: Synthetic oligonucleotide
  Target: ATXN1; (+) strand; PAM type: YTN; PAM sequence: CTC
ctgccgggacaaaaatccta

SEQ ID NO: 264824 - DNA, 20 bp, Artificial Sequence
  Description of Artificial Sequence: Synthetic oligonucleotide
  Target: ATXN1; (+) strand; PAM type: YTN; PAM sequence: CTG
ccgggacaaaaatcctaatc

SEQ ID NO: 264825 - DNA, 20 bp, Artificial Sequence
  Description of Artificial Sequence: Synthetic oligonucleotide
  Target: ATXN1; (+) strand; PAM type: YTN; PAM sequence: CTA
atcacatcaaccttttttac

SEQ ID NO: 264826 - DNA, 20 bp, Artificial Sequence
  Description of Artificial Sequence: Synthetic oligonucleotide
  Target: ATXN1; (+) strand; PAM type: YTN; PAM sequence: CTT
ttttacatgcaatccagctt

SEQ ID NO: 264827 - DNA, 20 bp, Artificial Sequence
  Description of Artificial Sequence: Synthetic oligonucleotide
  Target: ATXN1; (+) strand; PAM type: YTN; PAM sequence: TTT
tttacatgcaatccagcttt

SEQ ID NO: 264828 - DNA, 20 bp, Artificial Sequence
  Description of Artificial Sequence: Synthetic oligonucleotide
  Target: ATXN1; (+) strand; PAM type: YTN; PAM sequence: TTT
ttacatgcaatccagctttt

SEQ ID NO: 264829 - DNA, 20 bp, Artificial Sequence
  Description of Artificial Sequence: Synthetic oligonucleotide
  Target: ATXN1; (+) strand; PAM type: YTN; PAM sequence: TTT
tacatgcaatccagctttta

SEQ ID NO: 264830 - DNA, 20 bp, Artificial Sequence
  Description of Artificial Sequence: Synthetic oligonucleotide
  Target: ATXN1; (+) strand; PAM type: YTN; PAM sequence: TTT
acatgcaatccagcttttac

SEQ ID NO: 264831 - DNA, 20 bp, Artificial Sequence
  Description of Artificial Sequence: Synthetic oligonucleotide
  Target: ATXN1; (+) strand; PAM type: YTN; PAM sequence: TTA
catgcaatccagcttttacg

SEQ ID NO: 264832 - DNA, 20 bp, Artificial Sequence
  Description of Artificial Sequence: Synthetic oligonucleotide
  Target: ATXN1; (+) strand; PAM type: YTN; PAM sequence: CTT
ttacgctcttacatttccaa

SEQ ID NO: 264833 - DNA, 20 bp, Artificial Sequence
  Description of Artificial Sequence: Synthetic oligonucleotide
  Target: ATXN1; (+) strand; PAM type: YTN; PAM sequence: TTT
tacgctcttacatttccaac

SEQ ID NO: 264834 - DNA, 20 bp, Artificial Sequence
  Description of Artificial Sequence: Synthetic oligonucleotide
  Target: ATXN1; (+) strand; PAM type: YTN; PAM sequence: TTT
acgctcttacatttccaacc

SEQ ID NO: 264835 - DNA, 20 bp, Artificial Sequence
  Description of Artificial Sequence: Synthetic oligonucleotide
  Target: ATXN1; (+) strand; PAM type: YTN; PAM sequence: TTA
cgctcttacatttccaacct

SEQ ID NO: 264836 - DNA, 20 bp, Artificial Sequence
  Description of Artificial Sequence: Synthetic oligonucleotide
  Target: ATXN1; (+) strand; PAM type: YTN; PAM sequence: CTC
ttacatttccaacctcacct

SEQ ID NO: 264837 - DNA, 20 bp, Artificial Sequence
  Description of Artificial Sequence: Synthetic oligonucleotide
  Target: ATXN1; (+) strand; PAM type: YTN; PAM sequence: CTT
acatttccaacctcacctat

SEQ ID NO: 264838 - DNA, 20 bp, Artificial Sequence
  Description of Artificial Sequence: Synthetic oligonucleotide
  Target: ATXN1; (+) strand; PAM type: YTN; PAM sequence: TTA
catttccaacctcacctatt

SEQ ID NO: 264839 - DNA, 20 bp, Artificial Sequence
  Description of Artificial Sequence: Synthetic oligonucleotide
  Target: ATXN1; (+) strand; PAM type: YTN; PAM sequence: TTT
ccaacctcacctattacatg

SEQ ID NO: 264840 - DNA, 20 bp, Artificial Sequence
  Description of Artificial Sequence: Synthetic oligonucleotide
  Target: ATXN1; (+) strand; PAM type: YTN; PAM sequence: TTC
caacctcacctattacatga

SEQ ID NO: 264841 - DNA, 20 bp, Artificial Sequence
  Description of Artificial Sequence: Synthetic oligonucleotide
  Target: ATXN1; (+) strand; PAM type: YTN; PAM sequence: CTC
acctattacatgagcaatga

SEQ ID NO: 264842 - DNA, 20 bp, Artificial Sequence
  Description of Artificial Sequence: Synthetic oligonucleotide
  Target: ATXN1; (+) strand; PAM type: YTN; PAM sequence: CTA
ttacatgagcaatgaaaagc

SEQ ID NO: 264843 - DNA, 20 bp, Artificial Sequence
  Description of Artificial Sequence: Synthetic oligonucleotide
  Target: ATXN1; (+) strand; PAM type: YTN; PAM sequence: TTA
catgagcaatgaaaagccct

SEQ ID NO: 264844 - DNA, 20 bp, Artificial Sequence
  Description of Artificial Sequence: Synthetic oligonucleotide
  Target: ATXN1; (+) strand; PAM type: YTN; PAM sequence: CTG
taaccgtgaataccatctta

SEQ ID NO: 264845 - DNA, 20 bp, Artificial Sequence
  Description of Artificial Sequence: Synthetic oligonucleotide
  Target: ATXN1; (+) strand; PAM type: YTN; PAM sequence: CTT
aactttccaagccccgttat

SEQ ID NO: 264846 - DNA, 20 bp, Artificial Sequence
  Description of Artificial Sequence: Synthetic oligonucleotide
  Target: ATXN1; (+) strand; PAM type: YTN; PAM sequence: TTA
actttccaagccccgttatg

SEQ ID NO: 264847 - DNA, 20 bp, Artificial Sequence
  Description of Artificial Sequence: Synthetic oligonucleotide
  Target: ATXN1; (+) strand; PAM type: YTN; PAM sequence: CTT
tccaagccccgttatgcatc

SEQ ID NO: 264848 - DNA, 20 bp, Artificial Sequence
  Description of Artificial Sequence: Synthetic oligonucleotide
  Target: ATXN1; (+) strand; PAM type: YTN; PAM sequence: TTT
ccaagccccgttatgcatcc

SEQ ID NO: 264849 - DNA, 20 bp, Artificial Sequence
  Description of Artificial Sequence: Synthetic oligonucleotide
  Target: ATXN1; (+) strand; PAM type: YTN; PAM sequence: TTC
caagccccgttatgcatcca

SEQ ID NO: 264850 - DNA, 20 bp, Artificial Sequence
  Description of Artificial Sequence: Synthetic oligonucleotide
  Target: ATXN1; (+) strand; PAM type: YTN; PAM sequence: TTA
tgcatccaacgcaacctgtt

SEQ ID NO: 264851 - DNA, 20 bp, Artificial Sequence
  Description of Artificial Sequence: Synthetic oligonucleotide
  Target: ATXN1; (+) strand; PAM type: YTN; PAM sequence: CTG
ttatcaggcctgcccctggg

SEQ ID NO: 264852 - DNA, 20 bp, Artificial Sequence
  Description of Artificial Sequence: Synthetic oligonucleotide
  Target: ATXN1; (+) strand; PAM type: YTN; PAM sequence: TTA
tcaggcctgcccctggggca

SEQ ID NO: 264853 - DNA, 20 bp, Artificial Sequence
  Description of Artificial Sequence: Synthetic oligonucleotide
  Target: ATXN1; (+) strand; PAM type: YTN; PAM sequence: CTG
cccctggggcacctactatc

SEQ ID NO: 264854 - DNA, 20 bp, Artificial Sequence
  Description of Artificial Sequence: Synthetic oligonucleotide
  Target: ATXN1; (+) strand; PAM type: YTN; PAM sequence: CTG
gggcacctactatcccatca

SEQ ID NO: 264855 - DNA, 20 bp, Artificial Sequence
  Description of Artificial Sequence: Synthetic oligonucleotide
  Target: ATXN1; (+) strand; PAM type: YTN; PAM sequence: CTA
ctatcccatcagtgtaatta

SEQ ID NO: 264856 - DNA, 20 bp, Artificial Sequence
  Description of Artificial Sequence: Synthetic oligonucleotide
  Target: ATXN1; (+) strand; PAM type: YTN; PAM sequence: CTA
tcccatcagtgtaattacac

SEQ ID NO: 264857 - DNA, 20 bp, Artificial Sequence
  Description of Artificial Sequence: Synthetic oligonucleotide
  Target: ATXN1; (+) strand; PAM type: YTN; PAM sequence: TTA
cactctccaacttcaagccc

SEQ ID NO: 264858 - DNA, 20 bp, Artificial Sequence
  Description of Artificial Sequence: Synthetic oligonucleotide
  Target: ATXN1; (+) strand; PAM type: YTN; PAM sequence: CTC
tccaacttcaagccccaaat

SEQ ID NO: 264859 - DNA, 20 bp, Artificial Sequence
  Description of Artificial Sequence: Synthetic oligonucleotide
  Target: ATXN1; (+) strand; PAM type: YTN; PAM sequence: CTC
caacttcaagccccaaatga

SEQ ID NO: 264860 - DNA, 20 bp, Artificial Sequence
  Description of Artificial Sequence: Synthetic oligonucleotide
  Target: ATXN1; (+) strand; PAM type: YTN; PAM sequence: CTT
caagccccaaatgatcatag

SEQ ID NO: 264861 - DNA, 20 bp, Artificial Sequence
  Description of Artificial Sequence: Synthetic oligonucleotide
  Target: ATXN1; (+) strand; PAM type: YTN; PAM sequence: TTC
aagccccaaatgatcatagt

SEQ ID NO: 264862 - DNA, 20 bp, Artificial Sequence
  Description of Artificial Sequence: Synthetic oligonucleotide
  Target: ATXN1; (+) strand; PAM type: YTN; PAM sequence: CTT
ccaaggcacccaaaccgctc

SEQ ID NO: 264863 - DNA, 20 bp, Artificial Sequence
  Description of Artificial Sequence: Synthetic oligonucleotide
  Target: ATXN1; (+) strand; PAM type: YTN; PAM sequence: TTC
caaggcacccaaaccgctct

SEQ ID NO: 264864 - DNA, 20 bp, Artificial Sequence
  Description of Artificial Sequence: Synthetic oligonucleotide
  Target: ATXN1; (+) strand; PAM type: YTN; PAM sequence: CTC
tattcagatggcttgtccgc

SEQ ID NO: 264865 - DNA, 20 bp, Artificial Sequence
  Description of Artificial Sequence: Synthetic oligonucleotide
  Target: ATXN1; (+) strand; PAM type: YTN; PAM sequence: CTA
ttcagatggcttgtccgctt

SEQ ID NO: 264866 - DNA, 20 bp, Artificial Sequence
  Description of Artificial Sequence: Synthetic oligonucleotide
  Target: ATXN1; (+) strand; PAM type: YTN; PAM sequence: TTC
agatggcttgtccgcttctc

SEQ ID NO: 264867 - DNA, 20 bp, Artificial Sequence
  Description of Artificial Sequence: Synthetic oligonucleotide
  Target: ATXN1; (+) strand; PAM type: YTN; PAM sequence: CTT
gtccgcttctcagggccccc

SEQ ID NO: 264868 - DNA, 20 bp, Artificial Sequence
  Description of Artificial Sequence: Synthetic oligonucleotide
  Target: ATXN1; (+) strand; PAM type: YTN; PAM sequence: TTG
tccgcttctcagggccccca

SEQ ID NO: 264869 - DNA, 20 bp, Artificial Sequence
  Description of Artificial Sequence: Synthetic oligonucleotide
  Target: ATXN1; (+) strand; PAM type: YTN; PAM sequence: CTT
ctcagggcccccaaaaatca

SEQ ID NO: 264870 - DNA, 20 bp, Artificial Sequence
  Description of Artificial Sequence: Synthetic oligonucleotide
  Target: ATXN1; (+) strand; PAM type: YTN; PAM sequence: TTC
tcagggcccccaaaaatcat

SEQ ID NO: 264871 - DNA, 20 bp, Artificial Sequence
  Description of Artificial Sequence: Synthetic oligonucleotide
  Target: ATXN1; (+) strand; PAM type: YTN; PAM sequence: CTC
agggcccccaaaaatcatca

SEQ ID NO: 264872 - DNA, 20 bp, Artificial Sequence
  Description of Artificial Sequence: Synthetic oligonucleotide
  Target: ATXN1; (+) strand; PAM type: YTN; PAM sequence: CTC
ctccctgcttaacaaacagt

SEQ ID NO: 264873 - DNA, 20 bp, Artificial Sequence
  Description of Artificial Sequence: Synthetic oligonucleotide
  Target: ATXN1; (+) strand; PAM type: YTN; PAM sequence: CTC
cctgcttaacaaacagtcca

SEQ ID NO: 264874 - DNA, 20 bp, Artificial Sequence
  Description of Artificial Sequence: Synthetic oligonucleotide
  Target: ATXN1; (+) strand; PAM type: YTN; PAM sequence: CTG
cttaacaaacagtccaggtt

SEQ ID NO: 264875 - DNA, 20 bp, Artificial Sequence
  Description of Artificial Sequence: Synthetic oligonucleotide
  Target: ATXN1; (+) strand; PAM type: YTN; PAM sequence: CTT
aacaaacagtccaggttttg

SEQ ID NO: 264876 - DNA, 20 bp, Artificial Sequence
  Description of Artificial Sequence: Synthetic oligonucleotide
  Target: ATXN1; (+) strand; PAM type: YTN; PAM sequence: TTA
acaaacagtccaggttttgt

SEQ ID NO: 264877 - DNA, 20 bp, Artificial Sequence
  Description of Artificial Sequence: Synthetic oligonucleotide
  Target: ATXN1; (+) strand; PAM type: YTN; PAM sequence: TTT
tgtaatggcaaacatactcc

SEQ ID NO: 264878 - DNA, 20 bp, Artificial Sequence
  Description of Artificial Sequence: Synthetic oligonucleotide
  Target: ATXN1; (+) strand; PAM type: YTN; PAM sequence: TTT
gtaatggcaaacatactccc

SEQ ID NO: 264879 - DNA, 20 bp, Artificial Sequence
  Description of Artificial Sequence: Synthetic oligonucleotide
  Target: ATXN1; (+) strand; PAM type: YTN; PAM sequence: TTG
taatggcaaacatactccct

SEQ ID NO: 264880 - DNA, 20 bp, Artificial Sequence
  Description of Artificial Sequence: Synthetic oligonucleotide
  Target: ATXN1; (+) strand; PAM type: YTN; PAM sequence: CTC
cctgtatgactattcacccc

SEQ ID NO: 264881 - DNA, 20 bp, Artificial Sequence
  Description of Artificial Sequence: Synthetic oligonucleotide
  Target: ATXN1; (+) strand; PAM type: YTN; PAM sequence: CTG
tatgactattcacccctgga

SEQ ID NO: 264882 - DNA, 20 bp, Artificial Sequence
  Description of Artificial Sequence: Synthetic oligonucleotide
  Target: ATXN1; (+) strand; PAM type: YTN; PAM sequence: CTA
ttcacccctggaccccctgc

SEQ ID NO: 264883 - DNA, 20 bp, Artificial Sequence
  Description of Artificial Sequence: Synthetic oligonucleotide
  Target: ATXN1; (+) strand; PAM type: YTN; PAM sequence: TTC
acccctggaccccctgcagc

SEQ ID NO: 264884 - DNA, 20 bp, Artificial Sequence
  Description of Artificial Sequence: Synthetic oligonucleotide
  Target: ATXN1; (+) strand; PAM type: YTN; PAM sequence: CTG
gaccccctgcagcagcaccc

SEQ ID NO: 264885 - DNA, 20 bp, Artificial Sequence
  Description of Artificial Sequence: Synthetic oligonucleotide
  Target: ATXN1; (+) strand; PAM type: YTN; PAM sequence: CTG
cagcagcacccccaccacta

SEQ ID NO: 264886 - DNA, 20 bp, Artificial Sequence
  Description of Artificial Sequence: Synthetic oligonucleotide
  Target: ATXN1; (+) strand; PAM type: YTN; PAM sequence: CTA
aggaataccttctcatcctc

SEQ ID NO: 264887 - DNA, 20 bp, Artificial Sequence
  Description of Artificial Sequence: Synthetic oligonucleotide
  Target: ATXN1; (+) strand; PAM type: YTN; PAM sequence: CTT
ctcatcctctctttcaatca

SEQ ID NO: 264888 - DNA, 20 bp, Artificial Sequence
  Description of Artificial Sequence: Synthetic oligonucleotide
  Target: ATXN1; (+) strand; PAM type: YTN; PAM sequence: TTC
tcatcctctctttcaatcac

SEQ ID NO: 264889 - DNA, 20 bp, Artificial Sequence
  Description of Artificial Sequence: Synthetic oligonucleotide
  Target: ATXN1; (+) strand; PAM type: YTN; PAM sequence: CTC
atcctctctttcaatcactc

SEQ ID NO: 264890 - DNA, 20 bp, Artificial Sequence
  Description of Artificial Sequence: Synthetic oligonucleotide
  Target: ATXN1; (+) strand; PAM type: YTN; PAM sequence: CTC
tctttcaatcactctcttga

SEQ ID NO: 264891 - DNA, 20 bp, Artificial Sequence
  Description of Artificial Sequence: Synthetic oligonucleotide
  Target: ATXN1; (+) strand; PAM type: YTN; PAM sequence: CTC
tttcaatcactctcttgaat

SEQ ID NO: 264892 - DNA, 20 bp, Artificial Sequence
  Description of Artificial Sequence: Synthetic oligonucleotide
  Target: ATXN1; (+) strand; PAM type: YTN; PAM sequence: CTT
tcaatcactctcttgaatgg

SEQ ID NO: 264893 - DNA, 20 bp, Artificial Sequence
  Description of Artificial Sequence: Synthetic oligonucleotide
  Target: ATXN1; (+) strand; PAM type: YTN; PAM sequence: TTT
caatcactctcttgaatggt

SEQ ID NO: 264894 - DNA, 20 bp, Artificial Sequence
  Description of Artificial Sequence: Synthetic oligonucleotide
  Target: ATXN1; (+) strand; PAM type: YTN; PAM sequence: TTC
aatcactctcttgaatggtt

SEQ ID NO: 264895 - DNA, 20 bp, Artificial Sequence
  Description of Artificial Sequence: Synthetic oligonucleotide
  Target: ATXN1; (+) strand; PAM type: YTN; PAM sequence: CTC
tcttgaatggttcctagtag

SEQ ID NO: 264896 - DNA, 20 bp, Artificial Sequence
  Description of Artificial Sequence: Synthetic oligonucleotide
  Target: ATXN1; (+) strand; PAM type: YTN; PAM sequence: CTC
ttgaatggttcctagtagat

SEQ ID NO: 264897 - DNA, 20 bp, Artificial Sequence
  Description of Artificial Sequence: Synthetic oligonucleotide
  Target: ATXN1; (+) strand; PAM type: YTN; PAM sequence: CTT
gaatggttcctagtagatac

SEQ ID NO: 264898 - DNA, 20 bp, Artificial Sequence
  Description of Artificial Sequence: Synthetic oligonucleotide
  Target: ATXN1; (+) strand; PAM type: YTN; PAM sequence: TTG
aatggttcctagtagataca

SEQ ID NO: 264899 - DNA, 20 bp, Artificial Sequence
  Description of Artificial Sequence: Synthetic oligonucleotide
  Target: ATXN1; (+) strand; PAM type: YTN; PAM sequence: TTC
ctagtagatacaaaacagtt

SEQ ID NO: 264900 - DNA, 20 bp, Artificial Sequence
  Description of Artificial Sequence: Synthetic oligonucleotide
  Target: ATXN1; (+) strand; PAM type: YTN; PAM sequence: CTA
gtagatacaaaacagttttt

SEQ ID NO: 264901 - DNA, 20 bp, Artificial Sequence
  Description of Artificial Sequence: Synthetic oligonucleotide
  Target: ATXN1; (+) strand; PAM type: YTN; PAM sequence: TTT
tttctccaatgggaaaatag

SEQ ID NO: 264902 - DNA, 20 bp, Artificial Sequence
  Description of Artificial Sequence: Synthetic oligonucleotide
  Target: ATXN1; (+) strand; PAM type: YTN; PAM sequence: TTT
ttctccaatgggaaaataga

SEQ ID NO: 264903 - DNA, 20 bp, Artificial Sequence
  Description of Artificial Sequence: Synthetic oligonucleotide
  Target: ATXN1; (+) strand; PAM type: YTN; PAM sequence: TTT
tctccaatgggaaaatagag

SEQ ID NO: 264904 - DNA, 20 bp, Artificial Sequence
  Description of Artificial Sequence: Synthetic oligonucleotide
  Target: ATXN1; (+) strand; PAM type: YTN; PAM sequence: TTT
ctccaatgggaaaatagagc

SEQ ID NO: 264905 - DNA, 20 bp, Artificial Sequence
  Description of Artificial Sequence: Synthetic oligonucleotide
  Target: ATXN1; (+) strand; PAM type: YTN; PAM sequence: TTC
tccaatgggaaaatagagca

SEQ ID NO: 264906 - DNA, 20 bp, Artificial Sequence
  Description of Artificial Sequence: Synthetic oligonucleotide
  Target: ATXN1; (+) strand; PAM type: YTN; PAM sequence: CTC
caatgggaaaatagagcaca

SEQ ID NO: 264907 - DNA, 20 bp, Artificial Sequence
  Description of Artificial Sequence: Synthetic oligonucleotide
  Target: ATXN1; (+) strand; PAM type: YTN; PAM sequence: CTC
agtttgctcccaacacccct

SEQ ID NO: 264908 - DNA, 20 bp, Artificial Sequence
  Description of Artificial Sequence: Synthetic oligonucleotide
  Target: ATXN1; (+) strand; PAM type: YTN; PAM sequence: TTT
gctcccaacacccctttcca

SEQ ID NO: 264909 - DNA, 20 bp, Artificial Sequence
  Description of Artificial Sequence: Synthetic oligonucleotide
  Target: ATXN1; (+) strand; PAM type: YTN; PAM sequence: TTG
ctcccaacacccctttccag

SEQ ID NO: 264910 - DNA, 20 bp, Artificial Sequence
  Description of Artificial Sequence: Synthetic oligonucleotide
  Target: ATXN1; (+) strand; PAM type: YTN; PAM sequence: CTC
ccaacacccctttccagcca

SEQ ID NO: 264911 - DNA, 20 bp, Artificial Sequence
  Description of Artificial Sequence: Synthetic oligonucleotide
  Target: ATXN1; (+) strand; PAM type: YTN; PAM sequence: CTT
tccagccactcaccagacta

SEQ ID NO: 264912 - DNA, 20 bp, Artificial Sequence
  Description of Artificial Sequence: Synthetic oligonucleotide
  Target: ATXN1; (+) strand; PAM type: YTN; PAM sequence: TTT
ccagccactcaccagactac

SEQ ID NO: 264913 - DNA, 20 bp, Artificial Sequence
  Description of Artificial Sequence: Synthetic oligonucleotide
  Target: ATXN1; (+) strand; PAM type: YTN; PAM sequence: TTC
cagccactcaccagactacc

SEQ ID NO: 264914 - DNA, 20 bp, Artificial Sequence
  Description of Artificial Sequence: Synthetic oligonucleotide
  Target: ATXN1; (+) strand; PAM type: YTN; PAM sequence: CTC
accagactaccttggcaagt

SEQ ID NO: 264915 - DNA, 20 bp, Artificial Sequence
  Description of Artificial Sequence: Synthetic oligonucleotide
  Target: ATXN1; (+) strand; PAM type: YTN; PAM sequence: CTA
ccttggcaagtactctagga

SEQ ID NO: 264916 - DNA, 20 bp, Artificial Sequence
  Description of Artificial Sequence: Synthetic oligonucleotide
  Target: ATXN1; (+) strand; PAM type: YTN; PAM sequence: CTT
ggcaagtactctaggagtat

SEQ ID NO: 264917 - DNA, 20 bp, Artificial Sequence
  Description of Artificial Sequence: Synthetic oligonucleotide
  Target: ATXN1; (+) strand; PAM type: YTN; PAM sequence: TTG
gcaagtactctaggagtatg

SEQ ID NO: 264918 - DNA, 20 bp, Artificial Sequence
  Description of Artificial Sequence: Synthetic oligonucleotide
  Target: ATXN1; (+) strand; PAM type: YTN; PAM sequence: CTC
taggagtatgggaaaatgaa

SEQ ID NO: 264919 - DNA, 20 bp, Artificial Sequence
  Description of Artificial Sequence: Synthetic oligonucleotide
  Target: ATXN1; (+) strand; PAM type: YTN; PAM sequence: CTA
ggagtatgggaaaatgaaaa

SEQ ID NO: 264920 - DNA, 20 bp, Artificial Sequence
  Description of Artificial Sequence: Synthetic oligonucleotide
  Target: ATXN1; (+) strand; PAM type: YTN; PAM sequence: CTC
acacacctttttaacataca

SEQ ID NO: 264921 - DNA, 20 bp, Artificial Sequence
  Description of Artificial Sequence: Synthetic oligonucleotide
  Target: ATXN1; (+) strand; PAM type: YTN; PAM sequence: CTT
tttaacatacacaaccagtt

SEQ ID NO: 264922 - DNA, 20 bp, Artificial Sequence
  Description of Artificial Sequence: Synthetic oligonucleotide
  Target: ATXN1; (+) strand; PAM type: YTN; PAM sequence: TTT
ttaacatacacaaccagttc

SEQ ID NO: 264923 - DNA, 20 bp, Artificial Sequence
  Description of Artificial Sequence: Synthetic oligonucleotide
  Target: ATXN1; (+) strand; PAM type: YTN; PAM sequence: TTT
taacatacacaaccagttct

SEQ ID NO: 264924 - DNA, 20 bp, Artificial Sequence
  Description of Artificial Sequence: Synthetic oligonucleotide
  Target: ATXN1; (+) strand; PAM type: YTN; PAM sequence: TTT
aacatacacaaccagttctg

SEQ ID NO: 264925 - DNA, 20 bp, Artificial Sequence
  Description of Artificial Sequence: Synthetic oligonucleotide
  Target: ATXN1; (+) strand; PAM type: YTN; PAM sequence: TTA
acatacacaaccagttctgt

SEQ ID NO: 264926 - DNA, 20 bp, Artificial Sequence
  Description of Artificial Sequence: Synthetic oligonucleotide
  Target: ATXN1; (+) strand; PAM type: YTN; PAM sequence: TTC
tgtctacccagccaaggcat

SEQ ID NO: 264927 - DNA, 20 bp, Artificial Sequence
  Description of Artificial Sequence: Synthetic oligonucleotide
  Target: ATXN1; (+) strand; PAM type: YTN; PAM sequence: CTG
tctacccagccaaggcatat

SEQ ID NO: 264928 - DNA, 20 bp, Artificial Sequence
  Description of Artificial Sequence: Synthetic oligonucleotide
  Target: ATXN1; (+) strand; PAM type: YTN; PAM sequence: CTA
cccagccaaggcatattctt

SEQ ID NO: 264929 - DNA, 20 bp, Artificial Sequence
  Description of Artificial Sequence: Synthetic oligonucleotide
  Target: ATXN1; (+) strand; PAM type: YTN; PAM sequence: TTC
ttatgtggaacttcaactta

SEQ ID NO: 264930 - DNA, 20 bp, Artificial Sequence
  Description of Artificial Sequence: Synthetic oligonucleotide
  Target: ATXN1; (+) strand; PAM type: YTN; PAM sequence: CTT
atgtggaacttcaacttaca

SEQ ID NO: 264931 - DNA, 20 bp, Artificial Sequence
  Description of Artificial Sequence: Synthetic oligonucleotide
  Target: ATXN1; (+) strand; PAM type: YTN; PAM sequence: TTA
tgtggaacttcaacttacat

SEQ ID NO: 264932 - DNA, 20 bp, Artificial Sequence
  Description of Artificial Sequence: Synthetic oligonucleotide
  Target: ATXN1; (+) strand; PAM type: YTN; PAM sequence: CTT
caacttacatctgcctcccc

SEQ ID NO: 264933 - DNA, 20 bp, Artificial Sequence
  Description of Artificial Sequence: Synthetic oligonucleotide
  Target: ATXN1; (+) strand; PAM type: YTN; PAM sequence: TTC
aacttacatctgcctcccca

SEQ ID NO: 264934 - DNA, 20 bp, Artificial Sequence
  Description of Artificial Sequence: Synthetic oligonucleotide
  Target: ATXN1; (+) strand; PAM type: YTN; PAM sequence: CTT
acatctgcctccccactaac

SEQ ID NO: 264935 - DNA, 20 bp, Artificial Sequence
  Description of Artificial Sequence: Synthetic oligonucleotide
  Target: ATXN1; (+) strand; PAM type: YTN; PAM sequence: TTA
catctgcctccccactaact

SEQ ID NO: 264936 - DNA, 20 bp, Artificial Sequence
  Description of Artificial Sequence: Synthetic oligonucleotide
  Target: ATXN1; (+) strand; PAM type: YTN; PAM sequence: CTG
cctccccactaactggacag

SEQ ID NO: 264937 - DNA, 20 bp, Artificial Sequence
  Description of Artificial Sequence: Synthetic oligonucleotide
  Target: ATXN1; (+) strand; PAM type: YTN; PAM sequence: CTC
cccactaactggacaggcac

SEQ ID NO: 264938 - DNA, 20 bp, Artificial Sequence
  Description of Artificial Sequence: Synthetic oligonucleotide
  Target: ATXN1; (+) strand; PAM type: YTN; PAM sequence: CTA
actggacaggcacctgtacc

SEQ ID NO: 264939 - DNA, 20 bp, Artificial Sequence
  Description of Artificial Sequence: Synthetic oligonucleotide
  Target: ATXN1; (+) strand; PAM type: YTN; PAM sequence: CTG
gacaggcacctgtaccttag

SEQ ID NO: 264940 - DNA, 20 bp, Artificial Sequence
  Description of Artificial Sequence: Synthetic oligonucleotide
  Target: ATXN1; (+) strand; PAM type: YTN; PAM sequence: CTG
taccttagtcttcctaagtc

SEQ ID NO: 264941 - DNA, 20 bp, Artificial Sequence
  Description of Artificial Sequence: Synthetic oligonucleotide
  Target: ATXN1; (+) strand; PAM type: YTN; PAM sequence: CTT
agtcttcctaagtcccaaca

SEQ ID NO: 264942 - DNA, 20 bp, Artificial Sequence
  Description of Artificial Sequence: Synthetic oligonucleotide
  Target: ATXN1; (+) strand; PAM type: YTN; PAM sequence: TTA
gtcttcctaagtcccaacat

SEQ ID NO: 264943 - DNA, 20 bp, Artificial Sequence
  Description of Artificial Sequence: Synthetic oligonucleotide
  Target: ATXN1; (+) strand; PAM type: YTN; PAM sequence: CTT
cctaagtcccaacattaaca

SEQ ID NO: 264944 - DNA, 20 bp, Artificial Sequence
  Description of Artificial Sequence: Synthetic oligonucleotide
  Target: ATXN1; (+) strand; PAM type: YTN; PAM sequence: TTC
ctaagtcccaacattaacat

SEQ ID NO: 264945 - DNA, 20 bp, Artificial Sequence
  Description of Artificial Sequence: Synthetic oligonucleotide
  Target: ATXN1; (+) strand; PAM type: YTN; PAM sequence: CTA
agtcccaacattaacattac

SEQ ID NO: 264946 - DNA, 20 bp, Artificial Sequence
  Description of Artificial Sequence: Synthetic oligonucleotide
  Target: ATXN1; (+) strand; PAM type: YTN; PAM sequence: TTA
acattaccgcaggaaatcag

SEQ ID NO: 264947 - DNA, 20 bp, Artificial Sequence
  Description of Artificial Sequence: Synthetic oligonucleotide
  Target: ATXN1; (+) strand; PAM type: YTN; PAM sequence: TTA
ccgcaggaaatcagacccta

SEQ ID NO: 264948 - DNA, 20 bp, Artificial Sequence
  Description of Artificial Sequence: Synthetic oligonucleotide
  Target: ATXN1; (+) strand; PAM type: YTN; PAM sequence: CTA
tcagtgcccctcaaagctca

SEQ ID NO: 264949 - DNA, 20 bp, Artificial Sequence
  Description of Artificial Sequence: Synthetic oligonucleotide
  Target: ATXN1; (+) strand; PAM type: YTN; PAM sequence: CTC
aaagctcaggtccgtcagta

SEQ ID NO: 264950 - DNA, 20 bp, Artificial Sequence
  Description of Artificial Sequence: Synthetic oligonucleotide
  Target: ATXN1; (+) strand; PAM type: YTN; PAM sequence: CTC
aggtccgtcagtacagggcc

SEQ ID NO: 264951 - DNA, 20 bp, Artificial Sequence
  Description of Artificial Sequence: Synthetic oligonucleotide
  Target: ATXN1; (+) strand; PAM type: YTN; PAM sequence: CTA
atacccctacttatacggtt

SEQ ID NO: 264952 - DNA, 20 bp, Artificial Sequence
  Description of Artificial Sequence: Synthetic oligonucleotide
  Target: ATXN1; (+) strand; PAM type: YTN; PAM sequence: CTA
cttatacggttaagaatagc

SEQ ID NO: 264953 - DNA, 20 bp, Artificial Sequence
  Description of Artificial Sequence: Synthetic oligonucleotide
  Target: ATXN1; (+) strand; PAM type: YTN; PAM sequence: CTT
atacggttaagaatagccac

SEQ ID NO: 264954 - DNA, 20 bp, Artificial Sequence
  Description of Artificial Sequence: Synthetic oligonucleotide
  Target: ATXN1; (+) strand; PAM type: YTN; PAM sequence: TTA
tacggttaagaatagccact

SEQ ID NO: 264955 - DNA, 20 bp, Artificial Sequence
  Description of Artificial Sequence: Synthetic oligonucleotide
  Target: ATXN1; (+) strand; PAM type: YTN; PAM sequence: TTA
agaatagccactgctacagg

SEQ ID NO: 264956 - DNA, 20 bp, Artificial Sequence
  Description of Artificial Sequence: Synthetic oligonucleotide
  Target: ATXN1; (+) strand; PAM type: YTN; PAM sequence: CTG
ctacaggaaccagaatagcc

SEQ ID NO: 264957 - DNA, 20 bp, Artificial Sequence
  Description of Artificial Sequence: Synthetic oligonucleotide
  Target: ATXN1; (+) strand; PAM type: YTN; PAM sequence: CTA
caggaaccagaatagccagt

SEQ ID NO: 264958 - DNA, 20 bp, Artificial Sequence
  Description of Artificial Sequence: Synthetic oligonucleotide
  Target: ATXN1; (+) strand; PAM type: YTN; PAM sequence: TTT
atctacttcattatcctact

SEQ ID NO: 264959 - DNA, 20 bp, Artificial Sequence
  Description of Artificial Sequence: Synthetic oligonucleotide
  Target: ATXN1; (+) strand; PAM type: YTN; PAM sequence: TTA
tctacttcattatcctacta

SEQ ID NO: 264960 - DNA, 20 bp, Artificial Sequence
  Description of Artificial Sequence: Synthetic oligonucleotide
  Target: ATXN1; (+) strand; PAM type: YTN; PAM sequence: CTA
cttcattatcctactaccac

SEQ ID NO: 264961 - DNA, 20 bp, Artificial Sequence
  Description of Artificial Sequence: Synthetic oligonucleotide
  Target: ATXN1; (+) strand; PAM type: YTN; PAM sequence: CTT
cattatcctactaccacaca

SEQ ID NO: 264962 - DNA, 20 bp, Artificial Sequence
  Description of Artificial Sequence: Synthetic oligonucleotide
  Target: ATXN1; (+) strand; PAM type: YTN; PAM sequence: TTC
attatcctactaccacacac

SEQ ID NO: 264963 - DNA, 20 bp, Artificial Sequence
  Description of Artificial Sequence: Synthetic oligonucleotide
  Target: ATXN1; (+) strand; PAM type: YTN; PAM sequence: TTA
tcctactaccacacactctc

SEQ ID NO: 264964 - DNA, 20 bp, Artificial Sequence
  Description of Artificial Sequence: Synthetic oligonucleotide
  Target: ATXN1; (+) strand; PAM type: YTN; PAM sequence: CTA
ctaccacacactctcaaagg

SEQ ID NO: 264965 - DNA, 20 bp, Artificial Sequence
  Description of Artificial Sequence: Synthetic oligonucleotide
  Target: ATXN1; (+) strand; PAM type: YTN; PAM sequence: CTA
ccacacactctcaaaggatt

SEQ ID NO: 264966 - DNA, 20 bp, Artificial Sequence
  Description of Artificial Sequence: Synthetic oligonucleotide
  Target: ATXN1; (+) strand; PAM type: YTN; PAM sequence: CTC
tcaaaggatttctcaagaca

SEQ ID NO: 264967 - DNA, 20 bp, Artificial Sequence
  Description of Artificial Sequence: Synthetic oligonucleotide
  Target: ATXN1; (+) strand; PAM type: YTN; PAM sequence: CTC
aaaggatttctcaagacagt

SEQ ID NO: 264968 - DNA, 20 bp, Artificial Sequence
  Description of Artificial Sequence: Synthetic oligonucleotide
  Target: ATXN1; (+) strand; PAM type: YTN; PAM sequence: TTT
ctcaagacagtttgcaagaa

SEQ ID NO: 264969 - DNA, 20 bp, Artificial Sequence
  Description of Artificial Sequence: Synthetic oligonucleotide
  Target: ATXN1; (+) strand; PAM type: YTN; PAM sequence: TTC
tcaagacagtttgcaagaaa

SEQ ID NO: 264970 - DNA, 20 bp, Artificial Sequence
  Description of Artificial Sequence: Synthetic oligonucleotide
  Target: ATXN1; (+) strand; PAM type: YTN; PAM sequence: CTC
aagacagtttgcaagaaata

SEQ ID NO: 264971 - DNA, 20 bp, Artificial Sequence
  Description of Artificial Sequence: Synthetic oligonucleotide
  Target: ATXN1; (+) strand; PAM type: YTN; PAM sequence: TTT
gcaagaaataacaaaatcta

SEQ ID NO: 264972 - DNA, 20 bp, Artificial Sequence
  Description of Artificial Sequence: Synthetic oligonucleotide
  Target: ATXN1; (+) strand; PAM type: YTN; PAM sequence: TTG
caagaaataacaaaatctat

SEQ ID NO: 264973 - DNA, 20 bp, Artificial Sequence
  Description of Artificial Sequence: Synthetic oligonucleotide
  Target: ATXN1; (+) strand; PAM type: YTN; PAM sequence: CTA
tccttactctgcaatcccaa

SEQ ID NO: 264974 - DNA, 20 bp, Artificial Sequence
  Description of Artificial Sequence: Synthetic oligonucleotide
  Target: ATXN1; (+) strand; PAM type: YTN; PAM sequence: CTT
actctgcaatcccaaataga

SEQ ID NO: 264975 - DNA, 20 bp, Artificial Sequence
  Description of Artificial Sequence: Synthetic oligonucleotide
  Target: ATXN1; (+) strand; PAM type: YTN; PAM sequence: TTA
ctctgcaatcccaaatagac

SEQ ID NO: 264976 - DNA, 20 bp, Artificial Sequence
  Description of Artificial Sequence: Synthetic oligonucleotide
  Target: ATXN1; (+) strand; PAM type: YTN; PAM sequence: CTC
tgcaatcccaaatagactct

SEQ ID NO: 264977 - DNA, 20 bp, Artificial Sequence
  Description of Artificial Sequence: Synthetic oligonucleotide
  Target: ATXN1; (+) strand; PAM type: YTN; PAM sequence: CTG
caatcccaaatagactcttt

SEQ ID NO: 264978 - DNA, 20 bp, Artificial Sequence
  Description of Artificial Sequence: Synthetic oligonucleotide
  Target: ATXN1; (+) strand; PAM type: YTN; PAM sequence: CTC
tttggcagtagtgaatatcc

SEQ ID NO: 264979 - DNA, 20 bp, Artificial Sequence
  Description of Artificial Sequence: Synthetic oligonucleotide
  Target: ATXN1; (+) strand; PAM type: YTN; PAM sequence: CTT
tggcagtagtgaatatccaa

SEQ ID NO: 264980 - DNA, 20 bp, Artificial Sequence
  Description of Artificial Sequence: Synthetic oligonucleotide
  Target: ATXN1; (+) strand; PAM type: YTN; PAM sequence: TTT
ggcagtagtgaatatccaaa

SEQ ID NO: 264981 - DNA, 20 bp, Artificial Sequence
  Description of Artificial Sequence: Synthetic oligonucleotide
  Target: ATXN1; (+) strand; PAM type: YTN; PAM sequence: TTG
gcagtagtgaatatccaaaa

SEQ ID NO: 264982 - DNA, 20 bp, Artificial Sequence
  Description of Artificial Sequence: Synthetic oligonucleotide
  Target: ATXN1; (+) strand; PAM type: YTN; PAM sequence: CTA
gacctcctcactgctgagaa

SEQ ID NO: 264983 - DNA, 20 bp, Artificial Sequence
  Description of Artificial Sequence: Synthetic oligonucleotide
  Target: ATXN1; (+) strand; PAM type: YTN; PAM sequence: CTC
ctcactgctgagaaaggaag

SEQ ID NO: 264984 - DNA, 20 bp, Artificial Sequence
  Description of Artificial Sequence: Synthetic oligonucleotide
  Target: ATXN1; (+) strand; PAM type: YTN; PAM sequence: CTC
actgctgagaaaggaagact

SEQ ID NO: 264985 - DNA, 20 bp, Artificial Sequence
  Description of Artificial Sequence: Synthetic oligonucleotide
  Target: ATXN1; (+) strand; PAM type: YTN; PAM sequence: CTG
ctgagaaaggaagactctgc

SEQ ID NO: 264986 - DNA, 20 bp, Artificial Sequence
  Description of Artificial Sequence: Synthetic oligonucleotide
  Target: ATXN1; (+) strand; PAM type: YTN; PAM sequence: CTG
agaaaggaagactctgcacc

SEQ ID NO: 264987 - DNA, 20 bp, Artificial Sequence
  Description of Artificial Sequence: Synthetic oligonucleotide
  Target: ATXN1; (+) strand; PAM type: YTN; PAM sequence: CTC
tgcaccttcttaggagaaga

SEQ ID NO: 264988 - DNA, 20 bp, Artificial Sequence
  Description of Artificial Sequence: Synthetic oligonucleotide
  Target: ATXN1; (+) strand; PAM type: YTN; PAM sequence: CTG
caccttcttaggagaagact

SEQ ID NO: 264989 - DNA, 20 bp, Artificial Sequence
  Description of Artificial Sequence: Synthetic oligonucleotide
  Target: ATXN1; (+) strand; PAM type: YTN; PAM sequence: CTT
cttaggagaagactgttgtt

SEQ ID NO: 264990 - DNA, 20 bp, Artificial Sequence
  Description of Artificial Sequence: Synthetic oligonucleotide
  Target: ATXN1; (+) strand; PAM type: YTN; PAM sequence: TTC
ttaggagaagactgttgttt

SEQ ID NO: 264991 - DNA, 20 bp, Artificial Sequence
  Description of Artificial Sequence: Synthetic oligonucleotide
  Target: ATXN1; (+) strand; PAM type: YTN; PAM sequence: CTT
aggagaagactgttgttttt

SEQ ID NO: 264992 - DNA, 20 bp, Artificial Sequence
  Description of Artificial Sequence: Synthetic oligonucleotide
  Target: ATXN1; (+) strand; PAM type: YTN; PAM sequence: TTA
ggagaagactgttgttttta

SEQ ID NO: 264993 - DNA, 20 bp, Artificial Sequence
  Description of Artificial Sequence: Synthetic oligonucleotide
  Target: ATXN1; (+) strand; PAM type: YTN; PAM sequence: CTG
ttgtttttacactaaccact

SEQ ID NO: 264994 - DNA, 20 bp, Artificial Sequence
  Description of Artificial Sequence: Synthetic oligonucleotide
  Target: ATXN1; (+) strand; PAM type: YTN; PAM sequence: TTG
tttttacactaaccactcag

SEQ ID NO: 264995 - DNA, 20 bp, Artificial Sequence
  Description of Artificial Sequence: Synthetic oligonucleotide
  Target: ATXN1; (+) strand; PAM type: YTN; PAM sequence: TTT
ttacactaaccactcaggga

SEQ ID NO: 264996 - DNA, 20 bp, Artificial Sequence
  Description of Artificial Sequence: Synthetic oligonucleotide
  Target: ATXN1; (+) strand; PAM type: YTN; PAM sequence: TTT
tacactaaccactcagggat

SEQ ID NO: 264997 - DNA, 20 bp, Artificial Sequence
  Description of Artificial Sequence: Synthetic oligonucleotide
  Target: ATXN1; (+) strand; PAM type: YTN; PAM sequence: TTT
acactaaccactcagggata

SEQ ID NO: 264998 - DNA, 20 bp, Artificial Sequence
  Description of Artificial Sequence: Synthetic oligonucleotide
  Target: ATXN1; (+) strand; PAM type: YTN; PAM sequence: TTA
cactaaccactcagggatag

SEQ ID NO: 264999 - DNA, 20 bp, Artificial Sequence
  Description of Artificial Sequence: Synthetic oligonucleotide
  Target: ATXN1; (+) strand; PAM type: YTN; PAM sequence: CTA
accactcagggatagtacaa

SEQ ID NO: 265000 - DNA, 20 bp, Artificial Sequence
  Description of Artificial Sequence: Synthetic oligonucleotide
  Target: ATXN1; (+) strand; PAM type: YTN; PAM sequence: CTC
agggatagtacaagatgctg

SEQ ID NO: 265001 - DNA, 20 bp, Artificial Sequence
  Description of Artificial Sequence: Synthetic oligonucleotide
  Target: ATXN1; (+) strand; PAM type: YTN; PAM sequence: CTG
cccagcagttacaggaaaag

SEQ ID NO: 265002 - DNA, 20 bp, Artificial Sequence
  Description of Artificial Sequence: Synthetic oligonucleotide
  Target: ATXN1; (+) strand; PAM type: YTN; PAM sequence: TTA
caggaaaaggcttctgaaat

SEQ ID NO: 265003 - DNA, 20 bp, Artificial Sequence
  Description of Artificial Sequence: Synthetic oligonucleotide
  Target: ATXN1; (+) strand; PAM type: YTN; PAM sequence: CTT
ctgaaatcagacaatgcctt

SEQ ID NO: 265004 - DNA, 20 bp, Artificial Sequence
  Description of Artificial Sequence: Synthetic oligonucleotide
  Target: ATXN1; (+) strand; PAM type: YTN; PAM sequence: TTC
tgaaatcagacaatgccttt

SEQ ID NO: 265005 - DNA, 20 bp, Artificial Sequence
  Description of Artificial Sequence: Synthetic oligonucleotide
  Target: ATXN1; (+) strand; PAM type: YTN; PAM sequence: CTG
aaatcagacaatgcctttca

SEQ ID NO: 265006 - DNA, 20 bp, Artificial Sequence
  Description of Artificial Sequence: Synthetic oligonucleotide
  Target: ATXN1; (+) strand; PAM type: YTN; PAM sequence: CTT
tcaaactcttataccaacct

SEQ ID NO: 265007 - DNA, 20 bp, Artificial Sequence
  Description of Artificial Sequence: Synthetic oligonucleotide
  Target: ATXN1; (+) strand; PAM type: YTN; PAM sequence: TTT
caaactcttataccaacctc

SEQ ID NO: 265008 - DNA, 20 bp, Artificial Sequence
  Description of Artificial Sequence: Synthetic oligonucleotide
  Target: ATXN1; (+) strand; PAM type: YTN; PAM sequence: TTC
aaactcttataccaacctct

SEQ ID NO: 265009 - DNA, 20 bp, Artificial Sequence
  Description of Artificial Sequence: Synthetic oligonucleotide
  Target: ATXN1; (+) strand; PAM type: YTN; PAM sequence: CTC
ttataccaacctctagagtt

SEQ ID NO: 265010 - DNA, 20 bp, Artificial Sequence
  Description of Artificial Sequence: Synthetic oligonucleotide
  Target: ATXN1; (+) strand; PAM type: YTN; PAM sequence: CTT
ataccaacctctagagttgg

SEQ ID NO: 265011 - DNA, 20 bp, Artificial Sequence
  Description of Artificial Sequence: Synthetic oligonucleotide
  Target: ATXN1; (+) strand; PAM type: YTN; PAM sequence: TTA
taccaacctctagagttggg

SEQ ID NO: 265012 - DNA, 20 bp, Artificial Sequence
  Description of Artificial Sequence: Synthetic oligonucleotide
  Target: ATXN1; (+) strand; PAM type: YTN; PAM sequence: CTC
tagagttgggcaacatggtt

SEQ ID NO: 265013 - DNA, 20 bp, Artificial Sequence
  Description of Artificial Sequence: Synthetic oligonucleotide
  Target: ATXN1; (+) strand; PAM type: YTN; PAM sequence: CTA
gagttgggcaacatggtttc

SEQ ID NO: 265014 - DNA, 20 bp, Artificial Sequence
  Description of Artificial Sequence: Synthetic oligonucleotide
  Target: ATXN1; (+) strand; PAM type: YTN; PAM sequence: TTG
ggcaacatggtttctcccct

SEQ ID NO: 265015 - DNA, 20 bp, Artificial Sequence
  Description of Artificial Sequence: Synthetic oligonucleotide
  Target: ATXN1; (+) strand; PAM type: YTN; PAM sequence: TTT
ctcccctttctacgtcccat

SEQ ID NO: 265016 - DNA, 20 bp, Artificial Sequence
  Description of Artificial Sequence: Synthetic oligonucleotide
  Target: ATXN1; (+) strand; PAM type: YTN; PAM sequence: TTC
tcccctttctacgtcccatg

SEQ ID NO: 265017 - DNA, 20 bp, Artificial Sequence
  Description of Artificial Sequence: Synthetic oligonucleotide
  Target: ATXN1; (+) strand; PAM type: YTN; PAM sequence: CTC
ccctttctacgtcccatgac

SEQ ID NO: 265018 - DNA, 20 bp, Artificial Sequence
  Description of Artificial Sequence: Synthetic oligonucleotide
  Target: ATXN1; (+) strand; PAM type: YTN; PAM sequence: CTT
tctacgtcccatgacagcca

SEQ ID NO: 265019 - DNA, 20 bp, Artificial Sequence
  Description of Artificial Sequence: Synthetic oligonucleotide
  Target: ATXN1; (+) strand; PAM type: YTN; PAM sequence: TTT
ctacgtcccatgacagccat

SEQ ID NO: 265020 - DNA, 20 bp, Artificial Sequence
  Description of Artificial Sequence: Synthetic oligonucleotide
  Target: ATXN1; (+) strand; PAM type: YTN; PAM sequence: TTC
tacgtcccatgacagccatc

SEQ ID NO: 265021 - DNA, 20 bp, Artificial Sequence
  Description of Artificial Sequence: Synthetic oligonucleotide
  Target: ATXN1; (+) strand; PAM type: YTN; PAM sequence: CTA
cgtcccatgacagccatctt

SEQ ID NO: 265022 - DNA, 20 bp, Artificial Sequence
  Description of Artificial Sequence: Synthetic oligonucleotide
  Target: ATXN1; (+) strand; PAM type: YTN; PAM sequence: CTT
gctattactcaccttcgggc

SEQ ID NO: 265023 - DNA, 20 bp, Artificial Sequence
  Description of Artificial Sequence: Synthetic oligonucleotide
  Target: ATXN1; (+) strand; PAM type: YTN; PAM sequence: TTG
ctattactcaccttcgggcc

SEQ ID NO: 265024 - DNA, 20 bp, Artificial Sequence
  Description of Artificial Sequence: Synthetic oligonucleotide
  Target: ATXN1; (+) strand; PAM type: YTN; PAM sequence: CTA
ttactcaccttcgggccctg

SEQ ID NO: 265025 - DNA, 20 bp, Artificial Sequence
  Description of Artificial Sequence: Synthetic oligonucleotide
  Target: ATXN1; (+) strand; PAM type: YTN; PAM sequence: TTA
ctcaccttcgggccctgtgt

SEQ ID NO: 265026 - DNA, 20 bp, Artificial Sequence
  Description of Artificial Sequence: Synthetic oligonucleotide
  Target: ATXN1; (+) strand; PAM type: YTN; PAM sequence: CTC
accttcgggccctgtgtttt

SEQ ID NO: 265027 - DNA, 20 bp, Artificial Sequence
  Description of Artificial Sequence: Synthetic oligonucleotide
  Target: ATXN1; (+) strand; PAM type: YTN; PAM sequence: CTT
cgggccctgtgtttttaacc

SEQ ID NO: 265028 - DNA, 20 bp, Artificial Sequence
  Description of Artificial Sequence: Synthetic oligonucleotide
  Target: ATXN1; (+) strand; PAM type: YTN; PAM sequence: TTC
gggccctgtgtttttaacct

SEQ ID NO: 265029 - DNA, 20 bp, Artificial Sequence
  Description of Artificial Sequence: Synthetic oligonucleotide
  Target: ATXN1; (+) strand; PAM type: YTN; PAM sequence: CTG
tgtttttaacctctttgtca

SEQ ID NO: 265030 - DNA, 20 bp, Artificial Sequence
  Description of Artificial Sequence: Synthetic oligonucleotide
  Target: ATXN1; (+) strand; PAM type: YTN; PAM sequence: TTT
ttaacctctttgtcaaattt

SEQ ID NO: 265031 - DNA, 20 bp, Artificial Sequence
  Description of Artificial Sequence: Synthetic oligonucleotide
  Target: ATXN1; (+) strand; PAM type: YTN; PAM sequence: TTT
taacctctttgtcaaatttg

SEQ ID NO: 265032 - DNA, 20 bp, Artificial Sequence
  Description of Artificial Sequence: Synthetic oligonucleotide
  Target: ATXN1; (+) strand; PAM type: YTN; PAM sequence: TTT
aacctctttgtcaaatttgt

SEQ ID NO: 265033 - DNA, 20 bp, Artificial Sequence
  Description of Artificial Sequence: Synthetic oligonucleotide
  Target: ATXN1; (+) strand; PAM type: YTN; PAM sequence: TTA
acctctttgtcaaatttgtt

SEQ ID NO: 265034 - DNA, 20 bp, Artificial Sequence
  Description of Artificial Sequence: Synthetic oligonucleotide
  Target: ATXN1; (+) strand; PAM type: YTN; PAM sequence: CTC
tttgtcaaatttgtttcctc

SEQ ID NO: 265035 - DNA, 20 bp, Artificial Sequence
  Description of Artificial Sequence: Synthetic oligonucleotide
  Target: ATXN1; (+) strand; PAM type: YTN; PAM sequence: CTT
tgtcaaatttgtttcctcca

SEQ ID NO: 265036 - DNA, 20 bp, Artificial Sequence
  Description of Artificial Sequence: Synthetic oligonucleotide
  Target: ATXN1; (+) strand; PAM type: YTN; PAM sequence: TTT
gtcaaatttgtttcctccag

SEQ ID NO: 265037 - DNA, 20 bp, Artificial Sequence
  Description of Artificial Sequence: Synthetic oligonucleotide
  Target: ATXN1; (+) strand; PAM type: YTN; PAM sequence: TTG
tcaaatttgtttcctccagg

SEQ ID NO: 265038 - DNA, 20 bp, Artificial Sequence
  Description of Artificial Sequence: Synthetic oligonucleotide
  Target: ATXN1; (+) strand; PAM type: YTN; PAM sequence: TTT
gtttcctccaggatcgatac

SEQ ID NO: 265039 - DNA, 20 bp, Artificial Sequence
  Description of Artificial Sequence: Synthetic oligonucleotide
  Target: ATXN1; (+) strand; PAM type: YTN; PAM sequence: TTG
tttcctccaggatcgatacc

SEQ ID NO: 265040 - DNA, 20 bp, Artificial Sequence
  Description of Artificial Sequence: Synthetic oligonucleotide
  Target: ATXN1; (+) strand; PAM type: YTN; PAM sequence: TTT
cctccaggatcgataccatc

SEQ ID NO: 265041 - DNA, 20 bp, Artificial Sequence
  Description of Artificial Sequence: Synthetic oligonucleotide
  Target: ATXN1; (+) strand; PAM type: YTN; PAM sequence: TTC
ctccaggatcgataccatca

SEQ ID NO: 265042 - DNA, 20 bp, Artificial Sequence
  Description of Artificial Sequence: Synthetic oligonucleotide
  Target: ATXN1; (+) strand; PAM type: YTN; PAM sequence: CTC
caggatcgataccatcaagc

SEQ ID NO: 265043 - DNA, 20 bp, Artificial Sequence
  Description of Artificial Sequence: Synthetic oligonucleotide
  Target: ATXN1; (+) strand; PAM type: YTN; PAM sequence: CTA
cagatggtcttacaaatgga

SEQ ID NO: 265044 - DNA, 20 bp, Artificial Sequence
  Description of Artificial Sequence: Synthetic oligonucleotide
  Target: ATXN1; (+) strand; PAM type: YTN; PAM sequence: CTT
acaaatggaaccccaaatga

SEQ ID NO: 265045 - DNA, 20 bp, Artificial Sequence
  Description of Artificial Sequence: Synthetic oligonucleotide
  Target: ATXN1; (+) strand; PAM type: YTN; PAM sequence: TTA
caaatggaaccccaaatgag

SEQ ID NO: 265046 - DNA, 20 bp, Artificial Sequence
  Description of Artificial Sequence: Synthetic oligonucleotide
  Target: ATXN1; (+) strand; PAM type: YTN; PAM sequence: CTC
aactcacaacttctaccaag

SEQ ID NO: 265047 - DNA, 20 bp, Artificial Sequence
  Description of Artificial Sequence: Synthetic oligonucleotide
  Target: ATXN1; (+) strand; PAM type: YTN; PAM sequence: CTC
acaacttctaccaaggaccc

SEQ ID NO: 265048 - DNA, 20 bp, Artificial Sequence
  Description of Artificial Sequence: Synthetic oligonucleotide
  Target: ATXN1; (+) strand; PAM type: YTN; PAM sequence: CTT
ctaccaaggacccctggact

SEQ ID NO: 265049 - DNA, 20 bp, Artificial Sequence
  Description of Artificial Sequence: Synthetic oligonucleotide
  Target: ATXN1; (+) strand; PAM type: YTN; PAM sequence: TTC
taccaaggacccctggactg

SEQ ID NO: 265050 - DNA, 20 bp, Artificial Sequence
  Description of Artificial Sequence: Synthetic oligonucleotide
  Target: ATXN1; (+) strand; PAM type: YTN; PAM sequence: CTA
ccaaggacccctggactgac

SEQ ID NO: 265051 - DNA, 20 bp, Artificial Sequence
  Description of Artificial Sequence: Synthetic oligonucleotide
  Target: ATXN1; (+) strand; PAM type: YTN; PAM sequence: CTG
gactgacccaccagcccttt

SEQ ID NO: 265052 - DNA, 20 bp, Artificial Sequence
  Description of Artificial Sequence: Synthetic oligonucleotide
  Target: ATXN1; (+) strand; PAM type: YTN; PAM sequence: CTG
acccaccagccctttggcct

SEQ ID NO: 265053 - DNA, 20 bp, Artificial Sequence
  Description of Artificial Sequence: Synthetic oligonucleotide
  Target: ATXN1; (+) strand; PAM type: YTN; PAM sequence: CTT
tggcctagagtgttcccctc

SEQ ID NO: 265054 - DNA, 20 bp, Artificial Sequence
  Description of Artificial Sequence: Synthetic oligonucleotide
  Target: ATXN1; (+) strand; PAM type: YTN; PAM sequence: TTT
ggcctagagtgttcccctct

SEQ ID NO: 265055 - DNA, 20 bp, Artificial Sequence
  Description of Artificial Sequence: Synthetic oligonucleotide
  Target: ATXN1; (+) strand; PAM type: YTN; PAM sequence: TTG
gcctagagtgttcccctctg

SEQ ID NO: 265056 - DNA, 20 bp, Artificial Sequence
  Description of Artificial Sequence: Synthetic oligonucleotide
  Target: ATXN1; (+) strand; PAM type: YTN; PAM sequence: CTA
gagtgttcccctctggaggg

SEQ ID NO: 265057 - DNA, 20 bp, Artificial Sequence
  Description of Artificial Sequence: Synthetic oligonucleotide
  Target: ATXN1; (+) strand; PAM type: YTN; PAM sequence: TTC
ccctctggagggcactacaa

SEQ ID NO: 265058 - DNA, 20 bp, Artificial Sequence
  Description of Artificial Sequence: Synthetic oligonucleotide
  Target: ATXN1; (+) strand; PAM type: YTN; PAM sequence: CTC
tggagggcactacaactgca

SEQ ID NO: 265059 - DNA, 20 bp, Artificial Sequence
  Description of Artificial Sequence: Synthetic oligonucleotide
  Target: ATXN1; (+) strand; PAM type: YTN; PAM sequence: CTG
gagggcactacaactgcagg

SEQ ID NO: 265060 - DNA, 20 bp, Artificial Sequence
  Description of Artificial Sequence: Synthetic oligonucleotide
  Target: ATXN1; (+) strand; PAM type: YTN; PAM sequence: CTA
caactgcagggccccttctt

SEQ ID NO: 265061 - DNA, 20 bp, Artificial Sequence
  Description of Artificial Sequence: Synthetic oligonucleotide
  Target: ATXN1; (+) strand; PAM type: YTN; PAM sequence: CTG
cagggccccttcttcacccc

SEQ ID NO: 265062 - DNA, 20 bp, Artificial Sequence
  Description of Artificial Sequence: Synthetic oligonucleotide
  Target: ATXN1; (+) strand; PAM type: YTN; PAM sequence: CTT
cttcacccctatccagcagg

SEQ ID NO: 265063 - DNA, 20 bp, Artificial Sequence
  Description of Artificial Sequence: Synthetic oligonucleotide
  Target: ATXN1; (+) strand; PAM type: YTN; PAM sequence: TTC
ttcacccctatccagcagga

SEQ ID NO: 265064 - DNA, 20 bp, Artificial Sequence
  Description of Artificial Sequence: Synthetic oligonucleotide
  Target: ATXN1; (+) strand; PAM type: YTN; PAM sequence: CTT
cacccctatccagcaggaag

SEQ ID NO: 265065 - DNA, 20 bp, Artificial Sequence
  Description of Artificial Sequence: Synthetic oligonucleotide
  Target: ATXN1; (+) strand; PAM type: YTN; PAM sequence: TTC
acccctatccagcaggaagt

SEQ ID NO: 265066 - DNA, 20 bp, Artificial Sequence
  Description of Artificial Sequence: Synthetic oligonucleotide
  Target: ATXN1; (+) strand; PAM type: YTN; PAM sequence: CTA
tccagcaggaagtagctaga

SEQ ID NO: 265067 - DNA, 20 bp, Artificial Sequence
  Description of Artificial Sequence: Synthetic oligonucleotide
  Target: ATXN1; (+) strand; PAM type: YTN; PAM sequence: CTA
gagcagtcatcacccagttc

SEQ ID NO: 265068 - DNA, 20 bp, Artificial Sequence
  Description of Artificial Sequence: Synthetic oligonucleotide
  Target: ATXN1; (+) strand; PAM type: YTN; PAM sequence: TTC
ccaacagcagctggggtgtc

SEQ ID NO: 265069 - DNA, 20 bp, Artificial Sequence
  Description of Artificial Sequence: Synthetic oligonucleotide
  Target: ATXN1; (+) strand; PAM type: YTN; PAM sequence: CTG
gggtgtcctgtttagagggg

SEQ ID NO: 265070 - DNA, 20 bp, Artificial Sequence
  Description of Artificial Sequence: Synthetic oligonucleotide
  Target: ATXN1; (+) strand; PAM type: YTN; PAM sequence: CTG
tttagaggggggattgagag

SEQ ID NO: 265071 - DNA, 20 bp, Artificial Sequence
  Description of Artificial Sequence: Synthetic oligonucleotide
  Target: ATXN1; (+) strand; PAM type: YTN; PAM sequence: TTT
agaggggggattgagaggtg

SEQ ID NO: 265072 - DNA, 20 bp, Artificial Sequence
  Description of Artificial Sequence: Synthetic oligonucleotide
  Target: ATXN1; (+) strand; PAM type: YTN; PAM sequence: TTA
gaggggggattgagaggtga

SEQ ID NO: 265073 - DNA, 20 bp, Artificial Sequence
  Description of Artificial Sequence: Synthetic oligonucleotide
  Target: ATXN1; (+) strand; PAM type: YTN; PAM sequence: TTG
agaggtgaggccagctggac

SEQ ID NO: 265074 - DNA, 20 bp, Artificial Sequence
  Description of Artificial Sequence: Synthetic oligonucleotide
  Target: ATXN1; (+) strand; PAM type: YTN; PAM sequence: CTG
gacttcctgggtcaagtagg

SEQ ID NO: 265075 - DNA, 20 bp, Artificial Sequence
  Description of Artificial Sequence: Synthetic oligonucleotide
  Target: ATXN1; (+) strand; PAM type: YTN; PAM sequence: CTT
cctgggtcaagtagggactt

SEQ ID NO: 265076 - DNA, 20 bp, Artificial Sequence
  Description of Artificial Sequence: Synthetic oligonucleotide
  Target: ATXN1; (+) strand; PAM type: YTN; PAM sequence: TTC
ctgggtcaagtagggacttg

SEQ ID NO: 265077 - DNA, 20 bp, Artificial Sequence
  Description of Artificial Sequence: Synthetic oligonucleotide
  Target: ATXN1; (+) strand; PAM type: YTN; PAM sequence: CTG
ggtcaagtagggacttgagg

SEQ ID NO: 265078 - DNA, 20 bp, Artificial Sequence
  Description of Artificial Sequence: Synthetic oligonucleotide
  Target: ATXN1; (+) strand; PAM type: YTN; PAM sequence: CTT
gaggaactttcctgtcttac

SEQ ID NO: 265079 - DNA, 20 bp, Artificial Sequence
  Description of Artificial Sequence: Synthetic oligonucleotide
  Target: ATXN1; (+) strand; PAM type: YTN; PAM sequence: TTG
aggaactttcctgtcttaca

SEQ ID NO: 265080 - DNA, 20 bp, Artificial Sequence
  Description of Artificial Sequence: Synthetic oligonucleotide
  Target: ATXN1; (+) strand; PAM type: YTN; PAM sequence: CTT
tcctgtcttacaagaggatg

SEQ ID NO: 265081 - DNA, 20 bp, Artificial Sequence
  Description of Artificial Sequence: Synthetic oligonucleotide
  Target: ATXN1; (+) strand; PAM type: YTN; PAM sequence: TTT
cctgtcttacaagaggatgt

SEQ ID NO: 265082 - DNA, 20 bp, Artificial Sequence
  Description of Artificial Sequence: Synthetic oligonucleotide
  Target: ATXN1; (+) strand; PAM type: YTN; PAM sequence: TTC
ctgtcttacaagaggatgta

SEQ ID NO: 265083 - DNA, 20 bp, Artificial Sequence
  Description of Artificial Sequence: Synthetic oligonucleotide
  Target: ATXN1; (+) strand; PAM type: YTN; PAM sequence: CTG
tcttacaagaggatgtaaaa

SEQ ID NO: 265084 - DNA, 20 bp, Artificial Sequence
  Description of Artificial Sequence: Synthetic oligonucleotide
  Target: ATXN1; (+) strand; PAM type: YTN; PAM sequence: CTT
acaagaggatgtaaaatgca

SEQ ID NO: 265085 - DNA, 20 bp, Artificial Sequence
  Description of Artificial Sequence: Synthetic oligonucleotide
  Target: ATXN1; (+) strand; PAM type: YTN; PAM sequence: TTA
caagaggatgtaaaatgcac

SEQ ID NO: 265086 - DNA, 20 bp, Artificial Sequence
  Description of Artificial Sequence: Synthetic oligonucleotide
  Target: ATXN1; (+) strand; PAM type: YTN; PAM sequence: CTT
tcctgtcttacaagaggttc

SEQ ID NO: 265087 - DNA, 20 bp, Artificial Sequence
  Description of Artificial Sequence: Synthetic oligonucleotide
  Target: ATXN1; (+) strand; PAM type: YTN; PAM sequence: TTT
cctgtcttacaagaggttcg

SEQ ID NO: 265088 - DNA, 20 bp, Artificial Sequence
  Description of Artificial Sequence: Synthetic oligonucleotide
  Target: ATXN1; (+) strand; PAM type: YTN; PAM sequence: TTC
ctgtcttacaagaggttcgt

SEQ ID NO: 265089 - DNA, 20 bp, Artificial Sequence
  Description of Artificial Sequence: Synthetic oligonucleotide
  Target: ATXN1; (+) strand; PAM type: YTN; PAM sequence: CTG
tcttacaagaggttcgtaaa

SEQ ID NO: 265090 - DNA, 20 bp, Artificial Sequence
  Description of Artificial Sequence: Synthetic oligonucleotide
  Target: ATXN1; (+) strand; PAM type: YTN; PAM sequence: CTT
acaagaggttcgtaaaatgc

SEQ ID NO: 265091 - DNA, 20 bp, Artificial Sequence
  Description of Artificial Sequence: Synthetic oligonucleotide
  Target: ATXN1; (+) strand; PAM type: YTN; PAM sequence: TTA
caagaggttcgtaaaatgca

SEQ ID NO: 265092 - DNA, 20 bp, Artificial Sequence
  Description of Artificial Sequence: Synthetic oligonucleotide
  Target: ATXN1; (+) strand; PAM type: YTN; PAM sequence: TTC
gtaaaatgcaccaatcagca

SEQ ID NO: 265093 - DNA, 20 bp, Artificial Sequence
  Description of Artificial Sequence: Synthetic oligonucleotide
  Target: ATXN1; (+) strand; PAM type: YTN; PAM sequence: CTT
tgtaaaatgcaccaataagt

SEQ ID NO: 265094 - DNA, 20 bp, Artificial Sequence
  Description of Artificial Sequence: Synthetic oligonucleotide
  Target: ATXN1; (+) strand; PAM type: YTN; PAM sequence: TTT
gtaaaatgcaccaataagtg

SEQ ID NO: 265095 - DNA, 20 bp, Artificial Sequence
  Description of Artificial Sequence: Synthetic oligonucleotide
  Target: ATXN1; (+) strand; PAM type: YTN; PAM sequence: TTG
taaaatgcaccaataagtgc

SEQ ID NO: 265096 - DNA, 20 bp, Artificial Sequence
  Description of Artificial Sequence: Synthetic oligonucleotide
  Target: ATXN1; (+) strand; PAM type: YTN; PAM sequence: CTC
tgtaaaacgcaccaattagt

SEQ ID NO: 265097 - DNA, 20 bp, Artificial Sequence
  Description of Artificial Sequence: Synthetic oligonucleotide
  Target: ATXN1; (+) strand; PAM type: YTN; PAM sequence: CTG
taaaacgcaccaattagtgc

SEQ ID NO: 265098 - DNA, 20 bp, Artificial Sequence
  Description of Artificial Sequence: Synthetic oligonucleotide
  Target: ATXN1; (+) strand; PAM type: YTN; PAM sequence: TTA
gtgctctgtaaaatgcatca

SEQ ID NO: 265099 - DNA, 20 bp, Artificial Sequence
  Description of Artificial Sequence: Synthetic oligonucleotide
  Target: ATXN1; (+) strand; PAM type: YTN; PAM sequence: CTC
tgtaaaatgcatcaatcagc

SEQ ID NO: 265100 - DNA, 20 bp, Artificial Sequence
  Description of Artificial Sequence: Synthetic oligonucleotide
  Target: ATXN1; (+) strand; PAM type: YTN; PAM sequence: CTG
taaaatgcatcaatcagcag

SEQ ID NO: 265101 - DNA, 20 bp, Artificial Sequence
  Description of Artificial Sequence: Synthetic oligonucleotide
  Target: ATXN1; (+) strand; PAM type: YTN; PAM sequence: TTC
taaaggtagccaatcgcagg

SEQ ID NO: 265102 - DNA, 20 bp, Artificial Sequence
  Description of Artificial Sequence: Synthetic oligonucleotide
  Target: ATXN1; (+) strand; PAM type: YTN; PAM sequence: CTA
aaggtagccaatcgcaggga

SEQ ID NO: 265103 - DNA, 20 bp, Artificial Sequence
  Description of Artificial Sequence: Synthetic oligonucleotide
  Target: ATXN1; (+) strand; PAM type: YTN; PAM sequence: TTG
aaaaaaagggcactctgaca

SEQ ID NO: 265104 - DNA, 20 bp, Artificial Sequence
  Description of Artificial Sequence: Synthetic oligonucleotide
  Target: ATXN1; (+) strand; PAM type: YTN; PAM sequence: CTC
tgacagaacagaaatggaac

SEQ ID NO: 265105 - DNA, 20 bp, Artificial Sequence
  Description of Artificial Sequence: Synthetic oligonucleotide
  Target: ATXN1; (+) strand; PAM type: YTN; PAM sequence: CTG
acagaacagaaatggaacat

SEQ ID NO: 265106 - DNA, 20 bp, Artificial Sequence
  Description of Artificial Sequence: Synthetic oligonucleotide
  Target: ATXN1; (+) strand; PAM type: YTN; PAM sequence: CTG
gccaccacagccagcagcag

SEQ ID NO: 265107 - DNA, 20 bp, Artificial Sequence
  Description of Artificial Sequence: Synthetic oligonucleotide
  Target: ATXN1; (+) strand; PAM type: YTN; PAM sequence: CTT
gggtccccttccacgctgtg

SEQ ID NO: 265108 - DNA, 20 bp, Artificial Sequence
  Description of Artificial Sequence: Synthetic oligonucleotide
  Target: ATXN1; (+) strand; PAM type: YTN; PAM sequence: TTG
ggtccccttccacgctgtgg

SEQ ID NO: 265109 - DNA, 20 bp, Artificial Sequence
  Description of Artificial Sequence: Synthetic oligonucleotide
  Target: ATXN1; (+) strand; PAM type: YTN; PAM sequence: CTT
ccacgctgtggaagctttgt

SEQ ID NO: 265110 - DNA, 20 bp, Artificial Sequence
  Description of Artificial Sequence: Synthetic oligonucleotide
  Target: ATXN1; (+) strand; PAM type: YTN; PAM sequence: TTC
cacgctgtggaagctttgtc

SEQ ID NO: 265111 - DNA, 20 bp, Artificial Sequence
  Description of Artificial Sequence: Synthetic oligonucleotide
  Target: ATXN1; (+) strand; PAM type: YTN; PAM sequence: CTG
tggaagctttgtccttttgc

SEQ ID NO: 265112 - DNA, 20 bp, Artificial Sequence
  Description of Artificial Sequence: Synthetic oligonucleotide
  Target: ATXN1; (+) strand; PAM type: YTN; PAM sequence: CTT
tgtccttttgctcttcacaa

SEQ ID NO: 265113 - DNA, 20 bp, Artificial Sequence
  Description of Artificial Sequence: Synthetic oligonucleotide
  Target: ATXN1; (+) strand; PAM type: YTN; PAM sequence: TTT
gtccttttgctcttcacaat

SEQ ID NO: 265114 - DNA, 20 bp, Artificial Sequence
  Description of Artificial Sequence: Synthetic oligonucleotide
  Target: ATXN1; (+) strand; PAM type: YTN; PAM sequence: TTG
tccttttgctcttcacaata

SEQ ID NO: 265115 - DNA, 20 bp, Artificial Sequence
  Description of Artificial Sequence: Synthetic oligonucleotide
  Target: ATXN1; (+) strand; PAM type: YTN; PAM sequence: CTT
ttgctcttcacaataaacct

SEQ ID NO: 265116 - DNA, 20 bp, Artificial Sequence
  Description of Artificial Sequence: Synthetic oligonucleotide
  Target: ATXN1; (+) strand; PAM type: YTN; PAM sequence: TTT
tgctcttcacaataaacctt

SEQ ID NO: 265117 - DNA, 20 bp, Artificial Sequence
  Description of Artificial Sequence: Synthetic oligonucleotide
  Target: ATXN1; (+) strand; PAM type: YTN; PAM sequence: TTT
gctcttcacaataaaccttg

SEQ ID NO: 265118 - DNA, 20 bp, Artificial Sequence
  Description of Artificial Sequence: Synthetic oligonucleotide
  Target: ATXN1; (+) strand; PAM type: YTN; PAM sequence: TTG
ctcttcacaataaaccttgc

SEQ ID NO: 265119 - DNA, 20 bp, Artificial Sequence
  Description of Artificial Sequence: Synthetic oligonucleotide
  Target: ATXN1; (+) strand; PAM type: YTN; PAM sequence: CTC
ttcacaataaaccttgctac

SEQ ID NO: 265120 - DNA, 20 bp, Artificial Sequence
  Description of Artificial Sequence: Synthetic oligonucleotide
  Target: ATXN1; (+) strand; PAM type: YTN; PAM sequence: CTT
cacaataaaccttgctactg

SEQ ID NO: 265121 - DNA, 20 bp, Artificial Sequence
  Description of Artificial Sequence: Synthetic oligonucleotide
  Target: ATXN1; (+) strand; PAM type: YTN; PAM sequence: TTC
acaataaaccttgctactgc

SEQ ID NO: 265122 - DNA, 20 bp, Artificial Sequence
  Description of Artificial Sequence: Synthetic oligonucleotide
  Target: ATXN1; (+) strand; PAM type: YTN; PAM sequence: CTT
gctactgctcactctttggg

SEQ ID NO: 265123 - DNA, 20 bp, Artificial Sequence
  Description of Artificial Sequence: Synthetic oligonucleotide
  Target: ATXN1; (+) strand; PAM type: YTN; PAM sequence: TTG
ctactgctcactctttgggt

SEQ ID NO: 265124 - DNA, 20 bp, Artificial Sequence
  Description of Artificial Sequence: Synthetic oligonucleotide
  Target: ATXN1; (+) strand; PAM type: YTN; PAM sequence: CTA
ctgctcactctttgggtcca

SEQ ID NO: 265125 - DNA, 20 bp, Artificial Sequence
  Description of Artificial Sequence: Synthetic oligonucleotide
  Target: ATXN1; (+) strand; PAM type: YTN; PAM sequence: CTG
ctcactctttgggtccatgc

SEQ ID NO: 265126 - DNA, 20 bp, Artificial Sequence
  Description of Artificial Sequence: Synthetic oligonucleotide
  Target: ATXN1; (+) strand; PAM type: YTN; PAM sequence: CTC
actctttgggtccatgccat

SEQ ID NO: 265127 - DNA, 20 bp, Artificial Sequence
  Description of Artificial Sequence: Synthetic oligonucleotide
  Target: ATXN1; (+) strand; PAM type: YTN; PAM sequence: CTC
tttgggtccatgccatcttt

SEQ ID NO: 265128 - DNA, 20 bp, Artificial Sequence
  Description of Artificial Sequence: Synthetic oligonucleotide
  Target: ATXN1; (+) strand; PAM type: YTN; PAM sequence: CTT
tgggtccatgccatctttaa

SEQ ID NO: 265129 - DNA, 20 bp, Artificial Sequence
  Description of Artificial Sequence: Synthetic oligonucleotide
  Target: ATXN1; (+) strand; PAM type: YTN; PAM sequence: TTT
gggtccatgccatctttaag

SEQ ID NO: 265130 - DNA, 20 bp, Artificial Sequence
  Description of Artificial Sequence: Synthetic oligonucleotide
  Target: ATXN1; (+) strand; PAM type: YTN; PAM sequence: TTG
ggtccatgccatctttaaga

SEQ ID NO: 265131 - DNA, 20 bp, Artificial Sequence
  Description of Artificial Sequence: Synthetic oligonucleotide
  Target: ATXN1; (+) strand; PAM type: YTN; PAM sequence: CTT
taagagctgtaacactcacc

SEQ ID NO: 265132 - DNA, 20 bp, Artificial Sequence
  Description of Artificial Sequence: Synthetic oligonucleotide
  Target: ATXN1; (+) strand; PAM type: YTN; PAM sequence: TTT
aagagctgtaacactcacca

SEQ ID NO: 265133 - DNA, 20 bp, Artificial Sequence
  Description of Artificial Sequence: Synthetic oligonucleotide
  Target: ATXN1; (+) strand; PAM type: YTN; PAM sequence: TTA
agagctgtaacactcaccat

SEQ ID NO: 265134 - DNA, 20 bp, Artificial Sequence
  Description of Artificial Sequence: Synthetic oligonucleotide
  Target: ATXN1; (+) strand; PAM type: YTN; PAM sequence: CTG
taacactcaccatgaaggtc

SEQ ID NO: 265135 - DNA, 20 bp, Artificial Sequence
  Description of Artificial Sequence: Synthetic oligonucleotide
  Target: ATXN1; (+) strand; PAM type: YTN; PAM sequence: CTC
accatgaaggtccgcagctc

SEQ ID NO: 265136 - DNA, 20 bp, Artificial Sequence
  Description of Artificial Sequence: Synthetic oligonucleotide
  Target: ATXN1; (+) strand; PAM type: YTN; PAM sequence: CTC
cattcttgaagtcagcgaga

SEQ ID NO: 265137 - DNA, 20 bp, Artificial Sequence
  Description of Artificial Sequence: Synthetic oligonucleotide
  Target: ATXN1; (+) strand; PAM type: YTN; PAM sequence: TTC
ttgaagtcagcgagaccata

SEQ ID NO: 265138 - DNA, 20 bp, Artificial Sequence
  Description of Artificial Sequence: Synthetic oligonucleotide
  Target: ATXN1; (+) strand; PAM type: YTN; PAM sequence: CTT
gaagtcagcgagaccataaa

SEQ ID NO: 265139 - DNA, 20 bp, Artificial Sequence
  Description of Artificial Sequence: Synthetic oligonucleotide
  Target: ATXN1; (+) strand; PAM type: YTN; PAM sequence: TTG
aagtcagcgagaccataaac

SEQ ID NO: 265140 - DNA, 20 bp, Artificial Sequence
  Description of Artificial Sequence: Synthetic oligonucleotide
  Target: ATXN1; (+) strand; PAM type: YTN; PAM sequence: CTC
cagacacaaaaagacataga

SEQ ID NO: 265141 - DNA, 20 bp, Artificial Sequence
  Description of Artificial Sequence: Synthetic oligonucleotide
  Target: ATXN1; (+) strand; PAM type: YTN; PAM sequence: CTT
acacgcatattgccacatga

SEQ ID NO: 265142 - DNA, 20 bp, Artificial Sequence
  Description of Artificial Sequence: Synthetic oligonucleotide
  Target: ATXN1; (+) strand; PAM type: YTN; PAM sequence: TTA
cacgcatattgccacatgaa

SEQ ID NO: 265143 - DNA, 20 bp, Artificial Sequence
  Description of Artificial Sequence: Synthetic oligonucleotide
  Target: ATXN1; (+) strand; PAM type: YTN; PAM sequence: TTG
ccacatgaaagaagccaatg

SEQ ID NO: 265144 - DNA, 20 bp, Artificial Sequence
  Description of Artificial Sequence: Synthetic oligonucleotide
  Target: ATXN1; (+) strand; PAM type: YTN; PAM sequence: CTG
tatgattccaactttatgac

SEQ ID NO: 265145 - DNA, 20 bp, Artificial Sequence
  Description of Artificial Sequence: Synthetic oligonucleotide
  Target: ATXN1; (+) strand; PAM type: YTN; PAM sequence: TTC
caactttatgacattttgga

SEQ ID NO: 265146 - DNA, 20 bp, Artificial Sequence
  Description of Artificial Sequence: Synthetic oligonucleotide
  Target: ATXN1; (+) strand; PAM type: YTN; PAM sequence: CTT
tatgacattttggaaaaggc

SEQ ID NO: 265147 - DNA, 20 bp, Artificial Sequence
  Description of Artificial Sequence: Synthetic oligonucleotide
  Target: ATXN1; (+) strand; PAM type: YTN; PAM sequence: TTT
atgacattttggaaaaggca

SEQ ID NO: 265148 - DNA, 20 bp, Artificial Sequence
  Description of Artificial Sequence: Synthetic oligonucleotide
  Target: ATXN1; (+) strand; PAM type: YTN; PAM sequence: TTA
tgacattttggaaaaggcaa

SEQ ID NO: 265149 - DNA, 20 bp, Artificial Sequence
  Description of Artificial Sequence: Synthetic oligonucleotide
  Target: ATXN1; (+) strand; PAM type: YTN; PAM sequence: TTT
tggaaaaggcaaagctacag

SEQ ID NO: 265150 - DNA, 20 bp, Artificial Sequence
  Description of Artificial Sequence: Synthetic oligonucleotide
  Target: ATXN1; (+) strand; PAM type: YTN; PAM sequence: TTT
ggaaaaggcaaagctacagg

SEQ ID NO: 265151 - DNA, 20 bp, Artificial Sequence
  Description of Artificial Sequence: Synthetic oligonucleotide
  Target: ATXN1; (+) strand; PAM type: YTN; PAM sequence: TTG
gaaaaggcaaagctacaggg

SEQ ID NO: 265152 - DNA, 20 bp, Artificial Sequence
  Description of Artificial Sequence: Synthetic oligonucleotide
  Target: ATXN1; (+) strand; PAM type: YTN; PAM sequence: CTA
cagggatagtaaaaaaaaaa

SEQ ID NO: 265153 - DNA, 20 bp, Artificial Sequence
  Description of Artificial Sequence: Synthetic oligonucleotide
  Target: ATXN1; (+) strand; PAM type: YTN; PAM sequence: TTT
tggggattgggaggaacaaa

SEQ ID NO: 265154 - DNA, 20 bp, Artificial Sequence
  Description of Artificial Sequence: Synthetic oligonucleotide
  Target: ATXN1; (+) strand; PAM type: YTN; PAM sequence: TTT
ggggattgggaggaacaaat

SEQ ID NO: 265155 - DNA, 20 bp, Artificial Sequence
  Description of Artificial Sequence: Synthetic oligonucleotide
  Target: ATXN1; (+) strand; PAM type: YTN; PAM sequence: TTG
gggattgggaggaacaaata

SEQ ID NO: 265156 - DNA, 20 bp, Artificial Sequence
  Description of Artificial Sequence: Synthetic oligonucleotide
  Target: ATXN1; (+) strand; PAM type: YTN; PAM sequence: TTG
ggaggaacaaataagcagag

SEQ ID NO: 265157 - DNA, 20 bp, Artificial Sequence
  Description of Artificial Sequence: Synthetic oligonucleotide
  Target: ATXN1; (+) strand; PAM type: YTN; PAM sequence: TTG
ttaggacacatgtcatctat

SEQ ID NO: 265158 - DNA, 20 bp, Artificial Sequence
  Description of Artificial Sequence: Synthetic oligonucleotide
  Target: ATXN1; (+) strand; PAM type: YTN; PAM sequence: TTA
ggacacatgtcatctatttg

SEQ ID NO: 265159 - DNA, 20 bp, Artificial Sequence
  Description of Artificial Sequence: Synthetic oligonucleotide
  Target: ATXN1; (+) strand; PAM type: YTN; PAM sequence: CTA
tttgtcaaacacagaatgta

SEQ ID NO: 265160 - DNA, 20 bp, Artificial Sequence
  Description of Artificial Sequence: Synthetic oligonucleotide
  Target: ATXN1; (+) strand; PAM type: YTN; PAM sequence: TTT
gtcaaacacagaatgtacaa

SEQ ID NO: 265161 - DNA, 20 bp, Artificial Sequence
  Description of Artificial Sequence: Synthetic oligonucleotide
  Target: ATXN1; (+) strand; PAM type: YTN; PAM sequence: TTG
tcaaacacagaatgtacaac

SEQ ID NO: 265162 - DNA, 20 bp, Artificial Sequence
  Description of Artificial Sequence: Synthetic oligonucleotide
  Target: ATXN1; (+) strand; PAM type: YTN; PAM sequence: CTC
taacatgaactatagacttt

SEQ ID NO: 265163 - DNA, 20 bp, Artificial Sequence
  Description of Artificial Sequence: Synthetic oligonucleotide
  Target: ATXN1; (+) strand; PAM type: YTN; PAM sequence: CTA
acatgaactatagactttag

SEQ ID NO: 265164 - DNA, 20 bp, Artificial Sequence
  Description of Artificial Sequence: Synthetic oligonucleotide
  Target: ATXN1; (+) strand; PAM type: YTN; PAM sequence: CTA
tagactttagttaataataa

SEQ ID NO: 265165 - DNA, 20 bp, Artificial Sequence
  Description of Artificial Sequence: Synthetic oligonucleotide
  Target: ATXN1; (+) strand; PAM type: YTN; PAM sequence: CTT
tagttaataataatgtatcc

SEQ ID NO: 265166 - DNA, 20 bp, Artificial Sequence
  Description of Artificial Sequence: Synthetic oligonucleotide
  Target: ATXN1; (+) strand; PAM type: YTN; PAM sequence: TTT
agttaataataatgtatcca

SEQ ID NO: 265167 - DNA, 20 bp, Artificial Sequence
  Description of Artificial Sequence: Synthetic oligonucleotide
  Target: ATXN1; (+) strand; PAM type: YTN; PAM sequence: TTA
gttaataataatgtatccat

SEQ ID NO: 265168 - DNA, 20 bp, Artificial Sequence
  Description of Artificial Sequence: Synthetic oligonucleotide
  Target: ATXN1; (+) strand; PAM type: YTN; PAM sequence: TTA
ataataatgtatccatatta

SEQ ID NO: 265169 - DNA, 20 bp, Artificial Sequence
  Description of Artificial Sequence: Synthetic oligonucleotide
  Target: ATXN1; (+) strand; PAM type: YTN; PAM sequence: TTA
gttcaatttcaacaaatgta

SEQ ID NO: 265170 - DNA, 20 bp, Artificial Sequence
  Description of Artificial Sequence: Synthetic oligonucleotide
  Target: ATXN1; (+) strand; PAM type: YTN; PAM sequence: TTC
aatttcaacaaatgtaagat

SEQ ID NO: 265171 - DNA, 20 bp, Artificial Sequence
  Description of Artificial Sequence: Synthetic oligonucleotide
  Target: ATXN1; (+) strand; PAM type: YTN; PAM sequence: TTT
caacaaatgtaagatgcaag

SEQ ID NO: 265172 - DNA, 20 bp, Artificial Sequence
  Description of Artificial Sequence: Synthetic oligonucleotide
  Target: ATXN1; (+) strand; PAM type: YTN; PAM sequence: TTC
aacaaatgtaagatgcaaga

SEQ ID NO: 265173 - DNA, 20 bp, Artificial Sequence
  Description of Artificial Sequence: Synthetic oligonucleotide
  Target: ATXN1; (+) strand; PAM type: YTN; PAM sequence: TTA
gcagtagggacactgtttgt

SEQ ID NO: 265174 - DNA, 20 bp, Artificial Sequence
  Description of Artificial Sequence: Synthetic oligonucleotide
  Target: ATXN1; (+) strand; PAM type: YTN; PAM sequence: CTG
tttgtcaggggtcggggagg

SEQ ID NO: 265175 - DNA, 20 bp, Artificial Sequence
  Description of Artificial Sequence: Synthetic oligonucleotide
  Target: ATXN1; (+) strand; PAM type: YTN; PAM sequence: TTT
gtcaggggtcggggaggcta

SEQ ID NO: 265176 - DNA, 20 bp, Artificial Sequence
  Description of Artificial Sequence: Synthetic oligonucleotide
  Target: ATXN1; (+) strand; PAM type: YTN; PAM sequence: TTG
tcaggggtcggggaggctag

SEQ ID NO: 265177 - DNA, 20 bp, Artificial Sequence
  Description of Artificial Sequence: Synthetic oligonucleotide
  Target: ATXN1; (+) strand; PAM type: YTN; PAM sequence: CTA
ggaatataggaactctttgt

SEQ ID NO: 265178 - DNA, 20 bp, Artificial Sequence
  Description of Artificial Sequence: Synthetic oligonucleotide
  Target: ATXN1; (+) strand; PAM type: YTN; PAM sequence: CTC
tttgtactttcaaatcaatt

SEQ ID NO: 265179 - DNA, 20 bp, Artificial Sequence
  Description of Artificial Sequence: Synthetic oligonucleotide
  Target: ATXN1; (+) strand; PAM type: YTN; PAM sequence: CTT
tgtactttcaaatcaatttt

SEQ ID NO: 265180 - DNA, 20 bp, Artificial Sequence
  Description of Artificial Sequence: Synthetic oligonucleotide
  Target: ATXN1; (+) strand; PAM type: YTN; PAM sequence: TTT
gtactttcaaatcaattttt

SEQ ID NO: 265181 - DNA, 20 bp, Artificial Sequence
  Description of Artificial Sequence: Synthetic oligonucleotide
  Target: ATXN1; (+) strand; PAM type: YTN; PAM sequence: TTG
tactttcaaatcaatttttc

SEQ ID NO: 265182 - DNA, 20 bp, Artificial Sequence
  Description of Artificial Sequence: Synthetic oligonucleotide
  Target: ATXN1; (+) strand; PAM type: YTN; PAM sequence: CTT
tcaaatcaatttttctgtaa

SEQ ID NO: 265183 - DNA, 20 bp, Artificial Sequence
  Description of Artificial Sequence: Synthetic oligonucleotide
  Target: ATXN1; (+) strand; PAM type: YTN; PAM sequence: TTT
caaatcaatttttctgtaaa

SEQ ID NO: 265184 - DNA, 20 bp, Artificial Sequence
  Description of Artificial Sequence: Synthetic oligonucleotide
  Target: ATXN1; (+) strand; PAM type: YTN; PAM sequence: TTC
aaatcaatttttctgtaaac

SEQ ID NO: 265185 - DNA, 20 bp, Artificial Sequence
  Description of Artificial Sequence: Synthetic oligonucleotide
  Target: ATXN1; (+) strand; PAM type: YTN; PAM sequence: TTT
ttctgtaaacctaaaactgt

SEQ ID NO: 265186 - DNA, 20 bp, Artificial Sequence
  Description of Artificial Sequence: Synthetic oligonucleotide
  Target: ATXN1; (+) strand; PAM type: YTN; PAM sequence: TTT
tctgtaaacctaaaactgtt

SEQ ID NO: 265187 - DNA, 20 bp, Artificial Sequence
  Description of Artificial Sequence: Synthetic oligonucleotide
  Target: ATXN1; (+) strand; PAM type: YTN; PAM sequence: TTT
ctgtaaacctaaaactgttc

SEQ ID NO: 265188 - DNA, 20 bp, Artificial Sequence
  Description of Artificial Sequence: Synthetic oligonucleotide
  Target: ATXN1; (+) strand; PAM type: YTN; PAM sequence: TTC
tgtaaacctaaaactgttct

SEQ ID NO: 265189 - DNA, 20 bp, Artificial Sequence
  Description of Artificial Sequence: Synthetic oligonucleotide
  Target: ATXN1; (+) strand; PAM type: YTN; PAM sequence: CTG
taaacctaaaactgttctat

SEQ ID NO: 265190 - DNA, 20 bp, Artificial Sequence
  Description of Artificial Sequence: Synthetic oligonucleotide
  Target: ATXN1; (+) strand; PAM type: YTN; PAM sequence: CTA
aaactgttctataaaaaagc

SEQ ID NO: 265191 - DNA, 20 bp, Artificial Sequence
  Description of Artificial Sequence: Synthetic oligonucleotide
  Target: ATXN1; (+) strand; PAM type: YTN; PAM sequence: CTG
ttctataaaaaagcctatta

SEQ ID NO: 265192 - DNA, 20 bp, Artificial Sequence
  Description of Artificial Sequence: Synthetic oligonucleotide
  Target: ATXN1; (+) strand; PAM type: YTN; PAM sequence: TTC
tataaaaaagcctattaatt

SEQ ID NO: 265193 - DNA, 20 bp, Artificial Sequence
  Description of Artificial Sequence: Synthetic oligonucleotide
  Target: ATXN1; (+) strand; PAM type: YTN; PAM sequence: CTA
taaaaaagcctattaattaa

SEQ ID NO: 265194 - DNA, 20 bp, Artificial Sequence
  Description of Artificial Sequence: Synthetic oligonucleotide
  Target: ATXN1; (+) strand; PAM type: YTN; PAM sequence: CTA
ttaattaaaaaacaaaaaca

SEQ ID NO: 265195 - DNA, 20 bp, Artificial Sequence
  Description of Artificial Sequence: Synthetic oligonucleotide
  Target: ATXN1; (+) strand; PAM type: YTN; PAM sequence: TTA
attaaaaaacaaaaacaaca

SEQ ID NO: 265196 - DNA, 20 bp, Artificial Sequence
  Description of Artificial Sequence: Synthetic oligonucleotide
  Target: ATXN1; (+) strand; PAM type: YTN; PAM sequence: TTA
aaaaacaaaaacaacaacaa

SEQ ID NO: 265197 - DNA, 20 bp, Artificial Sequence
  Description of Artificial Sequence: Synthetic oligonucleotide
  Target: ATXN1; (+) strand; PAM type: YTN; PAM sequence: CTG
cactgacagctgtttgaagt

SEQ ID NO: 265198 - DNA, 20 bp, Artificial Sequence
  Description of Artificial Sequence: Synthetic oligonucleotide
  Target: ATXN1; (+) strand; PAM type: YTN; PAM sequence: CTG
acagctgtttgaagtgttcc

SEQ ID NO: 265199 - DNA, 20 bp, Artificial Sequence
  Description of Artificial Sequence: Synthetic oligonucleotide
  Target: ATXN1; (+) strand; PAM type: YTN; PAM sequence: CTG
tttgaagtgttcctcccagg

SEQ ID NO: 265200 - DNA, 20 bp, Artificial Sequence
  Description of Artificial Sequence: Synthetic oligonucleotide
  Target: ATXN1; (+) strand; PAM type: YTN; PAM sequence: TTT
gaagtgttcctcccaggtgt

SEQ ID NO: 265201 - DNA, 20 bp, Artificial Sequence
  Description of Artificial Sequence: Synthetic oligonucleotide
  Target: ATXN1; (+) strand; PAM type: YTN; PAM sequence: TTG
aagtgttcctcccaggtgtc

SEQ ID NO: 265202 - DNA, 20 bp, Artificial Sequence
  Description of Artificial Sequence: Synthetic oligonucleotide
  Target: ATXN1; (+) strand; PAM type: YTN; PAM sequence: TTC
ctcccaggtgtccttccaga

SEQ ID NO: 265203 - DNA, 20 bp, Artificial Sequence
  Description of Artificial Sequence: Synthetic oligonucleotide
  Target: ATXN1; (+) strand; PAM type: YTN; PAM sequence: CTC
ccaggtgtccttccagatac

SEQ ID NO: 265204 - DNA, 20 bp, Artificial Sequence
  Description of Artificial Sequence: Synthetic oligonucleotide
  Target: ATXN1; (+) strand; PAM type: YTN; PAM sequence: CTT
ccagatactagctagagcca

SEQ ID NO: 265205 - DNA, 20 bp, Artificial Sequence
  Description of Artificial Sequence: Synthetic oligonucleotide
  Target: ATXN1; (+) strand; PAM type: YTN; PAM sequence: TTC
cagatactagctagagccaa

SEQ ID NO: 265206 - DNA, 20 bp, Artificial Sequence
  Description of Artificial Sequence: Synthetic oligonucleotide
  Target: ATXN1; (+) strand; PAM type: YTN; PAM sequence: CTA
gctagagccaagtggaatta

SEQ ID NO: 265207 - DNA, 20 bp, Artificial Sequence
  Description of Artificial Sequence: Synthetic oligonucleotide
  Target: ATXN1; (+) strand; PAM type: YTN; PAM sequence: CTA
gagccaagtggaattaatca

SEQ ID NO: 265208 - DNA, 20 bp, Artificial Sequence
  Description of Artificial Sequence: Synthetic oligonucleotide
  Target: ATXN1; (+) strand; PAM type: YTN; PAM sequence: TTA
atcaggcaaggtgcaacggc

SEQ ID NO: 265209 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtagctgatgcctg

SEQ ID NO: 265210 - DNA, 20 bp, Artificial Sequence
  Description of Artificial Sequence: Synthetic oligonucleotide
  Target: ATXN1; (+) strand; PAM type: YTN; PAM sequence: CTG
atgcctgtaatcccagcact

SEQ ID NO: 265211 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 265212 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggttg

SEQ ID NO: 265213 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggttga

SEQ ID NO: 265214 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggttgat

SEQ ID NO: 265215 - DNA, 20 bp, Artificial Sequence
  Description of Artificial Sequence: Synthetic oligonucleotide
  Target: ATXN1; (+) strand; PAM type: YTN; PAM sequence: TTG
atcaccaaagggcaggagac

SEQ ID NO: 265216 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccccg

SEQ ID NO: 265217 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatagaaaaatta

SEQ ID NO: 265218 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatagaaaaattagc

SEQ ID NO: 265219 - DNA, 20 bp, Artificial Sequence
  Description of Artificial Sequence: Synthetic oligonucleotide
  Target: ATXN1; (+) strand; PAM type: YTN; PAM sequence: CTA
aaaatagaaaaattagctgg

SEQ ID NO: 265220 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcaggtg

SEQ ID NO: 265221 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcaggtgtctg

SEQ ID NO: 265222 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctacttgggag

SEQ ID NO: 265223 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 265224 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 265225 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 265226 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 265227 - DNA, 20 bp, Artificial Sequence
  Description of Artificial Sequence: Synthetic oligonucleotide
  Target: ATXN1; (+) strand; PAM type: YTN; PAM sequence: TTG
cttgaacccaggagacggag

SEQ ID NO: 265228 - DNA, 20 bp, Artificial Sequence
  Description of Artificial Sequence: Synthetic oligonucleotide
  Target: ATXN1; (+) strand; PAM type: YTN; PAM sequence: CTT
gaacccaggagacggaggtt

SEQ ID NO: 265229 - DNA, 20 bp, Artificial Sequence
  Description of Artificial Sequence: Synthetic oligonucleotide
  Target: ATXN1; (+) strand; PAM type: YTN; PAM sequence: TTG
aacccaggagacggaggttg

SEQ ID NO: 265230 - DNA, 20 bp, Artificial Sequence
  Description of Artificial Sequence: Synthetic oligonucleotide
  Target: ATXN1; (+) strand; PAM type: YTN; PAM sequence: TTG
ccgtgagccaagatcgtgcc

SEQ ID NO: 265231 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacaa

SEQ ID NO: 265232 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacaagagtg

SEQ ID NO: 265233 - DNA, 20 bp, Artificial Sequence
  Description of Artificial Sequence: Synthetic oligonucleotide
  Target: ATXN1; (+) strand; PAM type: YTN; PAM sequence: CTG
ggtgacaagagtgaaattcc

SEQ ID NO: 265234 - DNA, 20 bp, Artificial Sequence
  Description of Artificial Sequence: Synthetic oligonucleotide
  Target: ATXN1; (+) strand; PAM type: YTN; PAM sequence: TTC
catttccaaaaacaaaacaa

SEQ ID NO: 265235 - DNA, 20 bp, Artificial Sequence
  Description of Artificial Sequence: Synthetic oligonucleotide
  Target: ATXN1; (+) strand; PAM type: YTN; PAM sequence: TTT
ccaaaaacaaaacaaaacaa

SEQ ID NO: 265236 - DNA, 20 bp, Artificial Sequence
  Description of Artificial Sequence: Synthetic oligonucleotide
  Target: ATXN1; (+) strand; PAM type: YTN; PAM sequence: TTC
caaaaacaaaacaaaacaaa

SEQ ID NO: 265237 - DNA, 20 bp, Artificial Sequence
  Description of Artificial Sequence: Synthetic oligonucleotide
  Target: ATXN1; (+) strand; PAM type: YTN; PAM sequence: CTC
ccaggcaaggtttgaagggc

SEQ ID NO: 265238 - DNA, 20 bp, Artificial Sequence
  Description of Artificial Sequence: Synthetic oligonucleotide
  Target: ATXN1; (+) strand; PAM type: YTN; PAM sequence: TTT
gaagggctagaggagagcca

SEQ ID NO: 265239 - DNA, 20 bp, Artificial Sequence
  Description of Artificial Sequence: Synthetic oligonucleotide
  Target: ATXN1; (+) strand; PAM type: YTN; PAM sequence: TTG
aagggctagaggagagccag

SEQ ID NO: 265240 - DNA, 20 bp, Artificial Sequence
  Description of Artificial Sequence: Synthetic oligonucleotide
  Target: ATXN1; (+) strand; PAM type: YTN; PAM sequence: CTA
gaggagagccagttttttgg

SEQ ID NO: 265241 - DNA, 20 bp, Artificial Sequence
  Description of Artificial Sequence: Synthetic oligonucleotide
  Target: ATXN1; (+) strand; PAM type: YTN; PAM sequence: TTT
tttggccaagaactaggagg

SEQ ID NO: 265242 - DNA, 20 bp, Artificial Sequence
  Description of Artificial Sequence: Synthetic oligonucleotide
  Target: ATXN1; (+) strand; PAM type: YTN; PAM sequence: TTT
ttggccaagaactaggagga

SEQ ID NO: 265243 - DNA, 20 bp, Artificial Sequence
  Description of Artificial Sequence: Synthetic oligonucleotide
  Target: ATXN1; (+) strand; PAM type: YTN; PAM sequence: TTT
tggccaagaactaggaggat

SEQ ID NO: 265244 - DNA, 20 bp, Artificial Sequence
  Description of Artificial Sequence: Synthetic oligonucleotide
  Target: ATXN1; (+) strand; PAM type: YTN; PAM sequence: TTT
ggccaagaactaggaggatg

SEQ ID NO: 265245 - DNA, 20 bp, Artificial Sequence
  Description of Artificial Sequence: Synthetic oligonucleotide
  Target: ATXN1; (+) strand; PAM type: YTN; PAM sequence: TTG
gccaagaactaggaggatgc

SEQ ID NO: 265246 - DNA, 20 bp, Artificial Sequence
  Description of Artificial Sequence: Synthetic oligonucleotide
  Target: ATXN1; (+) strand; PAM type: YTN; PAM sequence: CTA
ggaggatgcaatgattcaga

SEQ ID NO: 265247 - DNA, 20 bp, Artificial Sequence
  Description of Artificial Sequence: Synthetic oligonucleotide
  Target: ATXN1; (+) strand; PAM type: YTN; PAM sequence: TTC
agatggggatgagggcaagg

SEQ ID NO: 265248 - DNA, 20 bp, Artificial Sequence
  Description of Artificial Sequence: Synthetic oligonucleotide
  Target: ATXN1; (+) strand; PAM type: YTN; PAM sequence: CTG
gggtgggatgaatgcatggg

SEQ ID NO: 265249 - DNA, 20 bp, Artificial Sequence
  Description of Artificial Sequence: Synthetic oligonucleotide
  Target: ATXN1; (+) strand; PAM type: YTN; PAM sequence: TTT
gaccggaagacaagagccac

SEQ ID NO: 265250 - DNA, 20 bp, Artificial Sequence
  Description of Artificial Sequence: Synthetic oligonucleotide
  Target: ATXN1; (+) strand; PAM type: YTN; PAM sequence: TTG
accggaagacaagagccaca

SEQ ID NO: 265251 - DNA, 20 bp, Artificial Sequence
  Description of Artificial Sequence: Synthetic oligonucleotide
  Target: ATXN1; (+) strand; PAM type: YTN; PAM sequence: CTC
cagttctttagcagaagaac

SEQ ID NO: 265252 - DNA, 20 bp, Artificial Sequence
  Description of Artificial Sequence: Synthetic oligonucleotide
  Target: ATXN1; (+) strand; PAM type: YTN; PAM sequence: TTC
tttagcagaagaactggagg

SEQ ID NO: 265253 - DNA, 20 bp, Artificial Sequence
  Description of Artificial Sequence: Synthetic oligonucleotide
  Target: ATXN1; (+) strand; PAM type: YTN; PAM sequence: CTT
tagcagaagaactggaggta

SEQ ID NO: 265254 - DNA, 20 bp, Artificial Sequence
  Description of Artificial Sequence: Synthetic oligonucleotide
  Target: ATXN1; (+) strand; PAM type: YTN; PAM sequence: TTT
agcagaagaactggaggtaa

SEQ ID NO: 265255 - DNA, 20 bp, Artificial Sequence
  Description of Artificial Sequence: Synthetic oligonucleotide
  Target: ATXN1; (+) strand; PAM type: YTN; PAM sequence: TTA
gcagaagaactggaggtaaa

SEQ ID NO: 265256 - DNA, 20 bp, Artificial Sequence
  Description of Artificial Sequence: Synthetic oligonucleotide
  Target: ATXN1; (+) strand; PAM type: YTN; PAM sequence: CTG
gaggtaaagataggtgcatc

SEQ ID NO: 265257 - DNA, 20 bp, Artificial Sequence
  Description of Artificial Sequence: Synthetic oligonucleotide
  Target: ATXN1; (+) strand; PAM type: YTN; PAM sequence: CTG
tgattaggaggttaaaatga

SEQ ID NO: 265258 - DNA, 20 bp, Artificial Sequence
  Description of Artificial Sequence: Synthetic oligonucleotide
  Target: ATXN1; (+) strand; PAM type: YTN; PAM sequence: TTA
ggaggttaaaatgaaatctg

SEQ ID NO: 265259 - DNA, 20 bp, Artificial Sequence
  Description of Artificial Sequence: Synthetic oligonucleotide
  Target: ATXN1; (+) strand; PAM type: YTN; PAM sequence: TTA
aaatgaaatctgaaagacag

SEQ ID NO: 265260 - DNA, 20 bp, Artificial Sequence
  Description of Artificial Sequence: Synthetic oligonucleotide
  Target: ATXN1; (+) strand; PAM type: YTN; PAM sequence: CTG
aaagacagagtcactccaga

SEQ ID NO: 265261 - DNA, 20 bp, Artificial Sequence
  Description of Artificial Sequence: Synthetic oligonucleotide
  Target: ATXN1; (+) strand; PAM type: YTN; PAM sequence: CTC
cagactctgggaaagctcat

SEQ ID NO: 265262 - DNA, 20 bp, Artificial Sequence
  Description of Artificial Sequence: Synthetic oligonucleotide
  Target: ATXN1; (+) strand; PAM type: YTN; PAM sequence: CTC
tgggaaagctcatgatgcaa

SEQ ID NO: 265263 - DNA, 20 bp, Artificial Sequence
  Description of Artificial Sequence: Synthetic oligonucleotide
  Target: ATXN1; (+) strand; PAM type: YTN; PAM sequence: CTG
ggaaagctcatgatgcaatc

SEQ ID NO: 265264 - DNA, 20 bp, Artificial Sequence
  Description of Artificial Sequence: Synthetic oligonucleotide
  Target: ATXN1; (+) strand; PAM type: YTN; PAM sequence: CTC
atgatgcaatcaaaatgatg

SEQ ID NO: 265265 - DNA, 20 bp, Artificial Sequence
  Description of Artificial Sequence: Synthetic oligonucleotide
  Target: ATXN1; (+) strand; PAM type: YTN; PAM sequence: CTC
tgctaagtccgggccacata

SEQ ID NO: 265266 - DNA, 20 bp, Artificial Sequence
  Description of Artificial Sequence: Synthetic oligonucleotide
  Target: ATXN1; (+) strand; PAM type: YTN; PAM sequence: CTG
ctaagtccgggccacataaa

SEQ ID NO: 265267 - DNA, 20 bp, Artificial Sequence
  Description of Artificial Sequence: Synthetic oligonucleotide
  Target: ATXN1; (+) strand; PAM type: YTN; PAM sequence: CTA
agtccgggccacataaagac

SEQ ID NO: 265268 - DNA, 20 bp, Artificial Sequence
  Description of Artificial Sequence: Synthetic oligonucleotide
  Target: ATXN1; (+) strand; PAM type: YTN; PAM sequence: CTA
caggtgaggtcatgagtcct

SEQ ID NO: 265269 - DNA, 20 bp, Artificial Sequence
  Description of Artificial Sequence: Synthetic oligonucleotide
  Target: ATXN1; (+) strand; PAM type: YTN; PAM sequence: CTT
gctttgagggaaagtaaaca

SEQ ID NO: 265270 - DNA, 20 bp, Artificial Sequence
  Description of Artificial Sequence: Synthetic oligonucleotide
  Target: ATXN1; (+) strand; PAM type: YTN; PAM sequence: TTG
ctttgagggaaagtaaacag

SEQ ID NO: 265271 - DNA, 20 bp, Artificial Sequence
  Description of Artificial Sequence: Synthetic oligonucleotide
  Target: ATXN1; (+) strand; PAM type: YTN; PAM sequence: CTT
tgagggaaagtaaacagaaa

SEQ ID NO: 265272 - DNA, 20 bp, Artificial Sequence
  Description of Artificial Sequence: Synthetic oligonucleotide
  Target: ATXN1; (+) strand; PAM type: YTN; PAM sequence: TTT
gagggaaagtaaacagaaaa

SEQ ID NO: 265273 - DNA, 20 bp, Artificial Sequence
  Description of Artificial Sequence: Synthetic oligonucleotide
  Target: ATXN1; (+) strand; PAM type: YTN; PAM sequence: TTG
agggaaagtaaacagaaaat

SEQ ID NO: 265274 - DNA, 20 bp, Artificial Sequence
  Description of Artificial Sequence: Synthetic oligonucleotide
  Target: ATXN1; (+) strand; PAM type: YTN; PAM sequence: TTC
taagggaatgcataatttcc

SEQ ID NO: 265275 - DNA, 20 bp, Artificial Sequence
  Description of Artificial Sequence: Synthetic oligonucleotide
  Target: ATXN1; (+) strand; PAM type: YTN; PAM sequence: CTA
agggaatgcataatttccaa

SEQ ID NO: 265276 - DNA, 20 bp, Artificial Sequence
  Description of Artificial Sequence: Synthetic oligonucleotide
  Target: ATXN1; (+) strand; PAM type: YTN; PAM sequence: TTT
ccaagaaaagtcatagcgaa

SEQ ID NO: 265277 - DNA, 20 bp, Artificial Sequence
  Description of Artificial Sequence: Synthetic oligonucleotide
  Target: ATXN1; (+) strand; PAM type: YTN; PAM sequence: TTC
caagaaaagtcatagcgaac

SEQ ID NO: 265278 - DNA, 20 bp, Artificial Sequence
  Description of Artificial Sequence: Synthetic oligonucleotide
  Target: ATXN1; (+) strand; PAM type: YTN; PAM sequence: CTG
tgtccaggaagctgagatgg

SEQ ID NO: 265279 - DNA, 20 bp, Artificial Sequence
  Description of Artificial Sequence: Synthetic oligonucleotide
  Target: ATXN1; (+) strand; PAM type: YTN; PAM sequence: CTG
agatggaagaggaataactt

SEQ ID NO: 265280 - DNA, 20 bp, Artificial Sequence
  Description of Artificial Sequence: Synthetic oligonucleotide
  Target: ATXN1; (+) strand; PAM type: YTN; PAM sequence: CTT
cttaaaagtactaaatgtgg

SEQ ID NO: 265281 - DNA, 20 bp, Artificial Sequence
  Description of Artificial Sequence: Synthetic oligonucleotide
  Target: ATXN1; (+) strand; PAM type: YTN; PAM sequence: TTC
ttaaaagtactaaatgtggc

SEQ ID NO: 265282 - DNA, 20 bp, Artificial Sequence
  Description of Artificial Sequence: Synthetic oligonucleotide
  Target: ATXN1; (+) strand; PAM type: YTN; PAM sequence: CTT
aaaagtactaaatgtggcca

SEQ ID NO: 265283 - DNA, 20 bp, Artificial Sequence
  Description of Artificial Sequence: Synthetic oligonucleotide
  Target: ATXN1; (+) strand; PAM type: YTN; PAM sequence: TTA
aaagtactaaatgtggccag

SEQ ID NO: 265284 - DNA, 20 bp, Artificial Sequence
  Description of Artificial Sequence: Synthetic oligonucleotide
  Target: ATXN1; (+) strand; PAM type: YTN; PAM sequence: CTA
aatgtggccaggcgcggtgg

SEQ ID NO: 265285 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 265286 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 265287 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcgggtgg

SEQ ID NO: 265288 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcgggtgga

SEQ ID NO: 265289 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcgggtggac

SEQ ID NO: 265290 - DNA, 20 bp, Artificial Sequence
  Description of Artificial Sequence: Synthetic oligonucleotide
  Target: ATXN1; (+) strand; PAM type: YTN; PAM sequence: CTG
gctaacacagtgaaacccca

SEQ ID NO: 265291 - DNA, 20 bp, Artificial Sequence
  Description of Artificial Sequence: Synthetic oligonucleotide
  Target: ATXN1; (+) strand; PAM type: YTN; PAM sequence: CTA
acacagtgaaaccccatctc

SEQ ID NO: 265292 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 265293 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 265294 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 265295 - DNA, 20 bp, Artificial Sequence
  Description of Artificial Sequence: Synthetic oligonucleotide
  Target: ATXN1; (+) strand; PAM type: YTN; PAM sequence: TTA
gctgggcgcagtggcaggtg

SEQ ID NO: 265296 - DNA, 20 bp, Artificial Sequence
  Description of Artificial Sequence: Synthetic oligonucleotide
  Target: ATXN1; (+) strand; PAM type: YTN; PAM sequence: CTG
ggcgcagtggcaggtgcctg

SEQ ID NO: 265297 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactagggag

SEQ ID NO: 265298 - DNA, 20 bp, Artificial Sequence
  Description of Artificial Sequence: Synthetic oligonucleotide
  Target: ATXN1; (+) strand; PAM type: YTN; PAM sequence: CTA
ctagggaggctgaggcagga

SEQ ID NO: 265299 - DNA, 20 bp, Artificial Sequence
  Description of Artificial Sequence: Synthetic oligonucleotide
  Target: ATXN1; (+) strand; PAM type: YTN; PAM sequence: CTA
gggaggctgaggcaggagaa

SEQ ID NO: 265300 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgta

SEQ ID NO: 265301 - DNA, 20 bp, Artificial Sequence
  Description of Artificial Sequence: Synthetic oligonucleotide
  Target: ATXN1; (+) strand; PAM type: YTN; PAM sequence: CTT
gtacccaggcgggggcagag

SEQ ID NO: 265302 - DNA, 20 bp, Artificial Sequence
  Description of Artificial Sequence: Synthetic oligonucleotide
  Target: ATXN1; (+) strand; PAM type: YTN; PAM sequence: TTG
tacccaggcgggggcagaga

SEQ ID NO: 265303 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagattgcgcc

SEQ ID NO: 265304 - DNA, 20 bp, Artificial Sequence
  Description of Artificial Sequence: Synthetic oligonucleotide
  Target: ATXN1; (+) strand; PAM type: YTN; PAM sequence: TTG
cgccactgcactccagtctg

SEQ ID NO: 265305 - DNA, 20 bp, Artificial Sequence
  Description of Artificial Sequence: Synthetic oligonucleotide
  Target: ATXN1; (+) strand; PAM type: YTN; PAM sequence: CTG
cactccagtctgggtgacag

SEQ ID NO: 265306 - DNA, 20 bp, Artificial Sequence
  Description of Artificial Sequence: Synthetic oligonucleotide
  Target: ATXN1; (+) strand; PAM type: YTN; PAM sequence: CTC
cagtctgggtgacagagtca

SEQ ID NO: 265307 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtcagacccca

SEQ ID NO: 265308 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 265309 - DNA, 20 bp, Artificial Sequence
  Description of Artificial Sequence: Synthetic oligonucleotide
  Target: ATXN1; (+) strand; PAM type: YTN; PAM sequence: CTA
aatgtcaggagggaacccaa

SEQ ID NO: 265310 - DNA, 20 bp, Artificial Sequence
  Description of Artificial Sequence: Synthetic oligonucleotide
  Target: ATXN1; (+) strand; PAM type: YTN; PAM sequence: CTC
tctatcaagtagggttccta

SEQ ID NO: 265311 - DNA, 20 bp, Artificial Sequence
  Description of Artificial Sequence: Synthetic oligonucleotide
  Target: ATXN1; (+) strand; PAM type: YTN; PAM sequence: CTC
tatcaagtagggttcctaga

SEQ ID NO: 265312 - DNA, 20 bp, Artificial Sequence
  Description of Artificial Sequence: Synthetic oligonucleotide
  Target: ATXN1; (+) strand; PAM type: YTN; PAM sequence: CTA
tcaagtagggttcctagatt

SEQ ID NO: 265313 - DNA, 20 bp, Artificial Sequence
  Description of Artificial Sequence: Synthetic oligonucleotide
  Target: ATXN1; (+) strand; PAM type: YTN; PAM sequence: TTC
ctagatttcttctctttcag

SEQ ID NO: 265314 - DNA, 20 bp, Artificial Sequence
  Description of Artificial Sequence: Synthetic oligonucleotide
  Target: ATXN1; (+) strand; PAM type: YTN; PAM sequence: CTA
gatttcttctctttcagaat

SEQ ID NO: 265315 - DNA, 20 bp, Artificial Sequence
  Description of Artificial Sequence: Synthetic oligonucleotide
  Target: ATXN1; (+) strand; PAM type: YTN; PAM sequence: TTT
cttctctttcagaattctca

SEQ ID NO: 265316 - DNA, 20 bp, Artificial Sequence
  Description of Artificial Sequence: Synthetic oligonucleotide
  Target: ATXN1; (+) strand; PAM type: YTN; PAM sequence: TTC
ttctctttcagaattctcat

SEQ ID NO: 265317 - DNA, 20 bp, Artificial Sequence
  Description of Artificial Sequence: Synthetic oligonucleotide
  Target: ATXN1; (+) strand; PAM type: YTN; PAM sequence: CTT
ctctttcagaattctcatct

SEQ ID NO: 265318 - DNA, 20 bp, Artificial Sequence
  Description of Artificial Sequence: Synthetic oligonucleotide
  Target: ATXN1; (+) strand; PAM type: YTN; PAM sequence: TTC
tctttcagaattctcatctg

SEQ ID NO: 265319 - DNA, 20 bp, Artificial Sequence
  Description of Artificial Sequence: Synthetic oligonucleotide
  Target: ATXN1; (+) strand; PAM type: YTN; PAM sequence: CTC
tttcagaattctcatctgat

SEQ ID NO: 265320 - DNA, 20 bp, Artificial Sequence
  Description of Artificial Sequence: Synthetic oligonucleotide
  Target: ATXN1; (+) strand; PAM type: YTN; PAM sequence: CTT
tcagaattctcatctgatca

SEQ ID NO: 265321 - DNA, 20 bp, Artificial Sequence
  Description of Artificial Sequence: Synthetic oligonucleotide
  Target: ATXN1; (+) strand; PAM type: YTN; PAM sequence: TTT
cagaattctcatctgatcat

SEQ ID NO: 265322 - DNA, 20 bp, Artificial Sequence
  Description of Artificial Sequence: Synthetic oligonucleotide
  Target: ATXN1; (+) strand; PAM type: YTN; PAM sequence: TTC
agaattctcatctgatcata

SEQ ID NO: 265323 - DNA, 20 bp, Artificial Sequence
  Description of Artificial Sequence: Synthetic oligonucleotide
  Target: ATXN1; (+) strand; PAM type: YTN; PAM sequence: TTC
tcatctgatcatatttagga

SEQ ID NO: 265324 - DNA, 20 bp, Artificial Sequence
  Description of Artificial Sequence: Synthetic oligonucleotide
  Target: ATXN1; (+) strand; PAM type: YTN; PAM sequence: CTC
atctgatcatatttaggata

SEQ ID NO: 265325 - DNA, 20 bp, Artificial Sequence
  Description of Artificial Sequence: Synthetic oligonucleotide
  Target: ATXN1; (+) strand; PAM type: YTN; PAM sequence: CTG
atcatatttaggatagcgca

SEQ ID NO: 265326 - DNA, 20 bp, Artificial Sequence
  Description of Artificial Sequence: Synthetic oligonucleotide
  Target: ATXN1; (+) strand; PAM type: YTN; PAM sequence: TTT
aggatagcgcaagagggcag

SEQ ID NO: 265327 - DNA, 20 bp, Artificial Sequence
  Description of Artificial Sequence: Synthetic oligonucleotide
  Target: ATXN1; (+) strand; PAM type: YTN; PAM sequence: TTA
ggatagcgcaagagggcagt

SEQ ID NO: 265328 - DNA, 20 bp, Artificial Sequence
  Description of Artificial Sequence: Synthetic oligonucleotide
  Target: ATXN1; (+) strand; PAM type: YTN; PAM sequence: TTG
atattggcagaaaagagaaa

SEQ ID NO: 265329 - DNA, 20 bp, Artificial Sequence
  Description of Artificial Sequence: Synthetic oligonucleotide
  Target: ATXN1; (+) strand; PAM type: YTN; PAM sequence: TTG
gcagaaaagagaaaaggggg

SEQ ID NO: 265330 - DNA, 20 bp, Artificial Sequence
  Description of Artificial Sequence: Synthetic oligonucleotide
  Target: ATXN1; (+) strand; PAM type: YTN; PAM sequence: CTG
gtgaaatcgaagaactttca

SEQ ID NO: 265331 - DNA, 20 bp, Artificial Sequence
  Description of Artificial Sequence: Synthetic oligonucleotide
  Target: ATXN1; (+) strand; PAM type: YTN; PAM sequence: CTT
tcactcttacattcatatac

SEQ ID NO: 265332 - DNA, 20 bp, Artificial Sequence
  Description of Artificial Sequence: Synthetic oligonucleotide
  Target: ATXN1; (+) strand; PAM type: YTN; PAM sequence: TTT
cactcttacattcatatact

SEQ ID NO: 265333 - DNA, 20 bp, Artificial Sequence
  Description of Artificial Sequence: Synthetic oligonucleotide
  Target: ATXN1; (+) strand; PAM type: YTN; PAM sequence: TTC
actcttacattcatatactg

SEQ ID NO: 265334 - DNA, 20 bp, Artificial Sequence
  Description of Artificial Sequence: Synthetic oligonucleotide
  Target: ATXN1; (+) strand; PAM type: YTN; PAM sequence: CTC
ttacattcatatactggaaa

SEQ ID NO: 265335 - DNA, 20 bp, Artificial Sequence
  Description of Artificial Sequence: Synthetic oligonucleotide
  Target: ATXN1; (+) strand; PAM type: YTN; PAM sequence: CTT
acattcatatactggaaaag

SEQ ID NO: 265336 - DNA, 20 bp, Artificial Sequence
  Description of Artificial Sequence: Synthetic oligonucleotide
  Target: ATXN1; (+) strand; PAM type: YTN; PAM sequence: TTA
cattcatatactggaaaagt

SEQ ID NO: 265337 - DNA, 20 bp, Artificial Sequence
  Description of Artificial Sequence: Synthetic oligonucleotide
  Target: ATXN1; (+) strand; PAM type: YTN; PAM sequence: TTC
atatactggaaaagtcagta

SEQ ID NO: 265338 - DNA, 20 bp, Artificial Sequence
  Description of Artificial Sequence: Synthetic oligonucleotide
  Target: ATXN1; (+) strand; PAM type: YTN; PAM sequence: CTG
gaaaagtcagtagccagaaa

SEQ ID NO: 265339 - DNA, 20 bp, Artificial Sequence
  Description of Artificial Sequence: Synthetic oligonucleotide
  Target: ATXN1; (+) strand; PAM type: YTN; PAM sequence: TTT
tgaaaatctgtaataattca

SEQ ID NO: 265340 - DNA, 20 bp, Artificial Sequence
  Description of Artificial Sequence: Synthetic oligonucleotide
  Target: ATXN1; (+) strand; PAM type: YTN; PAM sequence: TTT
gaaaatctgtaataattcag

SEQ ID NO: 265341 - DNA, 20 bp, Artificial Sequence
  Description of Artificial Sequence: Synthetic oligonucleotide
  Target: ATXN1; (+) strand; PAM type: YTN; PAM sequence: TTG
aaaatctgtaataattcaga

SEQ ID NO: 265342 - DNA, 20 bp, Artificial Sequence
  Description of Artificial Sequence: Synthetic oligonucleotide
  Target: ATXN1; (+) strand; PAM type: YTN; PAM sequence: CTG
taataattcagatggaaaga

SEQ ID NO: 265343 - DNA, 20 bp, Artificial Sequence
  Description of Artificial Sequence: Synthetic oligonucleotide
  Target: ATXN1; (+) strand; PAM type: YTN; PAM sequence: TTC
agatggaaagacattcacaa

SEQ ID NO: 265344 - DNA, 20 bp, Artificial Sequence
  Description of Artificial Sequence: Synthetic oligonucleotide
  Target: ATXN1; (+) strand; PAM type: YTN; PAM sequence: TTC
acaacttttgcaatgtgaga

SEQ ID NO: 265345 - DNA, 20 bp, Artificial Sequence
  Description of Artificial Sequence: Synthetic oligonucleotide
  Target: ATXN1; (+) strand; PAM type: YTN; PAM sequence: CTT
ttgcaatgtgagagaagaaa

SEQ ID NO: 265346 - DNA, 20 bp, Artificial Sequence
  Description of Artificial Sequence: Synthetic oligonucleotide
  Target: ATXN1; (+) strand; PAM type: YTN; PAM sequence: TTT
tgcaatgtgagagaagaaat

SEQ ID NO: 265347 - DNA, 20 bp, Artificial Sequence
  Description of Artificial Sequence: Synthetic oligonucleotide
  Target: ATXN1; (+) strand; PAM type: YTN; PAM sequence: TTT
gcaatgtgagagaagaaatt

SEQ ID NO: 265348 - DNA, 20 bp, Artificial Sequence
  Description of Artificial Sequence: Synthetic oligonucleotide
  Target: ATXN1; (+) strand; PAM type: YTN; PAM sequence: TTG
caatgtgagagaagaaattt

SEQ ID NO: 265349 - DNA, 20 bp, Artificial Sequence
  Description of Artificial Sequence: Synthetic oligonucleotide
  Target: ATXN1; (+) strand; PAM type: YTN; PAM sequence: TTT
cggaaaagtagatcaagcac

SEQ ID NO: 265350 - DNA, 20 bp, Artificial Sequence
  Description of Artificial Sequence: Synthetic oligonucleotide
  Target: ATXN1; (+) strand; PAM type: YTN; PAM sequence: TTC
ggaaaagtagatcaagcacg

SEQ ID NO: 265351 - DNA, 20 bp, Artificial Sequence
  Description of Artificial Sequence: Synthetic oligonucleotide
  Target: ATXN1; (+) strand; PAM type: YTN; PAM sequence: TTC
tatttctgtaaagctacatg

SEQ ID NO: 265352 - DNA, 20 bp, Artificial Sequence
  Description of Artificial Sequence: Synthetic oligonucleotide
  Target: ATXN1; (+) strand; PAM type: YTN; PAM sequence: CTA
tttctgtaaagctacatgta

SEQ ID NO: 265353 - DNA, 20 bp, Artificial Sequence
  Description of Artificial Sequence: Synthetic oligonucleotide
  Target: ATXN1; (+) strand; PAM type: YTN; PAM sequence: TTT
ctgtaaagctacatgtattt

SEQ ID NO: 265354 - DNA, 20 bp, Artificial Sequence
  Description of Artificial Sequence: Synthetic oligonucleotide
  Target: ATXN1; (+) strand; PAM type: YTN; PAM sequence: TTC
tgtaaagctacatgtattta

SEQ ID NO: 265355 - DNA, 20 bp, Artificial Sequence
  Description of Artificial Sequence: Synthetic oligonucleotide
  Target: ATXN1; (+) strand; PAM type: YTN; PAM sequence: CTG
taaagctacatgtatttatt

SEQ ID NO: 265356 - DNA, 20 bp, Artificial Sequence
  Description of Artificial Sequence: Synthetic oligonucleotide
  Target: ATXN1; (+) strand; PAM type: YTN; PAM sequence: CTA
catgtatttatttgtatata

SEQ ID NO: 265357 - DNA, 20 bp, Artificial Sequence
  Description of Artificial Sequence: Synthetic oligonucleotide
  Target: ATXN1; (+) strand; PAM type: YTN; PAM sequence: TTT
atttgtatatatatatatcc

SEQ ID NO: 265358 - DNA, 20 bp, Artificial Sequence
  Description of Artificial Sequence: Synthetic oligonucleotide
  Target: ATXN1; (+) strand; PAM type: YTN; PAM sequence: TTA
tttgtatatatatatatcca

SEQ ID NO: 265359 - DNA, 20 bp, Artificial Sequence
  Description of Artificial Sequence: Synthetic oligonucleotide
  Target: ATXN1; (+) strand; PAM type: YTN; PAM sequence: TTT
gtatatatatatatccatag

SEQ ID NO: 265360 - DNA, 20 bp, Artificial Sequence
  Description of Artificial Sequence: Synthetic oligonucleotide
  Target: ATXN1; (+) strand; PAM type: YTN; PAM sequence: TTG
tatatatatatatccataga

SEQ ID NO: 265361 - DNA, 20 bp, Artificial Sequence
  Description of Artificial Sequence: Synthetic oligonucleotide
  Target: ATXN1; (+) strand; PAM type: YTN; PAM sequence: CTT
ctggaagaaaacacactcaa

SEQ ID NO: 265362 - DNA, 20 bp, Artificial Sequence
  Description of Artificial Sequence: Synthetic oligonucleotide
  Target: ATXN1; (+) strand; PAM type: YTN; PAM sequence: TTC
tggaagaaaacacactcaaa

SEQ ID NO: 265363 - DNA, 20 bp, Artificial Sequence
  Description of Artificial Sequence: Synthetic oligonucleotide
  Target: ATXN1; (+) strand; PAM type: YTN; PAM sequence: CTG
gaagaaaacacactcaaatg

SEQ ID NO: 265364 - DNA, 20 bp, Artificial Sequence
  Description of Artificial Sequence: Synthetic oligonucleotide
  Target: ATXN1; (+) strand; PAM type: YTN; PAM sequence: CTC
aaatgctaacggtggtgaac

SEQ ID NO: 265365 - DNA, 20 bp, Artificial Sequence
  Description of Artificial Sequence: Synthetic oligonucleotide
  Target: ATXN1; (+) strand; PAM type: YTN; PAM sequence: CTA
acggtggtgaacatctatgg

SEQ ID NO: 265366 - DNA, 20 bp, Artificial Sequence
  Description of Artificial Sequence: Synthetic oligonucleotide
  Target: ATXN1; (+) strand; PAM type: YTN; PAM sequence: CTA
tgggcaggtagataataatg

SEQ ID NO: 265367 - DNA, 20 bp, Artificial Sequence
  Description of Artificial Sequence: Synthetic oligonucleotide
  Target: ATXN1; (+) strand; PAM type: YTN; PAM sequence: TTT
ttaatattactagtttgtat

SEQ ID NO: 265368 - DNA, 20 bp, Artificial Sequence
  Description of Artificial Sequence: Synthetic oligonucleotide
  Target: ATXN1; (+) strand; PAM type: YTN; PAM sequence: TTT
taatattactagtttgtatt

SEQ ID NO: 265369 - DNA, 20 bp, Artificial Sequence
  Description of Artificial Sequence: Synthetic oligonucleotide
  Target: ATXN1; (+) strand; PAM type: YTN; PAM sequence: TTT
aatattactagtttgtattt

SEQ ID NO: 265370 - DNA, 20 bp, Artificial Sequence
  Description of Artificial Sequence: Synthetic oligonucleotide
  Target: ATXN1; (+) strand; PAM type: YTN; PAM sequence: TTA
atattactagtttgtatttc

SEQ ID NO: 265371 - DNA, 20 bp, Artificial Sequence
  Description of Artificial Sequence: Synthetic oligonucleotide
  Target: ATXN1; (+) strand; PAM type: YTN; PAM sequence: TTA
ctagtttgtatttccttaat

SEQ ID NO: 265372 - DNA, 20 bp, Artificial Sequence
  Description of Artificial Sequence: Synthetic oligonucleotide
  Target: ATXN1; (+) strand; PAM type: YTN; PAM sequence: CTA
gtttgtatttccttaatttc

SEQ ID NO: 265373 - DNA, 20 bp, Artificial Sequence
  Description of Artificial Sequence: Synthetic oligonucleotide
  Target: ATXN1; (+) strand; PAM type: YTN; PAM sequence: TTT
gtatttccttaatttctctt

SEQ ID NO: 265374 - DNA, 20 bp, Artificial Sequence
  Description of Artificial Sequence: Synthetic oligonucleotide
  Target: ATXN1; (+) strand; PAM type: YTN; PAM sequence: TTG
tatttccttaatttctcttc

SEQ ID NO: 265375 - DNA, 20 bp, Artificial Sequence
  Description of Artificial Sequence: Synthetic oligonucleotide
  Target: ATXN1; (+) strand; PAM type: YTN; PAM sequence: TTT
ccttaatttctcttcaagct

SEQ ID NO: 265376 - DNA, 20 bp, Artificial Sequence
  Description of Artificial Sequence: Synthetic oligonucleotide
  Target: ATXN1; (+) strand; PAM type: YTN; PAM sequence: TTC
cttaatttctcttcaagcta

SEQ ID NO: 265377 - DNA, 20 bp, Artificial Sequence
  Description of Artificial Sequence: Synthetic oligonucleotide
  Target: ATXN1; (+) strand; PAM type: YTN; PAM sequence: CTT
aatttctcttcaagctatta

SEQ ID NO: 265378 - DNA, 20 bp, Artificial Sequence
  Description of Artificial Sequence: Synthetic oligonucleotide
  Target: ATXN1; (+) strand; PAM type: YTN; PAM sequence: TTA
atttctcttcaagctattac

SEQ ID NO: 265379 - DNA, 20 bp, Artificial Sequence
  Description of Artificial Sequence: Synthetic oligonucleotide
  Target: ATXN1; (+) strand; PAM type: YTN; PAM sequence: TTT
ctcttcaagctattacagag

SEQ ID NO: 265380 - DNA, 20 bp, Artificial Sequence
  Description of Artificial Sequence: Synthetic oligonucleotide
  Target: ATXN1; (+) strand; PAM type: YTN; PAM sequence: TTC
tcttcaagctattacagaga

SEQ ID NO: 265381 - DNA, 20 bp, Artificial Sequence
  Description of Artificial Sequence: Synthetic oligonucleotide
  Target: ATXN1; (+) strand; PAM type: YTN; PAM sequence: CTC
ttcaagctattacagagaat

SEQ ID NO: 265382 - DNA, 20 bp, Artificial Sequence
  Description of Artificial Sequence: Synthetic oligonucleotide
  Target: ATXN1; (+) strand; PAM type: YTN; PAM sequence: CTT
caagctattacagagaatcc

SEQ ID NO: 265383 - DNA, 20 bp, Artificial Sequence
  Description of Artificial Sequence: Synthetic oligonucleotide
  Target: ATXN1; (+) strand; PAM type: YTN; PAM sequence: TTC
aagctattacagagaatcca

SEQ ID NO: 265384 - DNA, 20 bp, Artificial Sequence
  Description of Artificial Sequence: Synthetic oligonucleotide
  Target: ATXN1; (+) strand; PAM type: YTN; PAM sequence: CTA
ttacagagaatccatgtaaa

SEQ ID NO: 265385 - DNA, 20 bp, Artificial Sequence
  Description of Artificial Sequence: Synthetic oligonucleotide
  Target: ATXN1; (+) strand; PAM type: YTN; PAM sequence: TTA
cagagaatccatgtaaaaga

SEQ ID NO: 265386 - DNA, 20 bp, Artificial Sequence
  Description of Artificial Sequence: Synthetic oligonucleotide
  Target: ATXN1; (+) strand; PAM type: YTN; PAM sequence: CTA
atgttttcaatgaaaggatt

SEQ ID NO: 265387 - DNA, 20 bp, Artificial Sequence
  Description of Artificial Sequence: Synthetic oligonucleotide
  Target: ATXN1; (+) strand; PAM type: YTN; PAM sequence: TTT
tcaatgaaaggattaatgtt

SEQ ID NO: 265388 - DNA, 20 bp, Artificial Sequence
  Description of Artificial Sequence: Synthetic oligonucleotide
  Target: ATXN1; (+) strand; PAM type: YTN; PAM sequence: TTT
caatgaaaggattaatgttc

SEQ ID NO: 265389 - DNA, 20 bp, Artificial Sequence
  Description of Artificial Sequence: Synthetic oligonucleotide
  Target: ATXN1; (+) strand; PAM type: YTN; PAM sequence: TTC
aatgaaaggattaatgttct

SEQ ID NO: 265390 - DNA, 20 bp, Artificial Sequence
  Description of Artificial Sequence: Synthetic oligonucleotide
  Target: ATXN1; (+) strand; PAM type: YTN; PAM sequence: TTA
atgttctttccatctcataa

SEQ ID NO: 265391 - DNA, 20 bp, Artificial Sequence
  Description of Artificial Sequence: Synthetic oligonucleotide
  Target: ATXN1; (+) strand; PAM type: YTN; PAM sequence: TTC
tttccatctcataactcaag

SEQ ID NO: 265392 - DNA, 20 bp, Artificial Sequence
  Description of Artificial Sequence: Synthetic oligonucleotide
  Target: ATXN1; (+) strand; PAM type: YTN; PAM sequence: CTT
tccatctcataactcaagtt

SEQ ID NO: 265393 - DNA, 20 bp, Artificial Sequence
  Description of Artificial Sequence: Synthetic oligonucleotide
  Target: ATXN1; (+) strand; PAM type: YTN; PAM sequence: TTT
ccatctcataactcaagttt

SEQ ID NO: 265394 - DNA, 20 bp, Artificial Sequence
  Description of Artificial Sequence: Synthetic oligonucleotide
  Target: ATXN1; (+) strand; PAM type: YTN; PAM sequence: TTC
catctcataactcaagtttc

SEQ ID NO: 265395 - DNA, 20 bp, Artificial Sequence
  Description of Artificial Sequence: Synthetic oligonucleotide
  Target: ATXN1; (+) strand; PAM type: YTN; PAM sequence: CTC
ataactcaagtttccaataa

SEQ ID NO: 265396 - DNA, 20 bp, Artificial Sequence
  Description of Artificial Sequence: Synthetic oligonucleotide
  Target: ATXN1; (+) strand; PAM type: YTN; PAM sequence: CTC
aagtttccaataacgtcttc

SEQ ID NO: 265397 - DNA, 20 bp, Artificial Sequence
  Description of Artificial Sequence: Synthetic oligonucleotide
  Target: ATXN1; (+) strand; PAM type: YTN; PAM sequence: TTT
ccaataacgtcttcctcgct

SEQ ID NO: 265398 - DNA, 20 bp, Artificial Sequence
  Description of Artificial Sequence: Synthetic oligonucleotide
  Target: ATXN1; (+) strand; PAM type: YTN; PAM sequence: TTC
caataacgtcttcctcgctg

SEQ ID NO: 265399 - DNA, 20 bp, Artificial Sequence
  Description of Artificial Sequence: Synthetic oligonucleotide
  Target: ATXN1; (+) strand; PAM type: YTN; PAM sequence: CTT
cctcgctgagggtagaatag

SEQ ID NO: 265400 - DNA, 20 bp, Artificial Sequence
  Description of Artificial Sequence: Synthetic oligonucleotide
  Target: ATXN1; (+) strand; PAM type: YTN; PAM sequence: TTC
ctcgctgagggtagaatagt

SEQ ID NO: 265401 - DNA, 20 bp, Artificial Sequence
  Description of Artificial Sequence: Synthetic oligonucleotide
  Target: ATXN1; (+) strand; PAM type: YTN; PAM sequence: CTC
gctgagggtagaatagtcag

SEQ ID NO: 265402 - DNA, 20 bp, Artificial Sequence
  Description of Artificial Sequence: Synthetic oligonucleotide
  Target: ATXN1; (+) strand; PAM type: YTN; PAM sequence: CTG
agggtagaatagtcagtgcc

SEQ ID NO: 265403 - DNA, 20 bp, Artificial Sequence
  Description of Artificial Sequence: Synthetic oligonucleotide
  Target: ATXN1; (+) strand; PAM type: YTN; PAM sequence: CTT
acacaaaagccagtgtttgc

SEQ ID NO: 265404 - DNA, 20 bp, Artificial Sequence
  Description of Artificial Sequence: Synthetic oligonucleotide
  Target: ATXN1; (+) strand; PAM type: YTN; PAM sequence: TTA
cacaaaagccagtgtttgca

SEQ ID NO: 265405 - DNA, 20 bp, Artificial Sequence
  Description of Artificial Sequence: Synthetic oligonucleotide
  Target: ATXN1; (+) strand; PAM type: YTN; PAM sequence: TTT
gcattaaatgactgtggtgc

SEQ ID NO: 265406 - DNA, 20 bp, Artificial Sequence
  Description of Artificial Sequence: Synthetic oligonucleotide
  Target: ATXN1; (+) strand; PAM type: YTN; PAM sequence: TTG
cattaaatgactgtggtgca

SEQ ID NO: 265407 - DNA, 20 bp, Artificial Sequence
  Description of Artificial Sequence: Synthetic oligonucleotide
  Target: ATXN1; (+) strand; PAM type: YTN; PAM sequence: TTA
aatgactgtggtgcagcctc

SEQ ID NO: 265408 - DNA, 20 bp, Artificial Sequence
  Description of Artificial Sequence: Synthetic oligonucleotide
  Target: ATXN1; (+) strand; PAM type: YTN; PAM sequence: CTG
tggtgcagcctcgcataaca

SEQ ID NO: 265409 - DNA, 20 bp, Artificial Sequence
  Description of Artificial Sequence: Synthetic oligonucleotide
  Target: ATXN1; (+) strand; PAM type: YTN; PAM sequence: CTC
gcataacataaatgacttca

SEQ ID NO: 265410 - DNA, 20 bp, Artificial Sequence
  Description of Artificial Sequence: Synthetic oligonucleotide
  Target: ATXN1; (+) strand; PAM type: YTN; PAM sequence: CTT
caacagccacatcctgatgc

SEQ ID NO: 265411 - DNA, 20 bp, Artificial Sequence
  Description of Artificial Sequence: Synthetic oligonucleotide
  Target: ATXN1; (+) strand; PAM type: YTN; PAM sequence: TTC
aacagccacatcctgatgca

SEQ ID NO: 265412 - DNA, 20 bp, Artificial Sequence
  Description of Artificial Sequence: Synthetic oligonucleotide
  Target: ATXN1; (+) strand; PAM type: YTN; PAM sequence: CTG
atgcacaagggaaaacaaag

SEQ ID NO: 265413 - DNA, 20 bp, Artificial Sequence
  Description of Artificial Sequence: Synthetic oligonucleotide
  Target: ATXN1; (+) strand; PAM type: YTN; PAM sequence: TTT
caaaaagctaaagtcacaaa

SEQ ID NO: 265414 - DNA, 20 bp, Artificial Sequence
  Description of Artificial Sequence: Synthetic oligonucleotide
  Target: ATXN1; (+) strand; PAM type: YTN; PAM sequence: TTC
aaaaagctaaagtcacaaaa

SEQ ID NO: 265415 - DNA, 20 bp, Artificial Sequence
  Description of Artificial Sequence: Synthetic oligonucleotide
  Target: ATXN1; (+) strand; PAM type: YTN; PAM sequence: CTA
aagtcacaaaaagtaatgga

SEQ ID NO: 265416 - DNA, 20 bp, Artificial Sequence
  Description of Artificial Sequence: Synthetic oligonucleotide
  Target: ATXN1; (+) strand; PAM type: YTN; PAM sequence: CTG
ggcggggagacagaccccca

SEQ ID NO: 265417 - DNA, 20 bp, Artificial Sequence
  Description of Artificial Sequence: Synthetic oligonucleotide
  Target: ATXN1; (+) strand; PAM type: YTN; PAM sequence: CTT
gttttcttgactctggaggc

SEQ ID NO: 265418 - DNA, 20 bp, Artificial Sequence
  Description of Artificial Sequence: Synthetic oligonucleotide
  Target: ATXN1; (+) strand; PAM type: YTN; PAM sequence: TTG
ttttcttgactctggaggcg

SEQ ID NO: 265419 - DNA, 20 bp, Artificial Sequence
  Description of Artificial Sequence: Synthetic oligonucleotide
  Target: ATXN1; (+) strand; PAM type: YTN; PAM sequence: TTT
tcttgactctggaggcgctt

SEQ ID NO: 265420 - DNA, 20 bp, Artificial Sequence
  Description of Artificial Sequence: Synthetic oligonucleotide
  Target: ATXN1; (+) strand; PAM type: YTN; PAM sequence: TTT
cttgactctggaggcgcttt

SEQ ID NO: 265421 - DNA, 20 bp, Artificial Sequence
  Description of Artificial Sequence: Synthetic oligonucleotide
  Target: ATXN1; (+) strand; PAM type: YTN; PAM sequence: TTC
ttgactctggaggcgctttc

SEQ ID NO: 265422 - DNA, 20 bp, Artificial Sequence
  Description of Artificial Sequence: Synthetic oligonucleotide
  Target: ATXN1; (+) strand; PAM type: YTN; PAM sequence: CTT
gactctggaggcgctttctt

SEQ ID NO: 265423 - DNA, 20 bp, Artificial Sequence
  Description of Artificial Sequence: Synthetic oligonucleotide
  Target: ATXN1; (+) strand; PAM type: YTN; PAM sequence: TTG
actctggaggcgctttcttg

SEQ ID NO: 265424 - DNA, 20 bp, Artificial Sequence
  Description of Artificial Sequence: Synthetic oligonucleotide
  Target: ATXN1; (+) strand; PAM type: YTN; PAM sequence: CTC
tggaggcgctttcttgatta

SEQ ID NO: 265425 - DNA, 20 bp, Artificial Sequence
  Description of Artificial Sequence: Synthetic oligonucleotide
  Target: ATXN1; (+) strand; PAM type: YTN; PAM sequence: CTG
gaggcgctttcttgattagt

SEQ ID NO: 265426 - DNA, 20 bp, Artificial Sequence
  Description of Artificial Sequence: Synthetic oligonucleotide
  Target: ATXN1; (+) strand; PAM type: YTN; PAM sequence: CTT
tcttgattagtctatttaaa

SEQ ID NO: 265427 - DNA, 20 bp, Artificial Sequence
  Description of Artificial Sequence: Synthetic oligonucleotide
  Target: ATXN1; (+) strand; PAM type: YTN; PAM sequence: TTT
cttgattagtctatttaaaa

SEQ ID NO: 265428 - DNA, 20 bp, Artificial Sequence
  Description of Artificial Sequence: Synthetic oligonucleotide
  Target: ATXN1; (+) strand; PAM type: YTN; PAM sequence: TTC
ttgattagtctatttaaaaa

SEQ ID NO: 265429 - DNA, 20 bp, Artificial Sequence
  Description of Artificial Sequence: Synthetic oligonucleotide
  Target: ATXN1; (+) strand; PAM type: YTN; PAM sequence: CTT
gattagtctatttaaaaaaa

SEQ ID NO: 265430 - DNA, 20 bp, Artificial Sequence
  Description of Artificial Sequence: Synthetic oligonucleotide
  Target: ATXN1; (+) strand; PAM type: YTN; PAM sequence: TTG
attagtctatttaaaaaaat

SEQ ID NO: 265431 - DNA, 20 bp, Artificial Sequence
  Description of Artificial Sequence: Synthetic oligonucleotide
  Target: ATXN1; (+) strand; PAM type: YTN; PAM sequence: TTA
gtctatttaaaaaaatgtta

SEQ ID NO: 265432 - DNA, 20 bp, Artificial Sequence
  Description of Artificial Sequence: Synthetic oligonucleotide
  Target: ATXN1; (+) strand; PAM type: YTN; PAM sequence: CTA
tttaaaaaaatgttattgtt

SEQ ID NO: 265433 - DNA, 20 bp, Artificial Sequence
  Description of Artificial Sequence: Synthetic oligonucleotide
  Target: ATXN1; (+) strand; PAM type: YTN; PAM sequence: TTT
aaaaaaatgttattgtttta

SEQ ID NO: 265434 - DNA, 20 bp, Artificial Sequence
  Description of Artificial Sequence: Synthetic oligonucleotide
  Target: ATXN1; (+) strand; PAM type: YTN; PAM sequence: TTA
aaaaaatgttattgttttaa

SEQ ID NO: 265435 - DNA, 20 bp, Artificial Sequence
  Description of Artificial Sequence: Synthetic oligonucleotide
  Target: ATXN1; (+) strand; PAM type: YTN; PAM sequence: TTA
ttgttttaaaaattgtagct

SEQ ID NO: 265436 - DNA, 20 bp, Artificial Sequence
  Description of Artificial Sequence: Synthetic oligonucleotide
  Target: ATXN1; (+) strand; PAM type: YTN; PAM sequence: TTG
ttttaaaaattgtagctaaa

SEQ ID NO: 265437 - DNA, 20 bp, Artificial Sequence
  Description of Artificial Sequence: Synthetic oligonucleotide
  Target: ATXN1; (+) strand; PAM type: YTN; PAM sequence: TTT
taaaaattgtagctaaaaat

SEQ ID NO: 265438 - DNA, 20 bp, Artificial Sequence
  Description of Artificial Sequence: Synthetic oligonucleotide
  Target: ATXN1; (+) strand; PAM type: YTN; PAM sequence: TTT
aaaaattgtagctaaaaata

SEQ ID NO: 265439 - DNA, 20 bp, Artificial Sequence
  Description of Artificial Sequence: Synthetic oligonucleotide
  Target: ATXN1; (+) strand; PAM type: YTN; PAM sequence: TTA
aaaattgtagctaaaaataa

SEQ ID NO: 265440 - DNA, 20 bp, Artificial Sequence
  Description of Artificial Sequence: Synthetic oligonucleotide
  Target: ATXN1; (+) strand; PAM type: YTN; PAM sequence: TTG
tagctaaaaataacatcaaa

SEQ ID NO: 265441 - DNA, 20 bp, Artificial Sequence
  Description of Artificial Sequence: Synthetic oligonucleotide
  Target: ATXN1; (+) strand; PAM type: YTN; PAM sequence: CTA
aaaataacatcaaaatgcac

SEQ ID NO: 265442 - DNA, 20 bp, Artificial Sequence
  Description of Artificial Sequence: Synthetic oligonucleotide
  Target: ATXN1; (+) strand; PAM type: YTN; PAM sequence: TTA
tgtatgaagaggatgcagcg

SEQ ID NO: 265443 - DNA, 20 bp, Artificial Sequence
  Description of Artificial Sequence: Synthetic oligonucleotide
  Target: ATXN1; (+) strand; PAM type: YTN; PAM sequence: TTA
gcatgaagcgtggttattct

SEQ ID NO: 265444 - DNA, 20 bp, Artificial Sequence
  Description of Artificial Sequence: Synthetic oligonucleotide
  Target: ATXN1; (+) strand; PAM type: YTN; PAM sequence: TTA
ttctatcacggagatatgct

SEQ ID NO: 265445 - DNA, 20 bp, Artificial Sequence
  Description of Artificial Sequence: Synthetic oligonucleotide
  Target: ATXN1; (+) strand; PAM type: YTN; PAM sequence: TTC
tatcacggagatatgctcct

SEQ ID NO: 265446 - DNA, 20 bp, Artificial Sequence
  Description of Artificial Sequence: Synthetic oligonucleotide
  Target: ATXN1; (+) strand; PAM type: YTN; PAM sequence: CTA
tcacggagatatgctcctca

SEQ ID NO: 265447 - DNA, 20 bp, Artificial Sequence
  Description of Artificial Sequence: Synthetic oligonucleotide
  Target: ATXN1; (+) strand; PAM type: YTN; PAM sequence: CTC
ctcatccacaaaccagaggg

SEQ ID NO: 265448 - DNA, 20 bp, Artificial Sequence
  Description of Artificial Sequence: Synthetic oligonucleotide
  Target: ATXN1; (+) strand; PAM type: YTN; PAM sequence: CTC
atccacaaaccagagggacg

SEQ ID NO: 265449 - DNA, 20 bp, Artificial Sequence
  Description of Artificial Sequence: Synthetic oligonucleotide
  Target: ATXN1; (+) strand; PAM type: YTN; PAM sequence: TTT
tactgtttggttttatttgt

SEQ ID NO: 265450 - DNA, 20 bp, Artificial Sequence
  Description of Artificial Sequence: Synthetic oligonucleotide
  Target: ATXN1; (+) strand; PAM type: YTN; PAM sequence: TTT
actgtttggttttatttgtc

SEQ ID NO: 265451 - DNA, 20 bp, Artificial Sequence
  Description of Artificial Sequence: Synthetic oligonucleotide
  Target: ATXN1; (+) strand; PAM type: YTN; PAM sequence: TTA
ctgtttggttttatttgtca

SEQ ID NO: 265452 - DNA, 20 bp, Artificial Sequence
  Description of Artificial Sequence: Synthetic oligonucleotide
  Target: ATXN1; (+) strand; PAM type: YTN; PAM sequence: CTG
tttggttttatttgtcaaaa

SEQ ID NO: 265453 - DNA, 20 bp, Artificial Sequence
  Description of Artificial Sequence: Synthetic oligonucleotide
  Target: ATXN1; (+) strand; PAM type: YTN; PAM sequence: TTT
ggttttatttgtcaaaacta

SEQ ID NO: 265454 - DNA, 20 bp, Artificial Sequence
  Description of Artificial Sequence: Synthetic oligonucleotide
  Target: ATXN1; (+) strand; PAM type: YTN; PAM sequence: TTG
gttttatttgtcaaaactac

SEQ ID NO: 265455 - DNA, 20 bp, Artificial Sequence
  Description of Artificial Sequence: Synthetic oligonucleotide
  Target: ATXN1; (+) strand; PAM type: YTN; PAM sequence: TTT
tatttgtcaaaactactgct

SEQ ID NO: 265456 - DNA, 20 bp, Artificial Sequence
  Description of Artificial Sequence: Synthetic oligonucleotide
  Target: ATXN1; (+) strand; PAM type: YTN; PAM sequence: TTT
atttgtcaaaactactgctt

SEQ ID NO: 265457 - DNA, 20 bp, Artificial Sequence
  Description of Artificial Sequence: Synthetic oligonucleotide
  Target: ATXN1; (+) strand; PAM type: YTN; PAM sequence: TTA
tttgtcaaaactactgcttt

SEQ ID NO: 265458 - DNA, 20 bp, Artificial Sequence
  Description of Artificial Sequence: Synthetic oligonucleotide
  Target: ATXN1; (+) strand; PAM type: YTN; PAM sequence: TTT
gtcaaaactactgctttaca

SEQ ID NO: 265459 - DNA, 20 bp, Artificial Sequence
  Description of Artificial Sequence: Synthetic oligonucleotide
  Target: ATXN1; (+) strand; PAM type: YTN; PAM sequence: TTG
tcaaaactactgctttacat

SEQ ID NO: 265460 - DNA, 20 bp, Artificial Sequence
  Description of Artificial Sequence: Synthetic oligonucleotide
  Target: ATXN1; (+) strand; PAM type: YTN; PAM sequence: CTA
ctgctttacatgcagaggag

SEQ ID NO: 265461 - DNA, 20 bp, Artificial Sequence
  Description of Artificial Sequence: Synthetic oligonucleotide
  Target: ATXN1; (+) strand; PAM type: YTN; PAM sequence: CTG
ctttacatgcagaggaggga

SEQ ID NO: 265462 - DNA, 20 bp, Artificial Sequence
  Description of Artificial Sequence: Synthetic oligonucleotide
  Target: ATXN1; (+) strand; PAM type: YTN; PAM sequence: CTT
tacatgcagaggagggagga

SEQ ID NO: 265463 - DNA, 20 bp, Artificial Sequence
  Description of Artificial Sequence: Synthetic oligonucleotide
  Target: ATXN1; (+) strand; PAM type: YTN; PAM sequence: TTT
acatgcagaggagggaggag

SEQ ID NO: 265464 - DNA, 20 bp, Artificial Sequence
  Description of Artificial Sequence: Synthetic oligonucleotide
  Target: ATXN1; (+) strand; PAM type: YTN; PAM sequence: TTA
catgcagaggagggaggagt

SEQ ID NO: 265465 - DNA, 20 bp, Artificial Sequence
  Description of Artificial Sequence: Synthetic oligonucleotide
  Target: ATXN1; (+) strand; PAM type: YTN; PAM sequence: TTT
cttcgggtgggggatggagg

SEQ ID NO: 265466 - DNA, 20 bp, Artificial Sequence
  Description of Artificial Sequence: Synthetic oligonucleotide
  Target: ATXN1; (+) strand; PAM type: YTN; PAM sequence: TTC
ttcgggtgggggatggaggg

SEQ ID NO: 265467 - DNA, 20 bp, Artificial Sequence
  Description of Artificial Sequence: Synthetic oligonucleotide
  Target: ATXN1; (+) strand; PAM type: YTN; PAM sequence: CTT
cgggtgggggatggagggag

SEQ ID NO: 265468 - DNA, 20 bp, Artificial Sequence
  Description of Artificial Sequence: Synthetic oligonucleotide
  Target: ATXN1; (+) strand; PAM type: YTN; PAM sequence: TTC
gggtgggggatggagggagc

SEQ ID NO: 265469 - DNA, 20 bp, Artificial Sequence
  Description of Artificial Sequence: Synthetic oligonucleotide
  Target: ATXN1; (+) strand; PAM type: YTN; PAM sequence: TTA
tagaagaacacgcatcccag

SEQ ID NO: 265470 - DNA, 20 bp, Artificial Sequence
  Description of Artificial Sequence: Synthetic oligonucleotide
  Target: ATXN1; (+) strand; PAM type: YTN; PAM sequence: TTT
ttaaagactctatctaccat

SEQ ID NO: 265471 - DNA, 20 bp, Artificial Sequence
  Description of Artificial Sequence: Synthetic oligonucleotide
  Target: ATXN1; (+) strand; PAM type: YTN; PAM sequence: TTT
taaagactctatctaccatc

SEQ ID NO: 265472 - DNA, 20 bp, Artificial Sequence
  Description of Artificial Sequence: Synthetic oligonucleotide
  Target: ATXN1; (+) strand; PAM type: YTN; PAM sequence: TTT
aaagactctatctaccatct

SEQ ID NO: 265473 - DNA, 20 bp, Artificial Sequence
  Description of Artificial Sequence: Synthetic oligonucleotide
  Target: ATXN1; (+) strand; PAM type: YTN; PAM sequence: TTA
aagactctatctaccatctt

SEQ ID NO: 265474 - DNA, 20 bp, Artificial Sequence
  Description of Artificial Sequence: Synthetic oligonucleotide
  Target: ATXN1; (+) strand; PAM type: YTN; PAM sequence: CTC
tatctaccatcttttctgaa

SEQ ID NO: 265475 - DNA, 20 bp, Artificial Sequence
  Description of Artificial Sequence: Synthetic oligonucleotide
  Target: ATXN1; (+) strand; PAM type: YTN; PAM sequence: CTA
tctaccatcttttctgaact

SEQ ID NO: 265476 - DNA, 20 bp, Artificial Sequence
  Description of Artificial Sequence: Synthetic oligonucleotide
  Target: ATXN1; (+) strand; PAM type: YTN; PAM sequence: CTA
ccatcttttctgaactaaca

SEQ ID NO: 265477 - DNA, 20 bp, Artificial Sequence
  Description of Artificial Sequence: Synthetic oligonucleotide
  Target: ATXN1; (+) strand; PAM type: YTN; PAM sequence: CTT
ttctgaactaacaatttcac

SEQ ID NO: 265478 - DNA, 20 bp, Artificial Sequence
  Description of Artificial Sequence: Synthetic oligonucleotide
  Target: ATXN1; (+) strand; PAM type: YTN; PAM sequence: TTT
tctgaactaacaatttcacc

SEQ ID NO: 265479 - DNA, 20 bp, Artificial Sequence
  Description of Artificial Sequence: Synthetic oligonucleotide
  Target: ATXN1; (+) strand; PAM type: YTN; PAM sequence: TTT
ctgaactaacaatttcacct

SEQ ID NO: 265480 - DNA, 20 bp, Artificial Sequence
  Description of Artificial Sequence: Synthetic oligonucleotide
  Target: ATXN1; (+) strand; PAM type: YTN; PAM sequence: TTC
tgaactaacaatttcacctt

SEQ ID NO: 265481 - DNA, 20 bp, Artificial Sequence
  Description of Artificial Sequence: Synthetic oligonucleotide
  Target: ATXN1; (+) strand; PAM type: YTN; PAM sequence: CTG
aactaacaatttcaccttga

SEQ ID NO: 265482 - DNA, 20 bp, Artificial Sequence
  Description of Artificial Sequence: Synthetic oligonucleotide
  Target: ATXN1; (+) strand; PAM type: YTN; PAM sequence: CTA
acaatttcaccttgaaatct

SEQ ID NO: 265483 - DNA, 20 bp, Artificial Sequence
  Description of Artificial Sequence: Synthetic oligonucleotide
  Target: ATXN1; (+) strand; PAM type: YTN; PAM sequence: TTT
caccttgaaatctgttacaa

SEQ ID NO: 265484 - DNA, 20 bp, Artificial Sequence
  Description of Artificial Sequence: Synthetic oligonucleotide
  Target: ATXN1; (+) strand; PAM type: YTN; PAM sequence: TTC
accttgaaatctgttacaat

SEQ ID NO: 265485 - DNA, 20 bp, Artificial Sequence
  Description of Artificial Sequence: Synthetic oligonucleotide
  Target: ATXN1; (+) strand; PAM type: YTN; PAM sequence: CTT
gaaatctgttacaataagta

SEQ ID NO: 265486 - DNA, 20 bp, Artificial Sequence
  Description of Artificial Sequence: Synthetic oligonucleotide
  Target: ATXN1; (+) strand; PAM type: YTN; PAM sequence: TTG
aaatctgttacaataagtac

SEQ ID NO: 265487 - DNA, 20 bp, Artificial Sequence
  Description of Artificial Sequence: Synthetic oligonucleotide
  Target: ATXN1; (+) strand; PAM type: YTN; PAM sequence: CTG
ttacaataagtacctttaat

SEQ ID NO: 265488 - DNA, 20 bp, Artificial Sequence
  Description of Artificial Sequence: Synthetic oligonucleotide
  Target: ATXN1; (+) strand; PAM type: YTN; PAM sequence: TTA
caataagtacctttaatcaa

SEQ ID NO: 265489 - DNA, 20 bp, Artificial Sequence
  Description of Artificial Sequence: Synthetic oligonucleotide
  Target: ATXN1; (+) strand; PAM type: YTN; PAM sequence: CTT
taatcaaaagccatttgttt

SEQ ID NO: 265490 - DNA, 20 bp, Artificial Sequence
  Description of Artificial Sequence: Synthetic oligonucleotide
  Target: ATXN1; (+) strand; PAM type: YTN; PAM sequence: TTT
aatcaaaagccatttgtttt

SEQ ID NO: 265491 - DNA, 20 bp, Artificial Sequence
  Description of Artificial Sequence: Synthetic oligonucleotide
  Target: ATXN1; (+) strand; PAM type: YTN; PAM sequence: TTA
atcaaaagccatttgttttc

SEQ ID NO: 265492 - DNA, 20 bp, Artificial Sequence
  Description of Artificial Sequence: Synthetic oligonucleotide
  Target: ATXN1; (+) strand; PAM type: YTN; PAM sequence: TTT
gttttccattcttttctatg

SEQ ID NO: 265493 - DNA, 20 bp, Artificial Sequence
  Description of Artificial Sequence: Synthetic oligonucleotide
  Target: ATXN1; (+) strand; PAM type: YTN; PAM sequence: TTG
ttttccattcttttctatgg

SEQ ID NO: 265494 - DNA, 20 bp, Artificial Sequence
  Description of Artificial Sequence: Synthetic oligonucleotide
  Target: ATXN1; (+) strand; PAM type: YTN; PAM sequence: TTT
tccattcttttctatgggca

SEQ ID NO: 265495 - DNA, 20 bp, Artificial Sequence
  Description of Artificial Sequence: Synthetic oligonucleotide
  Target: ATXN1; (+) strand; PAM type: YTN; PAM sequence: TTT
ccattcttttctatgggcat

SEQ ID NO: 265496 - DNA, 20 bp, Artificial Sequence
  Description of Artificial Sequence: Synthetic oligonucleotide
  Target: ATXN1; (+) strand; PAM type: YTN; PAM sequence: TTC
cattcttttctatgggcata

SEQ ID NO: 265497 - DNA, 20 bp, Artificial Sequence
  Description of Artificial Sequence: Synthetic oligonucleotide
  Target: ATXN1; (+) strand; PAM type: YTN; PAM sequence: TTC
ttttctatgggcatacattc

SEQ ID NO: 265498 - DNA, 20 bp, Artificial Sequence
  Description of Artificial Sequence: Synthetic oligonucleotide
  Target: ATXN1; (+) strand; PAM type: YTN; PAM sequence: CTT
ttctatgggcatacattcac

SEQ ID NO: 265499 - DNA, 20 bp, Artificial Sequence
  Description of Artificial Sequence: Synthetic oligonucleotide
  Target: ATXN1; (+) strand; PAM type: YTN; PAM sequence: TTT
tctatgggcatacattcact

SEQ ID NO: 265500 - DNA, 20 bp, Artificial Sequence
  Description of Artificial Sequence: Synthetic oligonucleotide
  Target: ATXN1; (+) strand; PAM type: YTN; PAM sequence: TTT
ctatgggcatacattcacta

SEQ ID NO: 265501 - DNA, 20 bp, Artificial Sequence
  Description of Artificial Sequence: Synthetic oligonucleotide
  Target: ATXN1; (+) strand; PAM type: YTN; PAM sequence: TTC
tatgggcatacattcactat

SEQ ID NO: 265502 - DNA, 20 bp, Artificial Sequence
  Description of Artificial Sequence: Synthetic oligonucleotide
  Target: ATXN1; (+) strand; PAM type: YTN; PAM sequence: CTA
tgggcatacattcactatag

SEQ ID NO: 265503 - DNA, 20 bp, Artificial Sequence
  Description of Artificial Sequence: Synthetic oligonucleotide
  Target: ATXN1; (+) strand; PAM type: YTN; PAM sequence: TTC
actatagctatttactgtag

SEQ ID NO: 265504 - DNA, 20 bp, Artificial Sequence
  Description of Artificial Sequence: Synthetic oligonucleotide
  Target: ATXN1; (+) strand; PAM type: YTN; PAM sequence: CTA
tagctatttactgtagttca

SEQ ID NO: 265505 - DNA, 20 bp, Artificial Sequence
  Description of Artificial Sequence: Synthetic oligonucleotide
  Target: ATXN1; (+) strand; PAM type: YTN; PAM sequence: CTA
tttactgtagttcattattt

SEQ ID NO: 265506 - DNA, 20 bp, Artificial Sequence
  Description of Artificial Sequence: Synthetic oligonucleotide
  Target: ATXN1; (+) strand; PAM type: YTN; PAM sequence: TTT
actgtagttcattatttcag

SEQ ID NO: 265507 - DNA, 20 bp, Artificial Sequence
  Description of Artificial Sequence: Synthetic oligonucleotide
  Target: ATXN1; (+) strand; PAM type: YTN; PAM sequence: TTA
ctgtagttcattatttcagc

SEQ ID NO: 265508 - DNA, 20 bp, Artificial Sequence
  Description of Artificial Sequence: Synthetic oligonucleotide
  Target: ATXN1; (+) strand; PAM type: YTN; PAM sequence: CTG
tagttcattatttcagcata

SEQ ID NO: 265509 - DNA, 20 bp, Artificial Sequence
  Description of Artificial Sequence: Synthetic oligonucleotide
  Target: ATXN1; (+) strand; PAM type: YTN; PAM sequence: TTC
attatttcagcatattgcaa

SEQ ID NO: 265510 - DNA, 20 bp, Artificial Sequence
  Description of Artificial Sequence: Synthetic oligonucleotide
  Target: ATXN1; (+) strand; PAM type: YTN; PAM sequence: TTA
tttcagcatattgcaattat

SEQ ID NO: 265511 - DNA, 20 bp, Artificial Sequence
  Description of Artificial Sequence: Synthetic oligonucleotide
  Target: ATXN1; (+) strand; PAM type: YTN; PAM sequence: TTT
cagcatattgcaattatcat

SEQ ID NO: 265512 - DNA, 20 bp, Artificial Sequence
  Description of Artificial Sequence: Synthetic oligonucleotide
  Target: ATXN1; (+) strand; PAM type: YTN; PAM sequence: TTC
agcatattgcaattatcatt

SEQ ID NO: 265513 - DNA, 20 bp, Artificial Sequence
  Description of Artificial Sequence: Synthetic oligonucleotide
  Target: ATXN1; (+) strand; PAM type: YTN; PAM sequence: TTG
caattatcattgttgtagcc

SEQ ID NO: 265514 - DNA, 20 bp, Artificial Sequence
  Description of Artificial Sequence: Synthetic oligonucleotide
  Target: ATXN1; (+) strand; PAM type: YTN; PAM sequence: TTA
tcattgttgtagccttcaat

SEQ ID NO: 265515 - DNA, 20 bp, Artificial Sequence
  Description of Artificial Sequence: Synthetic oligonucleotide
  Target: ATXN1; (+) strand; PAM type: YTN; PAM sequence: TTG
ttgtagccttcaatcctatt

SEQ ID NO: 265516 - DNA, 20 bp, Artificial Sequence
  Description of Artificial Sequence: Synthetic oligonucleotide
  Target: ATXN1; (+) strand; PAM type: YTN; PAM sequence: TTG
tagccttcaatcctattgca

SEQ ID NO: 265517 - DNA, 20 bp, Artificial Sequence
  Description of Artificial Sequence: Synthetic oligonucleotide
  Target: ATXN1; (+) strand; PAM type: YTN; PAM sequence: CTT
caatcctattgcattaatgt

SEQ ID NO: 265518 - DNA, 20 bp, Artificial Sequence
  Description of Artificial Sequence: Synthetic oligonucleotide
  Target: ATXN1; (+) strand; PAM type: YTN; PAM sequence: TTC
aatcctattgcattaatgta

SEQ ID NO: 265519 - DNA, 20 bp, Artificial Sequence
  Description of Artificial Sequence: Synthetic oligonucleotide
  Target: ATXN1; (+) strand; PAM type: YTN; PAM sequence: CTA
ttgcattaatgtaggagtat

SEQ ID NO: 265520 - DNA, 20 bp, Artificial Sequence
  Description of Artificial Sequence: Synthetic oligonucleotide
  Target: ATXN1; (+) strand; PAM type: YTN; PAM sequence: TTG
cattaatgtaggagtatgaa

SEQ ID NO: 265521 - DNA, 20 bp, Artificial Sequence
  Description of Artificial Sequence: Synthetic oligonucleotide
  Target: ATXN1; (+) strand; PAM type: YTN; PAM sequence: TTA
atgtaggagtatgaaaaagt

SEQ ID NO: 265522 - DNA, 20 bp, Artificial Sequence
  Description of Artificial Sequence: Synthetic oligonucleotide
  Target: ATXN1; (+) strand; PAM type: YTN; PAM sequence: CTT
aaaacagttcattttaaact

SEQ ID NO: 265523 - DNA, 20 bp, Artificial Sequence
  Description of Artificial Sequence: Synthetic oligonucleotide
  Target: ATXN1; (+) strand; PAM type: YTN; PAM sequence: TTA
aaacagttcattttaaactg

SEQ ID NO: 265524 - DNA, 20 bp, Artificial Sequence
  Description of Artificial Sequence: Synthetic oligonucleotide
  Target: ATXN1; (+) strand; PAM type: YTN; PAM sequence: TTC
attttaaactgtattgcctg

SEQ ID NO: 265525 - DNA, 20 bp, Artificial Sequence
  Description of Artificial Sequence: Synthetic oligonucleotide
  Target: ATXN1; (+) strand; PAM type: YTN; PAM sequence: TTT
taaactgtattgcctgttaa

SEQ ID NO: 265526 - DNA, 20 bp, Artificial Sequence
  Description of Artificial Sequence: Synthetic oligonucleotide
  Target: ATXN1; (+) strand; PAM type: YTN; PAM sequence: TTT
aaactgtattgcctgttaac

SEQ ID NO: 265527 - DNA, 20 bp, Artificial Sequence
  Description of Artificial Sequence: Synthetic oligonucleotide
  Target: ATXN1; (+) strand; PAM type: YTN; PAM sequence: TTA
aactgtattgcctgttaaca

SEQ ID NO: 265528 - DNA, 20 bp, Artificial Sequence
  Description of Artificial Sequence: Synthetic oligonucleotide
  Target: ATXN1; (+) strand; PAM type: YTN; PAM sequence: CTG
tattgcctgttaacaaccct

SEQ ID NO: 265529 - DNA, 20 bp, Artificial Sequence
  Description of Artificial Sequence: Synthetic oligonucleotide
  Target: ATXN1; (+) strand; PAM type: YTN; PAM sequence: TTG
cctgttaacaaccctgtcca

SEQ ID NO: 265530 - DNA, 20 bp, Artificial Sequence
  Description of Artificial Sequence: Synthetic oligonucleotide
  Target: ATXN1; (+) strand; PAM type: YTN; PAM sequence: CTG
ttaacaaccctgtccaaaat

SEQ ID NO: 265531 - DNA, 20 bp, Artificial Sequence
  Description of Artificial Sequence: Synthetic oligonucleotide
  Target: ATXN1; (+) strand; PAM type: YTN; PAM sequence: TTA
acaaccctgtccaaaatttt

SEQ ID NO: 265532 - DNA, 20 bp, Artificial Sequence
  Description of Artificial Sequence: Synthetic oligonucleotide
  Target: ATXN1; (+) strand; PAM type: YTN; PAM sequence: CTG
tccaaaattttagtaggtaa

SEQ ID NO: 265533 - DNA, 20 bp, Artificial Sequence
  Description of Artificial Sequence: Synthetic oligonucleotide
  Target: ATXN1; (+) strand; PAM type: YTN; PAM sequence: TTT
tagtaggtaaaaaagctgaa

SEQ ID NO: 265534 - DNA, 20 bp, Artificial Sequence
  Description of Artificial Sequence: Synthetic oligonucleotide
  Target: ATXN1; (+) strand; PAM type: YTN; PAM sequence: TTT
agtaggtaaaaaagctgaac

SEQ ID NO: 265535 - DNA, 20 bp, Artificial Sequence
  Description of Artificial Sequence: Synthetic oligonucleotide
  Target: ATXN1; (+) strand; PAM type: YTN; PAM sequence: TTA
gtaggtaaaaaagctgaacc

SEQ ID NO: 265536 - DNA, 20 bp, Artificial Sequence
  Description of Artificial Sequence: Synthetic oligonucleotide
  Target: ATXN1; (+) strand; PAM type: YTN; PAM sequence: CTG
aaccactgcctacaagaaga

SEQ ID NO: 265537 - DNA, 20 bp, Artificial Sequence
  Description of Artificial Sequence: Synthetic oligonucleotide
  Target: ATXN1; (+) strand; PAM type: YTN; PAM sequence: CTG
cctacaagaagaccaaaaga

SEQ ID NO: 265538 - DNA, 20 bp, Artificial Sequence
  Description of Artificial Sequence: Synthetic oligonucleotide
  Target: ATXN1; (+) strand; PAM type: YTN; PAM sequence: CTA
caagaagaccaaaagattgt

SEQ ID NO: 265539 - DNA, 20 bp, Artificial Sequence
  Description of Artificial Sequence: Synthetic oligonucleotide
  Target: ATXN1; (+) strand; PAM type: YTN; PAM sequence: TTG
tctgaagattccatttagta

SEQ ID NO: 265540 - DNA, 20 bp, Artificial Sequence
  Description of Artificial Sequence: Synthetic oligonucleotide
  Target: ATXN1; (+) strand; PAM type: YTN; PAM sequence: CTG
aagattccatttagtacttg

SEQ ID NO: 265541 - DNA, 20 bp, Artificial Sequence
  Description of Artificial Sequence: Synthetic oligonucleotide
  Target: ATXN1; (+) strand; PAM type: YTN; PAM sequence: TTC
catttagtacttgtttcctg

SEQ ID NO: 265542 - DNA, 20 bp, Artificial Sequence
  Description of Artificial Sequence: Synthetic oligonucleotide
  Target: ATXN1; (+) strand; PAM type: YTN; PAM sequence: TTT
agtacttgtttcctgttctc

SEQ ID NO: 265543 - DNA, 20 bp, Artificial Sequence
  Description of Artificial Sequence: Synthetic oligonucleotide
  Target: ATXN1; (+) strand; PAM type: YTN; PAM sequence: TTA
gtacttgtttcctgttctct

SEQ ID NO: 265544 - DNA, 20 bp, Artificial Sequence
  Description of Artificial Sequence: Synthetic oligonucleotide
  Target: ATXN1; (+) strand; PAM type: YTN; PAM sequence: CTT
gtttcctgttctctgtaaaa

SEQ ID NO: 265545 - DNA, 20 bp, Artificial Sequence
  Description of Artificial Sequence: Synthetic oligonucleotide
  Target: ATXN1; (+) strand; PAM type: YTN; PAM sequence: TTG
tttcctgttctctgtaaaac

SEQ ID NO: 265546 - DNA, 20 bp, Artificial Sequence
  Description of Artificial Sequence: Synthetic oligonucleotide
  Target: ATXN1; (+) strand; PAM type: YTN; PAM sequence: TTT
cctgttctctgtaaaacacg

SEQ ID NO: 265547 - DNA, 20 bp, Artificial Sequence
  Description of Artificial Sequence: Synthetic oligonucleotide
  Target: ATXN1; (+) strand; PAM type: YTN; PAM sequence: TTC
ctgttctctgtaaaacacgg

SEQ ID NO: 265548 - DNA, 20 bp, Artificial Sequence
  Description of Artificial Sequence: Synthetic oligonucleotide
  Target: ATXN1; (+) strand; PAM type: YTN; PAM sequence: CTG
ttctctgtaaaacacggata

SEQ ID NO: 265549 - DNA, 20 bp, Artificial Sequence
  Description of Artificial Sequence: Synthetic oligonucleotide
  Target: ATXN1; (+) strand; PAM type: YTN; PAM sequence: TTC
tctgtaaaacacggatattc

SEQ ID NO: 265550 - DNA, 20 bp, Artificial Sequence
  Description of Artificial Sequence: Synthetic oligonucleotide
  Target: ATXN1; (+) strand; PAM type: YTN; PAM sequence: CTC
tgtaaaacacggatattctc

SEQ ID NO: 265551 - DNA, 20 bp, Artificial Sequence
  Description of Artificial Sequence: Synthetic oligonucleotide
  Target: ATXN1; (+) strand; PAM type: YTN; PAM sequence: CTG
taaaacacggatattctctt

SEQ ID NO: 265552 - DNA, 20 bp, Artificial Sequence
  Description of Artificial Sequence: Synthetic oligonucleotide
  Target: ATXN1; (+) strand; PAM type: YTN; PAM sequence: TTC
tcttggtaaagacattccat

SEQ ID NO: 265553 - DNA, 20 bp, Artificial Sequence
  Description of Artificial Sequence: Synthetic oligonucleotide
  Target: ATXN1; (+) strand; PAM type: YTN; PAM sequence: CTC
ttggtaaagacattccattt

SEQ ID NO: 265554 - DNA, 20 bp, Artificial Sequence
  Description of Artificial Sequence: Synthetic oligonucleotide
  Target: ATXN1; (+) strand; PAM type: YTN; PAM sequence: CTT
ggtaaagacattccatttct

SEQ ID NO: 265555 - DNA, 20 bp, Artificial Sequence
  Description of Artificial Sequence: Synthetic oligonucleotide
  Target: ATXN1; (+) strand; PAM type: YTN; PAM sequence: TTG
gtaaagacattccatttcta

SEQ ID NO: 265556 - DNA, 20 bp, Artificial Sequence
  Description of Artificial Sequence: Synthetic oligonucleotide
  Target: ATXN1; (+) strand; PAM type: YTN; PAM sequence: TTC
catttctatttctatctagt

SEQ ID NO: 265557 - DNA, 20 bp, Artificial Sequence
  Description of Artificial Sequence: Synthetic oligonucleotide
  Target: ATXN1; (+) strand; PAM type: YTN; PAM sequence: TTT
ctatttctatctagtgacca

SEQ ID NO: 265558 - DNA, 20 bp, Artificial Sequence
  Description of Artificial Sequence: Synthetic oligonucleotide
  Target: ATXN1; (+) strand; PAM type: YTN; PAM sequence: TTC
tatttctatctagtgaccat

SEQ ID NO: 265559 - DNA, 20 bp, Artificial Sequence
  Description of Artificial Sequence: Synthetic oligonucleotide
  Target: ATXN1; (+) strand; PAM type: YTN; PAM sequence: CTA
tttctatctagtgaccatcg

SEQ ID NO: 265560 - DNA, 20 bp, Artificial Sequence
  Description of Artificial Sequence: Synthetic oligonucleotide
  Target: ATXN1; (+) strand; PAM type: YTN; PAM sequence: TTT
ctatctagtgaccatcgaat

SEQ ID NO: 265561 - DNA, 20 bp, Artificial Sequence
  Description of Artificial Sequence: Synthetic oligonucleotide
  Target: ATXN1; (+) strand; PAM type: YTN; PAM sequence: TTC
tatctagtgaccatcgaata

SEQ ID NO: 265562 - DNA, 20 bp, Artificial Sequence
  Description of Artificial Sequence: Synthetic oligonucleotide
  Target: ATXN1; (+) strand; PAM type: YTN; PAM sequence: CTA
tctagtgaccatcgaatatg

SEQ ID NO: 265563 - DNA, 20 bp, Artificial Sequence
  Description of Artificial Sequence: Synthetic oligonucleotide
  Target: ATXN1; (+) strand; PAM type: YTN; PAM sequence: CTA
gtgaccatcgaatatgttgt

SEQ ID NO: 265564 - DNA, 20 bp, Artificial Sequence
  Description of Artificial Sequence: Synthetic oligonucleotide
  Target: ATXN1; (+) strand; PAM type: YTN; PAM sequence: TTG
taacttgtttacctattaaa

SEQ ID NO: 265565 - DNA, 20 bp, Artificial Sequence
  Description of Artificial Sequence: Synthetic oligonucleotide
  Target: ATXN1; (+) strand; PAM type: YTN; PAM sequence: CTT
gtttacctattaaataggga

SEQ ID NO: 265566 - DNA, 20 bp, Artificial Sequence
  Description of Artificial Sequence: Synthetic oligonucleotide
  Target: ATXN1; (+) strand; PAM type: YTN; PAM sequence: TTG
tttacctattaaatagggaa

SEQ ID NO: 265567 - DNA, 20 bp, Artificial Sequence
  Description of Artificial Sequence: Synthetic oligonucleotide
  Target: ATXN1; (+) strand; PAM type: YTN; PAM sequence: TTT
acctattaaatagggaatta

SEQ ID NO: 265568 - DNA, 20 bp, Artificial Sequence
  Description of Artificial Sequence: Synthetic oligonucleotide
  Target: ATXN1; (+) strand; PAM type: YTN; PAM sequence: TTA
cctattaaatagggaattat

SEQ ID NO: 265569 - DNA, 20 bp, Artificial Sequence
  Description of Artificial Sequence: Synthetic oligonucleotide
  Target: ATXN1; (+) strand; PAM type: YTN; PAM sequence: CTA
ttaaatagggaattatagca

SEQ ID NO: 265570 - DNA, 20 bp, Artificial Sequence
  Description of Artificial Sequence: Synthetic oligonucleotide
  Target: ATXN1; (+) strand; PAM type: YTN; PAM sequence: TTA
aatagggaattatagcaata

SEQ ID NO: 265571 - DNA, 20 bp, Artificial Sequence
  Description of Artificial Sequence: Synthetic oligonucleotide
  Target: ATXN1; (+) strand; PAM type: YTN; PAM sequence: TTA
tagcaataatcataggaatt

SEQ ID NO: 265572 - DNA, 20 bp, Artificial Sequence
  Description of Artificial Sequence: Synthetic oligonucleotide
  Target: ATXN1; (+) strand; PAM type: YTN; PAM sequence: TTG
cagtggcagtaacaataaaa

SEQ ID NO: 265573 - DNA, 20 bp, Artificial Sequence
  Description of Artificial Sequence: Synthetic oligonucleotide
  Target: ATXN1; (+) strand; PAM type: YTN; PAM sequence: TTT
gtctcctatttgccttcata

SEQ ID NO: 265574 - DNA, 20 bp, Artificial Sequence
  Description of Artificial Sequence: Synthetic oligonucleotide
  Target: ATXN1; (+) strand; PAM type: YTN; PAM sequence: TTG
tctcctatttgccttcatag

SEQ ID NO: 265575 - DNA, 20 bp, Artificial Sequence
  Description of Artificial Sequence: Synthetic oligonucleotide
  Target: ATXN1; (+) strand; PAM type: YTN; PAM sequence: CTC
ctatttgccttcatagtaac

SEQ ID NO: 265576 - DNA, 20 bp, Artificial Sequence
  Description of Artificial Sequence: Synthetic oligonucleotide
  Target: ATXN1; (+) strand; PAM type: YTN; PAM sequence: CTA
tttgccttcatagtaacatt

SEQ ID NO: 265577 - DNA, 20 bp, Artificial Sequence
  Description of Artificial Sequence: Synthetic oligonucleotide
  Target: ATXN1; (+) strand; PAM type: YTN; PAM sequence: TTT
gccttcatagtaacattact

SEQ ID NO: 265578 - DNA, 20 bp, Artificial Sequence
  Description of Artificial Sequence: Synthetic oligonucleotide
  Target: ATXN1; (+) strand; PAM type: YTN; PAM sequence: TTG
ccttcatagtaacattacta

SEQ ID NO: 265579 - DNA, 20 bp, Artificial Sequence
  Description of Artificial Sequence: Synthetic oligonucleotide
  Target: ATXN1; (+) strand; PAM type: YTN; PAM sequence: CTT
catagtaacattactaagaa

SEQ ID NO: 265580 - DNA, 20 bp, Artificial Sequence
  Description of Artificial Sequence: Synthetic oligonucleotide
  Target: ATXN1; (+) strand; PAM type: YTN; PAM sequence: TTC
atagtaacattactaagaac

SEQ ID NO: 265581 - DNA, 20 bp, Artificial Sequence
  Description of Artificial Sequence: Synthetic oligonucleotide
  Target: ATXN1; (+) strand; PAM type: YTN; PAM sequence: TTA
ctaagaactaataaactctg

SEQ ID NO: 265582 - DNA, 20 bp, Artificial Sequence
  Description of Artificial Sequence: Synthetic oligonucleotide
  Target: ATXN1; (+) strand; PAM type: YTN; PAM sequence: CTA
agaactaataaactctgagg

SEQ ID NO: 265583 - DNA, 20 bp, Artificial Sequence
  Description of Artificial Sequence: Synthetic oligonucleotide
  Target: ATXN1; (+) strand; PAM type: YTN; PAM sequence: CTA
ataaactctgaggctagaga

SEQ ID NO: 265584 - DNA, 20 bp, Artificial Sequence
  Description of Artificial Sequence: Synthetic oligonucleotide
  Target: ATXN1; (+) strand; PAM type: YTN; PAM sequence: CTC
tgaggctagagactaaagta

SEQ ID NO: 265585 - DNA, 20 bp, Artificial Sequence
  Description of Artificial Sequence: Synthetic oligonucleotide
  Target: ATXN1; (+) strand; PAM type: YTN; PAM sequence: CTG
aggctagagactaaagtaag

SEQ ID NO: 265586 - DNA, 20 bp, Artificial Sequence
  Description of Artificial Sequence: Synthetic oligonucleotide
  Target: ATXN1; (+) strand; PAM type: YTN; PAM sequence: CTA
gagactaaagtaagaatttg

SEQ ID NO: 265587 - DNA, 20 bp, Artificial Sequence
  Description of Artificial Sequence: Synthetic oligonucleotide
  Target: ATXN1; (+) strand; PAM type: YTN; PAM sequence: CTA
aagtaagaatttggtttagg

SEQ ID NO: 265588 - DNA, 20 bp, Artificial Sequence
  Description of Artificial Sequence: Synthetic oligonucleotide
  Target: ATXN1; (+) strand; PAM type: YTN; PAM sequence: TTT
ggtttaggactggtttttat

SEQ ID NO: 265589 - DNA, 20 bp, Artificial Sequence
  Description of Artificial Sequence: Synthetic oligonucleotide
  Target: ATXN1; (+) strand; PAM type: YTN; PAM sequence: TTG
gtttaggactggtttttatt

SEQ ID NO: 265590 - DNA, 20 bp, Artificial Sequence
  Description of Artificial Sequence: Synthetic oligonucleotide
  Target: ATXN1; (+) strand; PAM type: YTN; PAM sequence: TTT
aggactggtttttattatta

SEQ ID NO: 265591 - DNA, 20 bp, Artificial Sequence
  Description of Artificial Sequence: Synthetic oligonucleotide
  Target: ATXN1; (+) strand; PAM type: YTN; PAM sequence: TTA
ggactggtttttattattat

SEQ ID NO: 265592 - DNA, 20 bp, Artificial Sequence
  Description of Artificial Sequence: Synthetic oligonucleotide
  Target: ATXN1; (+) strand; PAM type: YTN; PAM sequence: CTG
gtttttattattatttttat

SEQ ID NO: 265593 - DNA, 20 bp, Artificial Sequence
  Description of Artificial Sequence: Synthetic oligonucleotide
  Target: ATXN1; (+) strand; PAM type: YTN; PAM sequence: TTT
ttattattatttttattttt

SEQ ID NO: 265594 - DNA, 20 bp, Artificial Sequence
  Description of Artificial Sequence: Synthetic oligonucleotide
  Target: ATXN1; (+) strand; PAM type: YTN; PAM sequence: TTT
tattattatttttattttta

SEQ ID NO: 265595 - DNA, 20 bp, Artificial Sequence
  Description of Artificial Sequence: Synthetic oligonucleotide
  Target: ATXN1; (+) strand; PAM type: YTN; PAM sequence: TTT
attattatttttatttttat

SEQ ID NO: 265596 - DNA, 20 bp, Artificial Sequence
  Description of Artificial Sequence: Synthetic oligonucleotide
  Target: ATXN1; (+) strand; PAM type: YTN; PAM sequence: TTA
ttattatttttatttttatt

SEQ ID NO: 265597 - DNA, 20 bp, Artificial Sequence
  Description of Artificial Sequence: Synthetic oligonucleotide
  Target: ATXN1; (+) strand; PAM type: YTN; PAM sequence: TTA
ttatttttatttttatttta

SEQ ID NO: 265598 - DNA, 20 bp, Artificial Sequence
  Description of Artificial Sequence: Synthetic oligonucleotide
  Target: ATXN1; (+) strand; PAM type: YTN; PAM sequence: TTA
tttttatttttattttattt

SEQ ID NO: 265599 - DNA, 20 bp, Artificial Sequence
  Description of Artificial Sequence: Synthetic oligonucleotide
  Target: ATXN1; (+) strand; PAM type: YTN; PAM sequence: TTT
ttatttttattttattttat

SEQ ID NO: 265600 - DNA, 20 bp, Artificial Sequence
  Description of Artificial Sequence: Synthetic oligonucleotide
  Target: ATXN1; (+) strand; PAM type: YTN; PAM sequence: TTT
tatttttattttattttatt

SEQ ID NO: 265601 - DNA, 20 bp, Artificial Sequence
  Description of Artificial Sequence: Synthetic oligonucleotide
  Target: ATXN1; (+) strand; PAM type: YTN; PAM sequence: TTT
atttttattttattttattt

SEQ ID NO: 265602 - DNA, 20 bp, Artificial Sequence
  Description of Artificial Sequence: Synthetic oligonucleotide
  Target: ATXN1; (+) strand; PAM type: YTN; PAM sequence: TTA
tttttattttattttatttt

SEQ ID NO: 265603 - DNA, 20 bp, Artificial Sequence
  Description of Artificial Sequence: Synthetic oligonucleotide
  Target: ATXN1; (+) strand; PAM type: YTN; PAM sequence: TTT
ttattttattttattttgag

SEQ ID NO: 265604 - DNA, 20 bp, Artificial Sequence
  Description of Artificial Sequence: Synthetic oligonucleotide
  Target: ATXN1; (+) strand; PAM type: YTN; PAM sequence: TTT
tattttattttattttgaga

SEQ ID NO: 265605 - DNA, 20 bp, Artificial Sequence
  Description of Artificial Sequence: Synthetic oligonucleotide
  Target: ATXN1; (+) strand; PAM type: YTN; PAM sequence: TTT
attttattttattttgagac

SEQ ID NO: 265606 - DNA, 20 bp, Artificial Sequence
  Description of Artificial Sequence: Synthetic oligonucleotide
  Target: ATXN1; (+) strand; PAM type: YTN; PAM sequence: TTA
ttttattttattttgagacg

SEQ ID NO: 265607 - DNA, 20 bp, Artificial Sequence
  Description of Artificial Sequence: Synthetic oligonucleotide
  Target: ATXN1; (+) strand; PAM type: YTN; PAM sequence: TTT
tattttattttgagacggag

SEQ ID NO: 265608 - DNA, 20 bp, Artificial Sequence
  Description of Artificial Sequence: Synthetic oligonucleotide
  Target: ATXN1; (+) strand; PAM type: YTN; PAM sequence: TTT
attttattttgagacggagt

SEQ ID NO: 265609 - DNA, 20 bp, Artificial Sequence
  Description of Artificial Sequence: Synthetic oligonucleotide
  Target: ATXN1; (+) strand; PAM type: YTN; PAM sequence: TTA
ttttattttgagacggagtc

SEQ ID NO: 265610 - DNA, 20 bp, Artificial Sequence
  Description of Artificial Sequence: Synthetic oligonucleotide
  Target: ATXN1; (+) strand; PAM type: YTN; PAM sequence: TTT
tattttgagacggagtctca

SEQ ID NO: 265611 - DNA, 20 bp, Artificial Sequence
  Description of Artificial Sequence: Synthetic oligonucleotide
  Target: ATXN1; (+) strand; PAM type: YTN; PAM sequence: TTT
attttgagacggagtctcac

SEQ ID NO: 265612 - DNA, 20 bp, Artificial Sequence
  Description of Artificial Sequence: Synthetic oligonucleotide
  Target: ATXN1; (+) strand; PAM type: YTN; PAM sequence: TTA
ttttgagacggagtctcact

SEQ ID NO: 265613 - DNA, 20 bp, Artificial Sequence
  Description of Artificial Sequence: Synthetic oligonucleotide
  Target: ATXN1; (+) strand; PAM type: YTN; PAM sequence: TTT
tgagacggagtctcactctg

SEQ ID NO: 265614 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcactctgt

SEQ ID NO: 265615 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcactctgtc

SEQ ID NO: 265616 - DNA, 20 bp, Artificial Sequence
  Description of Artificial Sequence: Synthetic oligonucleotide
  Target: ATXN1; (+) strand; PAM type: YTN; PAM sequence: CTC
actctgtcgcccaggctgga

SEQ ID NO: 265617 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtgc

SEQ ID NO: 265618 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtgcag

SEQ ID NO: 265619 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcacgatctt

SEQ ID NO: 265620 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaagctccact

SEQ ID NO: 265621 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaagctccactt

SEQ ID NO: 265622 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccacttccca

SEQ ID NO: 265623 - DNA, 20 bp, Artificial Sequence
  Description of Artificial Sequence: Synthetic oligonucleotide
  Target: ATXN1; (+) strand; PAM type: YTN; PAM sequence: CTG
caagctccacttcccaggtt

SEQ ID NO: 265624 - DNA, 20 bp, Artificial Sequence
  Description of Artificial Sequence: Synthetic oligonucleotide
  Target: ATXN1; (+) strand; PAM type: YTN; PAM sequence: CTC
cacttcccaggttcacgcca

SEQ ID NO: 265625 - DNA, 20 bp, Artificial Sequence
  Description of Artificial Sequence: Synthetic oligonucleotide
  Target: ATXN1; (+) strand; PAM type: YTN; PAM sequence: CTT
cccaggttcacgccattctc

SEQ ID NO: 265626 - DNA, 20 bp, Artificial Sequence
  Description of Artificial Sequence: Synthetic oligonucleotide
  Target: ATXN1; (+) strand; PAM type: YTN; PAM sequence: TTC
ccaggttcacgccattctcc

SEQ ID NO: 265627 - DNA, 20 bp, Artificial Sequence
  Description of Artificial Sequence: Synthetic oligonucleotide
  Target: ATXN1; (+) strand; PAM type: YTN; PAM sequence: TTC
acgccattctcccgcctcag

SEQ ID NO: 265628 - DNA, 20 bp, Artificial Sequence
  Description of Artificial Sequence: Synthetic oligonucleotide
  Target: ATXN1; (+) strand; PAM type: YTN; PAM sequence: TTC
tcccgcctcagcctcctgag

SEQ ID NO: 265629 - DNA, 20 bp, Artificial Sequence
  Description of Artificial Sequence: Synthetic oligonucleotide
  Target: ATXN1; (+) strand; PAM type: YTN; PAM sequence: CTC
ccgcctcagcctcctgagta

SEQ ID NO: 265630 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 265631 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggactacag

SEQ ID NO: 265632 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactacaggcg

SEQ ID NO: 265633 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcatgccac

SEQ ID NO: 265634 - DNA, 20 bp, Artificial Sequence
  Description of Artificial Sequence: Synthetic oligonucleotide
  Target: ATXN1; (+) strand; PAM type: YTN; PAM sequence: CTA
caggcgcatgccaccacgcg

SEQ ID NO: 265635 - DNA, 20 bp, Artificial Sequence
  Description of Artificial Sequence: Synthetic oligonucleotide
  Target: ATXN1; (+) strand; PAM type: YTN; PAM sequence: CTA
atttggtttttgtattttta

SEQ ID NO: 265636 - DNA, 20 bp, Artificial Sequence
  Description of Artificial Sequence: Synthetic oligonucleotide
  Target: ATXN1; (+) strand; PAM type: YTN; PAM sequence: TTT
ggtttttgtatttttagtag

SEQ ID NO: 265637 - DNA, 20 bp, Artificial Sequence
  Description of Artificial Sequence: Synthetic oligonucleotide
  Target: ATXN1; (+) strand; PAM type: YTN; PAM sequence: TTG
gtttttgtatttttagtaga

SEQ ID NO: 265638 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagacg

SEQ ID NO: 265639 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacgg

SEQ ID NO: 265640 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacggg

SEQ ID NO: 265641 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacgggg

SEQ ID NO: 265642 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacggggtttca

SEQ ID NO: 265643 - DNA, 20 bp, Artificial Sequence
  Description of Artificial Sequence: Synthetic oligonucleotide
  Target: ATXN1; (+) strand; PAM type: YTN; PAM sequence: TTT
tagtagagacggggtttcac

SEQ ID NO: 265644 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcact

SEQ ID NO: 265645 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcactg

SEQ ID NO: 265646 - DNA, 20 bp, Artificial Sequence
  Description of Artificial Sequence: Synthetic oligonucleotide
  Target: ATXN1; (+) strand; PAM type: YTN; PAM sequence: TTT
cactgtgttagtcaggatgg

SEQ ID NO: 265647 - DNA, 20 bp, Artificial Sequence
  Description of Artificial Sequence: Synthetic oligonucleotide
  Target: ATXN1; (+) strand; PAM type: YTN; PAM sequence: TTC
actgtgttagtcaggatggt

SEQ ID NO: 265648 - DNA, 20 bp, Artificial Sequence
  Description of Artificial Sequence: Synthetic oligonucleotide
  Target: ATXN1; (+) strand; PAM type: YTN; PAM sequence: CTG
tgttagtcaggatggtcttg

SEQ ID NO: 265649 - DNA, 20 bp, Artificial Sequence
  Description of Artificial Sequence: Synthetic oligonucleotide
  Target: ATXN1; (+) strand; PAM type: YTN; PAM sequence: TTA
gtcaggatggtcttgatttc

SEQ ID NO: 265650 - DNA, 20 bp, Artificial Sequence
  Description of Artificial Sequence: Synthetic oligonucleotide
  Target: ATXN1; (+) strand; PAM type: YTN; PAM sequence: CTT
gatttcctgacatcgtgatc

SEQ ID NO: 265651 - DNA, 20 bp, Artificial Sequence
  Description of Artificial Sequence: Synthetic oligonucleotide
  Target: ATXN1; (+) strand; PAM type: YTN; PAM sequence: TTG
atttcctgacatcgtgatct

SEQ ID NO: 265652 - DNA, 20 bp, Artificial Sequence
  Description of Artificial Sequence: Synthetic oligonucleotide
  Target: ATXN1; (+) strand; PAM type: YTN; PAM sequence: TTT
cctgacatcgtgatctgccc

SEQ ID NO: 265653 - DNA, 20 bp, Artificial Sequence
  Description of Artificial Sequence: Synthetic oligonucleotide
  Target: ATXN1; (+) strand; PAM type: YTN; PAM sequence: TTC
ctgacatcgtgatctgcccg

SEQ ID NO: 265654 - DNA, 20 bp, Artificial Sequence
  Description of Artificial Sequence: Synthetic oligonucleotide
  Target: ATXN1; (+) strand; PAM type: YTN; PAM sequence: CTG
acatcgtgatctgcccgcct

SEQ ID NO: 265655 - DNA, 20 bp, Artificial Sequence
  Description of Artificial Sequence: Synthetic oligonucleotide
  Target: ATXN1; (+) strand; PAM type: YTN; PAM sequence: CTG
cccgcctcggcctcctaaag

SEQ ID NO: 265656 - DNA, 20 bp, Artificial Sequence
  Description of Artificial Sequence: Synthetic oligonucleotide
  Target: ATXN1; (+) strand; PAM type: YTN; PAM sequence: CTC
ggcctcctaaagtgctggga

SEQ ID NO: 265657 - DNA, 20 bp, Artificial Sequence
  Description of Artificial Sequence: Synthetic oligonucleotide
  Target: ATXN1; (+) strand; PAM type: YTN; PAM sequence: CTC
ctaaagtgctgggattacag

SEQ ID NO: 265658 - DNA, 20 bp, Artificial Sequence
  Description of Artificial Sequence: Synthetic oligonucleotide
  Target: ATXN1; (+) strand; PAM type: YTN; PAM sequence: CTA
aagtgctgggattacaggcg

SEQ ID NO: 265659 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 265660 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccatgcc

SEQ ID NO: 265661 - DNA, 20 bp, Artificial Sequence
  Description of Artificial Sequence: Synthetic oligonucleotide
  Target: ATXN1; (+) strand; PAM type: YTN; PAM sequence: CTG
gcccggactggttattacct

SEQ ID NO: 265662 - DNA, 20 bp, Artificial Sequence
  Description of Artificial Sequence: Synthetic oligonucleotide
  Target: ATXN1; (+) strand; PAM type: YTN; PAM sequence: CTG
gttattaccttataaaggga

SEQ ID NO: 265663 - DNA, 20 bp, Artificial Sequence
  Description of Artificial Sequence: Synthetic oligonucleotide
  Target: ATXN1; (+) strand; PAM type: YTN; PAM sequence: TTA
ttaccttataaagggaagta

SEQ ID NO: 265664 - DNA, 20 bp, Artificial Sequence
  Description of Artificial Sequence: Synthetic oligonucleotide
  Target: ATXN1; (+) strand; PAM type: YTN; PAM sequence: TTA
ccttataaagggaagtacca

SEQ ID NO: 265665 - DNA, 20 bp, Artificial Sequence
  Description of Artificial Sequence: Synthetic oligonucleotide
  Target: ATXN1; (+) strand; PAM type: YTN; PAM sequence: CTT
ataaagggaagtaccatcaa

SEQ ID NO: 265666 - DNA, 20 bp, Artificial Sequence
  Description of Artificial Sequence: Synthetic oligonucleotide
  Target: ATXN1; (+) strand; PAM type: YTN; PAM sequence: TTA
taaagggaagtaccatcaaa

SEQ ID NO: 265667 - DNA, 20 bp, Artificial Sequence
  Description of Artificial Sequence: Synthetic oligonucleotide
  Target: ATXN1; (+) strand; PAM type: YTN; PAM sequence: TTG
ttatcagagtaacttgtttc

SEQ ID NO: 265668 - DNA, 20 bp, Artificial Sequence
  Description of Artificial Sequence: Synthetic oligonucleotide
  Target: ATXN1; (+) strand; PAM type: YTN; PAM sequence: TTA
tcagagtaacttgtttccag

SEQ ID NO: 265669 - DNA, 20 bp, Artificial Sequence
  Description of Artificial Sequence: Synthetic oligonucleotide
  Target: ATXN1; (+) strand; PAM type: YTN; PAM sequence: CTT
gtttccagggaagccactgt

SEQ ID NO: 265670 - DNA, 20 bp, Artificial Sequence
  Description of Artificial Sequence: Synthetic oligonucleotide
  Target: ATXN1; (+) strand; PAM type: YTN; PAM sequence: TTG
tttccagggaagccactgtg

SEQ ID NO: 265671 - DNA, 20 bp, Artificial Sequence
  Description of Artificial Sequence: Synthetic oligonucleotide
  Target: ATXN1; (+) strand; PAM type: YTN; PAM sequence: TTT
ccagggaagccactgtggga

SEQ ID NO: 265672 - DNA, 20 bp, Artificial Sequence
  Description of Artificial Sequence: Synthetic oligonucleotide
  Target: ATXN1; (+) strand; PAM type: YTN; PAM sequence: TTC
cagggaagccactgtgggat

SEQ ID NO: 265673 - DNA, 20 bp, Artificial Sequence
  Description of Artificial Sequence: Synthetic oligonucleotide
  Target: ATXN1; (+) strand; PAM type: YTN; PAM sequence: CTG
tgggatgaatgaacagtcac

SEQ ID NO: 265674 - DNA, 20 bp, Artificial Sequence
  Description of Artificial Sequence: Synthetic oligonucleotide
  Target: ATXN1; (+) strand; PAM type: YTN; PAM sequence: CTG
gaaccagtaagcgagtatat

SEQ ID NO: 265675 - DNA, 20 bp, Artificial Sequence
  Description of Artificial Sequence: Synthetic oligonucleotide
  Target: ATXN1; (+) strand; PAM type: YTN; PAM sequence: CTA
tccctgggctaggagttgct

SEQ ID NO: 265676 - DNA, 20 bp, Artificial Sequence
  Description of Artificial Sequence: Synthetic oligonucleotide
  Target: ATXN1; (+) strand; PAM type: YTN; PAM sequence: CTG
ggctaggagttgctggtata

SEQ ID NO: 265677 - DNA, 20 bp, Artificial Sequence
  Description of Artificial Sequence: Synthetic oligonucleotide
  Target: ATXN1; (+) strand; PAM type: YTN; PAM sequence: CTA
ggagttgctggtatatactg

SEQ ID NO: 265678 - DNA, 20 bp, Artificial Sequence
  Description of Artificial Sequence: Synthetic oligonucleotide
  Target: ATXN1; (+) strand; PAM type: YTN; PAM sequence: TTG
ctggtatatactgaagtaca

SEQ ID NO: 265679 - DNA, 20 bp, Artificial Sequence
  Description of Artificial Sequence: Synthetic oligonucleotide
  Target: ATXN1; (+) strand; PAM type: YTN; PAM sequence: CTG
gtatatactgaagtacacag

SEQ ID NO: 265680 - DNA, 20 bp, Artificial Sequence
  Description of Artificial Sequence: Synthetic oligonucleotide
  Target: ATXN1; (+) strand; PAM type: YTN; PAM sequence: CTG
aagtacacagttacaaatca

SEQ ID NO: 265681 - DNA, 20 bp, Artificial Sequence
  Description of Artificial Sequence: Synthetic oligonucleotide
  Target: ATXN1; (+) strand; PAM type: YTN; PAM sequence: TTA
caaatcaatgcaaagcaaat

SEQ ID NO: 265682 - DNA, 20 bp, Artificial Sequence
  Description of Artificial Sequence: Synthetic oligonucleotide
  Target: ATXN1; (+) strand; PAM type: YTN; PAM sequence: TTA
gccaaaagaggcaaaagtca

SEQ ID NO: 265683 - DNA, 20 bp, Artificial Sequence
  Description of Artificial Sequence: Synthetic oligonucleotide
  Target: ATXN1; (+) strand; PAM type: YTN; PAM sequence: CTC
ccctttctaagcagattgtt

SEQ ID NO: 265684 - DNA, 20 bp, Artificial Sequence
  Description of Artificial Sequence: Synthetic oligonucleotide
  Target: ATXN1; (+) strand; PAM type: YTN; PAM sequence: CTT
tctaagcagattgttaacaa

SEQ ID NO: 265685 - DNA, 20 bp, Artificial Sequence
  Description of Artificial Sequence: Synthetic oligonucleotide
  Target: ATXN1; (+) strand; PAM type: YTN; PAM sequence: TTT
ctaagcagattgttaacaat

SEQ ID NO: 265686 - DNA, 20 bp, Artificial Sequence
  Description of Artificial Sequence: Synthetic oligonucleotide
  Target: ATXN1; (+) strand; PAM type: YTN; PAM sequence: TTC
taagcagattgttaacaatg

SEQ ID NO: 265687 - DNA, 20 bp, Artificial Sequence
  Description of Artificial Sequence: Synthetic oligonucleotide
  Target: ATXN1; (+) strand; PAM type: YTN; PAM sequence: CTA
agcagattgttaacaatgtc

SEQ ID NO: 265688 - DNA, 20 bp, Artificial Sequence
  Description of Artificial Sequence: Synthetic oligonucleotide
  Target: ATXN1; (+) strand; PAM type: YTN; PAM sequence: TTG
ttaacaatgtcctaagagaa

SEQ ID NO: 265689 - DNA, 20 bp, Artificial Sequence
  Description of Artificial Sequence: Synthetic oligonucleotide
  Target: ATXN1; (+) strand; PAM type: YTN; PAM sequence: TTA
acaatgtcctaagagaatgc

SEQ ID NO: 265690 - DNA, 20 bp, Artificial Sequence
  Description of Artificial Sequence: Synthetic oligonucleotide
  Target: ATXN1; (+) strand; PAM type: YTN; PAM sequence: CTA
agagaatgcaagcatttaaa

SEQ ID NO: 265691 - DNA, 20 bp, Artificial Sequence
  Description of Artificial Sequence: Synthetic oligonucleotide
  Target: ATXN1; (+) strand; PAM type: YTN; PAM sequence: TTT
aaaaactgtacatggctgat

SEQ ID NO: 265692 - DNA, 20 bp, Artificial Sequence
  Description of Artificial Sequence: Synthetic oligonucleotide
  Target: ATXN1; (+) strand; PAM type: YTN; PAM sequence: TTA
aaaactgtacatggctgata

SEQ ID NO: 265693 - DNA, 20 bp, Artificial Sequence
  Description of Artificial Sequence: Synthetic oligonucleotide
  Target: ATXN1; (+) strand; PAM type: YTN; PAM sequence: CTG
tacatggctgatattggaaa

SEQ ID NO: 265694 - DNA, 20 bp, Artificial Sequence
  Description of Artificial Sequence: Synthetic oligonucleotide
  Target: ATXN1; (+) strand; PAM type: YTN; PAM sequence: CTG
atattggaaatattgagatt

SEQ ID NO: 265695 - DNA, 20 bp, Artificial Sequence
  Description of Artificial Sequence: Synthetic oligonucleotide
  Target: ATXN1; (+) strand; PAM type: YTN; PAM sequence: TTG
gaaatattgagatttagagc

SEQ ID NO: 265696 - DNA, 20 bp, Artificial Sequence
  Description of Artificial Sequence: Synthetic oligonucleotide
  Target: ATXN1; (+) strand; PAM type: YTN; PAM sequence: TTG
agatttagagcaactagaga

SEQ ID NO: 265697 - DNA, 20 bp, Artificial Sequence
  Description of Artificial Sequence: Synthetic oligonucleotide
  Target: ATXN1; (+) strand; PAM type: YTN; PAM sequence: TTT
agagcaactagagaagtttt

SEQ ID NO: 265698 - DNA, 20 bp, Artificial Sequence
  Description of Artificial Sequence: Synthetic oligonucleotide
  Target: ATXN1; (+) strand; PAM type: YTN; PAM sequence: TTA
gagcaactagagaagttttc

SEQ ID NO: 265699 - DNA, 20 bp, Artificial Sequence
  Description of Artificial Sequence: Synthetic oligonucleotide
  Target: ATXN1; (+) strand; PAM type: YTN; PAM sequence: CTA
gagaagttttcagatgcttg

SEQ ID NO: 265700 - DNA, 20 bp, Artificial Sequence
  Description of Artificial Sequence: Synthetic oligonucleotide
  Target: ATXN1; (+) strand; PAM type: YTN; PAM sequence: TTT
tcagatgcttgagaatatac

SEQ ID NO: 265701 - DNA, 20 bp, Artificial Sequence
  Description of Artificial Sequence: Synthetic oligonucleotide
  Target: ATXN1; (+) strand; PAM type: YTN; PAM sequence: TTT
cagatgcttgagaatataca

SEQ ID NO: 265702 - DNA, 20 bp, Artificial Sequence
  Description of Artificial Sequence: Synthetic oligonucleotide
  Target: ATXN1; (+) strand; PAM type: YTN; PAM sequence: TTC
agatgcttgagaatatacat

SEQ ID NO: 265703 - DNA, 20 bp, Artificial Sequence
  Description of Artificial Sequence: Synthetic oligonucleotide
  Target: ATXN1; (+) strand; PAM type: YTN; PAM sequence: CTT
gagaatatacattgaaacat

SEQ ID NO: 265704 - DNA, 20 bp, Artificial Sequence
  Description of Artificial Sequence: Synthetic oligonucleotide
  Target: ATXN1; (+) strand; PAM type: YTN; PAM sequence: TTG
agaatatacattgaaacatc

SEQ ID NO: 265705 - DNA, 20 bp, Artificial Sequence
  Description of Artificial Sequence: Synthetic oligonucleotide
  Target: ATXN1; (+) strand; PAM type: YTN; PAM sequence: TTG
aaacatcaccttacttttga

SEQ ID NO: 265706 - DNA, 20 bp, Artificial Sequence
  Description of Artificial Sequence: Synthetic oligonucleotide
  Target: ATXN1; (+) strand; PAM type: YTN; PAM sequence: CTT
acttttgaacagaacacaaa

SEQ ID NO: 265707 - DNA, 20 bp, Artificial Sequence
  Description of Artificial Sequence: Synthetic oligonucleotide
  Target: ATXN1; (+) strand; PAM type: YTN; PAM sequence: TTA
cttttgaacagaacacaaac

SEQ ID NO: 265708 - DNA, 20 bp, Artificial Sequence
  Description of Artificial Sequence: Synthetic oligonucleotide
  Target: ATXN1; (+) strand; PAM type: YTN; PAM sequence: CTT
ttgaacagaacacaaactta

SEQ ID NO: 265709 - DNA, 20 bp, Artificial Sequence
  Description of Artificial Sequence: Synthetic oligonucleotide
  Target: ATXN1; (+) strand; PAM type: YTN; PAM sequence: TTT
tgaacagaacacaaacttac

SEQ ID NO: 265710 - DNA, 20 bp, Artificial Sequence
  Description of Artificial Sequence: Synthetic oligonucleotide
  Target: ATXN1; (+) strand; PAM type: YTN; PAM sequence: TTT
gaacagaacacaaacttact

SEQ ID NO: 265711 - DNA, 20 bp, Artificial Sequence
  Description of Artificial Sequence: Synthetic oligonucleotide
  Target: ATXN1; (+) strand; PAM type: YTN; PAM sequence: TTG
aacagaacacaaacttactt

SEQ ID NO: 265712 - DNA, 20 bp, Artificial Sequence
  Description of Artificial Sequence: Synthetic oligonucleotide
  Target: ATXN1; (+) strand; PAM type: YTN; PAM sequence: CTT
acttagatcgatgcttcttc

SEQ ID NO: 265713 - DNA, 20 bp, Artificial Sequence
  Description of Artificial Sequence: Synthetic oligonucleotide
  Target: ATXN1; (+) strand; PAM type: YTN; PAM sequence: TTA
cttagatcgatgcttcttct

SEQ ID NO: 265714 - DNA, 20 bp, Artificial Sequence
  Description of Artificial Sequence: Synthetic oligonucleotide
  Target: ATXN1; (+) strand; PAM type: YTN; PAM sequence: CTT
agatcgatgcttcttctgaa

SEQ ID NO: 265715 - DNA, 20 bp, Artificial Sequence
  Description of Artificial Sequence: Synthetic oligonucleotide
  Target: ATXN1; (+) strand; PAM type: YTN; PAM sequence: TTA
gatcgatgcttcttctgaat

SEQ ID NO: 265716 - DNA, 20 bp, Artificial Sequence
  Description of Artificial Sequence: Synthetic oligonucleotide
  Target: ATXN1; (+) strand; PAM type: YTN; PAM sequence: CTT
cttctgaatagaagcagaaa

SEQ ID NO: 265717 - DNA, 20 bp, Artificial Sequence
  Description of Artificial Sequence: Synthetic oligonucleotide
  Target: ATXN1; (+) strand; PAM type: YTN; PAM sequence: TTC
ttctgaatagaagcagaaaa

SEQ ID NO: 265718 - DNA, 20 bp, Artificial Sequence
  Description of Artificial Sequence: Synthetic oligonucleotide
  Target: ATXN1; (+) strand; PAM type: YTN; PAM sequence: CTT
ctgaatagaagcagaaaaaa

SEQ ID NO: 265719 - DNA, 20 bp, Artificial Sequence
  Description of Artificial Sequence: Synthetic oligonucleotide
  Target: ATXN1; (+) strand; PAM type: YTN; PAM sequence: TTC
tgaatagaagcagaaaaaaa

SEQ ID NO: 265720 - DNA, 20 bp, Artificial Sequence
  Description of Artificial Sequence: Synthetic oligonucleotide
  Target: ATXN1; (+) strand; PAM type: YTN; PAM sequence: CTG
aatagaagcagaaaaaaaaa

SEQ ID NO: 265721 - DNA, 20 bp, Artificial Sequence
  Description of Artificial Sequence: Synthetic oligonucleotide
  Target: ATXN1; (+) strand; PAM type: YTN; PAM sequence: CTG
tgatagaaaactatttcaga

SEQ ID NO: 265722 - DNA, 20 bp, Artificial Sequence
  Description of Artificial Sequence: Synthetic oligonucleotide
  Target: ATXN1; (+) strand; PAM type: YTN; PAM sequence: CTA
tttcagaggttgatccactc

SEQ ID NO: 265723 - DNA, 20 bp, Artificial Sequence
  Description of Artificial Sequence: Synthetic oligonucleotide
  Target: ATXN1; (+) strand; PAM type: YTN; PAM sequence: TTT
cagaggttgatccactcatc

SEQ ID NO: 265724 - DNA, 20 bp, Artificial Sequence
  Description of Artificial Sequence: Synthetic oligonucleotide
  Target: ATXN1; (+) strand; PAM type: YTN; PAM sequence: TTC
agaggttgatccactcatct

SEQ ID NO: 265725 - DNA, 20 bp, Artificial Sequence
  Description of Artificial Sequence: Synthetic oligonucleotide
  Target: ATXN1; (+) strand; PAM type: YTN; PAM sequence: TTG
atccactcatctggaccaag

SEQ ID NO: 265726 - DNA, 20 bp, Artificial Sequence
  Description of Artificial Sequence: Synthetic oligonucleotide
  Target: ATXN1; (+) strand; PAM type: YTN; PAM sequence: CTC
atctggaccaagtccctgca

SEQ ID NO: 265727 - DNA, 20 bp, Artificial Sequence
  Description of Artificial Sequence: Synthetic oligonucleotide
  Target: ATXN1; (+) strand; PAM type: YTN; PAM sequence: CTG
gaccaagtccctgcacctaa

SEQ ID NO: 265728 - DNA, 20 bp, Artificial Sequence
  Description of Artificial Sequence: Synthetic oligonucleotide
  Target: ATXN1; (+) strand; PAM type: YTN; PAM sequence: CTG
cacctaaaaatacaggaagt

SEQ ID NO: 265729 - DNA, 20 bp, Artificial Sequence
  Description of Artificial Sequence: Synthetic oligonucleotide
  Target: ATXN1; (+) strand; PAM type: YTN; PAM sequence: CTA
aaaatacaggaagttagatt

SEQ ID NO: 265730 - DNA, 20 bp, Artificial Sequence
  Description of Artificial Sequence: Synthetic oligonucleotide
  Target: ATXN1; (+) strand; PAM type: YTN; PAM sequence: TTA
gattttaaggtttctaaaat

SEQ ID NO: 265731 - DNA, 20 bp, Artificial Sequence
  Description of Artificial Sequence: Synthetic oligonucleotide
  Target: ATXN1; (+) strand; PAM type: YTN; PAM sequence: TTT
taaggtttctaaaatctgcc

SEQ ID NO: 265732 - DNA, 20 bp, Artificial Sequence
  Description of Artificial Sequence: Synthetic oligonucleotide
  Target: ATXN1; (+) strand; PAM type: YTN; PAM sequence: TTT
aaggtttctaaaatctgcca

SEQ ID NO: 265733 - DNA, 20 bp, Artificial Sequence
  Description of Artificial Sequence: Synthetic oligonucleotide
  Target: ATXN1; (+) strand; PAM type: YTN; PAM sequence: TTA
aggtttctaaaatctgccaa

SEQ ID NO: 265734 - DNA, 20 bp, Artificial Sequence
  Description of Artificial Sequence: Synthetic oligonucleotide
  Target: ATXN1; (+) strand; PAM type: YTN; PAM sequence: TTT
ctaaaatctgccaaaactgt

SEQ ID NO: 265735 - DNA, 20 bp, Artificial Sequence
  Description of Artificial Sequence: Synthetic oligonucleotide
  Target: ATXN1; (+) strand; PAM type: YTN; PAM sequence: TTC
taaaatctgccaaaactgtg

SEQ ID NO: 265736 - DNA, 20 bp, Artificial Sequence
  Description of Artificial Sequence: Synthetic oligonucleotide
  Target: ATXN1; (+) strand; PAM type: YTN; PAM sequence: CTA
aaatctgccaaaactgtgca

SEQ ID NO: 265737 - DNA, 20 bp, Artificial Sequence
  Description of Artificial Sequence: Synthetic oligonucleotide
  Target: ATXN1; (+) strand; PAM type: YTN; PAM sequence: CTG
ccaaaactgtgcaacagagc

SEQ ID NO: 265738 - DNA, 20 bp, Artificial Sequence
  Description of Artificial Sequence: Synthetic oligonucleotide
  Target: ATXN1; (+) strand; PAM type: YTN; PAM sequence: CTG
tgcaacagagctggcccttg

SEQ ID NO: 265739 - DNA, 20 bp, Artificial Sequence
  Description of Artificial Sequence: Synthetic oligonucleotide
  Target: ATXN1; (+) strand; PAM type: YTN; PAM sequence: CTG
gcccttggctgtccaaacct

SEQ ID NO: 265740 - DNA, 20 bp, Artificial Sequence
  Description of Artificial Sequence: Synthetic oligonucleotide
  Target: ATXN1; (+) strand; PAM type: YTN; PAM sequence: CTT
ggctgtccaaaccttctaga

SEQ ID NO: 265741 - DNA, 20 bp, Artificial Sequence
  Description of Artificial Sequence: Synthetic oligonucleotide
  Target: ATXN1; (+) strand; PAM type: YTN; PAM sequence: TTG
gctgtccaaaccttctagaa

SEQ ID NO: 265742 - DNA, 20 bp, Artificial Sequence
  Description of Artificial Sequence: Synthetic oligonucleotide
  Target: ATXN1; (+) strand; PAM type: YTN; PAM sequence: CTG
tccaaaccttctagaaaggc

SEQ ID NO: 265743 - DNA, 20 bp, Artificial Sequence
  Description of Artificial Sequence: Synthetic oligonucleotide
  Target: ATXN1; (+) strand; PAM type: YTN; PAM sequence: CTT
ctagaaaggcagagttttaa

SEQ ID NO: 265744 - DNA, 20 bp, Artificial Sequence
  Description of Artificial Sequence: Synthetic oligonucleotide
  Target: ATXN1; (+) strand; PAM type: YTN; PAM sequence: TTC
tagaaaggcagagttttaaa

SEQ ID NO: 265745 - DNA, 20 bp, Artificial Sequence
  Description of Artificial Sequence: Synthetic oligonucleotide
  Target: ATXN1; (+) strand; PAM type: YTN; PAM sequence: CTA
gaaaggcagagttttaaaat

SEQ ID NO: 265746 - DNA, 20 bp, Artificial Sequence
  Description of Artificial Sequence: Synthetic oligonucleotide
  Target: ATXN1; (+) strand; PAM type: YTN; PAM sequence: TTT
taaaatgcacttacaccgtg

SEQ ID NO: 265747 - DNA, 20 bp, Artificial Sequence
  Description of Artificial Sequence: Synthetic oligonucleotide
  Target: ATXN1; (+) strand; PAM type: YTN; PAM sequence: TTT
aaaatgcacttacaccgtgg

SEQ ID NO: 265748 - DNA, 20 bp, Artificial Sequence
  Description of Artificial Sequence: Synthetic oligonucleotide
  Target: ATXN1; (+) strand; PAM type: YTN; PAM sequence: TTA
aaatgcacttacaccgtggg

SEQ ID NO: 265749 - DNA, 20 bp, Artificial Sequence
  Description of Artificial Sequence: Synthetic oligonucleotide
  Target: ATXN1; (+) strand; PAM type: YTN; PAM sequence: CTT
acaccgtgggcacccaataa

SEQ ID NO: 265750 - DNA, 20 bp, Artificial Sequence
  Description of Artificial Sequence: Synthetic oligonucleotide
  Target: ATXN1; (+) strand; PAM type: YTN; PAM sequence: TTA
caccgtgggcacccaataaa

SEQ ID NO: 265751 - DNA, 20 bp, Artificial Sequence
  Description of Artificial Sequence: Synthetic oligonucleotide
  Target: ATXN1; (+) strand; PAM type: YTN; PAM sequence: CTT
gatgaataaatgagtgaaat

SEQ ID NO: 265752 - DNA, 20 bp, Artificial Sequence
  Description of Artificial Sequence: Synthetic oligonucleotide
  Target: ATXN1; (+) strand; PAM type: YTN; PAM sequence: TTG
atgaataaatgagtgaaatg

SEQ ID NO: 265753 - DNA, 20 bp, Artificial Sequence
  Description of Artificial Sequence: Synthetic oligonucleotide
  Target: ATXN1; (+) strand; PAM type: YTN; PAM sequence: CTT
attgaaagttgtctgtgaca

SEQ ID NO: 265754 - DNA, 20 bp, Artificial Sequence
  Description of Artificial Sequence: Synthetic oligonucleotide
  Target: ATXN1; (+) strand; PAM type: YTN; PAM sequence: TTA
ttgaaagttgtctgtgacat

SEQ ID NO: 265755 - DNA, 20 bp, Artificial Sequence
  Description of Artificial Sequence: Synthetic oligonucleotide
  Target: ATXN1; (+) strand; PAM type: YTN; PAM sequence: TTG
aaagttgtctgtgacattct

SEQ ID NO: 265756 - DNA, 20 bp, Artificial Sequence
  Description of Artificial Sequence: Synthetic oligonucleotide
  Target: ATXN1; (+) strand; PAM type: YTN; PAM sequence: TTG
tctgtgacattctattaggg

SEQ ID NO: 265757 - DNA, 20 bp, Artificial Sequence
  Description of Artificial Sequence: Synthetic oligonucleotide
  Target: ATXN1; (+) strand; PAM type: YTN; PAM sequence: CTG
tgacattctattagggcctg

SEQ ID NO: 265758 - DNA, 20 bp, Artificial Sequence
  Description of Artificial Sequence: Synthetic oligonucleotide
  Target: ATXN1; (+) strand; PAM type: YTN; PAM sequence: TTC
tattagggcctgaaaaacca

SEQ ID NO: 265759 - DNA, 20 bp, Artificial Sequence
  Description of Artificial Sequence: Synthetic oligonucleotide
  Target: ATXN1; (+) strand; PAM type: YTN; PAM sequence: CTA
ttagggcctgaaaaaccaac

SEQ ID NO: 265760 - DNA, 20 bp, Artificial Sequence
  Description of Artificial Sequence: Synthetic oligonucleotide
  Target: ATXN1; (+) strand; PAM type: YTN; PAM sequence: TTA
gggcctgaaaaaccaacagc

SEQ ID NO: 265761 - DNA, 20 bp, Artificial Sequence
  Description of Artificial Sequence: Synthetic oligonucleotide
  Target: ATXN1; (+) strand; PAM type: YTN; PAM sequence: CTG
aaaaaccaacagcaattata

SEQ ID NO: 265762 - DNA, 20 bp, Artificial Sequence
  Description of Artificial Sequence: Synthetic oligonucleotide
  Target: ATXN1; (+) strand; PAM type: YTN; PAM sequence: TTA
tacaagagtcttgcccttaa

SEQ ID NO: 265763 - DNA, 20 bp, Artificial Sequence
  Description of Artificial Sequence: Synthetic oligonucleotide
  Target: ATXN1; (+) strand; PAM type: YTN; PAM sequence: CTT
gcccttaagaagcttctatt

SEQ ID NO: 265764 - DNA, 20 bp, Artificial Sequence
  Description of Artificial Sequence: Synthetic oligonucleotide
  Target: ATXN1; (+) strand; PAM type: YTN; PAM sequence: TTG
cccttaagaagcttctattc

SEQ ID NO: 265765 - DNA, 20 bp, Artificial Sequence
  Description of Artificial Sequence: Synthetic oligonucleotide
  Target: ATXN1; (+) strand; PAM type: YTN; PAM sequence: CTT
aagaagcttctattctatca

SEQ ID NO: 265766 - DNA, 20 bp, Artificial Sequence
  Description of Artificial Sequence: Synthetic oligonucleotide
  Target: ATXN1; (+) strand; PAM type: YTN; PAM sequence: TTA
agaagcttctattctatcag

SEQ ID NO: 265767 - DNA, 20 bp, Artificial Sequence
  Description of Artificial Sequence: Synthetic oligonucleotide
  Target: ATXN1; (+) strand; PAM type: YTN; PAM sequence: CTT
ctattctatcaggagaagca

SEQ ID NO: 265768 - DNA, 20 bp, Artificial Sequence
  Description of Artificial Sequence: Synthetic oligonucleotide
  Target: ATXN1; (+) strand; PAM type: YTN; PAM sequence: TTC
tattctatcaggagaagcaa

SEQ ID NO: 265769 - DNA, 20 bp, Artificial Sequence
  Description of Artificial Sequence: Synthetic oligonucleotide
  Target: ATXN1; (+) strand; PAM type: YTN; PAM sequence: CTA
ttctatcaggagaagcaaaa

SEQ ID NO: 265770 - DNA, 20 bp, Artificial Sequence
  Description of Artificial Sequence: Synthetic oligonucleotide
  Target: ATXN1; (+) strand; PAM type: YTN; PAM sequence: TTC
tatcaggagaagcaaaaata

SEQ ID NO: 265771 - DNA, 20 bp, Artificial Sequence
  Description of Artificial Sequence: Synthetic oligonucleotide
  Target: ATXN1; (+) strand; PAM type: YTN; PAM sequence: CTA
tcaggagaagcaaaaatata

SEQ ID NO: 265772 - DNA, 20 bp, Artificial Sequence
  Description of Artificial Sequence: Synthetic oligonucleotide
  Target: ATXN1; (+) strand; PAM type: YTN; PAM sequence: TTT
aatacagtgtgatacttgca

SEQ ID NO: 265773 - DNA, 20 bp, Artificial Sequence
  Description of Artificial Sequence: Synthetic oligonucleotide
  Target: ATXN1; (+) strand; PAM type: YTN; PAM sequence: TTA
atacagtgtgatacttgcag

SEQ ID NO: 265774 - DNA, 20 bp, Artificial Sequence
  Description of Artificial Sequence: Synthetic oligonucleotide
  Target: ATXN1; (+) strand; PAM type: YTN; PAM sequence: CTT
gcagtaataatgcaagacct

SEQ ID NO: 265775 - DNA, 20 bp, Artificial Sequence
  Description of Artificial Sequence: Synthetic oligonucleotide
  Target: ATXN1; (+) strand; PAM type: YTN; PAM sequence: TTG
cagtaataatgcaagacctt

SEQ ID NO: 265776 - DNA, 20 bp, Artificial Sequence
  Description of Artificial Sequence: Synthetic oligonucleotide
  Target: ATXN1; (+) strand; PAM type: YTN; PAM sequence: CTT
atcagggagcaattagtgaa

SEQ ID NO: 265777 - DNA, 20 bp, Artificial Sequence
  Description of Artificial Sequence: Synthetic oligonucleotide
  Target: ATXN1; (+) strand; PAM type: YTN; PAM sequence: TTA
tcagggagcaattagtgaag

SEQ ID NO: 265778 - DNA, 20 bp, Artificial Sequence
  Description of Artificial Sequence: Synthetic oligonucleotide
  Target: ATXN1; (+) strand; PAM type: YTN; PAM sequence: TTA
gtgaagaactaggcaagggg

SEQ ID NO: 265779 - DNA, 20 bp, Artificial Sequence
  Description of Artificial Sequence: Synthetic oligonucleotide
  Target: ATXN1; (+) strand; PAM type: YTN; PAM sequence: CTA
ggcaaggggttaaagaaagc

SEQ ID NO: 265780 - DNA, 20 bp, Artificial Sequence
  Description of Artificial Sequence: Synthetic oligonucleotide
  Target: ATXN1; (+) strand; PAM type: YTN; PAM sequence: TTA
aagaaagcttctaagatagg

SEQ ID NO: 265781 - DNA, 20 bp, Artificial Sequence
  Description of Artificial Sequence: Synthetic oligonucleotide
  Target: ATXN1; (+) strand; PAM type: YTN; PAM sequence: CTT
ctaagataggatctaattaa

SEQ ID NO: 265782 - DNA, 20 bp, Artificial Sequence
  Description of Artificial Sequence: Synthetic oligonucleotide
  Target: ATXN1; (+) strand; PAM type: YTN; PAM sequence: TTC
taagataggatctaattaaa

SEQ ID NO: 265783 - DNA, 20 bp, Artificial Sequence
  Description of Artificial Sequence: Synthetic oligonucleotide
  Target: ATXN1; (+) strand; PAM type: YTN; PAM sequence: CTA
agataggatctaattaaaca

SEQ ID NO: 265784 - DNA, 20 bp, Artificial Sequence
  Description of Artificial Sequence: Synthetic oligonucleotide
  Target: ATXN1; (+) strand; PAM type: YTN; PAM sequence: CTA
attaaacaaattcacaccaa

SEQ ID NO: 265785 - DNA, 20 bp, Artificial Sequence
  Description of Artificial Sequence: Synthetic oligonucleotide
  Target: ATXN1; (+) strand; PAM type: YTN; PAM sequence: TTA
aacaaattcacaccaaggtg

SEQ ID NO: 265786 - DNA, 20 bp, Artificial Sequence
  Description of Artificial Sequence: Synthetic oligonucleotide
  Target: ATXN1; (+) strand; PAM type: YTN; PAM sequence: TTC
acaccaaggtgctaatatct

SEQ ID NO: 265787 - DNA, 20 bp, Artificial Sequence
  Description of Artificial Sequence: Synthetic oligonucleotide
  Target: ATXN1; (+) strand; PAM type: YTN; PAM sequence: CTA
atatcttatctgtggcctct

SEQ ID NO: 265788 - DNA, 20 bp, Artificial Sequence
  Description of Artificial Sequence: Synthetic oligonucleotide
  Target: ATXN1; (+) strand; PAM type: YTN; PAM sequence: CTT
atctgtggcctctgccccag

SEQ ID NO: 265789 - DNA, 20 bp, Artificial Sequence
  Description of Artificial Sequence: Synthetic oligonucleotide
  Target: ATXN1; (+) strand; PAM type: YTN; PAM sequence: TTA
tctgtggcctctgccccagg

SEQ ID NO: 265790 - DNA, 20 bp, Artificial Sequence
  Description of Artificial Sequence: Synthetic oligonucleotide
  Target: ATXN1; (+) strand; PAM type: YTN; PAM sequence: CTG
tggcctctgccccaggatca

SEQ ID NO: 265791 - DNA, 20 bp, Artificial Sequence
  Description of Artificial Sequence: Synthetic oligonucleotide
  Target: ATXN1; (+) strand; PAM type: YTN; PAM sequence: CTC
tgccccaggatcatttgcat

SEQ ID NO: 265792 - DNA, 20 bp, Artificial Sequence
  Description of Artificial Sequence: Synthetic oligonucleotide
  Target: ATXN1; (+) strand; PAM type: YTN; PAM sequence: CTG
ccccaggatcatttgcattt

SEQ ID NO: 265793 - DNA, 20 bp, Artificial Sequence
  Description of Artificial Sequence: Synthetic oligonucleotide
  Target: ATXN1; (+) strand; PAM type: YTN; PAM sequence: TTT
gcattttaatagaaaactag

SEQ ID NO: 265794 - DNA, 20 bp, Artificial Sequence
  Description of Artificial Sequence: Synthetic oligonucleotide
  Target: ATXN1; (+) strand; PAM type: YTN; PAM sequence: TTG
cattttaatagaaaactagc

SEQ ID NO: 265795 - DNA, 20 bp, Artificial Sequence
  Description of Artificial Sequence: Synthetic oligonucleotide
  Target: ATXN1; (+) strand; PAM type: YTN; PAM sequence: TTT
taatagaaaactagctgatg

SEQ ID NO: 265796 - DNA, 20 bp, Artificial Sequence
  Description of Artificial Sequence: Synthetic oligonucleotide
  Target: ATXN1; (+) strand; PAM type: YTN; PAM sequence: TTT
aatagaaaactagctgatgg

SEQ ID NO: 265797 - DNA, 20 bp, Artificial Sequence
  Description of Artificial Sequence: Synthetic oligonucleotide
  Target: ATXN1; (+) strand; PAM type: YTN; PAM sequence: TTA
atagaaaactagctgatggc

SEQ ID NO: 265798 - DNA, 20 bp, Artificial Sequence
  Description of Artificial Sequence: Synthetic oligonucleotide
  Target: ATXN1; (+) strand; PAM type: YTN; PAM sequence: CTA
gctgatggctttgcttgata

SEQ ID NO: 265799 - DNA, 20 bp, Artificial Sequence
  Description of Artificial Sequence: Synthetic oligonucleotide
  Target: ATXN1; (+) strand; PAM type: YTN; PAM sequence: CTG
atggctttgcttgatacttg

SEQ ID NO: 265800 - DNA, 20 bp, Artificial Sequence
  Description of Artificial Sequence: Synthetic oligonucleotide
  Target: ATXN1; (+) strand; PAM type: YTN; PAM sequence: CTT
tgcttgatacttgaggactg

SEQ ID NO: 265801 - DNA, 20 bp, Artificial Sequence
  Description of Artificial Sequence: Synthetic oligonucleotide
  Target: ATXN1; (+) strand; PAM type: YTN; PAM sequence: TTT
gcttgatacttgaggactga

SEQ ID NO: 265802 - DNA, 20 bp, Artificial Sequence
  Description of Artificial Sequence: Synthetic oligonucleotide
  Target: ATXN1; (+) strand; PAM type: YTN; PAM sequence: TTG
cttgatacttgaggactgaa

SEQ ID NO: 265803 - DNA, 20 bp, Artificial Sequence
  Description of Artificial Sequence: Synthetic oligonucleotide
  Target: ATXN1; (+) strand; PAM type: YTN; PAM sequence: CTT
gatacttgaggactgaacta

SEQ ID NO: 265804 - DNA, 20 bp, Artificial Sequence
  Description of Artificial Sequence: Synthetic oligonucleotide
  Target: ATXN1; (+) strand; PAM type: YTN; PAM sequence: TTG
atacttgaggactgaactac

SEQ ID NO: 265805 - DNA, 20 bp, Artificial Sequence
  Description of Artificial Sequence: Synthetic oligonucleotide
  Target: ATXN1; (+) strand; PAM type: YTN; PAM sequence: CTT
gaggactgaactactattag

SEQ ID NO: 265806 - DNA, 20 bp, Artificial Sequence
  Description of Artificial Sequence: Synthetic oligonucleotide
  Target: ATXN1; (+) strand; PAM type: YTN; PAM sequence: TTG
aggactgaactactattagt

SEQ ID NO: 265807 - DNA, 20 bp, Artificial Sequence
  Description of Artificial Sequence: Synthetic oligonucleotide
  Target: ATXN1; (+) strand; PAM type: YTN; PAM sequence: CTG
aactactattagtagcattt

SEQ ID NO: 265808 - DNA, 20 bp, Artificial Sequence
  Description of Artificial Sequence: Synthetic oligonucleotide
  Target: ATXN1; (+) strand; PAM type: YTN; PAM sequence: CTA
ctattagtagcatttcaggc

SEQ ID NO: 265809 - DNA, 20 bp, Artificial Sequence
  Description of Artificial Sequence: Synthetic oligonucleotide
  Target: ATXN1; (+) strand; PAM type: YTN; PAM sequence: CTA
ttagtagcatttcaggcctc

SEQ ID NO: 265810 - DNA, 20 bp, Artificial Sequence
  Description of Artificial Sequence: Synthetic oligonucleotide
  Target: ATXN1; (+) strand; PAM type: YTN; PAM sequence: TTA
gtagcatttcaggcctcagg

SEQ ID NO: 265811 - DNA, 20 bp, Artificial Sequence
  Description of Artificial Sequence: Synthetic oligonucleotide
  Target: ATXN1; (+) strand; PAM type: YTN; PAM sequence: TTT
caggcctcaggaaagaggtc

SEQ ID NO: 265812 - DNA, 20 bp, Artificial Sequence
  Description of Artificial Sequence: Synthetic oligonucleotide
  Target: ATXN1; (+) strand; PAM type: YTN; PAM sequence: TTC
aggcctcaggaaagaggtca

SEQ ID NO: 265813 - DNA, 20 bp, Artificial Sequence
  Description of Artificial Sequence: Synthetic oligonucleotide
  Target: ATXN1; (+) strand; PAM type: YTN; PAM sequence: CTC
aggaaagaggtcagcagaaa

SEQ ID NO: 265814 - DNA, 20 bp, Artificial Sequence
  Description of Artificial Sequence: Synthetic oligonucleotide
  Target: ATXN1; (+) strand; PAM type: YTN; PAM sequence: CTT
caaataacactactaggcag

SEQ ID NO: 265815 - DNA, 20 bp, Artificial Sequence
  Description of Artificial Sequence: Synthetic oligonucleotide
  Target: ATXN1; (+) strand; PAM type: YTN; PAM sequence: TTC
aaataacactactaggcaga

SEQ ID NO: 265816 - DNA, 20 bp, Artificial Sequence
  Description of Artificial Sequence: Synthetic oligonucleotide
  Target: ATXN1; (+) strand; PAM type: YTN; PAM sequence: CTA
ctaggcagaaagtctaccta

SEQ ID NO: 265817 - DNA, 20 bp, Artificial Sequence
  Description of Artificial Sequence: Synthetic oligonucleotide
  Target: ATXN1; (+) strand; PAM type: YTN; PAM sequence: CTA
ggcagaaagtctacctacag

SEQ ID NO: 265818 - DNA, 20 bp, Artificial Sequence
  Description of Artificial Sequence: Synthetic oligonucleotide
  Target: ATXN1; (+) strand; PAM type: YTN; PAM sequence: CTA
cctacagttctatcatgaaa

SEQ ID NO: 265819 - DNA, 20 bp, Artificial Sequence
  Description of Artificial Sequence: Synthetic oligonucleotide
  Target: ATXN1; (+) strand; PAM type: YTN; PAM sequence: CTA
cagttctatcatgaaaaaag

SEQ ID NO: 265820 - DNA, 20 bp, Artificial Sequence
  Description of Artificial Sequence: Synthetic oligonucleotide
  Target: ATXN1; (+) strand; PAM type: YTN; PAM sequence: TTC
tatcatgaaaaaaggttcaa

SEQ ID NO: 265821 - DNA, 20 bp, Artificial Sequence
  Description of Artificial Sequence: Synthetic oligonucleotide
  Target: ATXN1; (+) strand; PAM type: YTN; PAM sequence: CTA
tcatgaaaaaaggttcaaag

SEQ ID NO: 265822 - DNA, 20 bp, Artificial Sequence
  Description of Artificial Sequence: Synthetic oligonucleotide
  Target: ATXN1; (+) strand; PAM type: YTN; PAM sequence: TTC
aaagtgggtagatgcaaggc

SEQ ID NO: 265823 - DNA, 20 bp, Artificial Sequence
  Description of Artificial Sequence: Synthetic oligonucleotide
  Target: ATXN1; (+) strand; PAM type: YTN; PAM sequence: CTT
cttcaaacacttgtatctaa

SEQ ID NO: 265824 - DNA, 20 bp, Artificial Sequence
  Description of Artificial Sequence: Synthetic oligonucleotide
  Target: ATXN1; (+) strand; PAM type: YTN; PAM sequence: TTC
ttcaaacacttgtatctaat

SEQ ID NO: 265825 - DNA, 20 bp, Artificial Sequence
  Description of Artificial Sequence: Synthetic oligonucleotide
  Target: ATXN1; (+) strand; PAM type: YTN; PAM sequence: CTT
caaacacttgtatctaataa

SEQ ID NO: 265826 - DNA, 20 bp, Artificial Sequence
  Description of Artificial Sequence: Synthetic oligonucleotide
  Target: ATXN1; (+) strand; PAM type: YTN; PAM sequence: TTC
aaacacttgtatctaataaa

SEQ ID NO: 265827 - DNA, 20 bp, Artificial Sequence
  Description of Artificial Sequence: Synthetic oligonucleotide
  Target: ATXN1; (+) strand; PAM type: YTN; PAM sequence: CTT
gtatctaataaagacgtgaa

SEQ ID NO: 265828 - DNA, 20 bp, Artificial Sequence
  Description of Artificial Sequence: Synthetic oligonucleotide
  Target: ATXN1; (+) strand; PAM type: YTN; PAM sequence: TTG
tatctaataaagacgtgaaa

SEQ ID NO: 265829 - DNA, 20 bp, Artificial Sequence
  Description of Artificial Sequence: Synthetic oligonucleotide
  Target: ATXN1; (+) strand; PAM type: YTN; PAM sequence: CTA
ataaagacgtgaaagagagt

SEQ ID NO: 265830 - DNA, 20 bp, Artificial Sequence
  Description of Artificial Sequence: Synthetic oligonucleotide
  Target: ATXN1; (+) strand; PAM type: YTN; PAM sequence: TTG
gtgaagactgggtgcggtgg

SEQ ID NO: 265831 - DNA, 20 bp, Artificial Sequence
  Description of Artificial Sequence: Synthetic oligonucleotide
  Target: ATXN1; (+) strand; PAM type: YTN; PAM sequence: CTG
ggtgcggtggctcatgcctg

SEQ ID NO: 265832 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagtgct

SEQ ID NO: 265833 - DNA, 20 bp, Artificial Sequence
  Description of Artificial Sequence: Synthetic oligonucleotide
  Target: ATXN1; (+) strand; PAM type: YTN; PAM sequence: CTG
taatcccagtgctttgggag

SEQ ID NO: 265834 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcaggcag

SEQ ID NO: 265835 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaggcaga

SEQ ID NO: 265836 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaggcagat

SEQ ID NO: 265837 - DNA, 20 bp, Artificial Sequence
  Description of Artificial Sequence: Synthetic oligonucleotide
  Target: ATXN1; (+) strand; PAM type: YTN; PAM sequence: CTG
aggtcaggaatttgagacca

SEQ ID NO: 265838 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctgaccaacat

SEQ ID NO: 265839 - DNA, 20 bp, Artificial Sequence
  Description of Artificial Sequence: Synthetic oligonucleotide
  Target: ATXN1; (+) strand; PAM type: YTN; PAM sequence: TTG
agaccagcctgaccaacatg

SEQ ID NO: 265840 - DNA, 20 bp, Artificial Sequence
  Description of Artificial Sequence: Synthetic oligonucleotide
  Target: ATXN1; (+) strand; PAM type: YTN; PAM sequence: CTG
accaacatggcaaaaccctg

SEQ ID NO: 265841 - DNA, 20 bp, Artificial Sequence
  Description of Artificial Sequence: Synthetic oligonucleotide
  Target: ATXN1; (+) strand; PAM type: YTN; PAM sequence: CTG
accctactaaaaatacaaaa

SEQ ID NO: 265842 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaattagcc

SEQ ID NO: 265843 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaattagcctgg

SEQ ID NO: 265844 - DNA, 20 bp, Artificial Sequence
  Description of Artificial Sequence: Synthetic oligonucleotide
  Target: ATXN1; (+) strand; PAM type: YTN; PAM sequence: TTA
gcctggtgtggtggcgggca

SEQ ID NO: 265845 - DNA, 20 bp, Artificial Sequence
  Description of Artificial Sequence: Synthetic oligonucleotide
  Target: ATXN1; (+) strand; PAM type: YTN; PAM sequence: CTG
gtgtggtggcgggcacctgt

SEQ ID NO: 265846 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 265847 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcaaca

SEQ ID NO: 265848 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaacagaa

SEQ ID NO: 265849 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaacagaat

SEQ ID NO: 265850 - DNA, 20 bp, Artificial Sequence
  Description of Artificial Sequence: Synthetic oligonucleotide
  Target: ATXN1; (+) strand; PAM type: YTN; PAM sequence: CTG
aggcaacagaattgcttgaa

SEQ ID NO: 265851 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggaggcagag

SEQ ID NO: 265852 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggtt

SEQ ID NO: 265853 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggttt

SEQ ID NO: 265854 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttttgagcc

SEQ ID NO: 265855 - DNA, 20 bp, Artificial Sequence
  Description of Artificial Sequence: Synthetic oligonucleotide
  Target: ATXN1; (+) strand; PAM type: YTN; PAM sequence: TTT
tgagccgagatcacaccact

SEQ ID NO: 265856 - DNA, 20 bp, Artificial Sequence
  Description of Artificial Sequence: Synthetic oligonucleotide
  Target: ATXN1; (+) strand; PAM type: YTN; PAM sequence: TTT
gagccgagatcacaccactg

SEQ ID NO: 265857 - DNA, 20 bp, Artificial Sequence
  Description of Artificial Sequence: Synthetic oligonucleotide
  Target: ATXN1; (+) strand; PAM type: YTN; PAM sequence: TTG
agccgagatcacaccactgc

SEQ ID NO: 265858 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacaa

SEQ ID NO: 265859 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagagca

SEQ ID NO: 265860 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcaaaactct

SEQ ID NO: 265861 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 265862 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaga

SEQ ID NO: 265863 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaagaaaaa

SEQ ID NO: 265864 - DNA, 20 bp, Artificial Sequence
  Description of Artificial Sequence: Synthetic oligonucleotide
  Target: ATXN1; (+) strand; PAM type: YTN; PAM sequence: TTG
atgaatggtttcaaagagtt

SEQ ID NO: 265865 - DNA, 20 bp, Artificial Sequence
  Description of Artificial Sequence: Synthetic oligonucleotide
  Target: ATXN1; (+) strand; PAM type: YTN; PAM sequence: TTT
caaagagtttcaaagagata

SEQ ID NO: 265866 - DNA, 20 bp, Artificial Sequence
  Description of Artificial Sequence: Synthetic oligonucleotide
  Target: ATXN1; (+) strand; PAM type: YTN; PAM sequence: TTC
aaagagtttcaaagagatat

SEQ ID NO: 265867 - DNA, 20 bp, Artificial Sequence
  Description of Artificial Sequence: Synthetic oligonucleotide
  Target: ATXN1; (+) strand; PAM type: YTN; PAM sequence: TTT
caaagagatatttgcacact

SEQ ID NO: 265868 - DNA, 20 bp, Artificial Sequence
  Description of Artificial Sequence: Synthetic oligonucleotide
  Target: ATXN1; (+) strand; PAM type: YTN; PAM sequence: TTC
aaagagatatttgcacactc

SEQ ID NO: 265869 - DNA, 20 bp, Artificial Sequence
  Description of Artificial Sequence: Synthetic oligonucleotide
  Target: ATXN1; (+) strand; PAM type: YTN; PAM sequence: TTT
gcacactcatatccatagca

SEQ ID NO: 265870 - DNA, 20 bp, Artificial Sequence
  Description of Artificial Sequence: Synthetic oligonucleotide
  Target: ATXN1; (+) strand; PAM type: YTN; PAM sequence: TTG
cacactcatatccatagcag

SEQ ID NO: 265871 - DNA, 20 bp, Artificial Sequence
  Description of Artificial Sequence: Synthetic oligonucleotide
  Target: ATXN1; (+) strand; PAM type: YTN; PAM sequence: CTC
atatccatagcagcattatt

SEQ ID NO: 265872 - DNA, 20 bp, Artificial Sequence
  Description of Artificial Sequence: Synthetic oligonucleotide
  Target: ATXN1; (+) strand; PAM type: YTN; PAM sequence: TTA
ttaacaataaactaaaggtg

SEQ ID NO: 265873 - DNA, 20 bp, Artificial Sequence
  Description of Artificial Sequence: Synthetic oligonucleotide
  Target: ATXN1; (+) strand; PAM type: YTN; PAM sequence: TTA
acaataaactaaaggtggaa

SEQ ID NO: 265874 - DNA, 20 bp, Artificial Sequence
  Description of Artificial Sequence: Synthetic oligonucleotide
  Target: ATXN1; (+) strand; PAM type: YTN; PAM sequence: CTA
aaggtggaagcaacccaagt

SEQ ID NO: 265875 - DNA, 20 bp, Artificial Sequence
  Description of Artificial Sequence: Synthetic oligonucleotide
  Target: ATXN1; (+) strand; PAM type: YTN; PAM sequence: CTG
atagatgaaggataagctaa

SEQ ID NO: 265876 - DNA, 20 bp, Artificial Sequence
  Description of Artificial Sequence: Synthetic oligonucleotide
  Target: ATXN1; (+) strand; PAM type: YTN; PAM sequence: CTA
aatgtggtctacacatacaa

SEQ ID NO: 265877 - DNA, 20 bp, Artificial Sequence
  Description of Artificial Sequence: Synthetic oligonucleotide
  Target: ATXN1; (+) strand; PAM type: YTN; PAM sequence: CTA
cacatacaacagaatattat

SEQ ID NO: 265878 - DNA, 20 bp, Artificial Sequence
  Description of Artificial Sequence: Synthetic oligonucleotide
  Target: ATXN1; (+) strand; PAM type: YTN; PAM sequence: TTA
ttcagtctaaaaaggaagga

SEQ ID NO: 265879 - DNA, 20 bp, Artificial Sequence
  Description of Artificial Sequence: Synthetic oligonucleotide
  Target: ATXN1; (+) strand; PAM type: YTN; PAM sequence: TTC
agtctaaaaaggaaggaaat

SEQ ID NO: 265880 - DNA, 20 bp, Artificial Sequence
  Description of Artificial Sequence: Synthetic oligonucleotide
  Target: ATXN1; (+) strand; PAM type: YTN; PAM sequence: CTA
aaaaggaaggaaattctgac

SEQ ID NO: 265881 - DNA, 20 bp, Artificial Sequence
  Description of Artificial Sequence: Synthetic oligonucleotide
  Target: ATXN1; (+) strand; PAM type: YTN; PAM sequence: TTC
tgacatgctatagcacagac

SEQ ID NO: 265882 - DNA, 20 bp, Artificial Sequence
  Description of Artificial Sequence: Synthetic oligonucleotide
  Target: ATXN1; (+) strand; PAM type: YTN; PAM sequence: CTG
acatgctatagcacagacag

SEQ ID NO: 265883 - DNA, 20 bp, Artificial Sequence
  Description of Artificial Sequence: Synthetic oligonucleotide
  Target: ATXN1; (+) strand; PAM type: YTN; PAM sequence: CTA
tagcacagacagacctgaag

SEQ ID NO: 265884 - DNA, 20 bp, Artificial Sequence
  Description of Artificial Sequence: Synthetic oligonucleotide
  Target: ATXN1; (+) strand; PAM type: YTN; PAM sequence: CTG
aaggacattatgctcagtga

SEQ ID NO: 265885 - DNA, 20 bp, Artificial Sequence
  Description of Artificial Sequence: Synthetic oligonucleotide
  Target: ATXN1; (+) strand; PAM type: YTN; PAM sequence: TTA
tgctcagtgaaatgagccag

SEQ ID NO: 265886 - DNA, 20 bp, Artificial Sequence
  Description of Artificial Sequence: Synthetic oligonucleotide
  Target: ATXN1; (+) strand; PAM type: YTN; PAM sequence: CTC
agtgaaatgagccaggcaca

SEQ ID NO: 265887 - DNA, 20 bp, Artificial Sequence
  Description of Artificial Sequence: Synthetic oligonucleotide
  Target: ATXN1; (+) strand; PAM type: YTN; PAM sequence: CTA
catgattccacttatatgag

SEQ ID NO: 265888 - DNA, 20 bp, Artificial Sequence
  Description of Artificial Sequence: Synthetic oligonucleotide
  Target: ATXN1; (+) strand; PAM type: YTN; PAM sequence: TTC
cacttatatgagccacttac

SEQ ID NO: 265889 - DNA, 20 bp, Artificial Sequence
  Description of Artificial Sequence: Synthetic oligonucleotide
  Target: ATXN1; (+) strand; PAM type: YTN; PAM sequence: CTT
atatgagccacttacagtag

SEQ ID NO: 265890 - DNA, 20 bp, Artificial Sequence
  Description of Artificial Sequence: Synthetic oligonucleotide
  Target: ATXN1; (+) strand; PAM type: YTN; PAM sequence: TTA
tatgagccacttacagtagt

SEQ ID NO: 265891 - DNA, 20 bp, Artificial Sequence
  Description of Artificial Sequence: Synthetic oligonucleotide
  Target: ATXN1; (+) strand; PAM type: YTN; PAM sequence: CTT
acagtagtcaaaataataga

SEQ ID NO: 265892 - DNA, 20 bp, Artificial Sequence
  Description of Artificial Sequence: Synthetic oligonucleotide
  Target: ATXN1; (+) strand; PAM type: YTN; PAM sequence: TTA
cagtagtcaaaataatagac

SEQ ID NO: 265893 - DNA, 20 bp, Artificial Sequence
  Description of Artificial Sequence: Synthetic oligonucleotide
  Target: ATXN1; (+) strand; PAM type: YTN; PAM sequence: CTG
ccgggggctagggtggaggg

SEQ ID NO: 265894 - DNA, 20 bp, Artificial Sequence
  Description of Artificial Sequence: Synthetic oligonucleotide
  Target: ATXN1; (+) strand; PAM type: YTN; PAM sequence: CTA
gggtggagggtagagcatta

SEQ ID NO: 265895 - DNA, 20 bp, Artificial Sequence
  Description of Artificial Sequence: Synthetic oligonucleotide
  Target: ATXN1; (+) strand; PAM type: YTN; PAM sequence: TTA
gtattttatgggtctagatt

SEQ ID NO: 265896 - DNA, 20 bp, Artificial Sequence
  Description of Artificial Sequence: Synthetic oligonucleotide
  Target: ATXN1; (+) strand; PAM type: YTN; PAM sequence: TTT
tatgggtctagattcagttt

SEQ ID NO: 265897 - DNA, 20 bp, Artificial Sequence
  Description of Artificial Sequence: Synthetic oligonucleotide
  Target: ATXN1; (+) strand; PAM type: YTN; PAM sequence: TTT
atgggtctagattcagtttt

SEQ ID NO: 265898 - DNA, 20 bp, Artificial Sequence
  Description of Artificial Sequence: Synthetic oligonucleotide
  Target: ATXN1; (+) strand; PAM type: YTN; PAM sequence: TTA
tgggtctagattcagttttg

SEQ ID NO: 265899 - DNA, 20 bp, Artificial Sequence
  Description of Artificial Sequence: Synthetic oligonucleotide
  Target: ATXN1; (+) strand; PAM type: YTN; PAM sequence: CTA
gattcagttttgccagaaaa

SEQ ID NO: 265900 - DNA, 20 bp, Artificial Sequence
  Description of Artificial Sequence: Synthetic oligonucleotide
  Target: ATXN1; (+) strand; PAM type: YTN; PAM sequence: TTC
agttttgccagaaaaaaaga

SEQ ID NO: 265901 - DNA, 20 bp, Artificial Sequence
  Description of Artificial Sequence: Synthetic oligonucleotide
  Target: ATXN1; (+) strand; PAM type: YTN; PAM sequence: TTT
tgccagaaaaaaagaggtgt

SEQ ID NO: 265902 - DNA, 20 bp, Artificial Sequence
  Description of Artificial Sequence: Synthetic oligonucleotide
  Target: ATXN1; (+) strand; PAM type: YTN; PAM sequence: TTT
gccagaaaaaaagaggtgtg

SEQ ID NO: 265903 - DNA, 20 bp, Artificial Sequence
  Description of Artificial Sequence: Synthetic oligonucleotide
  Target: ATXN1; (+) strand; PAM type: YTN; PAM sequence: TTG
ccagaaaaaaagaggtgtga

SEQ ID NO: 265904 - DNA, 20 bp, Artificial Sequence
  Description of Artificial Sequence: Synthetic oligonucleotide
  Target: ATXN1; (+) strand; PAM type: YTN; PAM sequence: CTT
cacatcaatatgaatgtaca

SEQ ID NO: 265905 - DNA, 20 bp, Artificial Sequence
  Description of Artificial Sequence: Synthetic oligonucleotide
  Target: ATXN1; (+) strand; PAM type: YTN; PAM sequence: TTC
acatcaatatgaatgtacaa

SEQ ID NO: 265906 - DNA, 20 bp, Artificial Sequence
  Description of Artificial Sequence: Synthetic oligonucleotide
  Target: ATXN1; (+) strand; PAM type: YTN; PAM sequence: CTA
tacacttaaaaatggctaag

SEQ ID NO: 265907 - DNA, 20 bp, Artificial Sequence
  Description of Artificial Sequence: Synthetic oligonucleotide
  Target: ATXN1; (+) strand; PAM type: YTN; PAM sequence: CTT
aaaaatggctaagacagtaa

SEQ ID NO: 265908 - DNA, 20 bp, Artificial Sequence
  Description of Artificial Sequence: Synthetic oligonucleotide
  Target: ATXN1; (+) strand; PAM type: YTN; PAM sequence: TTA
aaaatggctaagacagtaaa

SEQ ID NO: 265909 - DNA, 20 bp, Artificial Sequence
  Description of Artificial Sequence: Synthetic oligonucleotide
  Target: ATXN1; (+) strand; PAM type: YTN; PAM sequence: CTA
agacagtaaattttatgtta

SEQ ID NO: 265910 - DNA, 20 bp, Artificial Sequence
  Description of Artificial Sequence: Synthetic oligonucleotide
  Target: ATXN1; (+) strand; PAM type: YTN; PAM sequence: TTT
tatgttatgtgtactttact

SEQ ID NO: 265911 - DNA, 20 bp, Artificial Sequence
  Description of Artificial Sequence: Synthetic oligonucleotide
  Target: ATXN1; (+) strand; PAM type: YTN; PAM sequence: TTT
atgttatgtgtactttacta

SEQ ID NO: 265912 - DNA, 20 bp, Artificial Sequence
  Description of Artificial Sequence: Synthetic oligonucleotide
  Target: ATXN1; (+) strand; PAM type: YTN; PAM sequence: TTA
tgttatgtgtactttactat

SEQ ID NO: 265913 - DNA, 20 bp, Artificial Sequence
  Description of Artificial Sequence: Synthetic oligonucleotide
  Target: ATXN1; (+) strand; PAM type: YTN; PAM sequence: TTA
tgtgtactttactataataa

SEQ ID NO: 265914 - DNA, 20 bp, Artificial Sequence
  Description of Artificial Sequence: Synthetic oligonucleotide
  Target: ATXN1; (+) strand; PAM type: YTN; PAM sequence: CTT
tactataataaaaaaaactg

SEQ ID NO: 265915 - DNA, 20 bp, Artificial Sequence
  Description of Artificial Sequence: Synthetic oligonucleotide
  Target: ATXN1; (+) strand; PAM type: YTN; PAM sequence: TTT
actataataaaaaaaactgg

SEQ ID NO: 265916 - DNA, 20 bp, Artificial Sequence
  Description of Artificial Sequence: Synthetic oligonucleotide
  Target: ATXN1; (+) strand; PAM type: YTN; PAM sequence: TTA
ctataataaaaaaaactgga

SEQ ID NO: 265917 - DNA, 20 bp, Artificial Sequence
  Description of Artificial Sequence: Synthetic oligonucleotide
  Target: ATXN1; (+) strand; PAM type: YTN; PAM sequence: CTA
taataaaaaaaactggaaaa

SEQ ID NO: 265918 - DNA, 20 bp, Artificial Sequence
  Description of Artificial Sequence: Synthetic oligonucleotide
  Target: ATXN1; (+) strand; PAM type: YTN; PAM sequence: CTG
gaaaattatgttggtgaact

SEQ ID NO: 265919 - DNA, 20 bp, Artificial Sequence
  Description of Artificial Sequence: Synthetic oligonucleotide
  Target: ATXN1; (+) strand; PAM type: YTN; PAM sequence: TTA
tgttggtgaactataccata

SEQ ID NO: 265920 - DNA, 20 bp, Artificial Sequence
  Description of Artificial Sequence: Synthetic oligonucleotide
  Target: ATXN1; (+) strand; PAM type: YTN; PAM sequence: TTG
gtgaactataccatagcttt

SEQ ID NO: 265921 - DNA, 20 bp, Artificial Sequence
  Description of Artificial Sequence: Synthetic oligonucleotide
  Target: ATXN1; (+) strand; PAM type: YTN; PAM sequence: CTA
taccatagctttgaaactta

SEQ ID NO: 265922 - DNA, 20 bp, Artificial Sequence
  Description of Artificial Sequence: Synthetic oligonucleotide
  Target: ATXN1; (+) strand; PAM type: YTN; PAM sequence: CTT
tgaaacttacatgcaaagtt

SEQ ID NO: 265923 - DNA, 20 bp, Artificial Sequence
  Description of Artificial Sequence: Synthetic oligonucleotide
  Target: ATXN1; (+) strand; PAM type: YTN; PAM sequence: TTT
gaaacttacatgcaaagtta

SEQ ID NO: 265924 - DNA, 20 bp, Artificial Sequence
  Description of Artificial Sequence: Synthetic oligonucleotide
  Target: ATXN1; (+) strand; PAM type: YTN; PAM sequence: TTG
aaacttacatgcaaagttat

SEQ ID NO: 265925 - DNA, 20 bp, Artificial Sequence
  Description of Artificial Sequence: Synthetic oligonucleotide
  Target: ATXN1; (+) strand; PAM type: YTN; PAM sequence: CTT
acatgcaaagttatctgatt

SEQ ID NO: 265926 - DNA, 20 bp, Artificial Sequence
  Description of Artificial Sequence: Synthetic oligonucleotide
  Target: ATXN1; (+) strand; PAM type: YTN; PAM sequence: TTA
catgcaaagttatctgatta

SEQ ID NO: 265927 - DNA, 20 bp, Artificial Sequence
  Description of Artificial Sequence: Synthetic oligonucleotide
  Target: ATXN1; (+) strand; PAM type: YTN; PAM sequence: TTA
tctgattattattatgttag

SEQ ID NO: 265928 - DNA, 20 bp, Artificial Sequence
  Description of Artificial Sequence: Synthetic oligonucleotide
  Target: ATXN1; (+) strand; PAM type: YTN; PAM sequence: CTG
attattattatgttagctat

SEQ ID NO: 265929 - DNA, 20 bp, Artificial Sequence
  Description of Artificial Sequence: Synthetic oligonucleotide
  Target: ATXN1; (+) strand; PAM type: YTN; PAM sequence: TTA
ttattatgttagctatttta

SEQ ID NO: 265930 - DNA, 20 bp, Artificial Sequence
  Description of Artificial Sequence: Synthetic oligonucleotide
  Target: ATXN1; (+) strand; PAM type: YTN; PAM sequence: TTA
ttatgttagctattttatat

SEQ ID NO: 265931 - DNA, 20 bp, Artificial Sequence
  Description of Artificial Sequence: Synthetic oligonucleotide
  Target: ATXN1; (+) strand; PAM type: YTN; PAM sequence: TTA
tgttagctattttatatgga

SEQ ID NO: 265932 - DNA, 20 bp, Artificial Sequence
  Description of Artificial Sequence: Synthetic oligonucleotide
  Target: ATXN1; (+) strand; PAM type: YTN; PAM sequence: TTA
gctattttatatggaaagtt

SEQ ID NO: 265933 - DNA, 20 bp, Artificial Sequence
  Description of Artificial Sequence: Synthetic oligonucleotide
  Target: ATXN1; (+) strand; PAM type: YTN; PAM sequence: CTA
ttttatatggaaagttattg

SEQ ID NO: 265934 - DNA, 20 bp, Artificial Sequence
  Description of Artificial Sequence: Synthetic oligonucleotide
  Target: ATXN1; (+) strand; PAM type: YTN; PAM sequence: TTT
tatatggaaagttattggac

SEQ ID NO: 265935 - DNA, 20 bp, Artificial Sequence
  Description of Artificial Sequence: Synthetic oligonucleotide
  Target: ATXN1; (+) strand; PAM type: YTN; PAM sequence: TTT
atatggaaagttattggaca

SEQ ID NO: 265936 - DNA, 20 bp, Artificial Sequence
  Description of Artificial Sequence: Synthetic oligonucleotide
  Target: ATXN1; (+) strand; PAM type: YTN; PAM sequence: TTA
tatggaaagttattggacag

SEQ ID NO: 265937 - DNA, 20 bp, Artificial Sequence
  Description of Artificial Sequence: Synthetic oligonucleotide
  Target: ATXN1; (+) strand; PAM type: YTN; PAM sequence: TTA
ttggacagaagtcagaatgg

SEQ ID NO: 265938 - DNA, 20 bp, Artificial Sequence
  Description of Artificial Sequence: Synthetic oligonucleotide
  Target: ATXN1; (+) strand; PAM type: YTN; PAM sequence: TTG
gacagaagtcagaatgggta

SEQ ID NO: 265939 - DNA, 20 bp, Artificial Sequence
  Description of Artificial Sequence: Synthetic oligonucleotide
  Target: ATXN1; (+) strand; PAM type: YTN; PAM sequence: TTT
agactgattaggtagacagc

SEQ ID NO: 265940 - DNA, 20 bp, Artificial Sequence
  Description of Artificial Sequence: Synthetic oligonucleotide
  Target: ATXN1; (+) strand; PAM type: YTN; PAM sequence: TTA
gactgattaggtagacagct

SEQ ID NO: 265941 - DNA, 20 bp, Artificial Sequence
  Description of Artificial Sequence: Synthetic oligonucleotide
  Target: ATXN1; (+) strand; PAM type: YTN; PAM sequence: CTG
attaggtagacagctgcttg

SEQ ID NO: 265942 - DNA, 20 bp, Artificial Sequence
  Description of Artificial Sequence: Synthetic oligonucleotide
  Target: ATXN1; (+) strand; PAM type: YTN; PAM sequence: TTA
ggtagacagctgcttgcttc

SEQ ID NO: 265943 - DNA, 20 bp, Artificial Sequence
  Description of Artificial Sequence: Synthetic oligonucleotide
  Target: ATXN1; (+) strand; PAM type: YTN; PAM sequence: CTG
cttgcttcctaatctgtttg

SEQ ID NO: 265944 - DNA, 20 bp, Artificial Sequence
  Description of Artificial Sequence: Synthetic oligonucleotide
  Target: ATXN1; (+) strand; PAM type: YTN; PAM sequence: CTT
gcttcctaatctgtttgaaa

SEQ ID NO: 265945 - DNA, 20 bp, Artificial Sequence
  Description of Artificial Sequence: Synthetic oligonucleotide
  Target: ATXN1; (+) strand; PAM type: YTN; PAM sequence: TTG
cttcctaatctgtttgaaaa

SEQ ID NO: 265946 - DNA, 20 bp, Artificial Sequence
  Description of Artificial Sequence: Synthetic oligonucleotide
  Target: ATXN1; (+) strand; PAM type: YTN; PAM sequence: CTT
cctaatctgtttgaaaaatg

SEQ ID NO: 265947 - DNA, 20 bp, Artificial Sequence
  Description of Artificial Sequence: Synthetic oligonucleotide
  Target: ATXN1; (+) strand; PAM type: YTN; PAM sequence: TTC
ctaatctgtttgaaaaatga

SEQ ID NO: 265948 - DNA, 20 bp, Artificial Sequence
  Description of Artificial Sequence: Synthetic oligonucleotide
  Target: ATXN1; (+) strand; PAM type: YTN; PAM sequence: CTA
atctgtttgaaaaatgacac

SEQ ID NO: 265949 - DNA, 20 bp, Artificial Sequence
  Description of Artificial Sequence: Synthetic oligonucleotide
  Target: ATXN1; (+) strand; PAM type: YTN; PAM sequence: CTG
tttgaaaaatgacacccaaa

SEQ ID NO: 265950 - DNA, 20 bp, Artificial Sequence
  Description of Artificial Sequence: Synthetic oligonucleotide
  Target: ATXN1; (+) strand; PAM type: YTN; PAM sequence: TTT
gaaaaatgacacccaaaaga

SEQ ID NO: 265951 - DNA, 20 bp, Artificial Sequence
  Description of Artificial Sequence: Synthetic oligonucleotide
  Target: ATXN1; (+) strand; PAM type: YTN; PAM sequence: TTG
aaaaatgacacccaaaagat

SEQ ID NO: 265952 - DNA, 20 bp, Artificial Sequence
  Description of Artificial Sequence: Synthetic oligonucleotide
  Target: ATXN1; (+) strand; PAM type: YTN; PAM sequence: CTC
ccctgggatcagctgaaatc

SEQ ID NO: 265953 - DNA, 20 bp, Artificial Sequence
  Description of Artificial Sequence: Synthetic oligonucleotide
  Target: ATXN1; (+) strand; PAM type: YTN; PAM sequence: CTG
ggatcagctgaaatcaccat

SEQ ID NO: 265954 - DNA, 20 bp, Artificial Sequence
  Description of Artificial Sequence: Synthetic oligonucleotide
  Target: ATXN1; (+) strand; PAM type: YTN; PAM sequence: CTG
aaatcaccattaaaaaaatt

SEQ ID NO: 265955 - DNA, 20 bp, Artificial Sequence
  Description of Artificial Sequence: Synthetic oligonucleotide
  Target: ATXN1; (+) strand; PAM type: YTN; PAM sequence: TTA
aaaaaattcaggccatgctt

SEQ ID NO: 265956 - DNA, 20 bp, Artificial Sequence
  Description of Artificial Sequence: Synthetic oligonucleotide
  Target: ATXN1; (+) strand; PAM type: YTN; PAM sequence: TTC
aggccatgcttgtaatttca

SEQ ID NO: 265957 - DNA, 20 bp, Artificial Sequence
  Description of Artificial Sequence: Synthetic oligonucleotide
  Target: ATXN1; (+) strand; PAM type: YTN; PAM sequence: CTT
gtaatttcagcactttggga

SEQ ID NO: 265958 - DNA, 20 bp, Artificial Sequence
  Description of Artificial Sequence: Synthetic oligonucleotide
  Target: ATXN1; (+) strand; PAM type: YTN; PAM sequence: TTG
taatttcagcactttgggag

SEQ ID NO: 265959 - DNA, 20 bp, Artificial Sequence
  Description of Artificial Sequence: Synthetic oligonucleotide
  Target: ATXN1; (+) strand; PAM type: YTN; PAM sequence: TTT
cagcactttgggaggtcaag

SEQ ID NO: 265960 - DNA, 20 bp, Artificial Sequence
  Description of Artificial Sequence: Synthetic oligonucleotide
  Target: ATXN1; (+) strand; PAM type: YTN; PAM sequence: TTC
agcactttgggaggtcaaga

SEQ ID NO: 265961 - DNA, 20 bp, Artificial Sequence
  Description of Artificial Sequence: Synthetic oligonucleotide
  Target: ATXN1; (+) strand; PAM type: YTN; PAM sequence: CTT
tgggaggtcaagacaggagg

SEQ ID NO: 265962 - DNA, 20 bp, Artificial Sequence
  Description of Artificial Sequence: Synthetic oligonucleotide
  Target: ATXN1; (+) strand; PAM type: YTN; PAM sequence: TTT
gggaggtcaagacaggagga

SEQ ID NO: 265963 - DNA, 20 bp, Artificial Sequence
  Description of Artificial Sequence: Synthetic oligonucleotide
  Target: ATXN1; (+) strand; PAM type: YTN; PAM sequence: TTG
ggaggtcaagacaggaggat

SEQ ID NO: 265964 - DNA, 20 bp, Artificial Sequence
  Description of Artificial Sequence: Synthetic oligonucleotide
  Target: ATXN1; (+) strand; PAM type: YTN; PAM sequence: CTT
gaggccagggagtgtgagtc

SEQ ID NO: 265965 - DNA, 20 bp, Artificial Sequence
  Description of Artificial Sequence: Synthetic oligonucleotide
  Target: ATXN1; (+) strand; PAM type: YTN; PAM sequence: TTG
aggccagggagtgtgagtcc

SEQ ID NO: 265966 - DNA, 20 bp, Artificial Sequence
  Description of Artificial Sequence: Synthetic oligonucleotide
  Target: ATXN1; (+) strand; PAM type: YTN; PAM sequence: CTG
ggcaacatagtgagacttca

SEQ ID NO: 265967 - DNA, 20 bp, Artificial Sequence
  Description of Artificial Sequence: Synthetic oligonucleotide
  Target: ATXN1; (+) strand; PAM type: YTN; PAM sequence: CTT
catctctataaaaaataatt

SEQ ID NO: 265968 - DNA, 20 bp, Artificial Sequence
  Description of Artificial Sequence: Synthetic oligonucleotide
  Target: ATXN1; (+) strand; PAM type: YTN; PAM sequence: TTC
atctctataaaaaataatta

SEQ ID NO: 265969 - DNA, 20 bp, Artificial Sequence
  Description of Artificial Sequence: Synthetic oligonucleotide
  Target: ATXN1; (+) strand; PAM type: YTN; PAM sequence: CTC
tataaaaaataattaagaga

SEQ ID NO: 265970 - DNA, 20 bp, Artificial Sequence
  Description of Artificial Sequence: Synthetic oligonucleotide
  Target: ATXN1; (+) strand; PAM type: YTN; PAM sequence: CTA
taaaaaataattaagagaaa

SEQ ID NO: 265971 - DNA, 20 bp, Artificial Sequence
  Description of Artificial Sequence: Synthetic oligonucleotide
  Target: ATXN1; (+) strand; PAM type: YTN; PAM sequence: TTA
agagaaaaattaaatccttc

SEQ ID NO: 265972 - DNA, 20 bp, Artificial Sequence
  Description of Artificial Sequence: Synthetic oligonucleotide
  Target: ATXN1; (+) strand; PAM type: YTN; PAM sequence: TTA
aatccttccaacccttagcc

SEQ ID NO: 265973 - DNA, 20 bp, Artificial Sequence
  Description of Artificial Sequence: Synthetic oligonucleotide
  Target: ATXN1; (+) strand; PAM type: YTN; PAM sequence: CTT
ccaacccttagcctttgaaa

SEQ ID NO: 265974 - DNA, 20 bp, Artificial Sequence
  Description of Artificial Sequence: Synthetic oligonucleotide
  Target: ATXN1; (+) strand; PAM type: YTN; PAM sequence: TTC
caacccttagcctttgaaaa

SEQ ID NO: 265975 - DNA, 20 bp, Artificial Sequence
  Description of Artificial Sequence: Synthetic oligonucleotide
  Target: ATXN1; (+) strand; PAM type: YTN; PAM sequence: CTT
agcctttgaaaaatgcaatt

SEQ ID NO: 265976 - DNA, 20 bp, Artificial Sequence
  Description of Artificial Sequence: Synthetic oligonucleotide
  Target: ATXN1; (+) strand; PAM type: YTN; PAM sequence: TTA
gcctttgaaaaatgcaatta

SEQ ID NO: 265977 - DNA, 20 bp, Artificial Sequence
  Description of Artificial Sequence: Synthetic oligonucleotide
  Target: ATXN1; (+) strand; PAM type: YTN; PAM sequence: CTT
tgaaaaatgcaattatccta

SEQ ID NO: 265978 - DNA, 20 bp, Artificial Sequence
  Description of Artificial Sequence: Synthetic oligonucleotide
  Target: ATXN1; (+) strand; PAM type: YTN; PAM sequence: TTT
gaaaaatgcaattatcctag

SEQ ID NO: 265979 - DNA, 20 bp, Artificial Sequence
  Description of Artificial Sequence: Synthetic oligonucleotide
  Target: ATXN1; (+) strand; PAM type: YTN; PAM sequence: TTG
aaaaatgcaattatcctagc

SEQ ID NO: 265980 - DNA, 20 bp, Artificial Sequence
  Description of Artificial Sequence: Synthetic oligonucleotide
  Target: ATXN1; (+) strand; PAM type: YTN; PAM sequence: TTA
tcctagccaaggtctctatc

SEQ ID NO: 265981 - DNA, 20 bp, Artificial Sequence
  Description of Artificial Sequence: Synthetic oligonucleotide
  Target: ATXN1; (+) strand; PAM type: YTN; PAM sequence: CTA
gccaaggtctctatcagctt

SEQ ID NO: 265982 - DNA, 20 bp, Artificial Sequence
  Description of Artificial Sequence: Synthetic oligonucleotide
  Target: ATXN1; (+) strand; PAM type: YTN; PAM sequence: CTC
tatcagcttaatgtgagtgt

SEQ ID NO: 265983 - DNA, 20 bp, Artificial Sequence
  Description of Artificial Sequence: Synthetic oligonucleotide
  Target: ATXN1; (+) strand; PAM type: YTN; PAM sequence: CTA
tcagcttaatgtgagtgtct

SEQ ID NO: 265984 - DNA, 20 bp, Artificial Sequence
  Description of Artificial Sequence: Synthetic oligonucleotide
  Target: ATXN1; (+) strand; PAM type: YTN; PAM sequence: CTT
aatgtgagtgtctcaacaag

SEQ ID NO: 265985 - DNA, 20 bp, Artificial Sequence
  Description of Artificial Sequence: Synthetic oligonucleotide
  Target: ATXN1; (+) strand; PAM type: YTN; PAM sequence: TTA
atgtgagtgtctcaacaaga

SEQ ID NO: 265986 - DNA, 20 bp, Artificial Sequence
  Description of Artificial Sequence: Synthetic oligonucleotide
  Target: ATXN1; (+) strand; PAM type: YTN; PAM sequence: CTC
aacaagactgtttttctcca

SEQ ID NO: 265987 - DNA, 20 bp, Artificial Sequence
  Description of Artificial Sequence: Synthetic oligonucleotide
  Target: ATXN1; (+) strand; PAM type: YTN; PAM sequence: CTG
tttttctccacaggccaacc

SEQ ID NO: 265988 - DNA, 20 bp, Artificial Sequence
  Description of Artificial Sequence: Synthetic oligonucleotide
  Target: ATXN1; (+) strand; PAM type: YTN; PAM sequence: TTT
ttctccacaggccaaccaag

SEQ ID NO: 265989 - DNA, 20 bp, Artificial Sequence
  Description of Artificial Sequence: Synthetic oligonucleotide
  Target: ATXN1; (+) strand; PAM type: YTN; PAM sequence: TTT
tctccacaggccaaccaagg

SEQ ID NO: 265990 - DNA, 20 bp, Artificial Sequence
  Description of Artificial Sequence: Synthetic oligonucleotide
  Target: ATXN1; (+) strand; PAM type: YTN; PAM sequence: TTT
ctccacaggccaaccaaggt

SEQ ID NO: 265991 - DNA, 20 bp, Artificial Sequence
  Description of Artificial Sequence: Synthetic oligonucleotide
  Target: ATXN1; (+) strand; PAM type: YTN; PAM sequence: TTC
tccacaggccaaccaaggta

SEQ ID NO: 265992 - DNA, 20 bp, Artificial Sequence
  Description of Artificial Sequence: Synthetic oligonucleotide
  Target: ATXN1; (+) strand; PAM type: YTN; PAM sequence: CTC
cacaggccaaccaaggtacc

SEQ ID NO: 265993 - DNA, 20 bp, Artificial Sequence
  Description of Artificial Sequence: Synthetic oligonucleotide
  Target: ATXN1; (+) strand; PAM type: YTN; PAM sequence: CTA
gactgatgtgaggcatttgg

SEQ ID NO: 265994 - DNA, 20 bp, Artificial Sequence
  Description of Artificial Sequence: Synthetic oligonucleotide
  Target: ATXN1; (+) strand; PAM type: YTN; PAM sequence: CTG
atgtgaggcatttggaagag

SEQ ID NO: 265995 - DNA, 20 bp, Artificial Sequence
  Description of Artificial Sequence: Synthetic oligonucleotide
  Target: ATXN1; (+) strand; PAM type: YTN; PAM sequence: TTT
ggaagaggggaaagattcgt

SEQ ID NO: 265996 - DNA, 20 bp, Artificial Sequence
  Description of Artificial Sequence: Synthetic oligonucleotide
  Target: ATXN1; (+) strand; PAM type: YTN; PAM sequence: TTG
gaagaggggaaagattcgtc

SEQ ID NO: 265997 - DNA, 20 bp, Artificial Sequence
  Description of Artificial Sequence: Synthetic oligonucleotide
  Target: ATXN1; (+) strand; PAM type: YTN; PAM sequence: TTC
gtctggaaagggaacagaga

SEQ ID NO: 265998 - DNA, 20 bp, Artificial Sequence
  Description of Artificial Sequence: Synthetic oligonucleotide
  Target: ATXN1; (+) strand; PAM type: YTN; PAM sequence: CTG
gaaagggaacagagagtgac

SEQ ID NO: 265999 - DNA, 20 bp, Artificial Sequence
  Description of Artificial Sequence: Synthetic oligonucleotide
  Target: ATXN1; (+) strand; PAM type: YTN; PAM sequence: CTG
aaaggacaggcaggaaccac

SEQ ID NO: 266000 - DNA, 20 bp, Artificial Sequence
  Description of Artificial Sequence: Synthetic oligonucleotide
  Target: ATXN1; (+) strand; PAM type: YTN; PAM sequence: CTG
gaaacaaactgcgcctactt

SEQ ID NO: 266001 - DNA, 20 bp, Artificial Sequence
  Description of Artificial Sequence: Synthetic oligonucleotide
  Target: ATXN1; (+) strand; PAM type: YTN; PAM sequence: CTG
cgcctactttgaaatttccc

SEQ ID NO: 266002 - DNA, 20 bp, Artificial Sequence
  Description of Artificial Sequence: Synthetic oligonucleotide
  Target: ATXN1; (+) strand; PAM type: YTN; PAM sequence: CTA
ctttgaaatttcccccacag

SEQ ID NO: 266003 - DNA, 20 bp, Artificial Sequence
  Description of Artificial Sequence: Synthetic oligonucleotide
  Target: ATXN1; (+) strand; PAM type: YTN; PAM sequence: CTT
tgaaatttcccccacagcac

SEQ ID NO: 266004 - DNA, 20 bp, Artificial Sequence
  Description of Artificial Sequence: Synthetic oligonucleotide
  Target: ATXN1; (+) strand; PAM type: YTN; PAM sequence: TTT
gaaatttcccccacagcaca

SEQ ID NO: 266005 - DNA, 20 bp, Artificial Sequence
  Description of Artificial Sequence: Synthetic oligonucleotide
  Target: ATXN1; (+) strand; PAM type: YTN; PAM sequence: TTG
aaatttcccccacagcacag

SEQ ID NO: 266006 - DNA, 20 bp, Artificial Sequence
  Description of Artificial Sequence: Synthetic oligonucleotide
  Target: ATXN1; (+) strand; PAM type: YTN; PAM sequence: TTT
cccccacagcacagatgacc

SEQ ID NO: 266007 - DNA, 20 bp, Artificial Sequence
  Description of Artificial Sequence: Synthetic oligonucleotide
  Target: ATXN1; (+) strand; PAM type: YTN; PAM sequence: TTC
ccccacagcacagatgacct

SEQ ID NO: 266008 - DNA, 20 bp, Artificial Sequence
  Description of Artificial Sequence: Synthetic oligonucleotide
  Target: ATXN1; (+) strand; PAM type: YTN; PAM sequence: CTT
ttgccacaagttttcataca

SEQ ID NO: 266009 - DNA, 20 bp, Artificial Sequence
  Description of Artificial Sequence: Synthetic oligonucleotide
  Target: ATXN1; (+) strand; PAM type: YTN; PAM sequence: TTT
tgccacaagttttcatacaa

SEQ ID NO: 266010 - DNA, 20 bp, Artificial Sequence
  Description of Artificial Sequence: Synthetic oligonucleotide
  Target: ATXN1; (+) strand; PAM type: YTN; PAM sequence: TTT
gccacaagttttcatacaag

SEQ ID NO: 266011 - DNA, 20 bp, Artificial Sequence
  Description of Artificial Sequence: Synthetic oligonucleotide
  Target: ATXN1; (+) strand; PAM type: YTN; PAM sequence: TTG
ccacaagttttcatacaagc

SEQ ID NO: 266012 - DNA, 20 bp, Artificial Sequence
  Description of Artificial Sequence: Synthetic oligonucleotide
  Target: ATXN1; (+) strand; PAM type: YTN; PAM sequence: TTT
tcatacaagctttgctttct

SEQ ID NO: 266013 - DNA, 20 bp, Artificial Sequence
  Description of Artificial Sequence: Synthetic oligonucleotide
  Target: ATXN1; (+) strand; PAM type: YTN; PAM sequence: TTT
catacaagctttgctttctc

SEQ ID NO: 266014 - DNA, 20 bp, Artificial Sequence
  Description of Artificial Sequence: Synthetic oligonucleotide
  Target: ATXN1; (+) strand; PAM type: YTN; PAM sequence: TTC
atacaagctttgctttctca

SEQ ID NO: 266015 - DNA, 20 bp, Artificial Sequence
  Description of Artificial Sequence: Synthetic oligonucleotide
  Target: ATXN1; (+) strand; PAM type: YTN; PAM sequence: CTT
tgctttctcattccaataat

SEQ ID NO: 266016 - DNA, 20 bp, Artificial Sequence
  Description of Artificial Sequence: Synthetic oligonucleotide
  Target: ATXN1; (+) strand; PAM type: YTN; PAM sequence: TTT
gctttctcattccaataatc

SEQ ID NO: 266017 - DNA, 20 bp, Artificial Sequence
  Description of Artificial Sequence: Synthetic oligonucleotide
  Target: ATXN1; (+) strand; PAM type: YTN; PAM sequence: TTG
ctttctcattccaataatct

SEQ ID NO: 266018 - DNA, 20 bp, Artificial Sequence
  Description of Artificial Sequence: Synthetic oligonucleotide
  Target: ATXN1; (+) strand; PAM type: YTN; PAM sequence: CTT
tctcattccaataatctccc

SEQ ID NO: 266019 - DNA, 20 bp, Artificial Sequence
  Description of Artificial Sequence: Synthetic oligonucleotide
  Target: ATXN1; (+) strand; PAM type: YTN; PAM sequence: TTT
ctcattccaataatctccct

SEQ ID NO: 266020 - DNA, 20 bp, Artificial Sequence
  Description of Artificial Sequence: Synthetic oligonucleotide
  Target: ATXN1; (+) strand; PAM type: YTN; PAM sequence: TTC
tcattccaataatctccctg

SEQ ID NO: 266021 - DNA, 20 bp, Artificial Sequence
  Description of Artificial Sequence: Synthetic oligonucleotide
  Target: ATXN1; (+) strand; PAM type: YTN; PAM sequence: CTC
attccaataatctccctgct

SEQ ID NO: 266022 - DNA, 20 bp, Artificial Sequence
  Description of Artificial Sequence: Synthetic oligonucleotide
  Target: ATXN1; (+) strand; PAM type: YTN; PAM sequence: TTC
caataatctccctgctatct

SEQ ID NO: 266023 - DNA, 20 bp, Artificial Sequence
  Description of Artificial Sequence: Synthetic oligonucleotide
  Target: ATXN1; (+) strand; PAM type: YTN; PAM sequence: CTC
cctgctatctgaaagacttc

SEQ ID NO: 266024 - DNA, 20 bp, Artificial Sequence
  Description of Artificial Sequence: Synthetic oligonucleotide
  Target: ATXN1; (+) strand; PAM type: YTN; PAM sequence: CTG
ctatctgaaagacttctggc

SEQ ID NO: 266025 - DNA, 20 bp, Artificial Sequence
  Description of Artificial Sequence: Synthetic oligonucleotide
  Target: ATXN1; (+) strand; PAM type: YTN; PAM sequence: CTA
tctgaaagacttctggcaat

SEQ ID NO: 266026 - DNA, 20 bp, Artificial Sequence
  Description of Artificial Sequence: Synthetic oligonucleotide
  Target: ATXN1; (+) strand; PAM type: YTN; PAM sequence: CTG
aaagacttctggcaattaaa

SEQ ID NO: 266027 - DNA, 20 bp, Artificial Sequence
  Description of Artificial Sequence: Synthetic oligonucleotide
  Target: ATXN1; (+) strand; PAM type: YTN; PAM sequence: CTT
ctggcaattaaaacacacac

SEQ ID NO: 266028 - DNA, 20 bp, Artificial Sequence
  Description of Artificial Sequence: Synthetic oligonucleotide
  Target: ATXN1; (+) strand; PAM type: YTN; PAM sequence: TTC
tggcaattaaaacacacaca

SEQ ID NO: 266029 - DNA, 20 bp, Artificial Sequence
  Description of Artificial Sequence: Synthetic oligonucleotide
  Target: ATXN1; (+) strand; PAM type: YTN; PAM sequence: CTG
gcaattaaaacacacacaca

SEQ ID NO: 266030 - DNA, 20 bp, Artificial Sequence
  Description of Artificial Sequence: Synthetic oligonucleotide
  Target: ATXN1; (+) strand; PAM type: YTN; PAM sequence: TTA
aaacacacacacacacacac

SEQ ID NO: 266031 - DNA, 20 bp, Artificial Sequence
  Description of Artificial Sequence: Synthetic oligonucleotide
  Target: ATXN1; (+) strand; PAM type: YTN; PAM sequence: TTC
aaaacttgaaaagggcttca

SEQ ID NO: 266032 - DNA, 20 bp, Artificial Sequence
  Description of Artificial Sequence: Synthetic oligonucleotide
  Target: ATXN1; (+) strand; PAM type: YTN; PAM sequence: CTT
gaaaagggcttcatcagaag

SEQ ID NO: 266033 - DNA, 20 bp, Artificial Sequence
  Description of Artificial Sequence: Synthetic oligonucleotide
  Target: ATXN1; (+) strand; PAM type: YTN; PAM sequence: TTG
aaaagggcttcatcagaaga

SEQ ID NO: 266034 - DNA, 20 bp, Artificial Sequence
  Description of Artificial Sequence: Synthetic oligonucleotide
  Target: ATXN1; (+) strand; PAM type: YTN; PAM sequence: CTT
catcagaagatgaacaggtc

SEQ ID NO: 266035 - DNA, 20 bp, Artificial Sequence
  Description of Artificial Sequence: Synthetic oligonucleotide
  Target: ATXN1; (+) strand; PAM type: YTN; PAM sequence: TTC
atcagaagatgaacaggtct

SEQ ID NO: 266036 - DNA, 20 bp, Artificial Sequence
  Description of Artificial Sequence: Synthetic oligonucleotide
  Target: ATXN1; (+) strand; PAM type: YTN; PAM sequence: CTT
ctgcgaaataattcccaacc

SEQ ID NO: 266037 - DNA, 20 bp, Artificial Sequence
  Description of Artificial Sequence: Synthetic oligonucleotide
  Target: ATXN1; (+) strand; PAM type: YTN; PAM sequence: TTC
tgcgaaataattcccaacca

SEQ ID NO: 266038 - DNA, 20 bp, Artificial Sequence
  Description of Artificial Sequence: Synthetic oligonucleotide
  Target: ATXN1; (+) strand; PAM type: YTN; PAM sequence: CTG
cgaaataattcccaaccatc

SEQ ID NO: 266039 - DNA, 20 bp, Artificial Sequence
  Description of Artificial Sequence: Synthetic oligonucleotide
  Target: ATXN1; (+) strand; PAM type: YTN; PAM sequence: TTC
ccaaccatcacaatgtaagt

SEQ ID NO: 266040 - DNA, 20 bp, Artificial Sequence
  Description of Artificial Sequence: Synthetic oligonucleotide
  Target: ATXN1; (+) strand; PAM type: YTN; PAM sequence: TTA
atcacaggaagtaattttga

SEQ ID NO: 266041 - DNA, 20 bp, Artificial Sequence
  Description of Artificial Sequence: Synthetic oligonucleotide
  Target: ATXN1; (+) strand; PAM type: YTN; PAM sequence: TTT
tgaattttcagtgtcatcct

SEQ ID NO: 266042 - DNA, 20 bp, Artificial Sequence
  Description of Artificial Sequence: Synthetic oligonucleotide
  Target: ATXN1; (+) strand; PAM type: YTN; PAM sequence: TTT
gaattttcagtgtcatcctg

SEQ ID NO: 266043 - DNA, 20 bp, Artificial Sequence
  Description of Artificial Sequence: Synthetic oligonucleotide
  Target: ATXN1; (+) strand; PAM type: YTN; PAM sequence: TTG
aattttcagtgtcatcctga

SEQ ID NO: 266044 - DNA, 20 bp, Artificial Sequence
  Description of Artificial Sequence: Synthetic oligonucleotide
  Target: ATXN1; (+) strand; PAM type: YTN; PAM sequence: TTT
tcagtgtcatcctgaaactg

SEQ ID NO: 266045 - DNA, 20 bp, Artificial Sequence
  Description of Artificial Sequence: Synthetic oligonucleotide
  Target: ATXN1; (+) strand; PAM type: YTN; PAM sequence: TTT
cagtgtcatcctgaaactga

SEQ ID NO: 266046 - DNA, 20 bp, Artificial Sequence
  Description of Artificial Sequence: Synthetic oligonucleotide
  Target: ATXN1; (+) strand; PAM type: YTN; PAM sequence: TTC
agtgtcatcctgaaactgaa

SEQ ID NO: 266047 - DNA, 20 bp, Artificial Sequence
  Description of Artificial Sequence: Synthetic oligonucleotide
  Target: ATXN1; (+) strand; PAM type: YTN; PAM sequence: CTG
aaactgaactatggttagta

SEQ ID NO: 266048 - DNA, 20 bp, Artificial Sequence
  Description of Artificial Sequence: Synthetic oligonucleotide
  Target: ATXN1; (+) strand; PAM type: YTN; PAM sequence: CTG
aactatggttagtaatttga

SEQ ID NO: 266049 - DNA, 20 bp, Artificial Sequence
  Description of Artificial Sequence: Synthetic oligonucleotide
  Target: ATXN1; (+) strand; PAM type: YTN; PAM sequence: CTA
tggttagtaatttgagattg

SEQ ID NO: 266050 - DNA, 20 bp, Artificial Sequence
  Description of Artificial Sequence: Synthetic oligonucleotide
  Target: ATXN1; (+) strand; PAM type: YTN; PAM sequence: TTA
gtaatttgagattgagatga

SEQ ID NO: 266051 - DNA, 20 bp, Artificial Sequence
  Description of Artificial Sequence: Synthetic oligonucleotide
  Target: ATXN1; (+) strand; PAM type: YTN; PAM sequence: TTT
gagattgagatgaacgaagt

SEQ ID NO: 266052 - DNA, 20 bp, Artificial Sequence
  Description of Artificial Sequence: Synthetic oligonucleotide
  Target: ATXN1; (+) strand; PAM type: YTN; PAM sequence: TTG
agattgagatgaacgaagta

SEQ ID NO: 266053 - DNA, 20 bp, Artificial Sequence
  Description of Artificial Sequence: Synthetic oligonucleotide
  Target: ATXN1; (+) strand; PAM type: YTN; PAM sequence: TTG
agatgaacgaagtaaatgga

SEQ ID NO: 266054 - DNA, 20 bp, Artificial Sequence
  Description of Artificial Sequence: Synthetic oligonucleotide
  Target: ATXN1; (+) strand; PAM type: YTN; PAM sequence: CTT
agagctcggcattcctgagt

SEQ ID NO: 266055 - DNA, 20 bp, Artificial Sequence
  Description of Artificial Sequence: Synthetic oligonucleotide
  Target: ATXN1; (+) strand; PAM type: YTN; PAM sequence: TTA
gagctcggcattcctgagtt

SEQ ID NO: 266056 - DNA, 20 bp, Artificial Sequence
  Description of Artificial Sequence: Synthetic oligonucleotide
  Target: ATXN1; (+) strand; PAM type: YTN; PAM sequence: CTC
ggcattcctgagtttgctgc

SEQ ID NO: 266057 - DNA, 20 bp, Artificial Sequence
  Description of Artificial Sequence: Synthetic oligonucleotide
  Target: ATXN1; (+) strand; PAM type: YTN; PAM sequence: TTC
ctgagtttgctgcaatgagt

SEQ ID NO: 266058 - DNA, 20 bp, Artificial Sequence
  Description of Artificial Sequence: Synthetic oligonucleotide
  Target: ATXN1; (+) strand; PAM type: YTN; PAM sequence: CTG
agtttgctgcaatgagtagt

SEQ ID NO: 266059 - DNA, 20 bp, Artificial Sequence
  Description of Artificial Sequence: Synthetic oligonucleotide
  Target: ATXN1; (+) strand; PAM type: YTN; PAM sequence: TTT
gctgcaatgagtagttaagt

SEQ ID NO: 266060 - DNA, 20 bp, Artificial Sequence
  Description of Artificial Sequence: Synthetic oligonucleotide
  Target: ATXN1; (+) strand; PAM type: YTN; PAM sequence: TTG
ctgcaatgagtagttaagtt

SEQ ID NO: 266061 - DNA, 20 bp, Artificial Sequence
  Description of Artificial Sequence: Synthetic oligonucleotide
  Target: ATXN1; (+) strand; PAM type: YTN; PAM sequence: CTG
caatgagtagttaagtttga

SEQ ID NO: 266062 - DNA, 20 bp, Artificial Sequence
  Description of Artificial Sequence: Synthetic oligonucleotide
  Target: ATXN1; (+) strand; PAM type: YTN; PAM sequence: TTA
agtttgaagaatctagatat

SEQ ID NO: 266063 - DNA, 20 bp, Artificial Sequence
  Description of Artificial Sequence: Synthetic oligonucleotide
  Target: ATXN1; (+) strand; PAM type: YTN; PAM sequence: TTT
gaagaatctagatatgtgaa

SEQ ID NO: 266064 - DNA, 20 bp, Artificial Sequence
  Description of Artificial Sequence: Synthetic oligonucleotide
  Target: ATXN1; (+) strand; PAM type: YTN; PAM sequence: TTG
aagaatctagatatgtgaat

SEQ ID NO: 266065 - DNA, 20 bp, Artificial Sequence
  Description of Artificial Sequence: Synthetic oligonucleotide
  Target: ATXN1; (+) strand; PAM type: YTN; PAM sequence: CTA
gatatgtgaatgatgtaata

SEQ ID NO: 266066 - DNA, 20 bp, Artificial Sequence
  Description of Artificial Sequence: Synthetic oligonucleotide
  Target: ATXN1; (+) strand; PAM type: YTN; PAM sequence: TTG
gatcagaggggttttaatat

SEQ ID NO: 266067 - DNA, 20 bp, Artificial Sequence
  Description of Artificial Sequence: Synthetic oligonucleotide
  Target: ATXN1; (+) strand; PAM type: YTN; PAM sequence: TTT
taatattaagataagtgaca

SEQ ID NO: 266068 - DNA, 20 bp, Artificial Sequence
  Description of Artificial Sequence: Synthetic oligonucleotide
  Target: ATXN1; (+) strand; PAM type: YTN; PAM sequence: TTT
aatattaagataagtgacaa

SEQ ID NO: 266069 - DNA, 20 bp, Artificial Sequence
  Description of Artificial Sequence: Synthetic oligonucleotide
  Target: ATXN1; (+) strand; PAM type: YTN; PAM sequence: TTA
atattaagataagtgacaat

SEQ ID NO: 266070 - DNA, 20 bp, Artificial Sequence
  Description of Artificial Sequence: Synthetic oligonucleotide
  Target: ATXN1; (+) strand; PAM type: YTN; PAM sequence: TTA
agataagtgacaatgatagc

SEQ ID NO: 266071 - DNA, 20 bp, Artificial Sequence
  Description of Artificial Sequence: Synthetic oligonucleotide
  Target: ATXN1; (+) strand; PAM type: YTN; PAM sequence: CTC
acagtcatgaccttatgcct

SEQ ID NO: 266072 - DNA, 20 bp, Artificial Sequence
  Description of Artificial Sequence: Synthetic oligonucleotide
  Target: ATXN1; (+) strand; PAM type: YTN; PAM sequence: CTT
atgcctatatcatagagtga

SEQ ID NO: 266073 - DNA, 20 bp, Artificial Sequence
  Description of Artificial Sequence: Synthetic oligonucleotide
  Target: ATXN1; (+) strand; PAM type: YTN; PAM sequence: TTA
tgcctatatcatagagtgac

SEQ ID NO: 266074 - DNA, 20 bp, Artificial Sequence
  Description of Artificial Sequence: Synthetic oligonucleotide
  Target: ATXN1; (+) strand; PAM type: YTN; PAM sequence: CTA
tatcatagagtgacactaga

SEQ ID NO: 266075 - DNA, 20 bp, Artificial Sequence
  Description of Artificial Sequence: Synthetic oligonucleotide
  Target: ATXN1; (+) strand; PAM type: YTN; PAM sequence: CTA
gacagccagtgaaatgcaaa

SEQ ID NO: 266076 - DNA, 20 bp, Artificial Sequence
  Description of Artificial Sequence: Synthetic oligonucleotide
  Target: ATXN1; (+) strand; PAM type: YTN; PAM sequence: CTG
gattagattcgcacctctct

SEQ ID NO: 266077 - DNA, 20 bp, Artificial Sequence
  Description of Artificial Sequence: Synthetic oligonucleotide
  Target: ATXN1; (+) strand; PAM type: YTN; PAM sequence: TTA
gattcgcacctctctgtagc

SEQ ID NO: 266078 - DNA, 20 bp, Artificial Sequence
  Description of Artificial Sequence: Synthetic oligonucleotide
  Target: ATXN1; (+) strand; PAM type: YTN; PAM sequence: TTC
gcacctctctgtagctgggc

SEQ ID NO: 266079 - DNA, 20 bp, Artificial Sequence
  Description of Artificial Sequence: Synthetic oligonucleotide
  Target: ATXN1; (+) strand; PAM type: YTN; PAM sequence: CTC
tctgtagctgggcagctttc

SEQ ID NO: 266080 - DNA, 20 bp, Artificial Sequence
  Description of Artificial Sequence: Synthetic oligonucleotide
  Target: ATXN1; (+) strand; PAM type: YTN; PAM sequence: CTC
tgtagctgggcagctttcag

SEQ ID NO: 266081 - DNA, 20 bp, Artificial Sequence
  Description of Artificial Sequence: Synthetic oligonucleotide
  Target: ATXN1; (+) strand; PAM type: YTN; PAM sequence: CTG
tagctgggcagctttcagta

SEQ ID NO: 266082 - DNA, 20 bp, Artificial Sequence
  Description of Artificial Sequence: Synthetic oligonucleotide
  Target: ATXN1; (+) strand; PAM type: YTN; PAM sequence: CTG
ggcagctttcagtagagcat

SEQ ID NO: 266083 - DNA, 20 bp, Artificial Sequence
  Description of Artificial Sequence: Synthetic oligonucleotide
  Target: ATXN1; (+) strand; PAM type: YTN; PAM sequence: CTT
tcagtagagcatgtcaggag

SEQ ID NO: 266084 - DNA, 20 bp, Artificial Sequence
  Description of Artificial Sequence: Synthetic oligonucleotide
  Target: ATXN1; (+) strand; PAM type: YTN; PAM sequence: TTT
cagtagagcatgtcaggagt

SEQ ID NO: 266085 - DNA, 20 bp, Artificial Sequence
  Description of Artificial Sequence: Synthetic oligonucleotide
  Target: ATXN1; (+) strand; PAM type: YTN; PAM sequence: TTC
agtagagcatgtcaggagtg

SEQ ID NO: 266086 - DNA, 20 bp, Artificial Sequence
  Description of Artificial Sequence: Synthetic oligonucleotide
  Target: ATXN1; (+) strand; PAM type: YTN; PAM sequence: CTG
tcattgtaatatacagggag

SEQ ID NO: 266087 - DNA, 20 bp, Artificial Sequence
  Description of Artificial Sequence: Synthetic oligonucleotide
  Target: ATXN1; (+) strand; PAM type: YTN; PAM sequence: TTG
taatatacagggagtttaca

SEQ ID NO: 266088 - DNA, 20 bp, Artificial Sequence
  Description of Artificial Sequence: Synthetic oligonucleotide
  Target: ATXN1; (+) strand; PAM type: YTN; PAM sequence: TTT
acataagagaaggttggaag

SEQ ID NO: 266089 - DNA, 20 bp, Artificial Sequence
  Description of Artificial Sequence: Synthetic oligonucleotide
  Target: ATXN1; (+) strand; PAM type: YTN; PAM sequence: TTA
cataagagaaggttggaaga

SEQ ID NO: 266090 - DNA, 20 bp, Artificial Sequence
  Description of Artificial Sequence: Synthetic oligonucleotide
  Target: ATXN1; (+) strand; PAM type: YTN; PAM sequence: TTG
gaagagcaacaacaatttga

SEQ ID NO: 266091 - DNA, 20 bp, Artificial Sequence
  Description of Artificial Sequence: Synthetic oligonucleotide
  Target: ATXN1; (+) strand; PAM type: YTN; PAM sequence: TTT
gaattaaggtagcctatttt

SEQ ID NO: 266092 - DNA, 20 bp, Artificial Sequence
  Description of Artificial Sequence: Synthetic oligonucleotide
  Target: ATXN1; (+) strand; PAM type: YTN; PAM sequence: TTG
aattaaggtagcctattttt

SEQ ID NO: 266093 - DNA, 20 bp, Artificial Sequence
  Description of Artificial Sequence: Synthetic oligonucleotide
  Target: ATXN1; (+) strand; PAM type: YTN; PAM sequence: TTA
aggtagcctatttttcttta

SEQ ID NO: 266094 - DNA, 20 bp, Artificial Sequence
  Description of Artificial Sequence: Synthetic oligonucleotide
  Target: ATXN1; (+) strand; PAM type: YTN; PAM sequence: CTA
tttttctttataagacactc

SEQ ID NO: 266095 - DNA, 20 bp, Artificial Sequence
  Description of Artificial Sequence: Synthetic oligonucleotide
  Target: ATXN1; (+) strand; PAM type: YTN; PAM sequence: TTT
ttctttataagacactcgga

SEQ ID NO: 266096 - DNA, 20 bp, Artificial Sequence
  Description of Artificial Sequence: Synthetic oligonucleotide
  Target: ATXN1; (+) strand; PAM type: YTN; PAM sequence: TTT
tctttataagacactcggaa

SEQ ID NO: 266097 - DNA, 20 bp, Artificial Sequence
  Description of Artificial Sequence: Synthetic oligonucleotide
  Target: ATXN1; (+) strand; PAM type: YTN; PAM sequence: TTT
ctttataagacactcggaat

SEQ ID NO: 266098 - DNA, 20 bp, Artificial Sequence
  Description of Artificial Sequence: Synthetic oligonucleotide
  Target: ATXN1; (+) strand; PAM type: YTN; PAM sequence: TTC
tttataagacactcggaata

SEQ ID NO: 266099 - DNA, 20 bp, Artificial Sequence
  Description of Artificial Sequence: Synthetic oligonucleotide
  Target: ATXN1; (+) strand; PAM type: YTN; PAM sequence: CTT
tataagacactcggaatacc

SEQ ID NO: 266100 - DNA, 20 bp, Artificial Sequence
  Description of Artificial Sequence: Synthetic oligonucleotide
  Target: ATXN1; (+) strand; PAM type: YTN; PAM sequence: TTT
ataagacactcggaatacct

SEQ ID NO: 266101 - DNA, 20 bp, Artificial Sequence
  Description of Artificial Sequence: Synthetic oligonucleotide
  Target: ATXN1; (+) strand; PAM type: YTN; PAM sequence: TTA
taagacactcggaataccta

SEQ ID NO: 266102 - DNA, 20 bp, Artificial Sequence
  Description of Artificial Sequence: Synthetic oligonucleotide
  Target: ATXN1; (+) strand; PAM type: YTN; PAM sequence: CTC
ggaatacctaacaggcctta

SEQ ID NO: 266103 - DNA, 20 bp, Artificial Sequence
  Description of Artificial Sequence: Synthetic oligonucleotide
  Target: ATXN1; (+) strand; PAM type: YTN; PAM sequence: CTA
acaggccttaacttcatcaa

SEQ ID NO: 266104 - DNA, 20 bp, Artificial Sequence
  Description of Artificial Sequence: Synthetic oligonucleotide
  Target: ATXN1; (+) strand; PAM type: YTN; PAM sequence: CTT
aacttcatcaatctccgcac

SEQ ID NO: 266105 - DNA, 20 bp, Artificial Sequence
  Description of Artificial Sequence: Synthetic oligonucleotide
  Target: ATXN1; (+) strand; PAM type: YTN; PAM sequence: TTA
acttcatcaatctccgcacc

SEQ ID NO: 266106 - DNA, 20 bp, Artificial Sequence
  Description of Artificial Sequence: Synthetic oligonucleotide
  Target: ATXN1; (+) strand; PAM type: YTN; PAM sequence: CTT
catcaatctccgcaccatct

SEQ ID NO: 266107 - DNA, 20 bp, Artificial Sequence
  Description of Artificial Sequence: Synthetic oligonucleotide
  Target: ATXN1; (+) strand; PAM type: YTN; PAM sequence: TTC
atcaatctccgcaccatctg

SEQ ID NO: 266108 - DNA, 20 bp, Artificial Sequence
  Description of Artificial Sequence: Synthetic oligonucleotide
  Target: ATXN1; (+) strand; PAM type: YTN; PAM sequence: CTC
cgcaccatctgtcagacctt

SEQ ID NO: 266109 - DNA, 20 bp, Artificial Sequence
  Description of Artificial Sequence: Synthetic oligonucleotide
  Target: ATXN1; (+) strand; PAM type: YTN; PAM sequence: CTG
tcagaccttaggttacagtg

SEQ ID NO: 266110 - DNA, 20 bp, Artificial Sequence
  Description of Artificial Sequence: Synthetic oligonucleotide
  Target: ATXN1; (+) strand; PAM type: YTN; PAM sequence: CTT
aggttacagtgaccaccccc

SEQ ID NO: 266111 - DNA, 20 bp, Artificial Sequence
  Description of Artificial Sequence: Synthetic oligonucleotide
  Target: ATXN1; (+) strand; PAM type: YTN; PAM sequence: TTA
ggttacagtgaccaccccca

SEQ ID NO: 266112 - DNA, 20 bp, Artificial Sequence
  Description of Artificial Sequence: Synthetic oligonucleotide
  Target: ATXN1; (+) strand; PAM type: YTN; PAM sequence: TTA
cagtgaccacccccatgcat

SEQ ID NO: 266113 - DNA, 20 bp, Artificial Sequence
  Description of Artificial Sequence: Synthetic oligonucleotide
  Target: ATXN1; (+) strand; PAM type: YTN; PAM sequence: TTA
atcaagaagaggcaaccaag

SEQ ID NO: 266114 - DNA, 20 bp, Artificial Sequence
  Description of Artificial Sequence: Synthetic oligonucleotide
  Target: ATXN1; (+) strand; PAM type: YTN; PAM sequence: CTT
tgagaaaagttctgctcttt

SEQ ID NO: 266115 - DNA, 20 bp, Artificial Sequence
  Description of Artificial Sequence: Synthetic oligonucleotide
  Target: ATXN1; (+) strand; PAM type: YTN; PAM sequence: TTT
gagaaaagttctgctctttc

SEQ ID NO: 266116 - DNA, 20 bp, Artificial Sequence
  Description of Artificial Sequence: Synthetic oligonucleotide
  Target: ATXN1; (+) strand; PAM type: YTN; PAM sequence: TTG
agaaaagttctgctctttca

SEQ ID NO: 266117 - DNA, 20 bp, Artificial Sequence
  Description of Artificial Sequence: Synthetic oligonucleotide
  Target: ATXN1; (+) strand; PAM type: YTN; PAM sequence: TTC
tgctctttcagacttgactg

SEQ ID NO: 266118 - DNA, 20 bp, Artificial Sequence
  Description of Artificial Sequence: Synthetic oligonucleotide
  Target: ATXN1; (+) strand; PAM type: YTN; PAM sequence: CTG
ctctttcagacttgactgta

SEQ ID NO: 266119 - DNA, 20 bp, Artificial Sequence
  Description of Artificial Sequence: Synthetic oligonucleotide
  Target: ATXN1; (+) strand; PAM type: YTN; PAM sequence: CTC
tttcagacttgactgtatta

SEQ ID NO: 266120 - DNA, 20 bp, Artificial Sequence
  Description of Artificial Sequence: Synthetic oligonucleotide
  Target: ATXN1; (+) strand; PAM type: YTN; PAM sequence: CTT
tcagacttgactgtattatt

SEQ ID NO: 266121 - DNA, 20 bp, Artificial Sequence
  Description of Artificial Sequence: Synthetic oligonucleotide
  Target: ATXN1; (+) strand; PAM type: YTN; PAM sequence: TTT
cagacttgactgtattatta

SEQ ID NO: 266122 - DNA, 20 bp, Artificial Sequence
  Description of Artificial Sequence: Synthetic oligonucleotide
  Target: ATXN1; (+) strand; PAM type: YTN; PAM sequence: TTC
agacttgactgtattattaa

SEQ ID NO: 266123 - DNA, 20 bp, Artificial Sequence
  Description of Artificial Sequence: Synthetic oligonucleotide
  Target: ATXN1; (+) strand; PAM type: YTN; PAM sequence: CTT
gactgtattattaaaatttc

SEQ ID NO: 266124 - DNA, 20 bp, Artificial Sequence
  Description of Artificial Sequence: Synthetic oligonucleotide
  Target: ATXN1; (+) strand; PAM type: YTN; PAM sequence: TTG
actgtattattaaaatttct

SEQ ID NO: 266125 - DNA, 20 bp, Artificial Sequence
  Description of Artificial Sequence: Synthetic oligonucleotide
  Target: ATXN1; (+) strand; PAM type: YTN; PAM sequence: CTG
tattattaaaatttctaaaa

SEQ ID NO: 266126 - DNA, 20 bp, Artificial Sequence
  Description of Artificial Sequence: Synthetic oligonucleotide
  Target: ATXN1; (+) strand; PAM type: YTN; PAM sequence: TTA
ttaaaatttctaaaaaggta

SEQ ID NO: 266127 - DNA, 20 bp, Artificial Sequence
  Description of Artificial Sequence: Synthetic oligonucleotide
  Target: ATXN1; (+) strand; PAM type: YTN; PAM sequence: TTA
aaatttctaaaaaggtaaac

SEQ ID NO: 266128 - DNA, 20 bp, Artificial Sequence
  Description of Artificial Sequence: Synthetic oligonucleotide
  Target: ATXN1; (+) strand; PAM type: YTN; PAM sequence: TTT
ctaaaaaggtaaacaacagg

SEQ ID NO: 266129 - DNA, 20 bp, Artificial Sequence
  Description of Artificial Sequence: Synthetic oligonucleotide
  Target: ATXN1; (+) strand; PAM type: YTN; PAM sequence: TTC
taaaaaggtaaacaacagga

SEQ ID NO: 266130 - DNA, 20 bp, Artificial Sequence
  Description of Artificial Sequence: Synthetic oligonucleotide
  Target: ATXN1; (+) strand; PAM type: YTN; PAM sequence: CTA
aaaaggtaaacaacaggagg

SEQ ID NO: 266131 - DNA, 20 bp, Artificial Sequence
  Description of Artificial Sequence: Synthetic oligonucleotide
  Target: ATXN1; (+) strand; PAM type: YTN; PAM sequence: TTT
taatcacagtgttgactttg

SEQ ID NO: 266132 - DNA, 20 bp, Artificial Sequence
  Description of Artificial Sequence: Synthetic oligonucleotide
  Target: ATXN1; (+) strand; PAM type: YTN; PAM sequence: TTT
aatcacagtgttgactttga

SEQ ID NO: 266133 - DNA, 20 bp, Artificial Sequence
  Description of Artificial Sequence: Synthetic oligonucleotide
  Target: ATXN1; (+) strand; PAM type: YTN; PAM sequence: TTA
atcacagtgttgactttgat

SEQ ID NO: 266134 - DNA, 20 bp, Artificial Sequence
  Description of Artificial Sequence: Synthetic oligonucleotide
  Target: ATXN1; (+) strand; PAM type: YTN; PAM sequence: TTG
actttgattgcatacccatg

SEQ ID NO: 266135 - DNA, 20 bp, Artificial Sequence
  Description of Artificial Sequence: Synthetic oligonucleotide
  Target: ATXN1; (+) strand; PAM type: YTN; PAM sequence: CTT
tgattgcatacccatgtccc

SEQ ID NO: 266136 - DNA, 20 bp, Artificial Sequence
  Description of Artificial Sequence: Synthetic oligonucleotide
  Target: ATXN1; (+) strand; PAM type: YTN; PAM sequence: TTT
gattgcatacccatgtccct

SEQ ID NO: 266137 - DNA, 20 bp, Artificial Sequence
  Description of Artificial Sequence: Synthetic oligonucleotide
  Target: ATXN1; (+) strand; PAM type: YTN; PAM sequence: TTG
attgcatacccatgtccctg

SEQ ID NO: 266138 - DNA, 20 bp, Artificial Sequence
  Description of Artificial Sequence: Synthetic oligonucleotide
  Target: ATXN1; (+) strand; PAM type: YTN; PAM sequence: TTG
catacccatgtccctggcag

SEQ ID NO: 266139 - DNA, 20 bp, Artificial Sequence
  Description of Artificial Sequence: Synthetic oligonucleotide
  Target: ATXN1; (+) strand; PAM type: YTN; PAM sequence: CTG
gcagcttagaatggttacag

SEQ ID NO: 266140 - DNA, 20 bp, Artificial Sequence
  Description of Artificial Sequence: Synthetic oligonucleotide
  Target: ATXN1; (+) strand; PAM type: YTN; PAM sequence: CTT
agaatggttacagcgcttaa

SEQ ID NO: 266141 - DNA, 20 bp, Artificial Sequence
  Description of Artificial Sequence: Synthetic oligonucleotide
  Target: ATXN1; (+) strand; PAM type: YTN; PAM sequence: TTA
gaatggttacagcgcttaag

SEQ ID NO: 266142 - DNA, 20 bp, Artificial Sequence
  Description of Artificial Sequence: Synthetic oligonucleotide
  Target: ATXN1; (+) strand; PAM type: YTN; PAM sequence: TTA
cagcgcttaaggtaacatac

SEQ ID NO: 266143 - DNA, 20 bp, Artificial Sequence
  Description of Artificial Sequence: Synthetic oligonucleotide
  Target: ATXN1; (+) strand; PAM type: YTN; PAM sequence: CTT
aaggtaacatacaaagtgca

SEQ ID NO: 266144 - DNA, 20 bp, Artificial Sequence
  Description of Artificial Sequence: Synthetic oligonucleotide
  Target: ATXN1; (+) strand; PAM type: YTN; PAM sequence: TTA
aggtaacatacaaagtgcag

SEQ ID NO: 266145 - DNA, 20 bp, Artificial Sequence
  Description of Artificial Sequence: Synthetic oligonucleotide
  Target: ATXN1; (+) strand; PAM type: YTN; PAM sequence: CTG
acaaaactcagtgaaataac

SEQ ID NO: 266146 - DNA, 20 bp, Artificial Sequence
  Description of Artificial Sequence: Synthetic oligonucleotide
  Target: ATXN1; (+) strand; PAM type: YTN; PAM sequence: CTC
agtgaaataacacgcaggtg

SEQ ID NO: 266147 - DNA, 20 bp, Artificial Sequence
  Description of Artificial Sequence: Synthetic oligonucleotide
  Target: ATXN1; (+) strand; PAM type: YTN; PAM sequence: CTG
cgtcttcaccccacttccaa

SEQ ID NO: 266148 - DNA, 20 bp, Artificial Sequence
  Description of Artificial Sequence: Synthetic oligonucleotide
  Target: ATXN1; (+) strand; PAM type: YTN; PAM sequence: CTT
caccccacttccaaaaataa

SEQ ID NO: 266149 - DNA, 20 bp, Artificial Sequence
  Description of Artificial Sequence: Synthetic oligonucleotide
  Target: ATXN1; (+) strand; PAM type: YTN; PAM sequence: TTC
accccacttccaaaaataag

SEQ ID NO: 266150 - DNA, 20 bp, Artificial Sequence
  Description of Artificial Sequence: Synthetic oligonucleotide
  Target: ATXN1; (+) strand; PAM type: YTN; PAM sequence: CTT
ccaaaaataagaagattcta

SEQ ID NO: 266151 - DNA, 20 bp, Artificial Sequence
  Description of Artificial Sequence: Synthetic oligonucleotide
  Target: ATXN1; (+) strand; PAM type: YTN; PAM sequence: TTC
caaaaataagaagattctat

SEQ ID NO: 266152 - DNA, 20 bp, Artificial Sequence
  Description of Artificial Sequence: Synthetic oligonucleotide
  Target: ATXN1; (+) strand; PAM type: YTN; PAM sequence: TTC
tatttttttttactgtctac

SEQ ID NO: 266153 - DNA, 20 bp, Artificial Sequence
  Description of Artificial Sequence: Synthetic oligonucleotide
  Target: ATXN1; (+) strand; PAM type: YTN; PAM sequence: CTA
tttttttttactgtctactc

SEQ ID NO: 266154 - DNA, 20 bp, Artificial Sequence
  Description of Artificial Sequence: Synthetic oligonucleotide
  Target: ATXN1; (+) strand; PAM type: YTN; PAM sequence: TTT
ttttttactgtctactccat

SEQ ID NO: 266155 - DNA, 20 bp, Artificial Sequence
  Description of Artificial Sequence: Synthetic oligonucleotide
  Target: ATXN1; (+) strand; PAM type: YTN; PAM sequence: TTT
tttttactgtctactccata

SEQ ID NO: 266156 - DNA, 20 bp, Artificial Sequence
  Description of Artificial Sequence: Synthetic oligonucleotide
  Target: ATXN1; (+) strand; PAM type: YTN; PAM sequence: TTT
ttttactgtctactccatac

SEQ ID NO: 266157 - DNA, 20 bp, Artificial Sequence
  Description of Artificial Sequence: Synthetic oligonucleotide
  Target: ATXN1; (+) strand; PAM type: YTN; PAM sequence: TTT
tttactgtctactccataca

SEQ ID NO: 266158 - DNA, 20 bp, Artificial Sequence
  Description of Artificial Sequence: Synthetic oligonucleotide
  Target: ATXN1; (+) strand; PAM type: YTN; PAM sequence: TTT
ttactgtctactccatacac

SEQ ID NO: 266159 - DNA, 20 bp, Artificial Sequence
  Description of Artificial Sequence: Synthetic oligonucleotide
  Target: ATXN1; (+) strand; PAM type: YTN; PAM sequence: TTT
tactgtctactccatacact

SEQ ID NO: 266160 - DNA, 20 bp, Artificial Sequence
  Description of Artificial Sequence: Synthetic oligonucleotide
  Target: ATXN1; (+) strand; PAM type: YTN; PAM sequence: TTT
actgtctactccatacactc

SEQ ID NO: 266161 - DNA, 20 bp, Artificial Sequence
  Description of Artificial Sequence: Synthetic oligonucleotide
  Target: ATXN1; (+) strand; PAM type: YTN; PAM sequence: TTA
ctgtctactccatacactct

SEQ ID NO: 266162 - DNA, 20 bp, Artificial Sequence
  Description of Artificial Sequence: Synthetic oligonucleotide
  Target: ATXN1; (+) strand; PAM type: YTN; PAM sequence: CTG
tctactccatacactctaga

SEQ ID NO: 266163 - DNA, 20 bp, Artificial Sequence
  Description of Artificial Sequence: Synthetic oligonucleotide
  Target: ATXN1; (+) strand; PAM type: YTN; PAM sequence: CTA
ctccatacactctagaacag

SEQ ID NO: 266164 - DNA, 20 bp, Artificial Sequence
  Description of Artificial Sequence: Synthetic oligonucleotide
  Target: ATXN1; (+) strand; PAM type: YTN; PAM sequence: CTC
catacactctagaacagatt

SEQ ID NO: 266165 - DNA, 20 bp, Artificial Sequence
  Description of Artificial Sequence: Synthetic oligonucleotide
  Target: ATXN1; (+) strand; PAM type: YTN; PAM sequence: CTC
tagaacagattacatacata

SEQ ID NO: 266166 - DNA, 20 bp, Artificial Sequence
  Description of Artificial Sequence: Synthetic oligonucleotide
  Target: ATXN1; (+) strand; PAM type: YTN; PAM sequence: CTA
gaacagattacatacatatt

SEQ ID NO: 266167 - DNA, 20 bp, Artificial Sequence
  Description of Artificial Sequence: Synthetic oligonucleotide
  Target: ATXN1; (+) strand; PAM type: YTN; PAM sequence: TTA
catacatatttataaagaga

SEQ ID NO: 266168 - DNA, 20 bp, Artificial Sequence
  Description of Artificial Sequence: Synthetic oligonucleotide
  Target: ATXN1; (+) strand; PAM type: YTN; PAM sequence: TTT
ataaagagaaatgtattgtt

SEQ ID NO: 266169 - DNA, 20 bp, Artificial Sequence
  Description of Artificial Sequence: Synthetic oligonucleotide
  Target: ATXN1; (+) strand; PAM type: YTN; PAM sequence: TTA
taaagagaaatgtattgttt

SEQ ID NO: 266170 - DNA, 20 bp, Artificial Sequence
  Description of Artificial Sequence: Synthetic oligonucleotide
  Target: ATXN1; (+) strand; PAM type: YTN; PAM sequence: TTG
tttcaatattttatgcaaaa

SEQ ID NO: 266171 - DNA, 20 bp, Artificial Sequence
  Description of Artificial Sequence: Synthetic oligonucleotide
  Target: ATXN1; (+) strand; PAM type: YTN; PAM sequence: TTT
caatattttatgcaaaactt

SEQ ID NO: 266172 - DNA, 20 bp, Artificial Sequence
  Description of Artificial Sequence: Synthetic oligonucleotide
  Target: ATXN1; (+) strand; PAM type: YTN; PAM sequence: TTC
aatattttatgcaaaacttc

SEQ ID NO: 266173 - DNA, 20 bp, Artificial Sequence
  Description of Artificial Sequence: Synthetic oligonucleotide
  Target: ATXN1; (+) strand; PAM type: YTN; PAM sequence: TTT
tatgcaaaacttcatgtaag

SEQ ID NO: 266174 - DNA, 20 bp, Artificial Sequence
  Description of Artificial Sequence: Synthetic oligonucleotide
  Target: ATXN1; (+) strand; PAM type: YTN; PAM sequence: TTT
atgcaaaacttcatgtaagg

SEQ ID NO: 266175 - DNA, 20 bp, Artificial Sequence
  Description of Artificial Sequence: Synthetic oligonucleotide
  Target: ATXN1; (+) strand; PAM type: YTN; PAM sequence: TTA
tgcaaaacttcatgtaaggt

SEQ ID NO: 266176 - DNA, 20 bp, Artificial Sequence
  Description of Artificial Sequence: Synthetic oligonucleotide
  Target: ATXN1; (+) strand; PAM type: YTN; PAM sequence: CTT
catgtaaggtcatgtgtttg

SEQ ID NO: 266177 - DNA, 20 bp, Artificial Sequence
  Description of Artificial Sequence: Synthetic oligonucleotide
  Target: ATXN1; (+) strand; PAM type: YTN; PAM sequence: TTC
atgtaaggtcatgtgtttgt

SEQ ID NO: 266178 - DNA, 20 bp, Artificial Sequence
  Description of Artificial Sequence: Synthetic oligonucleotide
  Target: ATXN1; (+) strand; PAM type: YTN; PAM sequence: TTT
gtacagcacaaaacatggaa

SEQ ID NO: 266179 - DNA, 20 bp, Artificial Sequence
  Description of Artificial Sequence: Synthetic oligonucleotide
  Target: ATXN1; (+) strand; PAM type: YTN; PAM sequence: TTG
tacagcacaaaacatggaat

SEQ ID NO: 266180 - DNA, 20 bp, Artificial Sequence
  Description of Artificial Sequence: Synthetic oligonucleotide
  Target: ATXN1; (+) strand; PAM type: YTN; PAM sequence: TTG
ggtatctctccagtcaccta

SEQ ID NO: 266181 - DNA, 20 bp, Artificial Sequence
  Description of Artificial Sequence: Synthetic oligonucleotide
  Target: ATXN1; (+) strand; PAM type: YTN; PAM sequence: CTC
tccagtcacctataaagctg

SEQ ID NO: 266182 - DNA, 20 bp, Artificial Sequence
  Description of Artificial Sequence: Synthetic oligonucleotide
  Target: ATXN1; (+) strand; PAM type: YTN; PAM sequence: CTC
cagtcacctataaagctgag

SEQ ID NO: 266183 - DNA, 20 bp, Artificial Sequence
  Description of Artificial Sequence: Synthetic oligonucleotide
  Target: ATXN1; (+) strand; PAM type: YTN; PAM sequence: CTA
taaagctgagctcatccctt

SEQ ID NO: 266184 - DNA, 20 bp, Artificial Sequence
  Description of Artificial Sequence: Synthetic oligonucleotide
  Target: ATXN1; (+) strand; PAM type: YTN; PAM sequence: CTG
agctcatcccttcttctggc

SEQ ID NO: 266185 - DNA, 20 bp, Artificial Sequence
  Description of Artificial Sequence: Synthetic oligonucleotide
  Target: ATXN1; (+) strand; PAM type: YTN; PAM sequence: CTC
atcccttcttctggcacttg

SEQ ID NO: 266186 - DNA, 20 bp, Artificial Sequence
  Description of Artificial Sequence: Synthetic oligonucleotide
  Target: ATXN1; (+) strand; PAM type: YTN; PAM sequence: CTT
cttctggcacttgttctata

SEQ ID NO: 266187 - DNA, 20 bp, Artificial Sequence
  Description of Artificial Sequence: Synthetic oligonucleotide
  Target: ATXN1; (+) strand; PAM type: YTN; PAM sequence: TTC
ttctggcacttgttctatac

SEQ ID NO: 266188 - DNA, 20 bp, Artificial Sequence
  Description of Artificial Sequence: Synthetic oligonucleotide
  Target: ATXN1; (+) strand; PAM type: YTN; PAM sequence: CTT
ctggcacttgttctatactg

SEQ ID NO: 266189 - DNA, 20 bp, Artificial Sequence
  Description of Artificial Sequence: Synthetic oligonucleotide
  Target: ATXN1; (+) strand; PAM type: YTN; PAM sequence: TTC
tggcacttgttctatactgt

SEQ ID NO: 266190 - DNA, 20 bp, Artificial Sequence
  Description of Artificial Sequence: Synthetic oligonucleotide
  Target: ATXN1; (+) strand; PAM type: YTN; PAM sequence: CTG
gcacttgttctatactgtgt

SEQ ID NO: 266191 - DNA, 20 bp, Artificial Sequence
  Description of Artificial Sequence: Synthetic oligonucleotide
  Target: ATXN1; (+) strand; PAM type: YTN; PAM sequence: CTT
gttctatactgtgttctgga

SEQ ID NO: 266192 - DNA, 20 bp, Artificial Sequence
  Description of Artificial Sequence: Synthetic oligonucleotide
  Target: ATXN1; (+) strand; PAM type: YTN; PAM sequence: TTG
ttctatactgtgttctggaa

SEQ ID NO: 266193 - DNA, 20 bp, Artificial Sequence
  Description of Artificial Sequence: Synthetic oligonucleotide
  Target: ATXN1; (+) strand; PAM type: YTN; PAM sequence: TTC
tatactgtgttctggaagcc

SEQ ID NO: 266194 - DNA, 20 bp, Artificial Sequence
  Description of Artificial Sequence: Synthetic oligonucleotide
  Target: ATXN1; (+) strand; PAM type: YTN; PAM sequence: CTA
tactgtgttctggaagccag

SEQ ID NO: 266195 - DNA, 20 bp, Artificial Sequence
  Description of Artificial Sequence: Synthetic oligonucleotide
  Target: ATXN1; (+) strand; PAM type: YTN; PAM sequence: CTG
tgttctggaagccagaccag

SEQ ID NO: 266196 - DNA, 20 bp, Artificial Sequence
  Description of Artificial Sequence: Synthetic oligonucleotide
  Target: ATXN1; (+) strand; PAM type: YTN; PAM sequence: TTC
tggaagccagaccagattga

SEQ ID NO: 266197 - DNA, 20 bp, Artificial Sequence
  Description of Artificial Sequence: Synthetic oligonucleotide
  Target: ATXN1; (+) strand; PAM type: YTN; PAM sequence: CTG
gaagccagaccagattgaac

SEQ ID NO: 266198 - DNA, 20 bp, Artificial Sequence
  Description of Artificial Sequence: Synthetic oligonucleotide
  Target: ATXN1; (+) strand; PAM type: YTN; PAM sequence: TTG
aacacagcaaaccatatctt

SEQ ID NO: 266199 - DNA, 20 bp, Artificial Sequence
  Description of Artificial Sequence: Synthetic oligonucleotide
  Target: ATXN1; (+) strand; PAM type: YTN; PAM sequence: CTT
cctttcagtatagaatgcaa

SEQ ID NO: 266200 - DNA, 20 bp, Artificial Sequence
  Description of Artificial Sequence: Synthetic oligonucleotide
  Target: ATXN1; (+) strand; PAM type: YTN; PAM sequence: TTC
ctttcagtatagaatgcaat

SEQ ID NO: 266201 - DNA, 20 bp, Artificial Sequence
  Description of Artificial Sequence: Synthetic oligonucleotide
  Target: ATXN1; (+) strand; PAM type: YTN; PAM sequence: CTT
tcagtatagaatgcaatgag

SEQ ID NO: 266202 - DNA, 20 bp, Artificial Sequence
  Description of Artificial Sequence: Synthetic oligonucleotide
  Target: ATXN1; (+) strand; PAM type: YTN; PAM sequence: TTT
cagtatagaatgcaatgagt

SEQ ID NO: 266203 - DNA, 20 bp, Artificial Sequence
  Description of Artificial Sequence: Synthetic oligonucleotide
  Target: ATXN1; (+) strand; PAM type: YTN; PAM sequence: TTC
agtatagaatgcaatgagtc

SEQ ID NO: 266204 - DNA, 20 bp, Artificial Sequence
  Description of Artificial Sequence: Synthetic oligonucleotide
  Target: ATXN1; (+) strand; PAM type: YTN; PAM sequence: TTT
atgcaatgatctgctattaa

SEQ ID NO: 266205 - DNA, 20 bp, Artificial Sequence
  Description of Artificial Sequence: Synthetic oligonucleotide
  Target: ATXN1; (+) strand; PAM type: YTN; PAM sequence: TTA
tgcaatgatctgctattaaa

SEQ ID NO: 266206 - DNA, 20 bp, Artificial Sequence
  Description of Artificial Sequence: Synthetic oligonucleotide
  Target: ATXN1; (+) strand; PAM type: YTN; PAM sequence: CTG
ctattaaagcaaataagcag

SEQ ID NO: 266207 - DNA, 20 bp, Artificial Sequence
  Description of Artificial Sequence: Synthetic oligonucleotide
  Target: ATXN1; (+) strand; PAM type: YTN; PAM sequence: CTA
ttaaagcaaataagcagaat

SEQ ID NO: 266208 - DNA, 20 bp, Artificial Sequence
  Description of Artificial Sequence: Synthetic oligonucleotide
  Target: ATXN1; (+) strand; PAM type: YTN; PAM sequence: TTA
aagcaaataagcagaatcag

SEQ ID NO: 266209 - DNA, 20 bp, Artificial Sequence
  Description of Artificial Sequence: Synthetic oligonucleotide
  Target: ATXN1; (+) strand; PAM type: YTN; PAM sequence: TTC
caaaacatgccatgttttca

SEQ ID NO: 266210 - DNA, 20 bp, Artificial Sequence
  Description of Artificial Sequence: Synthetic oligonucleotide
  Target: ATXN1; (+) strand; PAM type: YTN; PAM sequence: TTT
tcatttccatttcacatgag

SEQ ID NO: 266211 - DNA, 20 bp, Artificial Sequence
  Description of Artificial Sequence: Synthetic oligonucleotide
  Target: ATXN1; (+) strand; PAM type: YTN; PAM sequence: TTT
catttccatttcacatgagt

SEQ ID NO: 266212 - DNA, 20 bp, Artificial Sequence
  Description of Artificial Sequence: Synthetic oligonucleotide
  Target: ATXN1; (+) strand; PAM type: YTN; PAM sequence: TTC
atttccatttcacatgagta

SEQ ID NO: 266213 - DNA, 20 bp, Artificial Sequence
  Description of Artificial Sequence: Synthetic oligonucleotide
  Target: ATXN1; (+) strand; PAM type: YTN; PAM sequence: TTT
ccatttcacatgagtataaa

SEQ ID NO: 266214 - DNA, 20 bp, Artificial Sequence
  Description of Artificial Sequence: Synthetic oligonucleotide
  Target: ATXN1; (+) strand; PAM type: YTN; PAM sequence: TTC
catttcacatgagtataaag

SEQ ID NO: 266215 - DNA, 20 bp, Artificial Sequence
  Description of Artificial Sequence: Synthetic oligonucleotide
  Target: ATXN1; (+) strand; PAM type: YTN; PAM sequence: TTT
cacatgagtataaagctcac

SEQ ID NO: 266216 - DNA, 20 bp, Artificial Sequence
  Description of Artificial Sequence: Synthetic oligonucleotide
  Target: ATXN1; (+) strand; PAM type: YTN; PAM sequence: TTC
acatgagtataaagctcacc

SEQ ID NO: 266217 - DNA, 20 bp, Artificial Sequence
  Description of Artificial Sequence: Synthetic oligonucleotide
  Target: ATXN1; (+) strand; PAM type: YTN; PAM sequence: CTC
accaaatttgggcactttaa

SEQ ID NO: 266218 - DNA, 20 bp, Artificial Sequence
  Description of Artificial Sequence: Synthetic oligonucleotide
  Target: ATXN1; (+) strand; PAM type: YTN; PAM sequence: TTT
gggcactttaaattatgaag

SEQ ID NO: 266219 - DNA, 20 bp, Artificial Sequence
  Description of Artificial Sequence: Synthetic oligonucleotide
  Target: ATXN1; (+) strand; PAM type: YTN; PAM sequence: TTG
ggcactttaaattatgaagt

SEQ ID NO: 266220 - DNA, 20 bp, Artificial Sequence
  Description of Artificial Sequence: Synthetic oligonucleotide
  Target: ATXN1; (+) strand; PAM type: YTN; PAM sequence: CTT
taaattatgaagtctcctat

SEQ ID NO: 266221 - DNA, 20 bp, Artificial Sequence
  Description of Artificial Sequence: Synthetic oligonucleotide
  Target: ATXN1; (+) strand; PAM type: YTN; PAM sequence: TTT
aaattatgaagtctcctatc

SEQ ID NO: 266222 - DNA, 20 bp, Artificial Sequence
  Description of Artificial Sequence: Synthetic oligonucleotide
  Target: ATXN1; (+) strand; PAM type: YTN; PAM sequence: TTA
aattatgaagtctcctatca

SEQ ID NO: 266223 - DNA, 20 bp, Artificial Sequence
  Description of Artificial Sequence: Synthetic oligonucleotide
  Target: ATXN1; (+) strand; PAM type: YTN; PAM sequence: TTA
tgaagtctcctatcacacac

SEQ ID NO: 266224 - DNA, 20 bp, Artificial Sequence
  Description of Artificial Sequence: Synthetic oligonucleotide
  Target: ATXN1; (+) strand; PAM type: YTN; PAM sequence: CTC
ctatcacacacttctttatc

SEQ ID NO: 266225 - DNA, 20 bp, Artificial Sequence
  Description of Artificial Sequence: Synthetic oligonucleotide
  Target: ATXN1; (+) strand; PAM type: YTN; PAM sequence: CTA
tcacacacttctttatcagt

SEQ ID NO: 266226 - DNA, 20 bp, Artificial Sequence
  Description of Artificial Sequence: Synthetic oligonucleotide
  Target: ATXN1; (+) strand; PAM type: YTN; PAM sequence: CTT
ctttatcagtcctccacata

SEQ ID NO: 266227 - DNA, 20 bp, Artificial Sequence
  Description of Artificial Sequence: Synthetic oligonucleotide
  Target: ATXN1; (+) strand; PAM type: YTN; PAM sequence: TTC
tttatcagtcctccacataa

SEQ ID NO: 266228 - DNA, 20 bp, Artificial Sequence
  Description of Artificial Sequence: Synthetic oligonucleotide
  Target: ATXN1; (+) strand; PAM type: YTN; PAM sequence: CTT
tatcagtcctccacataatt

SEQ ID NO: 266229 - DNA, 20 bp, Artificial Sequence
  Description of Artificial Sequence: Synthetic oligonucleotide
  Target: ATXN1; (+) strand; PAM type: YTN; PAM sequence: TTT
atcagtcctccacataattg

SEQ ID NO: 266230 - DNA, 20 bp, Artificial Sequence
  Description of Artificial Sequence: Synthetic oligonucleotide
  Target: ATXN1; (+) strand; PAM type: YTN; PAM sequence: TTA
tcagtcctccacataattgt

SEQ ID NO: 266231 - DNA, 20 bp, Artificial Sequence
  Description of Artificial Sequence: Synthetic oligonucleotide
  Target: ATXN1; (+) strand; PAM type: YTN; PAM sequence: CTC
cacataattgtttaactaag

SEQ ID NO: 266232 - DNA, 20 bp, Artificial Sequence
  Description of Artificial Sequence: Synthetic oligonucleotide
  Target: ATXN1; (+) strand; PAM type: YTN; PAM sequence: TTG
tttaactaagactctgataa

SEQ ID NO: 266233 - DNA, 20 bp, Artificial Sequence
  Description of Artificial Sequence: Synthetic oligonucleotide
  Target: ATXN1; (+) strand; PAM type: YTN; PAM sequence: TTT
aactaagactctgataaaaa

SEQ ID NO: 266234 - DNA, 20 bp, Artificial Sequence
  Description of Artificial Sequence: Synthetic oligonucleotide
  Target: ATXN1; (+) strand; PAM type: YTN; PAM sequence: TTA
actaagactctgataaaaat

SEQ ID NO: 266235 - DNA, 20 bp, Artificial Sequence
  Description of Artificial Sequence: Synthetic oligonucleotide
  Target: ATXN1; (+) strand; PAM type: YTN; PAM sequence: CTA
agactctgataaaaatgtca

SEQ ID NO: 266236 - DNA, 20 bp, Artificial Sequence
  Description of Artificial Sequence: Synthetic oligonucleotide
  Target: ATXN1; (+) strand; PAM type: YTN; PAM sequence: CTC
tgataaaaatgtcaaaaatg

SEQ ID NO: 266237 - DNA, 20 bp, Artificial Sequence
  Description of Artificial Sequence: Synthetic oligonucleotide
  Target: ATXN1; (+) strand; PAM type: YTN; PAM sequence: CTG
ataaaaatgtcaaaaatgct

SEQ ID NO: 266238 - DNA, 20 bp, Artificial Sequence
  Description of Artificial Sequence: Synthetic oligonucleotide
  Target: ATXN1; (+) strand; PAM type: YTN; PAM sequence: CTT
gccatggttctcagcagcaa

SEQ ID NO: 266239 - DNA, 20 bp, Artificial Sequence
  Description of Artificial Sequence: Synthetic oligonucleotide
  Target: ATXN1; (+) strand; PAM type: YTN; PAM sequence: TTG
ccatggttctcagcagcaaa

SEQ ID NO: 266240 - DNA, 20 bp, Artificial Sequence
  Description of Artificial Sequence: Synthetic oligonucleotide
  Target: ATXN1; (+) strand; PAM type: YTN; PAM sequence: TTC
tcagcagcaaacaaatgcct

SEQ ID NO: 266241 - DNA, 20 bp, Artificial Sequence
  Description of Artificial Sequence: Synthetic oligonucleotide
  Target: ATXN1; (+) strand; PAM type: YTN; PAM sequence: CTC
agcagcaaacaaatgcctgc

SEQ ID NO: 266242 - DNA, 20 bp, Artificial Sequence
  Description of Artificial Sequence: Synthetic oligonucleotide
  Target: ATXN1; (+) strand; PAM type: YTN; PAM sequence: CTG
caggctccgagcatgccctg

SEQ ID NO: 266243 - DNA, 20 bp, Artificial Sequence
  Description of Artificial Sequence: Synthetic oligonucleotide
  Target: ATXN1; (+) strand; PAM type: YTN; PAM sequence: CTC
cgagcatgccctggggtttt

SEQ ID NO: 266244 - DNA, 20 bp, Artificial Sequence
  Description of Artificial Sequence: Synthetic oligonucleotide
  Target: ATXN1; (+) strand; PAM type: YTN; PAM sequence: CTG
gggtttttcaaaccctctcc

SEQ ID NO: 266245 - DNA, 20 bp, Artificial Sequence
  Description of Artificial Sequence: Synthetic oligonucleotide
  Target: ATXN1; (+) strand; PAM type: YTN; PAM sequence: TTT
ttcaaaccctctcctgtctt

SEQ ID NO: 266246 - DNA, 20 bp, Artificial Sequence
  Description of Artificial Sequence: Synthetic oligonucleotide
  Target: ATXN1; (+) strand; PAM type: YTN; PAM sequence: TTT
tcaaaccctctcctgtcttt

SEQ ID NO: 266247 - DNA, 20 bp, Artificial Sequence
  Description of Artificial Sequence: Synthetic oligonucleotide
  Target: ATXN1; (+) strand; PAM type: YTN; PAM sequence: TTT
caaaccctctcctgtctttg

SEQ ID NO: 266248 - DNA, 20 bp, Artificial Sequence
  Description of Artificial Sequence: Synthetic oligonucleotide
  Target: ATXN1; (+) strand; PAM type: YTN; PAM sequence: TTC
aaaccctctcctgtctttga

SEQ ID NO: 266249 - DNA, 20 bp, Artificial Sequence
  Description of Artificial Sequence: Synthetic oligonucleotide
  Target: ATXN1; (+) strand; PAM type: YTN; PAM sequence: CTC
tcctgtctttgaaaatgcat

SEQ ID NO: 266250 - DNA, 20 bp, Artificial Sequence
  Description of Artificial Sequence: Synthetic oligonucleotide
  Target: ATXN1; (+) strand; PAM type: YTN; PAM sequence: CTC
ctgtctttgaaaatgcatcc

SEQ ID NO: 266251 - DNA, 20 bp, Artificial Sequence
  Description of Artificial Sequence: Synthetic oligonucleotide
  Target: ATXN1; (+) strand; PAM type: YTN; PAM sequence: CTG
tctttgaaaatgcatcccat

SEQ ID NO: 266252 - DNA, 20 bp, Artificial Sequence
  Description of Artificial Sequence: Synthetic oligonucleotide
  Target: ATXN1; (+) strand; PAM type: YTN; PAM sequence: CTT
tgaaaatgcatcccattcag

SEQ ID NO: 266253 - DNA, 20 bp, Artificial Sequence
  Description of Artificial Sequence: Synthetic oligonucleotide
  Target: ATXN1; (+) strand; PAM type: YTN; PAM sequence: TTT
gaaaatgcatcccattcagt

SEQ ID NO: 266254 - DNA, 20 bp, Artificial Sequence
  Description of Artificial Sequence: Synthetic oligonucleotide
  Target: ATXN1; (+) strand; PAM type: YTN; PAM sequence: TTG
aaaatgcatcccattcagtt

SEQ ID NO: 266255 - DNA, 20 bp, Artificial Sequence
  Description of Artificial Sequence: Synthetic oligonucleotide
  Target: ATXN1; (+) strand; PAM type: YTN; PAM sequence: TTC
agttagcagtgctggtgata

SEQ ID NO: 266256 - DNA, 20 bp, Artificial Sequence
  Description of Artificial Sequence: Synthetic oligonucleotide
  Target: ATXN1; (+) strand; PAM type: YTN; PAM sequence: TTA
gcagtgctggtgataagaca

SEQ ID NO: 266257 - DNA, 20 bp, Artificial Sequence
  Description of Artificial Sequence: Synthetic oligonucleotide
  Target: ATXN1; (+) strand; PAM type: YTN; PAM sequence: CTG
gtgataagacatggcacgca

SEQ ID NO: 266258 - DNA, 20 bp, Artificial Sequence
  Description of Artificial Sequence: Synthetic oligonucleotide
  Target: ATXN1; (+) strand; PAM type: YTN; PAM sequence: CTA
aaccaccacccctaaaggtg

SEQ ID NO: 266259 - DNA, 20 bp, Artificial Sequence
  Description of Artificial Sequence: Synthetic oligonucleotide
  Target: ATXN1; (+) strand; PAM type: YTN; PAM sequence: CTA
aaggtgccagagcagaaccc

SEQ ID NO: 266260 - DNA, 20 bp, Artificial Sequence
  Description of Artificial Sequence: Synthetic oligonucleotide
  Target: ATXN1; (+) strand; PAM type: YTN; PAM sequence: CTG
cattgagtttaatgctgaca

SEQ ID NO: 266261 - DNA, 20 bp, Artificial Sequence
  Description of Artificial Sequence: Synthetic oligonucleotide
  Target: ATXN1; (+) strand; PAM type: YTN; PAM sequence: TTG
agtttaatgctgacagagca

SEQ ID NO: 266262 - DNA, 20 bp, Artificial Sequence
  Description of Artificial Sequence: Synthetic oligonucleotide
  Target: ATXN1; (+) strand; PAM type: YTN; PAM sequence: TTT
aatgctgacagagcactcca

SEQ ID NO: 266263 - DNA, 20 bp, Artificial Sequence
  Description of Artificial Sequence: Synthetic oligonucleotide
  Target: ATXN1; (+) strand; PAM type: YTN; PAM sequence: TTA
atgctgacagagcactccaa

SEQ ID NO: 266264 - DNA, 20 bp, Artificial Sequence
  Description of Artificial Sequence: Synthetic oligonucleotide
  Target: ATXN1; (+) strand; PAM type: YTN; PAM sequence: CTG
acagagcactccaatcagtc

SEQ ID NO: 266265 - DNA, 20 bp, Artificial Sequence
  Description of Artificial Sequence: Synthetic oligonucleotide
  Target: ATXN1; (+) strand; PAM type: YTN; PAM sequence: CTC
caatcagtcagtctgttcga

SEQ ID NO: 266266 - DNA, 20 bp, Artificial Sequence
  Description of Artificial Sequence: Synthetic oligonucleotide
  Target: ATXN1; (+) strand; PAM type: YTN; PAM sequence: CTG
ttcgaactctttgattggag

SEQ ID NO: 266267 - DNA, 20 bp, Artificial Sequence
  Description of Artificial Sequence: Synthetic oligonucleotide
  Target: ATXN1; (+) strand; PAM type: YTN; PAM sequence: TTC
gaactctttgattggagaaa

SEQ ID NO: 266268 - DNA, 20 bp, Artificial Sequence
  Description of Artificial Sequence: Synthetic oligonucleotide
  Target: ATXN1; (+) strand; PAM type: YTN; PAM sequence: CTC
tttgattggagaaaaggtca

SEQ ID NO: 266269 - DNA, 20 bp, Artificial Sequence
  Description of Artificial Sequence: Synthetic oligonucleotide
  Target: ATXN1; (+) strand; PAM type: YTN; PAM sequence: CTT
tgattggagaaaaggtcaga

SEQ ID NO: 266270 - DNA, 20 bp, Artificial Sequence
  Description of Artificial Sequence: Synthetic oligonucleotide
  Target: ATXN1; (+) strand; PAM type: YTN; PAM sequence: TTT
gattggagaaaaggtcagaa

SEQ ID NO: 266271 - DNA, 20 bp, Artificial Sequence
  Description of Artificial Sequence: Synthetic oligonucleotide
  Target: ATXN1; (+) strand; PAM type: YTN; PAM sequence: TTG
attggagaaaaggtcagaat

SEQ ID NO: 266272 - DNA, 20 bp, Artificial Sequence
  Description of Artificial Sequence: Synthetic oligonucleotide
  Target: ATXN1; (+) strand; PAM type: YTN; PAM sequence: TTG
gagaaaaggtcagaatctga

SEQ ID NO: 266273 - DNA, 20 bp, Artificial Sequence
  Description of Artificial Sequence: Synthetic oligonucleotide
  Target: ATXN1; (+) strand; PAM type: YTN; PAM sequence: CTG
agctacaaaagtggcctgcc

SEQ ID NO: 266274 - DNA, 20 bp, Artificial Sequence
  Description of Artificial Sequence: Synthetic oligonucleotide
  Target: ATXN1; (+) strand; PAM type: YTN; PAM sequence: CTA
caaaagtggcctgcctgccc

SEQ ID NO: 266275 - DNA, 20 bp, Artificial Sequence
  Description of Artificial Sequence: Synthetic oligonucleotide
  Target: ATXN1; (+) strand; PAM type: YTN; PAM sequence: CTG
cctgcccctggaagattagg

SEQ ID NO: 266276 - DNA, 20 bp, Artificial Sequence
  Description of Artificial Sequence: Synthetic oligonucleotide
  Target: ATXN1; (+) strand; PAM type: YTN; PAM sequence: CTG
cccctggaagattaggtcct

SEQ ID NO: 266277 - DNA, 20 bp, Artificial Sequence
  Description of Artificial Sequence: Synthetic oligonucleotide
  Target: ATXN1; (+) strand; PAM type: YTN; PAM sequence: CTG
gaagattaggtcctgggttt

SEQ ID NO: 266278 - DNA, 20 bp, Artificial Sequence
  Description of Artificial Sequence: Synthetic oligonucleotide
  Target: ATXN1; (+) strand; PAM type: YTN; PAM sequence: TTA
ggtcctgggtttttagtttt

SEQ ID NO: 266279 - DNA, 20 bp, Artificial Sequence
  Description of Artificial Sequence: Synthetic oligonucleotide
  Target: ATXN1; (+) strand; PAM type: YTN; PAM sequence: CTG
ggtttttagttttccttctt

SEQ ID NO: 266280 - DNA, 20 bp, Artificial Sequence
  Description of Artificial Sequence: Synthetic oligonucleotide
  Target: ATXN1; (+) strand; PAM type: YTN; PAM sequence: TTT
ttagttttccttcttgtctt

SEQ ID NO: 266281 - DNA, 20 bp, Artificial Sequence
  Description of Artificial Sequence: Synthetic oligonucleotide
  Target: ATXN1; (+) strand; PAM type: YTN; PAM sequence: TTT
tagttttccttcttgtcttc

SEQ ID NO: 266282 - DNA, 20 bp, Artificial Sequence
  Description of Artificial Sequence: Synthetic oligonucleotide
  Target: ATXN1; (+) strand; PAM type: YTN; PAM sequence: TTT
agttttccttcttgtcttcc

SEQ ID NO: 266283 - DNA, 20 bp, Artificial Sequence
  Description of Artificial Sequence: Synthetic oligonucleotide
  Target: ATXN1; (+) strand; PAM type: YTN; PAM sequence: TTA
gttttccttcttgtcttcct

SEQ ID NO: 266284 - DNA, 20 bp, Artificial Sequence
  Description of Artificial Sequence: Synthetic oligonucleotide
  Target: ATXN1; (+) strand; PAM type: YTN; PAM sequence: TTT
tccttcttgtcttcctctgt

SEQ ID NO: 266285 - DNA, 20 bp, Artificial Sequence
  Description of Artificial Sequence: Synthetic oligonucleotide
  Target: ATXN1; (+) strand; PAM type: YTN; PAM sequence: TTT
ccttcttgtcttcctctgtt

SEQ ID NO: 266286 - DNA, 20 bp, Artificial Sequence
  Description of Artificial Sequence: Synthetic oligonucleotide
  Target: ATXN1; (+) strand; PAM type: YTN; PAM sequence: TTC
cttcttgtcttcctctgttc

SEQ ID NO: 266287 - DNA, 20 bp, Artificial Sequence
  Description of Artificial Sequence: Synthetic oligonucleotide
  Target: ATXN1; (+) strand; PAM type: YTN; PAM sequence: CTT
cttgtcttcctctgttccca

SEQ ID NO: 266288 - DNA, 20 bp, Artificial Sequence
  Description of Artificial Sequence: Synthetic oligonucleotide
  Target: ATXN1; (+) strand; PAM type: YTN; PAM sequence: TTC
ttgtcttcctctgttcccac

SEQ ID NO: 266289 - DNA, 20 bp, Artificial Sequence
  Description of Artificial Sequence: Synthetic oligonucleotide
  Target: ATXN1; (+) strand; PAM type: YTN; PAM sequence: CTT
gtcttcctctgttcccacaa

SEQ ID NO: 266290 - DNA, 20 bp, Artificial Sequence
  Description of Artificial Sequence: Synthetic oligonucleotide
  Target: ATXN1; (+) strand; PAM type: YTN; PAM sequence: TTG
tcttcctctgttcccacaat

SEQ ID NO: 266291 - DNA, 20 bp, Artificial Sequence
  Description of Artificial Sequence: Synthetic oligonucleotide
  Target: ATXN1; (+) strand; PAM type: YTN; PAM sequence: CTT
cctctgttcccacaattccc

SEQ ID NO: 266292 - DNA, 20 bp, Artificial Sequence
  Description of Artificial Sequence: Synthetic oligonucleotide
  Target: ATXN1; (+) strand; PAM type: YTN; PAM sequence: TTC
ctctgttcccacaattccca

SEQ ID NO: 266293 - DNA, 20 bp, Artificial Sequence
  Description of Artificial Sequence: Synthetic oligonucleotide
  Target: ATXN1; (+) strand; PAM type: YTN; PAM sequence: CTC
tgttcccacaattcccattt

SEQ ID NO: 266294 - DNA, 20 bp, Artificial Sequence
  Description of Artificial Sequence: Synthetic oligonucleotide
  Target: ATXN1; (+) strand; PAM type: YTN; PAM sequence: CTG
ttcccacaattcccatttat

SEQ ID NO: 266295 - DNA, 20 bp, Artificial Sequence
  Description of Artificial Sequence: Synthetic oligonucleotide
  Target: ATXN1; (+) strand; PAM type: YTN; PAM sequence: TTC
ccacaattcccatttatttt

SEQ ID NO: 266296 - DNA, 20 bp, Artificial Sequence
  Description of Artificial Sequence: Synthetic oligonucleotide
  Target: ATXN1; (+) strand; PAM type: YTN; PAM sequence: TTC
ccatttattttcaattattt

SEQ ID NO: 266297 - DNA, 20 bp, Artificial Sequence
  Description of Artificial Sequence: Synthetic oligonucleotide
  Target: ATXN1; (+) strand; PAM type: YTN; PAM sequence: TTT
attttcaattatttggttag

SEQ ID NO: 266298 - DNA, 20 bp, Artificial Sequence
  Description of Artificial Sequence: Synthetic oligonucleotide
  Target: ATXN1; (+) strand; PAM type: YTN; PAM sequence: TTA
ttttcaattatttggttagg

SEQ ID NO: 266299 - DNA, 20 bp, Artificial Sequence
  Description of Artificial Sequence: Synthetic oligonucleotide
  Target: ATXN1; (+) strand; PAM type: YTN; PAM sequence: TTT
tcaattatttggttagggaa

SEQ ID NO: 266300 - DNA, 20 bp, Artificial Sequence
  Description of Artificial Sequence: Synthetic oligonucleotide
  Target: ATXN1; (+) strand; PAM type: YTN; PAM sequence: TTT
caattatttggttagggaag

SEQ ID NO: 266301 - DNA, 20 bp, Artificial Sequence
  Description of Artificial Sequence: Synthetic oligonucleotide
  Target: ATXN1; (+) strand; PAM type: YTN; PAM sequence: TTC
aattatttggttagggaagg

SEQ ID NO: 266302 - DNA, 20 bp, Artificial Sequence
  Description of Artificial Sequence: Synthetic oligonucleotide
  Target: ATXN1; (+) strand; PAM type: YTN; PAM sequence: TTA
tttggttagggaaggtgtcc

SEQ ID NO: 266303 - DNA, 20 bp, Artificial Sequence
  Description of Artificial Sequence: Synthetic oligonucleotide
  Target: ATXN1; (+) strand; PAM type: YTN; PAM sequence: TTT
ggttagggaaggtgtccctc

SEQ ID NO: 266304 - DNA, 20 bp, Artificial Sequence
  Description of Artificial Sequence: Synthetic oligonucleotide
  Target: ATXN1; (+) strand; PAM type: YTN; PAM sequence: TTG
gttagggaaggtgtccctca

SEQ ID NO: 266305 - DNA, 20 bp, Artificial Sequence
  Description of Artificial Sequence: Synthetic oligonucleotide
  Target: ATXN1; (+) strand; PAM type: YTN; PAM sequence: TTA
gggaaggtgtccctcaagga

SEQ ID NO: 266306 - DNA, 20 bp, Artificial Sequence
  Description of Artificial Sequence: Synthetic oligonucleotide
  Target: ATXN1; (+) strand; PAM type: YTN; PAM sequence: CTC
aaggaaaagagcataggaat

SEQ ID NO: 266307 - DNA, 20 bp, Artificial Sequence
  Description of Artificial Sequence: Synthetic oligonucleotide
  Target: ATXN1; (+) strand; PAM type: YTN; PAM sequence: CTG
cctgccctacttgtagactc

SEQ ID NO: 266308 - DNA, 20 bp, Artificial Sequence
  Description of Artificial Sequence: Synthetic oligonucleotide
  Target: ATXN1; (+) strand; PAM type: YTN; PAM sequence: CTG
ccctacttgtagactcttct

SEQ ID NO: 266309 - DNA, 20 bp, Artificial Sequence
  Description of Artificial Sequence: Synthetic oligonucleotide
  Target: ATXN1; (+) strand; PAM type: YTN; PAM sequence: CTA
cttgtagactcttctgtatg

SEQ ID NO: 266310 - DNA, 20 bp, Artificial Sequence
  Description of Artificial Sequence: Synthetic oligonucleotide
  Target: ATXN1; (+) strand; PAM type: YTN; PAM sequence: CTT
gtagactcttctgtatgttc

SEQ ID NO: 266311 - DNA, 20 bp, Artificial Sequence
  Description of Artificial Sequence: Synthetic oligonucleotide
  Target: ATXN1; (+) strand; PAM type: YTN; PAM sequence: TTG
tagactcttctgtatgttct

SEQ ID NO: 266312 - DNA, 20 bp, Artificial Sequence
  Description of Artificial Sequence: Synthetic oligonucleotide
  Target: ATXN1; (+) strand; PAM type: YTN; PAM sequence: CTC
ttctgtatgttcttttttaa

SEQ ID NO: 266313 - DNA, 20 bp, Artificial Sequence
  Description of Artificial Sequence: Synthetic oligonucleotide
  Target: ATXN1; (+) strand; PAM type: YTN; PAM sequence: CTT
ctgtatgttcttttttaatg

SEQ ID NO: 266314 - DNA, 20 bp, Artificial Sequence
  Description of Artificial Sequence: Synthetic oligonucleotide
  Target: ATXN1; (+) strand; PAM type: YTN; PAM sequence: TTC
tgtatgttcttttttaatga

SEQ ID NO: 266315 - DNA, 20 bp, Artificial Sequence
  Description of Artificial Sequence: Synthetic oligonucleotide
  Target: ATXN1; (+) strand; PAM type: YTN; PAM sequence: CTG
tatgttcttttttaatgaaa

SEQ ID NO: 266316 - DNA, 20 bp, Artificial Sequence
  Description of Artificial Sequence: Synthetic oligonucleotide
  Target: ATXN1; (+) strand; PAM type: YTN; PAM sequence: TTC
ttttttaatgaaaaaaatta

SEQ ID NO: 266317 - DNA, 20 bp, Artificial Sequence
  Description of Artificial Sequence: Synthetic oligonucleotide
  Target: ATXN1; (+) strand; PAM type: YTN; PAM sequence: CTT
ttttaatgaaaaaaattaga

SEQ ID NO: 266318 - DNA, 20 bp, Artificial Sequence
  Description of Artificial Sequence: Synthetic oligonucleotide
  Target: ATXN1; (+) strand; PAM type: YTN; PAM sequence: TTT
tttaatgaaaaaaattagaa

SEQ ID NO: 266319 - DNA, 20 bp, Artificial Sequence
  Description of Artificial Sequence: Synthetic oligonucleotide
  Target: ATXN1; (+) strand; PAM type: YTN; PAM sequence: TTT
ttaatgaaaaaaattagaaa

SEQ ID NO: 266320 - DNA, 20 bp, Artificial Sequence
  Description of Artificial Sequence: Synthetic oligonucleotide
  Target: ATXN1; (+) strand; PAM type: YTN; PAM sequence: TTT
taatgaaaaaaattagaaaa

SEQ ID NO: 266321 - DNA, 20 bp, Artificial Sequence
  Description of Artificial Sequence: Synthetic oligonucleotide
  Target: ATXN1; (+) strand; PAM type: YTN; PAM sequence: TTT
aatgaaaaaaattagaaaac

SEQ ID NO: 266322 - DNA, 20 bp, Artificial Sequence
  Description of Artificial Sequence: Synthetic oligonucleotide
  Target: ATXN1; (+) strand; PAM type: YTN; PAM sequence: TTA
atgaaaaaaattagaaaact

SEQ ID NO: 266323 - DNA, 20 bp, Artificial Sequence
  Description of Artificial Sequence: Synthetic oligonucleotide
  Target: ATXN1; (+) strand; PAM type: YTN; PAM sequence: TTA
gaaaacttggcaaattatta

SEQ ID NO: 266324 - DNA, 20 bp, Artificial Sequence
  Description of Artificial Sequence: Synthetic oligonucleotide
  Target: ATXN1; (+) strand; PAM type: YTN; PAM sequence: CTT
ggcaaattattatctgcatc

SEQ ID NO: 266325 - DNA, 20 bp, Artificial Sequence
  Description of Artificial Sequence: Synthetic oligonucleotide
  Target: ATXN1; (+) strand; PAM type: YTN; PAM sequence: TTG
gcaaattattatctgcatcg

SEQ ID NO: 266326 - DNA, 20 bp, Artificial Sequence
  Description of Artificial Sequence: Synthetic oligonucleotide
  Target: ATXN1; (+) strand; PAM type: YTN; PAM sequence: TTA
ttatctgcatcgcacacatt

SEQ ID NO: 266327 - DNA, 20 bp, Artificial Sequence
  Description of Artificial Sequence: Synthetic oligonucleotide
  Target: ATXN1; (+) strand; PAM type: YTN; PAM sequence: TTA
tctgcatcgcacacattttg

SEQ ID NO: 266328 - DNA, 20 bp, Artificial Sequence
  Description of Artificial Sequence: Synthetic oligonucleotide
  Target: ATXN1; (+) strand; PAM type: YTN; PAM sequence: CTG
catcgcacacattttgatgc

SEQ ID NO: 266329 - DNA, 20 bp, Artificial Sequence
  Description of Artificial Sequence: Synthetic oligonucleotide
  Target: ATXN1; (+) strand; PAM type: YTN; PAM sequence: TTT
tgatgctcccctccctcaat

SEQ ID NO: 266330 - DNA, 20 bp, Artificial Sequence
  Description of Artificial Sequence: Synthetic oligonucleotide
  Target: ATXN1; (+) strand; PAM type: YTN; PAM sequence: TTT
gatgctcccctccctcaatt

SEQ ID NO: 266331 - DNA, 20 bp, Artificial Sequence
  Description of Artificial Sequence: Synthetic oligonucleotide
  Target: ATXN1; (+) strand; PAM type: YTN; PAM sequence: TTG
atgctcccctccctcaattt

SEQ ID NO: 266332 - DNA, 20 bp, Artificial Sequence
  Description of Artificial Sequence: Synthetic oligonucleotide
  Target: ATXN1; (+) strand; PAM type: YTN; PAM sequence: CTC
ccctccctcaattttaccta

SEQ ID NO: 266333 - DNA, 20 bp, Artificial Sequence
  Description of Artificial Sequence: Synthetic oligonucleotide
  Target: ATXN1; (+) strand; PAM type: YTN; PAM sequence: CTC
cctcaattttacctataaaa

SEQ ID NO: 266334 - DNA, 20 bp, Artificial Sequence
  Description of Artificial Sequence: Synthetic oligonucleotide
  Target: ATXN1; (+) strand; PAM type: YTN; PAM sequence: CTC
aattttacctataaaagata

SEQ ID NO: 266335 - DNA, 20 bp, Artificial Sequence
  Description of Artificial Sequence: Synthetic oligonucleotide
  Target: ATXN1; (+) strand; PAM type: YTN; PAM sequence: TTT
tacctataaaagataccact

SEQ ID NO: 266336 - DNA, 20 bp, Artificial Sequence
  Description of Artificial Sequence: Synthetic oligonucleotide
  Target: ATXN1; (+) strand; PAM type: YTN; PAM sequence: TTT
acctataaaagataccactt

SEQ ID NO: 266337 - DNA, 20 bp, Artificial Sequence
  Description of Artificial Sequence: Synthetic oligonucleotide
  Target: ATXN1; (+) strand; PAM type: YTN; PAM sequence: TTA
cctataaaagataccacttc

SEQ ID NO: 266338 - DNA, 20 bp, Artificial Sequence
  Description of Artificial Sequence: Synthetic oligonucleotide
  Target: ATXN1; (+) strand; PAM type: YTN; PAM sequence: CTA
taaaagataccacttccaac

SEQ ID NO: 266339 - DNA, 20 bp, Artificial Sequence
  Description of Artificial Sequence: Synthetic oligonucleotide
  Target: ATXN1; (+) strand; PAM type: YTN; PAM sequence: CTT
ccaacatttgagttataacc

SEQ ID NO: 266340 - DNA, 20 bp, Artificial Sequence
  Description of Artificial Sequence: Synthetic oligonucleotide
  Target: ATXN1; (+) strand; PAM type: YTN; PAM sequence: TTC
caacatttgagttataaccc

SEQ ID NO: 266341 - DNA, 20 bp, Artificial Sequence
  Description of Artificial Sequence: Synthetic oligonucleotide
  Target: ATXN1; (+) strand; PAM type: YTN; PAM sequence: TTT
gagttataaccccaaggact

SEQ ID NO: 266342 - DNA, 20 bp, Artificial Sequence
  Description of Artificial Sequence: Synthetic oligonucleotide
  Target: ATXN1; (+) strand; PAM type: YTN; PAM sequence: TTG
agttataaccccaaggactg

SEQ ID NO: 266343 - DNA, 20 bp, Artificial Sequence
  Description of Artificial Sequence: Synthetic oligonucleotide
  Target: ATXN1; (+) strand; PAM type: YTN; PAM sequence: TTA
taaccccaaggactgaaaaa

SEQ ID NO: 266344 - DNA, 20 bp, Artificial Sequence
  Description of Artificial Sequence: Synthetic oligonucleotide
  Target: ATXN1; (+) strand; PAM type: YTN; PAM sequence: CTG
aaaaatacccagccactccg

SEQ ID NO: 266345 - DNA, 20 bp, Artificial Sequence
  Description of Artificial Sequence: Synthetic oligonucleotide
  Target: ATXN1; (+) strand; PAM type: YTN; PAM sequence: CTC
cgacccgatatcaggcagtt

SEQ ID NO: 266346 - DNA, 20 bp, Artificial Sequence
  Description of Artificial Sequence: Synthetic oligonucleotide
  Target: ATXN1; (+) strand; PAM type: YTN; PAM sequence: TTT
cagtgacaacaaactggtcc

SEQ ID NO: 266347 - DNA, 20 bp, Artificial Sequence
  Description of Artificial Sequence: Synthetic oligonucleotide
  Target: ATXN1; (+) strand; PAM type: YTN; PAM sequence: TTC
agtgacaacaaactggtccc

SEQ ID NO: 266348 - DNA, 20 bp, Artificial Sequence
  Description of Artificial Sequence: Synthetic oligonucleotide
  Target: ATXN1; (+) strand; PAM type: YTN; PAM sequence: CTG
gtccccaaacgtaccggtga

SEQ ID NO: 266349 - DNA, 20 bp, Artificial Sequence
  Description of Artificial Sequence: Synthetic oligonucleotide
  Target: ATXN1; (+) strand; PAM type: YTN; PAM sequence: TTC
tcactcttggcgacttgaat

SEQ ID NO: 266350 - DNA, 20 bp, Artificial Sequence
  Description of Artificial Sequence: Synthetic oligonucleotide
  Target: ATXN1; (+) strand; PAM type: YTN; PAM sequence: CTC
actcttggcgacttgaattt

SEQ ID NO: 266351 - DNA, 20 bp, Artificial Sequence
  Description of Artificial Sequence: Synthetic oligonucleotide
  Target: ATXN1; (+) strand; PAM type: YTN; PAM sequence: CTC
ttggcgacttgaatttggtg

SEQ ID NO: 266352 - DNA, 20 bp, Artificial Sequence
  Description of Artificial Sequence: Synthetic oligonucleotide
  Target: ATXN1; (+) strand; PAM type: YTN; PAM sequence: CTT
ggcgacttgaatttggtgaa

SEQ ID NO: 266353 - DNA, 20 bp, Artificial Sequence
  Description of Artificial Sequence: Synthetic oligonucleotide
  Target: ATXN1; (+) strand; PAM type: YTN; PAM sequence: TTG
gcgacttgaatttggtgaaa

SEQ ID NO: 266354 - DNA, 20 bp, Artificial Sequence
  Description of Artificial Sequence: Synthetic oligonucleotide
  Target: ATXN1; (+) strand; PAM type: YTN; PAM sequence: CTT
gaatttggtgaaatgaaaca

SEQ ID NO: 266355 - DNA, 20 bp, Artificial Sequence
  Description of Artificial Sequence: Synthetic oligonucleotide
  Target: ATXN1; (+) strand; PAM type: YTN; PAM sequence: TTG
aatttggtgaaatgaaacag

SEQ ID NO: 266356 - DNA, 20 bp, Artificial Sequence
  Description of Artificial Sequence: Synthetic oligonucleotide
  Target: ATXN1; (+) strand; PAM type: YTN; PAM sequence: TTT
ggtgaaatgaaacagtcatt

SEQ ID NO: 266357 - DNA, 20 bp, Artificial Sequence
  Description of Artificial Sequence: Synthetic oligonucleotide
  Target: ATXN1; (+) strand; PAM type: YTN; PAM sequence: TTG
gtgaaatgaaacagtcattt

SEQ ID NO: 266358 - DNA, 20 bp, Artificial Sequence
  Description of Artificial Sequence: Synthetic oligonucleotide
  Target: ATXN1; (+) strand; PAM type: YTN; PAM sequence: TTT
ctatttttgccttttgaaag

SEQ ID NO: 266359 - DNA, 20 bp, Artificial Sequence
  Description of Artificial Sequence: Synthetic oligonucleotide
  Target: ATXN1; (+) strand; PAM type: YTN; PAM sequence: TTC
tatttttgccttttgaaaga

SEQ ID NO: 266360 - DNA, 20 bp, Artificial Sequence
  Description of Artificial Sequence: Synthetic oligonucleotide
  Target: ATXN1; (+) strand; PAM type: YTN; PAM sequence: CTA
tttttgccttttgaaagagt

SEQ ID NO: 266361 - DNA, 20 bp, Artificial Sequence
  Description of Artificial Sequence: Synthetic oligonucleotide
  Target: ATXN1; (+) strand; PAM type: YTN; PAM sequence: TTT
ttgccttttgaaagagttat

SEQ ID NO: 266362 - DNA, 20 bp, Artificial Sequence
  Description of Artificial Sequence: Synthetic oligonucleotide
  Target: ATXN1; (+) strand; PAM type: YTN; PAM sequence: TTT
tgccttttgaaagagttatg

SEQ ID NO: 266363 - DNA, 20 bp, Artificial Sequence
  Description of Artificial Sequence: Synthetic oligonucleotide
  Target: ATXN1; (+) strand; PAM type: YTN; PAM sequence: TTT
gccttttgaaagagttatgc

SEQ ID NO: 266364 - DNA, 20 bp, Artificial Sequence
  Description of Artificial Sequence: Synthetic oligonucleotide
  Target: ATXN1; (+) strand; PAM type: YTN; PAM sequence: TTG
ccttttgaaagagttatgct

SEQ ID NO: 266365 - DNA, 20 bp, Artificial Sequence
  Description of Artificial Sequence: Synthetic oligonucleotide
  Target: ATXN1; (+) strand; PAM type: YTN; PAM sequence: CTT
ttgaaagagttatgcttaaa

SEQ ID NO: 266366 - DNA, 20 bp, Artificial Sequence
  Description of Artificial Sequence: Synthetic oligonucleotide
  Target: ATXN1; (+) strand; PAM type: YTN; PAM sequence: TTT
tgaaagagttatgcttaaag

SEQ ID NO: 266367 - DNA, 20 bp, Artificial Sequence
  Description of Artificial Sequence: Synthetic oligonucleotide
  Target: ATXN1; (+) strand; PAM type: YTN; PAM sequence: TTT
gaaagagttatgcttaaagg

SEQ ID NO: 266368 - DNA, 20 bp, Artificial Sequence
  Description of Artificial Sequence: Synthetic oligonucleotide
  Target: ATXN1; (+) strand; PAM type: YTN; PAM sequence: TTG
aaagagttatgcttaaaggt

SEQ ID NO: 266369 - DNA, 20 bp, Artificial Sequence
  Description of Artificial Sequence: Synthetic oligonucleotide
  Target: ATXN1; (+) strand; PAM type: YTN; PAM sequence: TTA
tgcttaaaggtgtagtgaaa

SEQ ID NO: 266370 - DNA, 20 bp, Artificial Sequence
  Description of Artificial Sequence: Synthetic oligonucleotide
  Target: ATXN1; (+) strand; PAM type: YTN; PAM sequence: CTT
aaaggtgtagtgaaaaggtc

SEQ ID NO: 266371 - DNA, 20 bp, Artificial Sequence
  Description of Artificial Sequence: Synthetic oligonucleotide
  Target: ATXN1; (+) strand; PAM type: YTN; PAM sequence: TTA
aaggtgtagtgaaaaggtca

SEQ ID NO: 266372 - DNA, 20 bp, Artificial Sequence
  Description of Artificial Sequence: Synthetic oligonucleotide
  Target: ATXN1; (+) strand; PAM type: YTN; PAM sequence: CTG
gaaattaatgggtaagcatg

SEQ ID NO: 266373 - DNA, 20 bp, Artificial Sequence
  Description of Artificial Sequence: Synthetic oligonucleotide
  Target: ATXN1; (+) strand; PAM type: YTN; PAM sequence: TTA
atgggtaagcatggtcctat

SEQ ID NO: 266374 - DNA, 20 bp, Artificial Sequence
  Description of Artificial Sequence: Synthetic oligonucleotide
  Target: ATXN1; (+) strand; PAM type: YTN; PAM sequence: CTA
tccgaggtcagagaagcatt

SEQ ID NO: 266375 - DNA, 20 bp, Artificial Sequence
  Description of Artificial Sequence: Synthetic oligonucleotide
  Target: ATXN1; (+) strand; PAM type: YTN; PAM sequence: TTT
tgagagtgccccagagcctt

SEQ ID NO: 266376 - DNA, 20 bp, Artificial Sequence
  Description of Artificial Sequence: Synthetic oligonucleotide
  Target: ATXN1; (+) strand; PAM type: YTN; PAM sequence: TTT
gagagtgccccagagccttt

SEQ ID NO: 266377 - DNA, 20 bp, Artificial Sequence
  Description of Artificial Sequence: Synthetic oligonucleotide
  Target: ATXN1; (+) strand; PAM type: YTN; PAM sequence: TTG
agagtgccccagagccttta

SEQ ID NO: 266378 - DNA, 20 bp, Artificial Sequence
  Description of Artificial Sequence: Synthetic oligonucleotide
  Target: ATXN1; (+) strand; PAM type: YTN; PAM sequence: CTT
tagaacacattgtttatttt

SEQ ID NO: 266379 - DNA, 20 bp, Artificial Sequence
  Description of Artificial Sequence: Synthetic oligonucleotide
  Target: ATXN1; (+) strand; PAM type: YTN; PAM sequence: TTT
agaacacattgtttattttg

SEQ ID NO: 266380 - DNA, 20 bp, Artificial Sequence
  Description of Artificial Sequence: Synthetic oligonucleotide
  Target: ATXN1; (+) strand; PAM type: YTN; PAM sequence: TTA
gaacacattgtttattttga

SEQ ID NO: 266381 - DNA, 20 bp, Artificial Sequence
  Description of Artificial Sequence: Synthetic oligonucleotide
  Target: ATXN1; (+) strand; PAM type: YTN; PAM sequence: TTG
tttattttgaggtcaaaggg

SEQ ID NO: 266382 - DNA, 20 bp, Artificial Sequence
  Description of Artificial Sequence: Synthetic oligonucleotide
  Target: ATXN1; (+) strand; PAM type: YTN; PAM sequence: TTT
attttgaggtcaaagggaaa

SEQ ID NO: 266383 - DNA, 20 bp, Artificial Sequence
  Description of Artificial Sequence: Synthetic oligonucleotide
  Target: ATXN1; (+) strand; PAM type: YTN; PAM sequence: TTA
ttttgaggtcaaagggaaaa

SEQ ID NO: 266384 - DNA, 20 bp, Artificial Sequence
  Description of Artificial Sequence: Synthetic oligonucleotide
  Target: ATXN1; (+) strand; PAM type: YTN; PAM sequence: TTT
tgaggtcaaagggaaaaaca

SEQ ID NO: 266385 - DNA, 20 bp, Artificial Sequence
  Description of Artificial Sequence: Synthetic oligonucleotide
  Target: ATXN1; (+) strand; PAM type: YTN; PAM sequence: TTT
gaggtcaaagggaaaaacat

SEQ ID NO: 266386 - DNA, 20 bp, Artificial Sequence
  Description of Artificial Sequence: Synthetic oligonucleotide
  Target: ATXN1; (+) strand; PAM type: YTN; PAM sequence: TTG
aggtcaaagggaaaaacatg

SEQ ID NO: 266387 - DNA, 20 bp, Artificial Sequence
  Description of Artificial Sequence: Synthetic oligonucleotide
  Target: ATXN1; (+) strand; PAM type: YTN; PAM sequence: TTG
gaaggaaaagagtctttggc

SEQ ID NO: 266388 - DNA, 20 bp, Artificial Sequence
  Description of Artificial Sequence: Synthetic oligonucleotide
  Target: ATXN1; (+) strand; PAM type: YTN; PAM sequence: CTT
tggctgggtgatgacaatga

SEQ ID NO: 266389 - DNA, 20 bp, Artificial Sequence
  Description of Artificial Sequence: Synthetic oligonucleotide
  Target: ATXN1; (+) strand; PAM type: YTN; PAM sequence: TTT
ggctgggtgatgacaatgac

SEQ ID NO: 266390 - DNA, 20 bp, Artificial Sequence
  Description of Artificial Sequence: Synthetic oligonucleotide
  Target: ATXN1; (+) strand; PAM type: YTN; PAM sequence: TTG
gctgggtgatgacaatgaca

SEQ ID NO: 266391 - DNA, 20 bp, Artificial Sequence
  Description of Artificial Sequence: Synthetic oligonucleotide
  Target: ATXN1; (+) strand; PAM type: YTN; PAM sequence: CTG
ggtgatgacaatgacaagaa

SEQ ID NO: 266392 - DNA, 20 bp, Artificial Sequence
  Description of Artificial Sequence: Synthetic oligonucleotide
  Target: ATXN1; (+) strand; PAM type: YTN; PAM sequence: CTT
ccagagactggaatctcttt

SEQ ID NO: 266393 - DNA, 20 bp, Artificial Sequence
  Description of Artificial Sequence: Synthetic oligonucleotide
  Target: ATXN1; (+) strand; PAM type: YTN; PAM sequence: TTC
cagagactggaatctctttg

SEQ ID NO: 266394 - DNA, 20 bp, Artificial Sequence
  Description of Artificial Sequence: Synthetic oligonucleotide
  Target: ATXN1; (+) strand; PAM type: YTN; PAM sequence: CTG
gaatctctttgactcagccc

SEQ ID NO: 266395 - DNA, 20 bp, Artificial Sequence
  Description of Artificial Sequence: Synthetic oligonucleotide
  Target: ATXN1; (+) strand; PAM type: YTN; PAM sequence: CTC
tttgactcagccccttggta

SEQ ID NO: 266396 - DNA, 20 bp, Artificial Sequence
  Description of Artificial Sequence: Synthetic oligonucleotide
  Target: ATXN1; (+) strand; PAM type: YTN; PAM sequence: CTT
tgactcagccccttggtagg

SEQ ID NO: 266397 - DNA, 20 bp, Artificial Sequence
  Description of Artificial Sequence: Synthetic oligonucleotide
  Target: ATXN1; (+) strand; PAM type: YTN; PAM sequence: TTT
gactcagccccttggtaggt

SEQ ID NO: 266398 - DNA, 20 bp, Artificial Sequence
  Description of Artificial Sequence: Synthetic oligonucleotide
  Target: ATXN1; (+) strand; PAM type: YTN; PAM sequence: TTG
actcagccccttggtaggtg

SEQ ID NO: 266399 - DNA, 20 bp, Artificial Sequence
  Description of Artificial Sequence: Synthetic oligonucleotide
  Target: ATXN1; (+) strand; PAM type: YTN; PAM sequence: CTC
agccccttggtaggtgttta

SEQ ID NO: 266400 - DNA, 20 bp, Artificial Sequence
  Description of Artificial Sequence: Synthetic oligonucleotide
  Target: ATXN1; (+) strand; PAM type: YTN; PAM sequence: CTT
ggtaggtgtttatttagaac

SEQ ID NO: 266401 - DNA, 20 bp, Artificial Sequence
  Description of Artificial Sequence: Synthetic oligonucleotide
  Target: ATXN1; (+) strand; PAM type: YTN; PAM sequence: TTG
gtaggtgtttatttagaacc

SEQ ID NO: 266402 - DNA, 20 bp, Artificial Sequence
  Description of Artificial Sequence: Synthetic oligonucleotide
  Target: ATXN1; (+) strand; PAM type: YTN; PAM sequence: TTT
atttagaacccaaggacatt

SEQ ID NO: 266403 - DNA, 20 bp, Artificial Sequence
  Description of Artificial Sequence: Synthetic oligonucleotide
  Target: ATXN1; (+) strand; PAM type: YTN; PAM sequence: TTA
tttagaacccaaggacattg

SEQ ID NO: 266404 - DNA, 20 bp, Artificial Sequence
  Description of Artificial Sequence: Synthetic oligonucleotide
  Target: ATXN1; (+) strand; PAM type: YTN; PAM sequence: TTT
agaacccaaggacattggag

SEQ ID NO: 266405 - DNA, 20 bp, Artificial Sequence
  Description of Artificial Sequence: Synthetic oligonucleotide
  Target: ATXN1; (+) strand; PAM type: YTN; PAM sequence: TTA
gaacccaaggacattggagt

SEQ ID NO: 266406 - DNA, 20 bp, Artificial Sequence
  Description of Artificial Sequence: Synthetic oligonucleotide
  Target: ATXN1; (+) strand; PAM type: YTN; PAM sequence: TTG
gagtctggcaggatcccaca

SEQ ID NO: 266407 - DNA, 20 bp, Artificial Sequence
  Description of Artificial Sequence: Synthetic oligonucleotide
  Target: ATXN1; (+) strand; PAM type: YTN; PAM sequence: CTG
gcaggatcccacaaaggagc

SEQ ID NO: 266408 - DNA, 20 bp, Artificial Sequence
  Description of Artificial Sequence: Synthetic oligonucleotide
  Target: ATXN1; (+) strand; PAM type: YTN; PAM sequence: CTG
gtggagttctcccaccagat

SEQ ID NO: 266409 - DNA, 20 bp, Artificial Sequence
  Description of Artificial Sequence: Synthetic oligonucleotide
  Target: ATXN1; (+) strand; PAM type: YTN; PAM sequence: TTC
tcccaccagattcatacgga

SEQ ID NO: 266410 - DNA, 20 bp, Artificial Sequence
  Description of Artificial Sequence: Synthetic oligonucleotide
  Target: ATXN1; (+) strand; PAM type: YTN; PAM sequence: CTC
ccaccagattcatacggata

SEQ ID NO: 266411 - DNA, 20 bp, Artificial Sequence
  Description of Artificial Sequence: Synthetic oligonucleotide
  Target: ATXN1; (+) strand; PAM type: YTN; PAM sequence: TTC
atacggatattgctgatgac

SEQ ID NO: 266412 - DNA, 20 bp, Artificial Sequence
  Description of Artificial Sequence: Synthetic oligonucleotide
  Target: ATXN1; (+) strand; PAM type: YTN; PAM sequence: TTG
ctgatgacctgagcctctgt

SEQ ID NO: 266413 - DNA, 20 bp, Artificial Sequence
  Description of Artificial Sequence: Synthetic oligonucleotide
  Target: ATXN1; (+) strand; PAM type: YTN; PAM sequence: CTG
atgacctgagcctctgtctt

SEQ ID NO: 266414 - DNA, 20 bp, Artificial Sequence
  Description of Artificial Sequence: Synthetic oligonucleotide
  Target: ATXN1; (+) strand; PAM type: YTN; PAM sequence: CTG
agcctctgtcttttctgctc

SEQ ID NO: 266415 - DNA, 20 bp, Artificial Sequence
  Description of Artificial Sequence: Synthetic oligonucleotide
  Target: ATXN1; (+) strand; PAM type: YTN; PAM sequence: CTC
tgtcttttctgctctacctt

SEQ ID NO: 266416 - DNA, 20 bp, Artificial Sequence
  Description of Artificial Sequence: Synthetic oligonucleotide
  Target: ATXN1; (+) strand; PAM type: YTN; PAM sequence: CTG
tcttttctgctctaccttga

SEQ ID NO: 266417 - DNA, 20 bp, Artificial Sequence
  Description of Artificial Sequence: Synthetic oligonucleotide
  Target: ATXN1; (+) strand; PAM type: YTN; PAM sequence: CTT
ttctgctctaccttgaaggg

SEQ ID NO: 266418 - DNA, 20 bp, Artificial Sequence
  Description of Artificial Sequence: Synthetic oligonucleotide
  Target: ATXN1; (+) strand; PAM type: YTN; PAM sequence: TTT
tctgctctaccttgaagggc

SEQ ID NO: 266419 - DNA, 20 bp, Artificial Sequence
  Description of Artificial Sequence: Synthetic oligonucleotide
  Target: ATXN1; (+) strand; PAM type: YTN; PAM sequence: TTT
ctgctctaccttgaagggcc

SEQ ID NO: 266420 - DNA, 20 bp, Artificial Sequence
  Description of Artificial Sequence: Synthetic oligonucleotide
  Target: ATXN1; (+) strand; PAM type: YTN; PAM sequence: TTC
tgctctaccttgaagggcct

SEQ ID NO: 266421 - DNA, 20 bp, Artificial Sequence
  Description of Artificial Sequence: Synthetic oligonucleotide
  Target: ATXN1; (+) strand; PAM type: YTN; PAM sequence: CTG
ctctaccttgaagggcctcc

SEQ ID NO: 266422 - DNA, 20 bp, Artificial Sequence
  Description of Artificial Sequence: Synthetic oligonucleotide
  Target: ATXN1; (+) strand; PAM type: YTN; PAM sequence: CTC
taccttgaagggcctccaac

SEQ ID NO: 266423 - DNA, 20 bp, Artificial Sequence
  Description of Artificial Sequence: Synthetic oligonucleotide
  Target: ATXN1; (+) strand; PAM type: YTN; PAM sequence: CTA
ccttgaagggcctccaacct

SEQ ID NO: 266424 - DNA, 20 bp, Artificial Sequence
  Description of Artificial Sequence: Synthetic oligonucleotide
  Target: ATXN1; (+) strand; PAM type: YTN; PAM sequence: CTT
gaagggcctccaacctcttt

SEQ ID NO: 266425 - DNA, 20 bp, Artificial Sequence
  Description of Artificial Sequence: Synthetic oligonucleotide
  Target: ATXN1; (+) strand; PAM type: YTN; PAM sequence: TTG
aagggcctccaacctctttt

SEQ ID NO: 266426 - DNA, 20 bp, Artificial Sequence
  Description of Artificial Sequence: Synthetic oligonucleotide
  Target: ATXN1; (+) strand; PAM type: YTN; PAM sequence: CTC
caacctcttttctggtcaca

SEQ ID NO: 266427 - DNA, 20 bp, Artificial Sequence
  Description of Artificial Sequence: Synthetic oligonucleotide
  Target: ATXN1; (+) strand; PAM type: YTN; PAM sequence: CTC
ttttctggtcacattgttct

SEQ ID NO: 266428 - DNA, 20 bp, Artificial Sequence
  Description of Artificial Sequence: Synthetic oligonucleotide
  Target: ATXN1; (+) strand; PAM type: YTN; PAM sequence: CTT
ttctggtcacattgttctga

SEQ ID NO: 266429 - DNA, 20 bp, Artificial Sequence
  Description of Artificial Sequence: Synthetic oligonucleotide
  Target: ATXN1; (+) strand; PAM type: YTN; PAM sequence: TTT
tctggtcacattgttctgaa

SEQ ID NO: 266430 - DNA, 20 bp, Artificial Sequence
  Description of Artificial Sequence: Synthetic oligonucleotide
  Target: ATXN1; (+) strand; PAM type: YTN; PAM sequence: TTT
ctggtcacattgttctgaaa

SEQ ID NO: 266431 - DNA, 20 bp, Artificial Sequence
  Description of Artificial Sequence: Synthetic oligonucleotide
  Target: ATXN1; (+) strand; PAM type: YTN; PAM sequence: TTC
tggtcacattgttctgaaag

SEQ ID NO: 266432 - DNA, 20 bp, Artificial Sequence
  Description of Artificial Sequence: Synthetic oligonucleotide
  Target: ATXN1; (+) strand; PAM type: YTN; PAM sequence: CTG
gtcacattgttctgaaagta

SEQ ID NO: 266433 - DNA, 20 bp, Artificial Sequence
  Description of Artificial Sequence: Synthetic oligonucleotide
  Target: ATXN1; (+) strand; PAM type: YTN; PAM sequence: TTG
ttctgaaagtacacgtcagc

SEQ ID NO: 266434 - DNA, 20 bp, Artificial Sequence
  Description of Artificial Sequence: Synthetic oligonucleotide
  Target: ATXN1; (+) strand; PAM type: YTN; PAM sequence: TTC
tgaaagtacacgtcagcttt

SEQ ID NO: 266435 - DNA, 20 bp, Artificial Sequence
  Description of Artificial Sequence: Synthetic oligonucleotide
  Target: ATXN1; (+) strand; PAM type: YTN; PAM sequence: CTG
aaagtacacgtcagctttga

SEQ ID NO: 266436 - DNA, 20 bp, Artificial Sequence
  Description of Artificial Sequence: Synthetic oligonucleotide
  Target: ATXN1; (+) strand; PAM type: YTN; PAM sequence: CTT
tgagccacctctcagtcaag

SEQ ID NO: 266437 - DNA, 20 bp, Artificial Sequence
  Description of Artificial Sequence: Synthetic oligonucleotide
  Target: ATXN1; (+) strand; PAM type: YTN; PAM sequence: TTT
gagccacctctcagtcaagt

SEQ ID NO: 266438 - DNA, 20 bp, Artificial Sequence
  Description of Artificial Sequence: Synthetic oligonucleotide
  Target: ATXN1; (+) strand; PAM type: YTN; PAM sequence: TTG
agccacctctcagtcaagtc

SEQ ID NO: 266439 - DNA, 20 bp, Artificial Sequence
  Description of Artificial Sequence: Synthetic oligonucleotide
  Target: ATXN1; (+) strand; PAM type: YTN; PAM sequence: CTC
tcagtcaagtccttccatct

SEQ ID NO: 266440 - DNA, 20 bp, Artificial Sequence
  Description of Artificial Sequence: Synthetic oligonucleotide
  Target: ATXN1; (+) strand; PAM type: YTN; PAM sequence: CTC
agtcaagtccttccatcttc

SEQ ID NO: 266441 - DNA, 20 bp, Artificial Sequence
  Description of Artificial Sequence: Synthetic oligonucleotide
  Target: ATXN1; (+) strand; PAM type: YTN; PAM sequence: CTT
ccatcttctcctatgctatc

SEQ ID NO: 266442 - DNA, 20 bp, Artificial Sequence
  Description of Artificial Sequence: Synthetic oligonucleotide
  Target: ATXN1; (+) strand; PAM type: YTN; PAM sequence: TTC
catcttctcctatgctatcc

SEQ ID NO: 266443 - DNA, 20 bp, Artificial Sequence
  Description of Artificial Sequence: Synthetic oligonucleotide
  Target: ATXN1; (+) strand; PAM type: YTN; PAM sequence: CTT
ctcctatgctatccctgggt

SEQ ID NO: 266444 - DNA, 20 bp, Artificial Sequence
  Description of Artificial Sequence: Synthetic oligonucleotide
  Target: ATXN1; (+) strand; PAM type: YTN; PAM sequence: TTC
tcctatgctatccctgggtc

SEQ ID NO: 266445 - DNA, 20 bp, Artificial Sequence
  Description of Artificial Sequence: Synthetic oligonucleotide
  Target: ATXN1; (+) strand; PAM type: YTN; PAM sequence: CTC
ctatgctatccctgggtcat

SEQ ID NO: 266446 - DNA, 20 bp, Artificial Sequence
  Description of Artificial Sequence: Synthetic oligonucleotide
  Target: ATXN1; (+) strand; PAM type: YTN; PAM sequence: CTA
tgctatccctgggtcatctc

SEQ ID NO: 266447 - DNA, 20 bp, Artificial Sequence
  Description of Artificial Sequence: Synthetic oligonucleotide
  Target: ATXN1; (+) strand; PAM type: YTN; PAM sequence: CTA
tccctgggtcatctctttgg

SEQ ID NO: 266448 - DNA, 20 bp, Artificial Sequence
  Description of Artificial Sequence: Synthetic oligonucleotide
  Target: ATXN1; (+) strand; PAM type: YTN; PAM sequence: CTG
ggtcatctctttggaaactt

SEQ ID NO: 266449 - DNA, 20 bp, Artificial Sequence
  Description of Artificial Sequence: Synthetic oligonucleotide
  Target: ATXN1; (+) strand; PAM type: YTN; PAM sequence: CTC
tttggaaacttcctgaattg

SEQ ID NO: 266450 - DNA, 20 bp, Artificial Sequence
  Description of Artificial Sequence: Synthetic oligonucleotide
  Target: ATXN1; (+) strand; PAM type: YTN; PAM sequence: CTT
tggaaacttcctgaattgtc

SEQ ID NO: 266451 - DNA, 20 bp, Artificial Sequence
  Description of Artificial Sequence: Synthetic oligonucleotide
  Target: ATXN1; (+) strand; PAM type: YTN; PAM sequence: TTT
ggaaacttcctgaattgtct

SEQ ID NO: 266452 - DNA, 20 bp, Artificial Sequence
  Description of Artificial Sequence: Synthetic oligonucleotide
  Target: ATXN1; (+) strand; PAM type: YTN; PAM sequence: TTG
gaaacttcctgaattgtcta

SEQ ID NO: 266453 - DNA, 20 bp, Artificial Sequence
  Description of Artificial Sequence: Synthetic oligonucleotide
  Target: ATXN1; (+) strand; PAM type: YTN; PAM sequence: CTT
cctgaattgtctaggctaac

SEQ ID NO: 266454 - DNA, 20 bp, Artificial Sequence
  Description of Artificial Sequence: Synthetic oligonucleotide
  Target: ATXN1; (+) strand; PAM type: YTN; PAM sequence: TTC
ctgaattgtctaggctaacg

SEQ ID NO: 266455 - DNA, 20 bp, Artificial Sequence
  Description of Artificial Sequence: Synthetic oligonucleotide
  Target: ATXN1; (+) strand; PAM type: YTN; PAM sequence: CTG
aattgtctaggctaacgagt

SEQ ID NO: 266456 - DNA, 20 bp, Artificial Sequence
  Description of Artificial Sequence: Synthetic oligonucleotide
  Target: ATXN1; (+) strand; PAM type: YTN; PAM sequence: TTG
tctaggctaacgagtgtttt

SEQ ID NO: 266457 - DNA, 20 bp, Artificial Sequence
  Description of Artificial Sequence: Synthetic oligonucleotide
  Target: ATXN1; (+) strand; PAM type: YTN; PAM sequence: CTA
ggctaacgagtgtttttagg

SEQ ID NO: 266458 - DNA, 20 bp, Artificial Sequence
  Description of Artificial Sequence: Synthetic oligonucleotide
  Target: ATXN1; (+) strand; PAM type: YTN; PAM sequence: CTA
acgagtgtttttaggcttct

SEQ ID NO: 266459 - DNA, 20 bp, Artificial Sequence
  Description of Artificial Sequence: Synthetic oligonucleotide
  Target: ATXN1; (+) strand; PAM type: YTN; PAM sequence: TTT
ttaggcttctaccacctaac

SEQ ID NO: 266460 - DNA, 20 bp, Artificial Sequence
  Description of Artificial Sequence: Synthetic oligonucleotide
  Target: ATXN1; (+) strand; PAM type: YTN; PAM sequence: TTT
taggcttctaccacctaacc

SEQ ID NO: 266461 - DNA, 20 bp, Artificial Sequence
  Description of Artificial Sequence: Synthetic oligonucleotide
  Target: ATXN1; (+) strand; PAM type: YTN; PAM sequence: TTT
aggcttctaccacctaacca

SEQ ID NO: 266462 - DNA, 20 bp, Artificial Sequence
  Description of Artificial Sequence: Synthetic oligonucleotide
  Target: ATXN1; (+) strand; PAM type: YTN; PAM sequence: TTA
ggcttctaccacctaaccat

SEQ ID NO: 266463 - DNA, 20 bp, Artificial Sequence
  Description of Artificial Sequence: Synthetic oligonucleotide
  Target: ATXN1; (+) strand; PAM type: YTN; PAM sequence: CTT
ctaccacctaaccatgtctc

SEQ ID NO: 266464 - DNA, 20 bp, Artificial Sequence
  Description of Artificial Sequence: Synthetic oligonucleotide
  Target: ATXN1; (+) strand; PAM type: YTN; PAM sequence: TTC
taccacctaaccatgtctct

SEQ ID NO: 266465 - DNA, 20 bp, Artificial Sequence
  Description of Artificial Sequence: Synthetic oligonucleotide
  Target: ATXN1; (+) strand; PAM type: YTN; PAM sequence: CTA
ccacctaaccatgtctctac

SEQ ID NO: 266466 - DNA, 20 bp, Artificial Sequence
  Description of Artificial Sequence: Synthetic oligonucleotide
  Target: ATXN1; (+) strand; PAM type: YTN; PAM sequence: CTA
accatgtctctacacatctc

SEQ ID NO: 266467 - DNA, 20 bp, Artificial Sequence
  Description of Artificial Sequence: Synthetic oligonucleotide
  Target: ATXN1; (+) strand; PAM type: YTN; PAM sequence: CTC
tacacatctcattgatcatg

SEQ ID NO: 266468 - DNA, 20 bp, Artificial Sequence
  Description of Artificial Sequence: Synthetic oligonucleotide
  Target: ATXN1; (+) strand; PAM type: YTN; PAM sequence: CTA
cacatctcattgatcatgtc

SEQ ID NO: 266469 - DNA, 20 bp, Artificial Sequence
  Description of Artificial Sequence: Synthetic oligonucleotide
  Target: ATXN1; (+) strand; PAM type: YTN; PAM sequence: CTC
attgatcatgtcaacatcct

SEQ ID NO: 266470 - DNA, 20 bp, Artificial Sequence
  Description of Artificial Sequence: Synthetic oligonucleotide
  Target: ATXN1; (+) strand; PAM type: YTN; PAM sequence: TTG
atcatgtcaacatcctgctt

SEQ ID NO: 266471 - DNA, 20 bp, Artificial Sequence
  Description of Artificial Sequence: Synthetic oligonucleotide
  Target: ATXN1; (+) strand; PAM type: YTN; PAM sequence: CTG
cttaaactctttcaatgacc

SEQ ID NO: 266472 - DNA, 20 bp, Artificial Sequence
  Description of Artificial Sequence: Synthetic oligonucleotide
  Target: ATXN1; (+) strand; PAM type: YTN; PAM sequence: CTT
aaactctttcaatgaccact

SEQ ID NO: 266473 - DNA, 20 bp, Artificial Sequence
  Description of Artificial Sequence: Synthetic oligonucleotide
  Target: ATXN1; (+) strand; PAM type: YTN; PAM sequence: TTA
aactctttcaatgaccactc

SEQ ID NO: 266474 - DNA, 20 bp, Artificial Sequence
  Description of Artificial Sequence: Synthetic oligonucleotide
  Target: ATXN1; (+) strand; PAM type: YTN; PAM sequence: CTC
tttcaatgaccactcccctg

SEQ ID NO: 266475 - DNA, 20 bp, Artificial Sequence
  Description of Artificial Sequence: Synthetic oligonucleotide
  Target: ATXN1; (+) strand; PAM type: YTN; PAM sequence: CTT
tcaatgaccactcccctgtc

SEQ ID NO: 266476 - DNA, 20 bp, Artificial Sequence
  Description of Artificial Sequence: Synthetic oligonucleotide
  Target: ATXN1; (+) strand; PAM type: YTN; PAM sequence: TTT
caatgaccactcccctgtct

SEQ ID NO: 266477 - DNA, 20 bp, Artificial Sequence
  Description of Artificial Sequence: Synthetic oligonucleotide
  Target: ATXN1; (+) strand; PAM type: YTN; PAM sequence: TTC
aatgaccactcccctgtctt

SEQ ID NO: 266478 - DNA, 20 bp, Artificial Sequence
  Description of Artificial Sequence: Synthetic oligonucleotide
  Target: ATXN1; (+) strand; PAM type: YTN; PAM sequence: CTC
ccctgtcttcaagataaact

SEQ ID NO: 266479 - DNA, 20 bp, Artificial Sequence
  Description of Artificial Sequence: Synthetic oligonucleotide
  Target: ATXN1; (+) strand; PAM type: YTN; PAM sequence: CTG
tcttcaagataaactctaaa

SEQ ID NO: 266480 - DNA, 20 bp, Artificial Sequence
  Description of Artificial Sequence: Synthetic oligonucleotide
  Target: ATXN1; (+) strand; PAM type: YTN; PAM sequence: CTT
caagataaactctaaactcc

SEQ ID NO: 266481 - DNA, 20 bp, Artificial Sequence
  Description of Artificial Sequence: Synthetic oligonucleotide
  Target: ATXN1; (+) strand; PAM type: YTN; PAM sequence: TTC
aagataaactctaaactcct

SEQ ID NO: 266482 - DNA, 20 bp, Artificial Sequence
  Description of Artificial Sequence: Synthetic oligonucleotide
  Target: ATXN1; (+) strand; PAM type: YTN; PAM sequence: CTC
taaactcctcagcagaactt

SEQ ID NO: 266483 - DNA, 20 bp, Artificial Sequence
  Description of Artificial Sequence: Synthetic oligonucleotide
  Target: ATXN1; (+) strand; PAM type: YTN; PAM sequence: CTA
aactcctcagcagaacttac

SEQ ID NO: 266484 - DNA, 20 bp, Artificial Sequence
  Description of Artificial Sequence: Synthetic oligonucleotide
  Target: ATXN1; (+) strand; PAM type: YTN; PAM sequence: CTC
ctcagcagaacttactgaaa

SEQ ID NO: 266485 - DNA, 20 bp, Artificial Sequence
  Description of Artificial Sequence: Synthetic oligonucleotide
  Target: ATXN1; (+) strand; PAM type: YTN; PAM sequence: CTC
agcagaacttactgaaaaga

SEQ ID NO: 266486 - DNA, 20 bp, Artificial Sequence
  Description of Artificial Sequence: Synthetic oligonucleotide
  Target: ATXN1; (+) strand; PAM type: YTN; PAM sequence: CTT
actgaaaagacactttatga

SEQ ID NO: 266487 - DNA, 20 bp, Artificial Sequence
  Description of Artificial Sequence: Synthetic oligonucleotide
  Target: ATXN1; (+) strand; PAM type: YTN; PAM sequence: TTA
ctgaaaagacactttatgat

SEQ ID NO: 266488 - DNA, 20 bp, Artificial Sequence
  Description of Artificial Sequence: Synthetic oligonucleotide
  Target: ATXN1; (+) strand; PAM type: YTN; PAM sequence: CTG
aaaagacactttatgatctg

SEQ ID NO: 266489 - DNA, 20 bp, Artificial Sequence
  Description of Artificial Sequence: Synthetic oligonucleotide
  Target: ATXN1; (+) strand; PAM type: YTN; PAM sequence: CTT
tatgatctggctttttcttc

SEQ ID NO: 266490 - DNA, 20 bp, Artificial Sequence
  Description of Artificial Sequence: Synthetic oligonucleotide
  Target: ATXN1; (+) strand; PAM type: YTN; PAM sequence: TTT
atgatctggctttttcttca

SEQ ID NO: 266491 - DNA, 20 bp, Artificial Sequence
  Description of Artificial Sequence: Synthetic oligonucleotide
  Target: ATXN1; (+) strand; PAM type: YTN; PAM sequence: TTA
tgatctggctttttcttcat

SEQ ID NO: 266492 - DNA, 20 bp, Artificial Sequence
  Description of Artificial Sequence: Synthetic oligonucleotide
  Target: ATXN1; (+) strand; PAM type: YTN; PAM sequence: CTG
gctttttcttcatgagactt

SEQ ID NO: 266493 - DNA, 20 bp, Artificial Sequence
  Description of Artificial Sequence: Synthetic oligonucleotide
  Target: ATXN1; (+) strand; PAM type: YTN; PAM sequence: CTT
tttcttcatgagacttcaca

SEQ ID NO: 266494 - DNA, 20 bp, Artificial Sequence
  Description of Artificial Sequence: Synthetic oligonucleotide
  Target: ATXN1; (+) strand; PAM type: YTN; PAM sequence: TTT
ttcttcatgagacttcacat

SEQ ID NO: 266495 - DNA, 20 bp, Artificial Sequence
  Description of Artificial Sequence: Synthetic oligonucleotide
  Target: ATXN1; (+) strand; PAM type: YTN; PAM sequence: TTT
tcttcatgagacttcacata

SEQ ID NO: 266496 - DNA, 20 bp, Artificial Sequence
  Description of Artificial Sequence: Synthetic oligonucleotide
  Target: ATXN1; (+) strand; PAM type: YTN; PAM sequence: TTT
cttcatgagacttcacatat

SEQ ID NO: 266497 - DNA, 20 bp, Artificial Sequence
  Description of Artificial Sequence: Synthetic oligonucleotide
  Target: ATXN1; (+) strand; PAM type: YTN; PAM sequence: TTC
ttcatgagacttcacatatg

SEQ ID NO: 266498 - DNA, 20 bp, Artificial Sequence
  Description of Artificial Sequence: Synthetic oligonucleotide
  Target: ATXN1; (+) strand; PAM type: YTN; PAM sequence: CTT
catgagacttcacatatgcc

SEQ ID NO: 266499 - DNA, 20 bp, Artificial Sequence
  Description of Artificial Sequence: Synthetic oligonucleotide
  Target: ATXN1; (+) strand; PAM type: YTN; PAM sequence: TTC
atgagacttcacatatgcct

SEQ ID NO: 266500 - DNA, 20 bp, Artificial Sequence
  Description of Artificial Sequence: Synthetic oligonucleotide
  Target: ATXN1; (+) strand; PAM type: YTN; PAM sequence: CTT
cacatatgcctgactccagc

SEQ ID NO: 266501 - DNA, 20 bp, Artificial Sequence
  Description of Artificial Sequence: Synthetic oligonucleotide
  Target: ATXN1; (+) strand; PAM type: YTN; PAM sequence: TTC
acatatgcctgactccagcc

SEQ ID NO: 266502 - DNA, 20 bp, Artificial Sequence
  Description of Artificial Sequence: Synthetic oligonucleotide
  Target: ATXN1; (+) strand; PAM type: YTN; PAM sequence: CTG
actccagccactccaaacta

SEQ ID NO: 266503 - DNA, 20 bp, Artificial Sequence
  Description of Artificial Sequence: Synthetic oligonucleotide
  Target: ATXN1; (+) strand; PAM type: YTN; PAM sequence: CTC
cagccactccaaactacttg

SEQ ID NO: 266504 - DNA, 20 bp, Artificial Sequence
  Description of Artificial Sequence: Synthetic oligonucleotide
  Target: ATXN1; (+) strand; PAM type: YTN; PAM sequence: CTC
caaactacttgctgtcttcc

SEQ ID NO: 266505 - DNA, 20 bp, Artificial Sequence
  Description of Artificial Sequence: Synthetic oligonucleotide
  Target: ATXN1; (+) strand; PAM type: YTN; PAM sequence: CTA
cttgctgtcttccaacatgc

SEQ ID NO: 266506 - DNA, 20 bp, Artificial Sequence
  Description of Artificial Sequence: Synthetic oligonucleotide
  Target: ATXN1; (+) strand; PAM type: YTN; PAM sequence: CTT
gctgtcttccaacatgccat

SEQ ID NO: 266507 - DNA, 20 bp, Artificial Sequence
  Description of Artificial Sequence: Synthetic oligonucleotide
  Target: ATXN1; (+) strand; PAM type: YTN; PAM sequence: TTG
ctgtcttccaacatgccatg

SEQ ID NO: 266508 - DNA, 20 bp, Artificial Sequence
  Description of Artificial Sequence: Synthetic oligonucleotide
  Target: ATXN1; (+) strand; PAM type: YTN; PAM sequence: CTG
tcttccaacatgccatgttc

SEQ ID NO: 266509 - DNA, 20 bp, Artificial Sequence
  Description of Artificial Sequence: Synthetic oligonucleotide
  Target: ATXN1; (+) strand; PAM type: YTN; PAM sequence: CTT
ccaacatgccatgttctctc

SEQ ID NO: 266510 - DNA, 20 bp, Artificial Sequence
  Description of Artificial Sequence: Synthetic oligonucleotide
  Target: ATXN1; (+) strand; PAM type: YTN; PAM sequence: TTC
caacatgccatgttctctct

SEQ ID NO: 266511 - DNA, 20 bp, Artificial Sequence
  Description of Artificial Sequence: Synthetic oligonucleotide
  Target: ATXN1; (+) strand; PAM type: YTN; PAM sequence: TTC
tctcttacctttgagctttg

SEQ ID NO: 266512 - DNA, 20 bp, Artificial Sequence
  Description of Artificial Sequence: Synthetic oligonucleotide
  Target: ATXN1; (+) strand; PAM type: YTN; PAM sequence: CTC
tcttacctttgagctttgct

SEQ ID NO: 266513 - DNA, 20 bp, Artificial Sequence
  Description of Artificial Sequence: Synthetic oligonucleotide
  Target: ATXN1; (+) strand; PAM type: YTN; PAM sequence: CTC
ttacctttgagctttgctca

SEQ ID NO: 266514 - DNA, 20 bp, Artificial Sequence
  Description of Artificial Sequence: Synthetic oligonucleotide
  Target: ATXN1; (+) strand; PAM type: YTN; PAM sequence: CTT
acctttgagctttgctcatg

SEQ ID NO: 266515 - DNA, 20 bp, Artificial Sequence
  Description of Artificial Sequence: Synthetic oligonucleotide
  Target: ATXN1; (+) strand; PAM type: YTN; PAM sequence: TTA
cctttgagctttgctcatgt

SEQ ID NO: 266516 - DNA, 20 bp, Artificial Sequence
  Description of Artificial Sequence: Synthetic oligonucleotide
  Target: ATXN1; (+) strand; PAM type: YTN; PAM sequence: CTT
tgagctttgctcatgttgtc

SEQ ID NO: 266517 - DNA, 20 bp, Artificial Sequence
  Description of Artificial Sequence: Synthetic oligonucleotide
  Target: ATXN1; (+) strand; PAM type: YTN; PAM sequence: TTT
gagctttgctcatgttgtcc

SEQ ID NO: 266518 - DNA, 20 bp, Artificial Sequence
  Description of Artificial Sequence: Synthetic oligonucleotide
  Target: ATXN1; (+) strand; PAM type: YTN; PAM sequence: TTG
agctttgctcatgttgtcct

SEQ ID NO: 266519 - DNA, 20 bp, Artificial Sequence
  Description of Artificial Sequence: Synthetic oligonucleotide
  Target: ATXN1; (+) strand; PAM type: YTN; PAM sequence: CTT
tgctcatgttgtcctcatgt

SEQ ID NO: 266520 - DNA, 20 bp, Artificial Sequence
  Description of Artificial Sequence: Synthetic oligonucleotide
  Target: ATXN1; (+) strand; PAM type: YTN; PAM sequence: TTT
gctcatgttgtcctcatgtg

SEQ ID NO: 266521 - DNA, 20 bp, Artificial Sequence
  Description of Artificial Sequence: Synthetic oligonucleotide
  Target: ATXN1; (+) strand; PAM type: YTN; PAM sequence: TTG
ctcatgttgtcctcatgtga

SEQ ID NO: 266522 - DNA, 20 bp, Artificial Sequence
  Description of Artificial Sequence: Synthetic oligonucleotide
  Target: ATXN1; (+) strand; PAM type: YTN; PAM sequence: CTC
atgttgtcctcatgtgacta

SEQ ID NO: 266523 - DNA, 20 bp, Artificial Sequence
  Description of Artificial Sequence: Synthetic oligonucleotide
  Target: ATXN1; (+) strand; PAM type: YTN; PAM sequence: TTG
tcctcatgtgactagagctg

SEQ ID NO: 266524 - DNA, 20 bp, Artificial Sequence
  Description of Artificial Sequence: Synthetic oligonucleotide
  Target: ATXN1; (+) strand; PAM type: YTN; PAM sequence: CTC
atgtgactagagctggagtt

SEQ ID NO: 266525 - DNA, 20 bp, Artificial Sequence
  Description of Artificial Sequence: Synthetic oligonucleotide
  Target: ATXN1; (+) strand; PAM type: YTN; PAM sequence: CTA
gagctggagtttccccatcc

SEQ ID NO: 266526 - DNA, 20 bp, Artificial Sequence
  Description of Artificial Sequence: Synthetic oligonucleotide
  Target: ATXN1; (+) strand; PAM type: YTN; PAM sequence: CTG
gagtttccccatcctttgaa

SEQ ID NO: 266527 - DNA, 20 bp, Artificial Sequence
  Description of Artificial Sequence: Synthetic oligonucleotide
  Target: ATXN1; (+) strand; PAM type: YTN; PAM sequence: TTT
ccccatcctttgaactgaac

SEQ ID NO: 266528 - DNA, 20 bp, Artificial Sequence
  Description of Artificial Sequence: Synthetic oligonucleotide
  Target: ATXN1; (+) strand; PAM type: YTN; PAM sequence: TTC
cccatcctttgaactgaaca

SEQ ID NO: 266529 - DNA, 20 bp, Artificial Sequence
  Description of Artificial Sequence: Synthetic oligonucleotide
  Target: ATXN1; (+) strand; PAM type: YTN; PAM sequence: CTT
tgaactgaacaaattaagta

SEQ ID NO: 266530 - DNA, 20 bp, Artificial Sequence
  Description of Artificial Sequence: Synthetic oligonucleotide
  Target: ATXN1; (+) strand; PAM type: YTN; PAM sequence: TTT
gaactgaacaaattaagtaa

SEQ ID NO: 266531 - DNA, 20 bp, Artificial Sequence
  Description of Artificial Sequence: Synthetic oligonucleotide
  Target: ATXN1; (+) strand; PAM type: YTN; PAM sequence: TTG
aactgaacaaattaagtaat

SEQ ID NO: 266532 - DNA, 20 bp, Artificial Sequence
  Description of Artificial Sequence: Synthetic oligonucleotide
  Target: ATXN1; (+) strand; PAM type: YTN; PAM sequence: CTG
aacaaattaagtaatttgct

SEQ ID NO: 266533 - DNA, 20 bp, Artificial Sequence
  Description of Artificial Sequence: Synthetic oligonucleotide
  Target: ATXN1; (+) strand; PAM type: YTN; PAM sequence: TTA
agtaatttgctttggttaaa

SEQ ID NO: 266534 - DNA, 20 bp, Artificial Sequence
  Description of Artificial Sequence: Synthetic oligonucleotide
  Target: ATXN1; (+) strand; PAM type: YTN; PAM sequence: TTT
gctttggttaaagggaaatt

SEQ ID NO: 266535 - DNA, 20 bp, Artificial Sequence
  Description of Artificial Sequence: Synthetic oligonucleotide
  Target: ATXN1; (+) strand; PAM type: YTN; PAM sequence: TTG
ctttggttaaagggaaatta

SEQ ID NO: 266536 - DNA, 20 bp, Artificial Sequence
  Description of Artificial Sequence: Synthetic oligonucleotide
  Target: ATXN1; (+) strand; PAM type: YTN; PAM sequence: CTT
tggttaaagggaaattagca

SEQ ID NO: 266537 - DNA, 20 bp, Artificial Sequence
  Description of Artificial Sequence: Synthetic oligonucleotide
  Target: ATXN1; (+) strand; PAM type: YTN; PAM sequence: TTT
ggttaaagggaaattagcaa

SEQ ID NO: 266538 - DNA, 20 bp, Artificial Sequence
  Description of Artificial Sequence: Synthetic oligonucleotide
  Target: ATXN1; (+) strand; PAM type: YTN; PAM sequence: TTG
gttaaagggaaattagcaag

SEQ ID NO: 266539 - DNA, 20 bp, Artificial Sequence
  Description of Artificial Sequence: Synthetic oligonucleotide
  Target: ATXN1; (+) strand; PAM type: YTN; PAM sequence: TTA
aagggaaattagcaagcatc

SEQ ID NO: 266540 - DNA, 20 bp, Artificial Sequence
  Description of Artificial Sequence: Synthetic oligonucleotide
  Target: ATXN1; (+) strand; PAM type: YTN; PAM sequence: TTA
gcaagcatcttgaagcagag

SEQ ID NO: 266541 - DNA, 20 bp, Artificial Sequence
  Description of Artificial Sequence: Synthetic oligonucleotide
  Target: ATXN1; (+) strand; PAM type: YTN; PAM sequence: CTT
gaagcagagcttgaaaagca

SEQ ID NO: 266542 - DNA, 20 bp, Artificial Sequence
  Description of Artificial Sequence: Synthetic oligonucleotide
  Target: ATXN1; (+) strand; PAM type: YTN; PAM sequence: TTG
aagcagagcttgaaaagcac

SEQ ID NO: 266543 - DNA, 20 bp, Artificial Sequence
  Description of Artificial Sequence: Synthetic oligonucleotide
  Target: ATXN1; (+) strand; PAM type: YTN; PAM sequence: CTT
gaaaagcactcatgcactgg

SEQ ID NO: 266544 - DNA, 20 bp, Artificial Sequence
  Description of Artificial Sequence: Synthetic oligonucleotide
  Target: ATXN1; (+) strand; PAM type: YTN; PAM sequence: TTG
aaaagcactcatgcactggg

SEQ ID NO: 266545 - DNA, 20 bp, Artificial Sequence
  Description of Artificial Sequence: Synthetic oligonucleotide
  Target: ATXN1; (+) strand; PAM type: YTN; PAM sequence: CTC
atgcactggggcttgccctt

SEQ ID NO: 266546 - DNA, 20 bp, Artificial Sequence
  Description of Artificial Sequence: Synthetic oligonucleotide
  Target: ATXN1; (+) strand; PAM type: YTN; PAM sequence: CTG
gggcttgccctttcttgctg

SEQ ID NO: 266547 - DNA, 20 bp, Artificial Sequence
  Description of Artificial Sequence: Synthetic oligonucleotide
  Target: ATXN1; (+) strand; PAM type: YTN; PAM sequence: CTT
gccctttcttgctgcttttg

SEQ ID NO: 266548 - DNA, 20 bp, Artificial Sequence
  Description of Artificial Sequence: Synthetic oligonucleotide
  Target: ATXN1; (+) strand; PAM type: YTN; PAM sequence: TTG
ccctttcttgctgcttttgg

SEQ ID NO: 266549 - DNA, 20 bp, Artificial Sequence
  Description of Artificial Sequence: Synthetic oligonucleotide
  Target: ATXN1; (+) strand; PAM type: YTN; PAM sequence: CTT
tcttgctgcttttgggaacc

SEQ ID NO: 266550 - DNA, 20 bp, Artificial Sequence
  Description of Artificial Sequence: Synthetic oligonucleotide
  Target: ATXN1; (+) strand; PAM type: YTN; PAM sequence: TTT
cttgctgcttttgggaaccc

SEQ ID NO: 266551 - DNA, 20 bp, Artificial Sequence
  Description of Artificial Sequence: Synthetic oligonucleotide
  Target: ATXN1; (+) strand; PAM type: YTN; PAM sequence: TTC
ttgctgcttttgggaaccct

SEQ ID NO: 266552 - DNA, 20 bp, Artificial Sequence
  Description of Artificial Sequence: Synthetic oligonucleotide
  Target: ATXN1; (+) strand; PAM type: YTN; PAM sequence: CTT
gctgcttttgggaaccctta

SEQ ID NO: 266553 - DNA, 20 bp, Artificial Sequence
  Description of Artificial Sequence: Synthetic oligonucleotide
  Target: ATXN1; (+) strand; PAM type: YTN; PAM sequence: TTG
ctgcttttgggaacccttag

SEQ ID NO: 266554 - DNA, 20 bp, Artificial Sequence
  Description of Artificial Sequence: Synthetic oligonucleotide
  Target: ATXN1; (+) strand; PAM type: YTN; PAM sequence: CTG
cttttgggaacccttagcct

SEQ ID NO: 266555 - DNA, 20 bp, Artificial Sequence
  Description of Artificial Sequence: Synthetic oligonucleotide
  Target: ATXN1; (+) strand; PAM type: YTN; PAM sequence: CTT
ttgggaacccttagcctgca

SEQ ID NO: 266556 - DNA, 20 bp, Artificial Sequence
  Description of Artificial Sequence: Synthetic oligonucleotide
  Target: ATXN1; (+) strand; PAM type: YTN; PAM sequence: TTT
tgggaacccttagcctgcaa

SEQ ID NO: 266557 - DNA, 20 bp, Artificial Sequence
  Description of Artificial Sequence: Synthetic oligonucleotide
  Target: ATXN1; (+) strand; PAM type: YTN; PAM sequence: TTT
gggaacccttagcctgcaaa

SEQ ID NO: 266558 - DNA, 20 bp, Artificial Sequence
  Description of Artificial Sequence: Synthetic oligonucleotide
  Target: ATXN1; (+) strand; PAM type: YTN; PAM sequence: TTG
ggaacccttagcctgcaaag

SEQ ID NO: 266559 - DNA, 20 bp, Artificial Sequence
  Description of Artificial Sequence: Synthetic oligonucleotide
  Target: ATXN1; (+) strand; PAM type: YTN; PAM sequence: CTT
agcctgcaaagtgaagaagc

SEQ ID NO: 266560 - DNA, 20 bp, Artificial Sequence
  Description of Artificial Sequence: Synthetic oligonucleotide
  Target: ATXN1; (+) strand; PAM type: YTN; PAM sequence: TTA
gcctgcaaagtgaagaagct

SEQ ID NO: 266561 - DNA, 20 bp, Artificial Sequence
  Description of Artificial Sequence: Synthetic oligonucleotide
  Target: ATXN1; (+) strand; PAM type: YTN; PAM sequence: CTG
caaagtgaagaagctcagac

SEQ ID NO: 266562 - DNA, 20 bp, Artificial Sequence
  Description of Artificial Sequence: Synthetic oligonucleotide
  Target: ATXN1; (+) strand; PAM type: YTN; PAM sequence: CTC
agactagtctactggaggat

SEQ ID NO: 266563 - DNA, 20 bp, Artificial Sequence
  Description of Artificial Sequence: Synthetic oligonucleotide
  Target: ATXN1; (+) strand; PAM type: YTN; PAM sequence: CTA
gtctactggaggatgagagg

SEQ ID NO: 266564 - DNA, 20 bp, Artificial Sequence
  Description of Artificial Sequence: Synthetic oligonucleotide
  Target: ATXN1; (+) strand; PAM type: YTN; PAM sequence: CTA
ctggaggatgagaggccacc

SEQ ID NO: 266565 - DNA, 20 bp, Artificial Sequence
  Description of Artificial Sequence: Synthetic oligonucleotide
  Target: ATXN1; (+) strand; PAM type: YTN; PAM sequence: CTG
gaggatgagaggccacctga

SEQ ID NO: 266566 - DNA, 20 bp, Artificial Sequence
  Description of Artificial Sequence: Synthetic oligonucleotide
  Target: ATXN1; (+) strand; PAM type: YTN; PAM sequence: CTG
aagcagagacaagctgtccc

SEQ ID NO: 266567 - DNA, 20 bp, Artificial Sequence
  Description of Artificial Sequence: Synthetic oligonucleotide
  Target: ATXN1; (+) strand; PAM type: YTN; PAM sequence: CTG
tcccagctgaagatcaccca

SEQ ID NO: 266568 - DNA, 20 bp, Artificial Sequence
  Description of Artificial Sequence: Synthetic oligonucleotide
  Target: ATXN1; (+) strand; PAM type: YTN; PAM sequence: CTG
aagatcacccatctctcagg

SEQ ID NO: 266569 - DNA, 20 bp, Artificial Sequence
  Description of Artificial Sequence: Synthetic oligonucleotide
  Target: ATXN1; (+) strand; PAM type: YTN; PAM sequence: CTC
tcaggcaaaccagccttcta

SEQ ID NO: 266570 - DNA, 20 bp, Artificial Sequence
  Description of Artificial Sequence: Synthetic oligonucleotide
  Target: ATXN1; (+) strand; PAM type: YTN; PAM sequence: CTC
aggcaaaccagccttctagt

SEQ ID NO: 266571 - DNA, 20 bp, Artificial Sequence
  Description of Artificial Sequence: Synthetic oligonucleotide
  Target: ATXN1; (+) strand; PAM type: YTN; PAM sequence: CTT
ctagtagctatgtgagtgag

SEQ ID NO: 266572 - DNA, 20 bp, Artificial Sequence
  Description of Artificial Sequence: Synthetic oligonucleotide
  Target: ATXN1; (+) strand; PAM type: YTN; PAM sequence: TTC
tagtagctatgtgagtgaga

SEQ ID NO: 266573 - DNA, 20 bp, Artificial Sequence
  Description of Artificial Sequence: Synthetic oligonucleotide
  Target: ATXN1; (+) strand; PAM type: YTN; PAM sequence: CTA
gtagctatgtgagtgagacc

SEQ ID NO: 266574 - DNA, 20 bp, Artificial Sequence
  Description of Artificial Sequence: Synthetic oligonucleotide
  Target: ATXN1; (+) strand; PAM type: YTN; PAM sequence: CTA
tgtgagtgagaccatgctgg

SEQ ID NO: 266575 - DNA, 20 bp, Artificial Sequence
  Description of Artificial Sequence: Synthetic oligonucleotide
  Target: ATXN1; (+) strand; PAM type: YTN; PAM sequence: CTG
gattaaccagtcccagccaa

SEQ ID NO: 266576 - DNA, 20 bp, Artificial Sequence
  Description of Artificial Sequence: Synthetic oligonucleotide
  Target: ATXN1; (+) strand; PAM type: YTN; PAM sequence: TTA
accagtcccagccaagctgg

SEQ ID NO: 266577 - DNA, 20 bp, Artificial Sequence
  Description of Artificial Sequence: Synthetic oligonucleotide
  Target: ATXN1; (+) strand; PAM type: YTN; PAM sequence: CTG
gcccagactaaaatagtcca

SEQ ID NO: 266578 - DNA, 20 bp, Artificial Sequence
  Description of Artificial Sequence: Synthetic oligonucleotide
  Target: ATXN1; (+) strand; PAM type: YTN; PAM sequence: CTA
aaatagtccaggtgacccac

SEQ ID NO: 266579 - DNA, 20 bp, Artificial Sequence
  Description of Artificial Sequence: Synthetic oligonucleotide
  Target: ATXN1; (+) strand; PAM type: YTN; PAM sequence: TTG
tggtcttggcccttaactgt

SEQ ID NO: 266580 - DNA, 20 bp, Artificial Sequence
  Description of Artificial Sequence: Synthetic oligonucleotide
  Target: ATXN1; (+) strand; PAM type: YTN; PAM sequence: CTT
ggcccttaactgttgggatg

SEQ ID NO: 266581 - DNA, 20 bp, Artificial Sequence
  Description of Artificial Sequence: Synthetic oligonucleotide
  Target: ATXN1; (+) strand; PAM type: YTN; PAM sequence: TTG
gcccttaactgttgggatgg

SEQ ID NO: 266582 - DNA, 20 bp, Artificial Sequence
  Description of Artificial Sequence: Synthetic oligonucleotide
  Target: ATXN1; (+) strand; PAM type: YTN; PAM sequence: CTT
aactgttgggatggcttgtt

SEQ ID NO: 266583 - DNA, 20 bp, Artificial Sequence
  Description of Artificial Sequence: Synthetic oligonucleotide
  Target: ATXN1; (+) strand; PAM type: YTN; PAM sequence: TTA
actgttgggatggcttgtta

SEQ ID NO: 266584 - DNA, 20 bp, Artificial Sequence
  Description of Artificial Sequence: Synthetic oligonucleotide
  Target: ATXN1; (+) strand; PAM type: YTN; PAM sequence: CTG
ttgggatggcttgttacaca

SEQ ID NO: 266585 - DNA, 20 bp, Artificial Sequence
  Description of Artificial Sequence: Synthetic oligonucleotide
  Target: ATXN1; (+) strand; PAM type: YTN; PAM sequence: TTG
ggatggcttgttacacagta

SEQ ID NO: 266586 - DNA, 20 bp, Artificial Sequence
  Description of Artificial Sequence: Synthetic oligonucleotide
  Target: ATXN1; (+) strand; PAM type: YTN; PAM sequence: CTT
gttacacagtatatgctaac

SEQ ID NO: 266587 - DNA, 20 bp, Artificial Sequence
  Description of Artificial Sequence: Synthetic oligonucleotide
  Target: ATXN1; (+) strand; PAM type: YTN; PAM sequence: TTG
ttacacagtatatgctaact

SEQ ID NO: 266588 - DNA, 20 bp, Artificial Sequence
  Description of Artificial Sequence: Synthetic oligonucleotide
  Target: ATXN1; (+) strand; PAM type: YTN; PAM sequence: TTA
cacagtatatgctaactgat

SEQ ID NO: 266589 - DNA, 20 bp, Artificial Sequence
  Description of Artificial Sequence: Synthetic oligonucleotide
  Target: ATXN1; (+) strand; PAM type: YTN; PAM sequence: CTA
actgatacatccactttgtt

SEQ ID NO: 266590 - DNA, 20 bp, Artificial Sequence
  Description of Artificial Sequence: Synthetic oligonucleotide
  Target: ATXN1; (+) strand; PAM type: YTN; PAM sequence: CTG
atacatccactttgttttct

SEQ ID NO: 266591 - DNA, 20 bp, Artificial Sequence
  Description of Artificial Sequence: Synthetic oligonucleotide
  Target: ATXN1; (+) strand; PAM type: YTN; PAM sequence: CTT
tgttttctggttaacatcta

SEQ ID NO: 266592 - DNA, 20 bp, Artificial Sequence
  Description of Artificial Sequence: Synthetic oligonucleotide
  Target: ATXN1; (+) strand; PAM type: YTN; PAM sequence: TTT
gttttctggttaacatctac

SEQ ID NO: 266593 - DNA, 20 bp, Artificial Sequence
  Description of Artificial Sequence: Synthetic oligonucleotide
  Target: ATXN1; (+) strand; PAM type: YTN; PAM sequence: TTG
ttttctggttaacatctact

SEQ ID NO: 266594 - DNA, 20 bp, Artificial Sequence
  Description of Artificial Sequence: Synthetic oligonucleotide
  Target: ATXN1; (+) strand; PAM type: YTN; PAM sequence: TTT
tctggttaacatctactcct

SEQ ID NO: 266595 - DNA, 20 bp, Artificial Sequence
  Description of Artificial Sequence: Synthetic oligonucleotide
  Target: ATXN1; (+) strand; PAM type: YTN; PAM sequence: TTT
ctggttaacatctactcctc

SEQ ID NO: 266596 - DNA, 20 bp, Artificial Sequence
  Description of Artificial Sequence: Synthetic oligonucleotide
  Target: ATXN1; (+) strand; PAM type: YTN; PAM sequence: TTC
tggttaacatctactcctca

SEQ ID NO: 266597 - DNA, 20 bp, Artificial Sequence
  Description of Artificial Sequence: Synthetic oligonucleotide
  Target: ATXN1; (+) strand; PAM type: YTN; PAM sequence: CTG
gttaacatctactcctcatt

SEQ ID NO: 266598 - DNA, 20 bp, Artificial Sequence
  Description of Artificial Sequence: Synthetic oligonucleotide
  Target: ATXN1; (+) strand; PAM type: YTN; PAM sequence: TTA
acatctactcctcattcaag

SEQ ID NO: 266599 - DNA, 20 bp, Artificial Sequence
  Description of Artificial Sequence: Synthetic oligonucleotide
  Target: ATXN1; (+) strand; PAM type: YTN; PAM sequence: CTA
ctcctcattcaagtctgagg

SEQ ID NO: 266600 - DNA, 20 bp, Artificial Sequence
  Description of Artificial Sequence: Synthetic oligonucleotide
  Target: ATXN1; (+) strand; PAM type: YTN; PAM sequence: CTC
ctcattcaagtctgaggatg

SEQ ID NO: 266601 - DNA, 20 bp, Artificial Sequence
  Description of Artificial Sequence: Synthetic oligonucleotide
  Target: ATXN1; (+) strand; PAM type: YTN; PAM sequence: CTC
attcaagtctgaggatgaaa

SEQ ID NO: 266602 - DNA, 20 bp, Artificial Sequence
  Description of Artificial Sequence: Synthetic oligonucleotide
  Target: ATXN1; (+) strand; PAM type: YTN; PAM sequence: TTC
aagtctgaggatgaaagctt

SEQ ID NO: 266603 - DNA, 20 bp, Artificial Sequence
  Description of Artificial Sequence: Synthetic oligonucleotide
  Target: ATXN1; (+) strand; PAM type: YTN; PAM sequence: CTG
aggatgaaagcttccctgat

SEQ ID NO: 266604 - DNA, 20 bp, Artificial Sequence
  Description of Artificial Sequence: Synthetic oligonucleotide
  Target: ATXN1; (+) strand; PAM type: YTN; PAM sequence: CTT
ccctgatcccagaagatgcc

SEQ ID NO: 266605 - DNA, 20 bp, Artificial Sequence
  Description of Artificial Sequence: Synthetic oligonucleotide
  Target: ATXN1; (+) strand; PAM type: YTN; PAM sequence: TTC
cctgatcccagaagatgcca

SEQ ID NO: 266606 - DNA, 20 bp, Artificial Sequence
  Description of Artificial Sequence: Synthetic oligonucleotide
  Target: ATXN1; (+) strand; PAM type: YTN; PAM sequence: CTG
atcccagaagatgccatgct

SEQ ID NO: 266607 - DNA, 20 bp, Artificial Sequence
  Description of Artificial Sequence: Synthetic oligonucleotide
  Target: ATXN1; (+) strand; PAM type: YTN; PAM sequence: CTG
gtctgcatccatggcaacct

SEQ ID NO: 266608 - DNA, 20 bp, Artificial Sequence
  Description of Artificial Sequence: Synthetic oligonucleotide
  Target: ATXN1; (+) strand; PAM type: YTN; PAM sequence: CTG
catccatggcaacctgtggg

SEQ ID NO: 266609 - DNA, 20 bp, Artificial Sequence
  Description of Artificial Sequence: Synthetic oligonucleotide
  Target: ATXN1; (+) strand; PAM type: YTN; PAM sequence: CTG
tgggtaccattaggagagag

SEQ ID NO: 266610 - DNA, 20 bp, Artificial Sequence
  Description of Artificial Sequence: Synthetic oligonucleotide
  Target: ATXN1; (+) strand; PAM type: YTN; PAM sequence: TTA
ggagagagctggtcatggtg

SEQ ID NO: 266611 - DNA, 20 bp, Artificial Sequence
  Description of Artificial Sequence: Synthetic oligonucleotide
  Target: ATXN1; (+) strand; PAM type: YTN; PAM sequence: CTG
gtcatggtgtaaaggaattg

SEQ ID NO: 266612 - DNA, 20 bp, Artificial Sequence
  Description of Artificial Sequence: Synthetic oligonucleotide
  Target: ATXN1; (+) strand; PAM type: YTN; PAM sequence: TTG
cctgttttctcatttctttc

SEQ ID NO: 266613 - DNA, 20 bp, Artificial Sequence
  Description of Artificial Sequence: Synthetic oligonucleotide
  Target: ATXN1; (+) strand; PAM type: YTN; PAM sequence: CTG
ttttctcatttctttcccca

SEQ ID NO: 266614 - DNA, 20 bp, Artificial Sequence
  Description of Artificial Sequence: Synthetic oligonucleotide
  Target: ATXN1; (+) strand; PAM type: YTN; PAM sequence: TTT
tctcatttctttccccagtg

SEQ ID NO: 266615 - DNA, 20 bp, Artificial Sequence
  Description of Artificial Sequence: Synthetic oligonucleotide
  Target: ATXN1; (+) strand; PAM type: YTN; PAM sequence: TTT
ctcatttctttccccagtga

SEQ ID NO: 266616 - DNA, 20 bp, Artificial Sequence
  Description of Artificial Sequence: Synthetic oligonucleotide
  Target: ATXN1; (+) strand; PAM type: YTN; PAM sequence: TTC
tcatttctttccccagtgac

SEQ ID NO: 266617 - DNA, 20 bp, Artificial Sequence
  Description of Artificial Sequence: Synthetic oligonucleotide
  Target: ATXN1; (+) strand; PAM type: YTN; PAM sequence: CTC
atttctttccccagtgactg

SEQ ID NO: 266618 - DNA, 20 bp, Artificial Sequence
  Description of Artificial Sequence: Synthetic oligonucleotide
  Target: ATXN1; (+) strand; PAM type: YTN; PAM sequence: TTT
ctttccccagtgactgaaag

SEQ ID NO: 266619 - DNA, 20 bp, Artificial Sequence
  Description of Artificial Sequence: Synthetic oligonucleotide
  Target: ATXN1; (+) strand; PAM type: YTN; PAM sequence: TTC
tttccccagtgactgaaagc

SEQ ID NO: 266620 - DNA, 20 bp, Artificial Sequence
  Description of Artificial Sequence: Synthetic oligonucleotide
  Target: ATXN1; (+) strand; PAM type: YTN; PAM sequence: CTT
tccccagtgactgaaagctc

SEQ ID NO: 266621 - DNA, 20 bp, Artificial Sequence
  Description of Artificial Sequence: Synthetic oligonucleotide
  Target: ATXN1; (+) strand; PAM type: YTN; PAM sequence: TTT
ccccagtgactgaaagctcc

SEQ ID NO: 266622 - DNA, 20 bp, Artificial Sequence
  Description of Artificial Sequence: Synthetic oligonucleotide
  Target: ATXN1; (+) strand; PAM type: YTN; PAM sequence: TTC
cccagtgactgaaagctcct

SEQ ID NO: 266623 - DNA, 20 bp, Artificial Sequence
  Description of Artificial Sequence: Synthetic oligonucleotide
  Target: ATXN1; (+) strand; PAM type: YTN; PAM sequence: CTG
aaagctcctttaactactgt

SEQ ID NO: 266624 - DNA, 20 bp, Artificial Sequence
  Description of Artificial Sequence: Synthetic oligonucleotide
  Target: ATXN1; (+) strand; PAM type: YTN; PAM sequence: CTC
ctttaactactgtaggtgcc

SEQ ID NO: 266625 - DNA, 20 bp, Artificial Sequence
  Description of Artificial Sequence: Synthetic oligonucleotide
  Target: ATXN1; (+) strand; PAM type: YTN; PAM sequence: CTT
taactactgtaggtgcctag

SEQ ID NO: 266626 - DNA, 20 bp, Artificial Sequence
  Description of Artificial Sequence: Synthetic oligonucleotide
  Target: ATXN1; (+) strand; PAM type: YTN; PAM sequence: TTT
aactactgtaggtgcctagc

SEQ ID NO: 266627 - DNA, 20 bp, Artificial Sequence
  Description of Artificial Sequence: Synthetic oligonucleotide
  Target: ATXN1; (+) strand; PAM type: YTN; PAM sequence: TTA
actactgtaggtgcctagcc

SEQ ID NO: 266628 - DNA, 20 bp, Artificial Sequence
  Description of Artificial Sequence: Synthetic oligonucleotide
  Target: ATXN1; (+) strand; PAM type: YTN; PAM sequence: CTA
ctgtaggtgcctagcctgta

SEQ ID NO: 266629 - DNA, 20 bp, Artificial Sequence
  Description of Artificial Sequence: Synthetic oligonucleotide
  Target: ATXN1; (+) strand; PAM type: YTN; PAM sequence: CTG
taggtgcctagcctgtagca

SEQ ID NO: 266630 - DNA, 20 bp, Artificial Sequence
  Description of Artificial Sequence: Synthetic oligonucleotide
  Target: ATXN1; (+) strand; PAM type: YTN; PAM sequence: CTA
gcctgtagcatatgtgtgtg

SEQ ID NO: 266631 - DNA, 20 bp, Artificial Sequence
  Description of Artificial Sequence: Synthetic oligonucleotide
  Target: ATXN1; (+) strand; PAM type: YTN; PAM sequence: CTG
tagcatatgtgtgtgcatac

SEQ ID NO: 266632 - DNA, 20 bp, Artificial Sequence
  Description of Artificial Sequence: Synthetic oligonucleotide
  Target: ATXN1; (+) strand; PAM type: YTN; PAM sequence: CTC
tctctctctttctgtaaata

SEQ ID NO: 266633 - DNA, 20 bp, Artificial Sequence
  Description of Artificial Sequence: Synthetic oligonucleotide
  Target: ATXN1; (+) strand; PAM type: YTN; PAM sequence: CTC
tctctctttctgtaaatatt

SEQ ID NO: 266634 - DNA, 20 bp, Artificial Sequence
  Description of Artificial Sequence: Synthetic oligonucleotide
  Target: ATXN1; (+) strand; PAM type: YTN; PAM sequence: CTC
tctctttctgtaaatatttg

SEQ ID NO: 266635 - DNA, 20 bp, Artificial Sequence
  Description of Artificial Sequence: Synthetic oligonucleotide
  Target: ATXN1; (+) strand; PAM type: YTN; PAM sequence: CTC
tctttctgtaaatatttgct

SEQ ID NO: 266636 - DNA, 20 bp, Artificial Sequence
  Description of Artificial Sequence: Synthetic oligonucleotide
  Target: ATXN1; (+) strand; PAM type: YTN; PAM sequence: CTC
tttctgtaaatatttgctga

SEQ ID NO: 266637 - DNA, 20 bp, Artificial Sequence
  Description of Artificial Sequence: Synthetic oligonucleotide
  Target: ATXN1; (+) strand; PAM type: YTN; PAM sequence: CTT
tctgtaaatatttgctgaaa

SEQ ID NO: 266638 - DNA, 20 bp, Artificial Sequence
  Description of Artificial Sequence: Synthetic oligonucleotide
  Target: ATXN1; (+) strand; PAM type: YTN; PAM sequence: TTT
ctgtaaatatttgctgaaag

SEQ ID NO: 266639 - DNA, 20 bp, Artificial Sequence
  Description of Artificial Sequence: Synthetic oligonucleotide
  Target: ATXN1; (+) strand; PAM type: YTN; PAM sequence: TTC
tgtaaatatttgctgaaaga

SEQ ID NO: 266640 - DNA, 20 bp, Artificial Sequence
  Description of Artificial Sequence: Synthetic oligonucleotide
  Target: ATXN1; (+) strand; PAM type: YTN; PAM sequence: CTG
taaatatttgctgaaagaag

SEQ ID NO: 266641 - DNA, 20 bp, Artificial Sequence
  Description of Artificial Sequence: Synthetic oligonucleotide
  Target: ATXN1; (+) strand; PAM type: YTN; PAM sequence: TTT
gctgaaagaagatacaagaa

SEQ ID NO: 266642 - DNA, 20 bp, Artificial Sequence
  Description of Artificial Sequence: Synthetic oligonucleotide
  Target: ATXN1; (+) strand; PAM type: YTN; PAM sequence: TTG
ctgaaagaagatacaagaat

SEQ ID NO: 266643 - DNA, 20 bp, Artificial Sequence
  Description of Artificial Sequence: Synthetic oligonucleotide
  Target: ATXN1; (+) strand; PAM type: YTN; PAM sequence: CTG
aaagaagatacaagaatgta

SEQ ID NO: 266644 - DNA, 20 bp, Artificial Sequence
  Description of Artificial Sequence: Synthetic oligonucleotide
  Target: ATXN1; (+) strand; PAM type: YTN; PAM sequence: CTT
caggctttcttctatcctaa

SEQ ID NO: 266645 - DNA, 20 bp, Artificial Sequence
  Description of Artificial Sequence: Synthetic oligonucleotide
  Target: ATXN1; (+) strand; PAM type: YTN; PAM sequence: TTC
aggctttcttctatcctaaa

SEQ ID NO: 266646 - DNA, 20 bp, Artificial Sequence
  Description of Artificial Sequence: Synthetic oligonucleotide
  Target: ATXN1; (+) strand; PAM type: YTN; PAM sequence: CTT
tcttctatcctaaatttcaa

SEQ ID NO: 266647 - DNA, 20 bp, Artificial Sequence
  Description of Artificial Sequence: Synthetic oligonucleotide
  Target: ATXN1; (+) strand; PAM type: YTN; PAM sequence: TTT
cttctatcctaaatttcaaa

SEQ ID NO: 266648 - DNA, 20 bp, Artificial Sequence
  Description of Artificial Sequence: Synthetic oligonucleotide
  Target: ATXN1; (+) strand; PAM type: YTN; PAM sequence: TTC
ttctatcctaaatttcaaag

SEQ ID NO: 266649 - DNA, 20 bp, Artificial Sequence
  Description of Artificial Sequence: Synthetic oligonucleotide
  Target: ATXN1; (+) strand; PAM type: YTN; PAM sequence: CTT
ctatcctaaatttcaaagaa

SEQ ID NO: 266650 - DNA, 20 bp, Artificial Sequence
  Description of Artificial Sequence: Synthetic oligonucleotide
  Target: ATXN1; (+) strand; PAM type: YTN; PAM sequence: TTC
tatcctaaatttcaaagaat

SEQ ID NO: 266651 - DNA, 20 bp, Artificial Sequence
  Description of Artificial Sequence: Synthetic oligonucleotide
  Target: ATXN1; (+) strand; PAM type: YTN; PAM sequence: CTA
tcctaaatttcaaagaatta

SEQ ID NO: 266652 - DNA, 20 bp, Artificial Sequence
  Description of Artificial Sequence: Synthetic oligonucleotide
  Target: ATXN1; (+) strand; PAM type: YTN; PAM sequence: CTA
aatttcaaagaattagacta

SEQ ID NO: 266653 - DNA, 20 bp, Artificial Sequence
  Description of Artificial Sequence: Synthetic oligonucleotide
  Target: ATXN1; (+) strand; PAM type: YTN; PAM sequence: TTT
caaagaattagactagactg

SEQ ID NO: 266654 - DNA, 20 bp, Artificial Sequence
  Description of Artificial Sequence: Synthetic oligonucleotide
  Target: ATXN1; (+) strand; PAM type: YTN; PAM sequence: TTC
aaagaattagactagactgt

SEQ ID NO: 266655 - DNA, 20 bp, Artificial Sequence
  Description of Artificial Sequence: Synthetic oligonucleotide
  Target: ATXN1; (+) strand; PAM type: YTN; PAM sequence: TTA
gactagactgtttttaccta

SEQ ID NO: 266656 - DNA, 20 bp, Artificial Sequence
  Description of Artificial Sequence: Synthetic oligonucleotide
  Target: ATXN1; (+) strand; PAM type: YTN; PAM sequence: CTA
gactgtttttacctatcacc

SEQ ID NO: 266657 - DNA, 20 bp, Artificial Sequence
  Description of Artificial Sequence: Synthetic oligonucleotide
  Target: ATXN1; (+) strand; PAM type: YTN; PAM sequence: CTG
tttttacctatcaccaccta

SEQ ID NO: 266658 - DNA, 20 bp, Artificial Sequence
  Description of Artificial Sequence: Synthetic oligonucleotide
  Target: ATXN1; (+) strand; PAM type: YTN; PAM sequence: TTT
ttacctatcaccacctagac

SEQ ID NO: 266659 - DNA, 20 bp, Artificial Sequence
  Description of Artificial Sequence: Synthetic oligonucleotide
  Target: ATXN1; (+) strand; PAM type: YTN; PAM sequence: TTT
tacctatcaccacctagaca

SEQ ID NO: 266660 - DNA, 20 bp, Artificial Sequence
  Description of Artificial Sequence: Synthetic oligonucleotide
  Target: ATXN1; (+) strand; PAM type: YTN; PAM sequence: TTT
acctatcaccacctagacac

SEQ ID NO: 266661 - DNA, 20 bp, Artificial Sequence
  Description of Artificial Sequence: Synthetic oligonucleotide
  Target: ATXN1; (+) strand; PAM type: YTN; PAM sequence: TTA
cctatcaccacctagacacg

SEQ ID NO: 266662 - DNA, 20 bp, Artificial Sequence
  Description of Artificial Sequence: Synthetic oligonucleotide
  Target: ATXN1; (+) strand; PAM type: YTN; PAM sequence: CTA
tcaccacctagacacggtaa

SEQ ID NO: 266663 - DNA, 20 bp, Artificial Sequence
  Description of Artificial Sequence: Synthetic oligonucleotide
  Target: ATXN1; (+) strand; PAM type: YTN; PAM sequence: CTA
gacacggtaaccacatcaaa

SEQ ID NO: 266664 - DNA, 20 bp, Artificial Sequence
  Description of Artificial Sequence: Synthetic oligonucleotide
  Target: ATXN1; (+) strand; PAM type: YTN; PAM sequence: TTT
taatgttttactttttcaga

SEQ ID NO: 266665 - DNA, 20 bp, Artificial Sequence
  Description of Artificial Sequence: Synthetic oligonucleotide
  Target: ATXN1; (+) strand; PAM type: YTN; PAM sequence: TTT
aatgttttactttttcagag

SEQ ID NO: 266666 - DNA, 20 bp, Artificial Sequence
  Description of Artificial Sequence: Synthetic oligonucleotide
  Target: ATXN1; (+) strand; PAM type: YTN; PAM sequence: TTA
atgttttactttttcagagt

SEQ ID NO: 266667 - DNA, 20 bp, Artificial Sequence
  Description of Artificial Sequence: Synthetic oligonucleotide
  Target: ATXN1; (+) strand; PAM type: YTN; PAM sequence: TTT
tactttttcagagttctact

SEQ ID NO: 266668 - DNA, 20 bp, Artificial Sequence
  Description of Artificial Sequence: Synthetic oligonucleotide
  Target: ATXN1; (+) strand; PAM type: YTN; PAM sequence: TTT
actttttcagagttctactc

SEQ ID NO: 266669 - DNA, 20 bp, Artificial Sequence
  Description of Artificial Sequence: Synthetic oligonucleotide
  Target: ATXN1; (+) strand; PAM type: YTN; PAM sequence: TTA
ctttttcagagttctactca

SEQ ID NO: 266670 - DNA, 20 bp, Artificial Sequence
  Description of Artificial Sequence: Synthetic oligonucleotide
  Target: ATXN1; (+) strand; PAM type: YTN; PAM sequence: CTT
tttcagagttctactcatat

SEQ ID NO: 266671 - DNA, 20 bp, Artificial Sequence
  Description of Artificial Sequence: Synthetic oligonucleotide
  Target: ATXN1; (+) strand; PAM type: YTN; PAM sequence: TTT
ttcagagttctactcatatc

SEQ ID NO: 266672 - DNA, 20 bp, Artificial Sequence
  Description of Artificial Sequence: Synthetic oligonucleotide
  Target: ATXN1; (+) strand; PAM type: YTN; PAM sequence: TTT
tcagagttctactcatatca

SEQ ID NO: 266673 - DNA, 20 bp, Artificial Sequence
  Description of Artificial Sequence: Synthetic oligonucleotide
  Target: ATXN1; (+) strand; PAM type: YTN; PAM sequence: TTT
cagagttctactcatatcaa

SEQ ID NO: 266674 - DNA, 20 bp, Artificial Sequence
  Description of Artificial Sequence: Synthetic oligonucleotide
  Target: ATXN1; (+) strand; PAM type: YTN; PAM sequence: TTC
agagttctactcatatcaac

SEQ ID NO: 266675 - DNA, 20 bp, Artificial Sequence
  Description of Artificial Sequence: Synthetic oligonucleotide
  Target: ATXN1; (+) strand; PAM type: YTN; PAM sequence: TTC
tactcatatcaacagccttt

SEQ ID NO: 266676 - DNA, 20 bp, Artificial Sequence
  Description of Artificial Sequence: Synthetic oligonucleotide
  Target: ATXN1; (+) strand; PAM type: YTN; PAM sequence: CTA
ctcatatcaacagcctttgg

SEQ ID NO: 266677 - DNA, 20 bp, Artificial Sequence
  Description of Artificial Sequence: Synthetic oligonucleotide
  Target: ATXN1; (+) strand; PAM type: YTN; PAM sequence: CTC
atatcaacagcctttgggaa

SEQ ID NO: 266678 - DNA, 20 bp, Artificial Sequence
  Description of Artificial Sequence: Synthetic oligonucleotide
  Target: ATXN1; (+) strand; PAM type: YTN; PAM sequence: CTT
tgggaatctccctactcctt

SEQ ID NO: 266679 - DNA, 20 bp, Artificial Sequence
  Description of Artificial Sequence: Synthetic oligonucleotide
  Target: ATXN1; (+) strand; PAM type: YTN; PAM sequence: TTT
gggaatctccctactccttt

SEQ ID NO: 266680 - DNA, 20 bp, Artificial Sequence
  Description of Artificial Sequence: Synthetic oligonucleotide
  Target: ATXN1; (+) strand; PAM type: YTN; PAM sequence: TTG
ggaatctccctactcctttt

SEQ ID NO: 266681 - DNA, 20 bp, Artificial Sequence
  Description of Artificial Sequence: Synthetic oligonucleotide
  Target: ATXN1; (+) strand; PAM type: YTN; PAM sequence: CTC
cctactccttttatagatga

SEQ ID NO: 266682 - DNA, 20 bp, Artificial Sequence
  Description of Artificial Sequence: Synthetic oligonucleotide
  Target: ATXN1; (+) strand; PAM type: YTN; PAM sequence: CTA
ctccttttatagatgagact

SEQ ID NO: 266683 - DNA, 20 bp, Artificial Sequence
  Description of Artificial Sequence: Synthetic oligonucleotide
  Target: ATXN1; (+) strand; PAM type: YTN; PAM sequence: CTC
cttttatagatgagactatt

SEQ ID NO: 266684 - DNA, 20 bp, Artificial Sequence
  Description of Artificial Sequence: Synthetic oligonucleotide
  Target: ATXN1; (+) strand; PAM type: YTN; PAM sequence: CTT
ttatagatgagactattata

SEQ ID NO: 266685 - DNA, 20 bp, Artificial Sequence
  Description of Artificial Sequence: Synthetic oligonucleotide
  Target: ATXN1; (+) strand; PAM type: YTN; PAM sequence: TTT
tatagatgagactattatag

SEQ ID NO: 266686 - DNA, 20 bp, Artificial Sequence
  Description of Artificial Sequence: Synthetic oligonucleotide
  Target: ATXN1; (+) strand; PAM type: YTN; PAM sequence: TTT
atagatgagactattatagt

SEQ ID NO: 266687 - DNA, 20 bp, Artificial Sequence
  Description of Artificial Sequence: Synthetic oligonucleotide
  Target: ATXN1; (+) strand; PAM type: YTN; PAM sequence: TTA
tagatgagactattatagtt

SEQ ID NO: 266688 - DNA, 20 bp, Artificial Sequence
  Description of Artificial Sequence: Synthetic oligonucleotide
  Target: ATXN1; (+) strand; PAM type: YTN; PAM sequence: CTA
ttatagtttccaaactcact

SEQ ID NO: 266689 - DNA, 20 bp, Artificial Sequence
  Description of Artificial Sequence: Synthetic oligonucleotide
  Target: ATXN1; (+) strand; PAM type: YTN; PAM sequence: TTA
tagtttccaaactcactgtg

SEQ ID NO: 266690 - DNA, 20 bp, Artificial Sequence
  Description of Artificial Sequence: Synthetic oligonucleotide
  Target: ATXN1; (+) strand; PAM type: YTN; PAM sequence: TTT
ccaaactcactgtgcctttc

SEQ ID NO: 266691 - DNA, 20 bp, Artificial Sequence
  Description of Artificial Sequence: Synthetic oligonucleotide
  Target: ATXN1; (+) strand; PAM type: YTN; PAM sequence: TTC
caaactcactgtgcctttca

SEQ ID NO: 266692 - DNA, 20 bp, Artificial Sequence
  Description of Artificial Sequence: Synthetic oligonucleotide
  Target: ATXN1; (+) strand; PAM type: YTN; PAM sequence: CTC
actgtgcctttcagtttgac

SEQ ID NO: 266693 - DNA, 20 bp, Artificial Sequence
  Description of Artificial Sequence: Synthetic oligonucleotide
  Target: ATXN1; (+) strand; PAM type: YTN; PAM sequence: CTG
tgcctttcagtttgactaat

SEQ ID NO: 266694 - DNA, 20 bp, Artificial Sequence
  Description of Artificial Sequence: Synthetic oligonucleotide
  Target: ATXN1; (+) strand; PAM type: YTN; PAM sequence: CTT
tcagtttgactaatactata

SEQ ID NO: 266695 - DNA, 20 bp, Artificial Sequence
  Description of Artificial Sequence: Synthetic oligonucleotide
  Target: ATXN1; (+) strand; PAM type: YTN; PAM sequence: TTT
cagtttgactaatactataa

SEQ ID NO: 266696 - DNA, 20 bp, Artificial Sequence
  Description of Artificial Sequence: Synthetic oligonucleotide
  Target: ATXN1; (+) strand; PAM type: YTN; PAM sequence: TTC
agtttgactaatactataaa

SEQ ID NO: 266697 - DNA, 20 bp, Artificial Sequence
  Description of Artificial Sequence: Synthetic oligonucleotide
  Target: ATXN1; (+) strand; PAM type: YTN; PAM sequence: TTT
gactaatactataaaattca

SEQ ID NO: 266698 - DNA, 20 bp, Artificial Sequence
  Description of Artificial Sequence: Synthetic oligonucleotide
  Target: ATXN1; (+) strand; PAM type: YTN; PAM sequence: TTG
actaatactataaaattcac

SEQ ID NO: 266699 - DNA, 20 bp, Artificial Sequence
  Description of Artificial Sequence: Synthetic oligonucleotide
  Target: ATXN1; (+) strand; PAM type: YTN; PAM sequence: CTA
atactataaaattcacctaa

SEQ ID NO: 266700 - DNA, 20 bp, Artificial Sequence
  Description of Artificial Sequence: Synthetic oligonucleotide
  Target: ATXN1; (+) strand; PAM type: YTN; PAM sequence: CTA
taaaattcacctaaaattcc

SEQ ID NO: 266701 - DNA, 20 bp, Artificial Sequence
  Description of Artificial Sequence: Synthetic oligonucleotide
  Target: ATXN1; (+) strand; PAM type: YTN; PAM sequence: TTC
acctaaaattccaagggccc

SEQ ID NO: 266702 - DNA, 20 bp, Artificial Sequence
  Description of Artificial Sequence: Synthetic oligonucleotide
  Target: ATXN1; (+) strand; PAM type: YTN; PAM sequence: CTA
aaattccaagggccctcagc

SEQ ID NO: 266703 - DNA, 20 bp, Artificial Sequence
  Description of Artificial Sequence: Synthetic oligonucleotide
  Target: ATXN1; (+) strand; PAM type: YTN; PAM sequence: TTC
caagggccctcagcatatgc

SEQ ID NO: 266704 - DNA, 20 bp, Artificial Sequence
  Description of Artificial Sequence: Synthetic oligonucleotide
  Target: ATXN1; (+) strand; PAM type: YTN; PAM sequence: CTC
agcatatgcacatggataat

SEQ ID NO: 266705 - DNA, 20 bp, Artificial Sequence
  Description of Artificial Sequence: Synthetic oligonucleotide
  Target: ATXN1; (+) strand; PAM type: YTN; PAM sequence: TTC
tgacaaatgtgtcaccttca

SEQ ID NO: 266706 - DNA, 20 bp, Artificial Sequence
  Description of Artificial Sequence: Synthetic oligonucleotide
  Target: ATXN1; (+) strand; PAM type: YTN; PAM sequence: CTG
acaaatgtgtcaccttcact

SEQ ID NO: 266707 - DNA, 20 bp, Artificial Sequence
  Description of Artificial Sequence: Synthetic oligonucleotide
  Target: ATXN1; (+) strand; PAM type: YTN; PAM sequence: CTT
cactgtcataattattctac

SEQ ID NO: 266708 - DNA, 20 bp, Artificial Sequence
  Description of Artificial Sequence: Synthetic oligonucleotide
  Target: ATXN1; (+) strand; PAM type: YTN; PAM sequence: TTC
actgtcataattattctact

SEQ ID NO: 266709 - DNA, 20 bp, Artificial Sequence
  Description of Artificial Sequence: Synthetic oligonucleotide
  Target: ATXN1; (+) strand; PAM type: YTN; PAM sequence: CTG
tcataattattctactatat

SEQ ID NO: 266710 - DNA, 20 bp, Artificial Sequence
  Description of Artificial Sequence: Synthetic oligonucleotide
  Target: ATXN1; (+) strand; PAM type: YTN; PAM sequence: TTA
ttctactatatacatgtcaa

SEQ ID NO: 266711 - DNA, 20 bp, Artificial Sequence
  Description of Artificial Sequence: Synthetic oligonucleotide
  Target: ATXN1; (+) strand; PAM type: YTN; PAM sequence: TTC
tactatatacatgtcaagga

SEQ ID NO: 266712 - DNA, 20 bp, Artificial Sequence
  Description of Artificial Sequence: Synthetic oligonucleotide
  Target: ATXN1; (+) strand; PAM type: YTN; PAM sequence: CTA
ctatatacatgtcaaggaag

SEQ ID NO: 266713 - DNA, 20 bp, Artificial Sequence
  Description of Artificial Sequence: Synthetic oligonucleotide
  Target: ATXN1; (+) strand; PAM type: YTN; PAM sequence: CTA
tatacatgtcaaggaagcag

SEQ ID NO: 266714 - DNA, 20 bp, Artificial Sequence
  Description of Artificial Sequence: Synthetic oligonucleotide
  Target: ATXN1; (+) strand; PAM type: YTN; PAM sequence: CTT
aacaatacataaccgaattc

SEQ ID NO: 266715 - DNA, 20 bp, Artificial Sequence
  Description of Artificial Sequence: Synthetic oligonucleotide
  Target: ATXN1; (+) strand; PAM type: YTN; PAM sequence: TTA
acaatacataaccgaattca

SEQ ID NO: 266716 - DNA, 20 bp, Artificial Sequence
  Description of Artificial Sequence: Synthetic oligonucleotide
  Target: ATXN1; (+) strand; PAM type: YTN; PAM sequence: TTC
actgtcagtgtaatgacaat

SEQ ID NO: 266717 - DNA, 20 bp, Artificial Sequence
  Description of Artificial Sequence: Synthetic oligonucleotide
  Target: ATXN1; (+) strand; PAM type: YTN; PAM sequence: CTG
tcagtgtaatgacaatgaca

SEQ ID NO: 266718 - DNA, 20 bp, Artificial Sequence
  Description of Artificial Sequence: Synthetic oligonucleotide
  Target: ATXN1; (+) strand; PAM type: YTN; PAM sequence: TTA
atgacaactcctattatagc

SEQ ID NO: 266719 - DNA, 20 bp, Artificial Sequence
  Description of Artificial Sequence: Synthetic oligonucleotide
  Target: ATXN1; (+) strand; PAM type: YTN; PAM sequence: CTC
ctattatagcagaaatgtct

SEQ ID NO: 266720 - DNA, 20 bp, Artificial Sequence
  Description of Artificial Sequence: Synthetic oligonucleotide
  Target: ATXN1; (+) strand; PAM type: YTN; PAM sequence: CTA
ttatagcagaaatgtctcta

SEQ ID NO: 266721 - DNA, 20 bp, Artificial Sequence
  Description of Artificial Sequence: Synthetic oligonucleotide
  Target: ATXN1; (+) strand; PAM type: YTN; PAM sequence: TTA
tagcagaaatgtctctacaa

SEQ ID NO: 266722 - DNA, 20 bp, Artificial Sequence
  Description of Artificial Sequence: Synthetic oligonucleotide
  Target: ATXN1; (+) strand; PAM type: YTN; PAM sequence: CTC
tacaacaaagagatgagcaa

SEQ ID NO: 266723 - DNA, 20 bp, Artificial Sequence
  Description of Artificial Sequence: Synthetic oligonucleotide
  Target: ATXN1; (+) strand; PAM type: YTN; PAM sequence: CTA
caacaaagagatgagcaagt

SEQ ID NO: 266724 - DNA, 20 bp, Artificial Sequence
  Description of Artificial Sequence: Synthetic oligonucleotide
  Target: ATXN1; (+) strand; PAM type: YTN; PAM sequence: TTG
caactgctcacctgttcact

SEQ ID NO: 266725 - DNA, 20 bp, Artificial Sequence
  Description of Artificial Sequence: Synthetic oligonucleotide
  Target: ATXN1; (+) strand; PAM type: YTN; PAM sequence: CTG
ctcacctgttcacttcagca

SEQ ID NO: 266726 - DNA, 20 bp, Artificial Sequence
  Description of Artificial Sequence: Synthetic oligonucleotide
  Target: ATXN1; (+) strand; PAM type: YTN; PAM sequence: CTC
acctgttcacttcagcaacg

SEQ ID NO: 266727 - DNA, 20 bp, Artificial Sequence
  Description of Artificial Sequence: Synthetic oligonucleotide
  Target: ATXN1; (+) strand; PAM type: YTN; PAM sequence: CTG
ttcacttcagcaacgcatca

SEQ ID NO: 266728 - DNA, 20 bp, Artificial Sequence
  Description of Artificial Sequence: Synthetic oligonucleotide
  Target: ATXN1; (+) strand; PAM type: YTN; PAM sequence: TTC
acttcagcaacgcatcatga

SEQ ID NO: 266729 - DNA, 20 bp, Artificial Sequence
  Description of Artificial Sequence: Synthetic oligonucleotide
  Target: ATXN1; (+) strand; PAM type: YTN; PAM sequence: CTT
cagcaacgcatcatgataga

SEQ ID NO: 266730 - DNA, 20 bp, Artificial Sequence
  Description of Artificial Sequence: Synthetic oligonucleotide
  Target: ATXN1; (+) strand; PAM type: YTN; PAM sequence: TTC
agcaacgcatcatgatagat

SEQ ID NO: 266731 - DNA, 20 bp, Artificial Sequence
  Description of Artificial Sequence: Synthetic oligonucleotide
  Target: ATXN1; (+) strand; PAM type: YTN; PAM sequence: TTT
tgttgtgtgaaatttatcat

SEQ ID NO: 266732 - DNA, 20 bp, Artificial Sequence
  Description of Artificial Sequence: Synthetic oligonucleotide
  Target: ATXN1; (+) strand; PAM type: YTN; PAM sequence: TTT
gttgtgtgaaatttatcata

SEQ ID NO: 266733 - DNA, 20 bp, Artificial Sequence
  Description of Artificial Sequence: Synthetic oligonucleotide
  Target: ATXN1; (+) strand; PAM type: YTN; PAM sequence: TTG
ttgtgtgaaatttatcataa

SEQ ID NO: 266734 - DNA, 20 bp, Artificial Sequence
  Description of Artificial Sequence: Synthetic oligonucleotide
  Target: ATXN1; (+) strand; PAM type: YTN; PAM sequence: TTG
tgtgaaatttatcataacag

SEQ ID NO: 266735 - DNA, 20 bp, Artificial Sequence
  Description of Artificial Sequence: Synthetic oligonucleotide
  Target: ATXN1; (+) strand; PAM type: YTN; PAM sequence: TTT
atcataacagcatcatggct

SEQ ID NO: 266736 - DNA, 20 bp, Artificial Sequence
  Description of Artificial Sequence: Synthetic oligonucleotide
  Target: ATXN1; (+) strand; PAM type: YTN; PAM sequence: TTA
tcataacagcatcatggctg

SEQ ID NO: 266737 - DNA, 20 bp, Artificial Sequence
  Description of Artificial Sequence: Synthetic oligonucleotide
  Target: ATXN1; (+) strand; PAM type: YTN; PAM sequence: CTG
ccacagttattagggagcaa

SEQ ID NO: 266738 - DNA, 20 bp, Artificial Sequence
  Description of Artificial Sequence: Synthetic oligonucleotide
  Target: ATXN1; (+) strand; PAM type: YTN; PAM sequence: TTA
ttagggagcaatcactgggc

SEQ ID NO: 266739 - DNA, 20 bp, Artificial Sequence
  Description of Artificial Sequence: Synthetic oligonucleotide
  Target: ATXN1; (+) strand; PAM type: YTN; PAM sequence: TTA
gggagcaatcactgggctaa

SEQ ID NO: 266740 - DNA, 20 bp, Artificial Sequence
  Description of Artificial Sequence: Synthetic oligonucleotide
  Target: ATXN1; (+) strand; PAM type: YTN; PAM sequence: CTG
ggctaaaaacttaacagact

SEQ ID NO: 266741 - DNA, 20 bp, Artificial Sequence
  Description of Artificial Sequence: Synthetic oligonucleotide
  Target: ATXN1; (+) strand; PAM type: YTN; PAM sequence: CTA
aaaacttaacagactttatc

SEQ ID NO: 266742 - DNA, 20 bp, Artificial Sequence
  Description of Artificial Sequence: Synthetic oligonucleotide
  Target: ATXN1; (+) strand; PAM type: YTN; PAM sequence: CTT
aacagactttatcgcattta

SEQ ID NO: 266743 - DNA, 20 bp, Artificial Sequence
  Description of Artificial Sequence: Synthetic oligonucleotide
  Target: ATXN1; (+) strand; PAM type: YTN; PAM sequence: TTA
acagactttatcgcatttaa

SEQ ID NO: 266744 - DNA, 20 bp, Artificial Sequence
  Description of Artificial Sequence: Synthetic oligonucleotide
  Target: ATXN1; (+) strand; PAM type: YTN; PAM sequence: CTT
tatcgcatttaactctctta

SEQ ID NO: 266745 - DNA, 20 bp, Artificial Sequence
  Description of Artificial Sequence: Synthetic oligonucleotide
  Target: ATXN1; (+) strand; PAM type: YTN; PAM sequence: TTT
atcgcatttaactctcttaa

SEQ ID NO: 266746 - DNA, 20 bp, Artificial Sequence
  Description of Artificial Sequence: Synthetic oligonucleotide
  Target: ATXN1; (+) strand; PAM type: YTN; PAM sequence: TTA
tcgcatttaactctcttaac

SEQ ID NO: 266747 - DNA, 20 bp, Artificial Sequence
  Description of Artificial Sequence: Synthetic oligonucleotide
  Target: ATXN1; (+) strand; PAM type: YTN; PAM sequence: TTT
aactctcttaacaggtcatc

SEQ ID NO: 266748 - DNA, 20 bp, Artificial Sequence
  Description of Artificial Sequence: Synthetic oligonucleotide
  Target: ATXN1; (+) strand; PAM type: YTN; PAM sequence: TTA
actctcttaacaggtcatca

SEQ ID NO: 266749 - DNA, 20 bp, Artificial Sequence
  Description of Artificial Sequence: Synthetic oligonucleotide
  Target: ATXN1; (+) strand; PAM type: YTN; PAM sequence: CTC
tcttaacaggtcatcagggt

SEQ ID NO: 266750 - DNA, 20 bp, Artificial Sequence
  Description of Artificial Sequence: Synthetic oligonucleotide
  Target: ATXN1; (+) strand; PAM type: YTN; PAM sequence: CTC
ttaacaggtcatcagggtag

SEQ ID NO: 266751 - DNA, 20 bp, Artificial Sequence
  Description of Artificial Sequence: Synthetic oligonucleotide
  Target: ATXN1; (+) strand; PAM type: YTN; PAM sequence: CTT
aacaggtcatcagggtaggt

SEQ ID NO: 266752 - DNA, 20 bp, Artificial Sequence
  Description of Artificial Sequence: Synthetic oligonucleotide
  Target: ATXN1; (+) strand; PAM type: YTN; PAM sequence: TTA
acaggtcatcagggtaggtg

SEQ ID NO: 266753 - DNA, 20 bp, Artificial Sequence
  Description of Artificial Sequence: Synthetic oligonucleotide
  Target: ATXN1; (+) strand; PAM type: YTN; PAM sequence: CTT
ctttatagatgaagtaaata

SEQ ID NO: 266754 - DNA, 20 bp, Artificial Sequence
  Description of Artificial Sequence: Synthetic oligonucleotide
  Target: ATXN1; (+) strand; PAM type: YTN; PAM sequence: TTC
tttatagatgaagtaaataa

SEQ ID NO: 266755 - DNA, 20 bp, Artificial Sequence
  Description of Artificial Sequence: Synthetic oligonucleotide
  Target: ATXN1; (+) strand; PAM type: YTN; PAM sequence: CTT
tatagatgaagtaaataagg

SEQ ID NO: 266756 - DNA, 20 bp, Artificial Sequence
  Description of Artificial Sequence: Synthetic oligonucleotide
  Target: ATXN1; (+) strand; PAM type: YTN; PAM sequence: TTT
atagatgaagtaaataaggc

SEQ ID NO: 266757 - DNA, 20 bp, Artificial Sequence
  Description of Artificial Sequence: Synthetic oligonucleotide
  Target: ATXN1; (+) strand; PAM type: YTN; PAM sequence: TTA
tagatgaagtaaataaggct

SEQ ID NO: 266758 - DNA, 20 bp, Artificial Sequence
  Description of Artificial Sequence: Synthetic oligonucleotide
  Target: ATXN1; (+) strand; PAM type: YTN; PAM sequence: CTC
agagaagttgggcaatttcc

SEQ ID NO: 266759 - DNA, 20 bp, Artificial Sequence
  Description of Artificial Sequence: Synthetic oligonucleotide
  Target: ATXN1; (+) strand; PAM type: YTN; PAM sequence: TTG
ggcaatttcccaaaggacac

SEQ ID NO: 266760 - DNA, 20 bp, Artificial Sequence
  Description of Artificial Sequence: Synthetic oligonucleotide
  Target: ATXN1; (+) strand; PAM type: YTN; PAM sequence: TTT
cccaaaggacacacagctac

SEQ ID NO: 266761 - DNA, 20 bp, Artificial Sequence
  Description of Artificial Sequence: Synthetic oligonucleotide
  Target: ATXN1; (+) strand; PAM type: YTN; PAM sequence: TTC
ccaaaggacacacagctact

SEQ ID NO: 266762 - DNA, 20 bp, Artificial Sequence
  Description of Artificial Sequence: Synthetic oligonucleotide
  Target: ATXN1; (+) strand; PAM type: YTN; PAM sequence: CTA
ctgggtggcaggtctgaaat

SEQ ID NO: 266763 - DNA, 20 bp, Artificial Sequence
  Description of Artificial Sequence: Synthetic oligonucleotide
  Target: ATXN1; (+) strand; PAM type: YTN; PAM sequence: CTG
ggtggcaggtctgaaatctg

SEQ ID NO: 266764 - DNA, 20 bp, Artificial Sequence
  Description of Artificial Sequence: Synthetic oligonucleotide
  Target: ATXN1; (+) strand; PAM type: YTN; PAM sequence: CTG
aaatctgaacccaaatgtga

SEQ ID NO: 266765 - DNA, 20 bp, Artificial Sequence
  Description of Artificial Sequence: Synthetic oligonucleotide
  Target: ATXN1; (+) strand; PAM type: YTN; PAM sequence: CTG
aacccaaatgtgattcaaag

SEQ ID NO: 266766 - DNA, 20 bp, Artificial Sequence
  Description of Artificial Sequence: Synthetic oligonucleotide
  Target: ATXN1; (+) strand; PAM type: YTN; PAM sequence: TTC
aaagagtctcttatatgaac

SEQ ID NO: 266767 - DNA, 20 bp, Artificial Sequence
  Description of Artificial Sequence: Synthetic oligonucleotide
  Target: ATXN1; (+) strand; PAM type: YTN; PAM sequence: CTC
ttatatgaactaatacttta

SEQ ID NO: 266768 - DNA, 20 bp, Artificial Sequence
  Description of Artificial Sequence: Synthetic oligonucleotide
  Target: ATXN1; (+) strand; PAM type: YTN; PAM sequence: CTT
atatgaactaatactttaaa

SEQ ID NO: 266769 - DNA, 20 bp, Artificial Sequence
  Description of Artificial Sequence: Synthetic oligonucleotide
  Target: ATXN1; (+) strand; PAM type: YTN; PAM sequence: TTA
tatgaactaatactttaaat

SEQ ID NO: 266770 - DNA, 20 bp, Artificial Sequence
  Description of Artificial Sequence: Synthetic oligonucleotide
  Target: ATXN1; (+) strand; PAM type: YTN; PAM sequence: CTA
atactttaaatctgatgctg

SEQ ID NO: 266771 - DNA, 20 bp, Artificial Sequence
  Description of Artificial Sequence: Synthetic oligonucleotide
  Target: ATXN1; (+) strand; PAM type: YTN; PAM sequence: CTT
taaatctgatgctgttaagt

SEQ ID NO: 266772 - DNA, 20 bp, Artificial Sequence
  Description of Artificial Sequence: Synthetic oligonucleotide
  Target: ATXN1; (+) strand; PAM type: YTN; PAM sequence: TTT
aaatctgatgctgttaagtg

SEQ ID NO: 266773 - DNA, 20 bp, Artificial Sequence
  Description of Artificial Sequence: Synthetic oligonucleotide
  Target: ATXN1; (+) strand; PAM type: YTN; PAM sequence: TTA
aatctgatgctgttaagtgg

SEQ ID NO: 266774 - DNA, 20 bp, Artificial Sequence
  Description of Artificial Sequence: Synthetic oligonucleotide
  Target: ATXN1; (+) strand; PAM type: YTN; PAM sequence: CTG
atgctgttaagtggcagtga

SEQ ID NO: 266775 - DNA, 20 bp, Artificial Sequence
  Description of Artificial Sequence: Synthetic oligonucleotide
  Target: ATXN1; (+) strand; PAM type: YTN; PAM sequence: CTG
ttaagtggcagtgataatga

SEQ ID NO: 266776 - DNA, 20 bp, Artificial Sequence
  Description of Artificial Sequence: Synthetic oligonucleotide
  Target: ATXN1; (+) strand; PAM type: YTN; PAM sequence: TTA
agtggcagtgataatgatct

SEQ ID NO: 266777 - DNA, 20 bp, Artificial Sequence
  Description of Artificial Sequence: Synthetic oligonucleotide
  Target: ATXN1; (+) strand; PAM type: YTN; PAM sequence: CTT
cctttggaagataaggaaat

SEQ ID NO: 266778 - DNA, 20 bp, Artificial Sequence
  Description of Artificial Sequence: Synthetic oligonucleotide
  Target: ATXN1; (+) strand; PAM type: YTN; PAM sequence: TTC
ctttggaagataaggaaata

SEQ ID NO: 266779 - DNA, 20 bp, Artificial Sequence
  Description of Artificial Sequence: Synthetic oligonucleotide
  Target: ATXN1; (+) strand; PAM type: YTN; PAM sequence: CTT
tggaagataaggaaatagag

SEQ ID NO: 266780 - DNA, 20 bp, Artificial Sequence
  Description of Artificial Sequence: Synthetic oligonucleotide
  Target: ATXN1; (+) strand; PAM type: YTN; PAM sequence: TTT
ggaagataaggaaatagagg

SEQ ID NO: 266781 - DNA, 20 bp, Artificial Sequence
  Description of Artificial Sequence: Synthetic oligonucleotide
  Target: ATXN1; (+) strand; PAM type: YTN; PAM sequence: TTG
gaagataaggaaatagaggc

SEQ ID NO: 266782 - DNA, 20 bp, Artificial Sequence
  Description of Artificial Sequence: Synthetic oligonucleotide
  Target: ATXN1; (+) strand; PAM type: YTN; PAM sequence: CTT
gccactggtctaaaagggca

SEQ ID NO: 266783 - DNA, 20 bp, Artificial Sequence
  Description of Artificial Sequence: Synthetic oligonucleotide
  Target: ATXN1; (+) strand; PAM type: YTN; PAM sequence: TTG
ccactggtctaaaagggcag

SEQ ID NO: 266784 - DNA, 20 bp, Artificial Sequence
  Description of Artificial Sequence: Synthetic oligonucleotide
  Target: ATXN1; (+) strand; PAM type: YTN; PAM sequence: CTG
gtctaaaagggcagggatgg

SEQ ID NO: 266785 - DNA, 20 bp, Artificial Sequence
  Description of Artificial Sequence: Synthetic oligonucleotide
  Target: ATXN1; (+) strand; PAM type: YTN; PAM sequence: CTA
aaagggcagggatgggaaga

SEQ ID NO: 266786 - DNA, 20 bp, Artificial Sequence
  Description of Artificial Sequence: Synthetic oligonucleotide
  Target: ATXN1; (+) strand; PAM type: YTN; PAM sequence: CTT
cttagcctgaggttcctgct

SEQ ID NO: 266787 - DNA, 20 bp, Artificial Sequence
  Description of Artificial Sequence: Synthetic oligonucleotide
  Target: ATXN1; (+) strand; PAM type: YTN; PAM sequence: TTC
ttagcctgaggttcctgcta

SEQ ID NO: 266788 - DNA, 20 bp, Artificial Sequence
  Description of Artificial Sequence: Synthetic oligonucleotide
  Target: ATXN1; (+) strand; PAM type: YTN; PAM sequence: CTT
agcctgaggttcctgctact

SEQ ID NO: 266789 - DNA, 20 bp, Artificial Sequence
  Description of Artificial Sequence: Synthetic oligonucleotide
  Target: ATXN1; (+) strand; PAM type: YTN; PAM sequence: TTA
gcctgaggttcctgctactg

SEQ ID NO: 266790 - DNA, 20 bp, Artificial Sequence
  Description of Artificial Sequence: Synthetic oligonucleotide
  Target: ATXN1; (+) strand; PAM type: YTN; PAM sequence: CTG
aggttcctgctactggacag

SEQ ID NO: 266791 - DNA, 20 bp, Artificial Sequence
  Description of Artificial Sequence: Synthetic oligonucleotide
  Target: ATXN1; (+) strand; PAM type: YTN; PAM sequence: TTC
ctgctactggacagagccca

SEQ ID NO: 266792 - DNA, 20 bp, Artificial Sequence
  Description of Artificial Sequence: Synthetic oligonucleotide
  Target: ATXN1; (+) strand; PAM type: YTN; PAM sequence: CTG
ctactggacagagcccaagg

SEQ ID NO: 266793 - DNA, 20 bp, Artificial Sequence
  Description of Artificial Sequence: Synthetic oligonucleotide
  Target: ATXN1; (+) strand; PAM type: YTN; PAM sequence: CTA
ctggacagagcccaaggtgt

SEQ ID NO: 266794 - DNA, 20 bp, Artificial Sequence
  Description of Artificial Sequence: Synthetic oligonucleotide
  Target: ATXN1; (+) strand; PAM type: YTN; PAM sequence: CTG
gacagagcccaaggtgtccc

SEQ ID NO: 266795 - DNA, 20 bp, Artificial Sequence
  Description of Artificial Sequence: Synthetic oligonucleotide
  Target: ATXN1; (+) strand; PAM type: YTN; PAM sequence: CTA
tcttctccttagtcattact

SEQ ID NO: 266796 - DNA, 20 bp, Artificial Sequence
  Description of Artificial Sequence: Synthetic oligonucleotide
  Target: ATXN1; (+) strand; PAM type: YTN; PAM sequence: CTT
ctccttagtcattacttttt

SEQ ID NO: 266797 - DNA, 20 bp, Artificial Sequence
  Description of Artificial Sequence: Synthetic oligonucleotide
  Target: ATXN1; (+) strand; PAM type: YTN; PAM sequence: TTC
tccttagtcattactttttt

SEQ ID NO: 266798 - DNA, 20 bp, Artificial Sequence
  Description of Artificial Sequence: Synthetic oligonucleotide
  Target: ATXN1; (+) strand; PAM type: YTN; PAM sequence: CTC
cttagtcattactttttttt

SEQ ID NO: 266799 - DNA, 20 bp, Artificial Sequence
  Description of Artificial Sequence: Synthetic oligonucleotide
  Target: ATXN1; (+) strand; PAM type: YTN; PAM sequence: CTT
agtcattacttttttttttt

SEQ ID NO: 266800 - DNA, 20 bp, Artificial Sequence
  Description of Artificial Sequence: Synthetic oligonucleotide
  Target: ATXN1; (+) strand; PAM type: YTN; PAM sequence: TTA
gtcattactttttttttttt

SEQ ID NO: 266801 - DNA, 20 bp, Artificial Sequence
  Description of Artificial Sequence: Synthetic oligonucleotide
  Target: ATXN1; (+) strand; PAM type: YTN; PAM sequence: TTA
cttttttttttttttttgag

SEQ ID NO: 266802 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttttgagatg

SEQ ID NO: 266803 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagatgg

SEQ ID NO: 266804 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagatgga

SEQ ID NO: 266805 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagatggag

SEQ ID NO: 266806 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagatggagt

SEQ ID NO: 266807 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagatggagtc

SEQ ID NO: 266808 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagtct

SEQ ID NO: 266809 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtctc

SEQ ID NO: 266810 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagtctca

SEQ ID NO: 266811 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagtctcac

SEQ ID NO: 266812 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagtctcact

SEQ ID NO: 266813 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcactc

SEQ ID NO: 266814 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcactct

SEQ ID NO: 266815 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcactctg

SEQ ID NO: 266816 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcactctgt

SEQ ID NO: 266817 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcactctgtt

SEQ ID NO: 266818 - DNA, 20 bp, Artificial Sequence
  Description of Artificial Sequence: Synthetic oligonucleotide
  Target: ATXN1; (+) strand; PAM type: YTN; PAM sequence: CTC
actctgttacccagactgga

SEQ ID NO: 266819 - DNA, 20 bp, Artificial Sequence
  Description of Artificial Sequence: Synthetic oligonucleotide
  Target: ATXN1; (+) strand; PAM type: YTN; PAM sequence: CTC
tgttacccagactggagtgc

SEQ ID NO: 266820 - DNA, 20 bp, Artificial Sequence
  Description of Artificial Sequence: Synthetic oligonucleotide
  Target: ATXN1; (+) strand; PAM type: YTN; PAM sequence: CTG
ttacccagactggagtgcag

SEQ ID NO: 266821 - DNA, 20 bp, Artificial Sequence
  Description of Artificial Sequence: Synthetic oligonucleotide
  Target: ATXN1; (+) strand; PAM type: YTN; PAM sequence: TTA
cccagactggagtgcagtgg

SEQ ID NO: 266822 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcatgatctt

SEQ ID NO: 266823 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaacctccacc

SEQ ID NO: 266824 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaacctccacct

SEQ ID NO: 266825 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccacctcccg

SEQ ID NO: 266826 - DNA, 20 bp, Artificial Sequence
  Description of Artificial Sequence: Synthetic oligonucleotide
  Target: ATXN1; (+) strand; PAM type: YTN; PAM sequence: CTG
caacctccacctcccgggtc

SEQ ID NO: 266827 - DNA, 20 bp, Artificial Sequence
  Description of Artificial Sequence: Synthetic oligonucleotide
  Target: ATXN1; (+) strand; PAM type: YTN; PAM sequence: CTC
cacctcccgggtccaagtga

SEQ ID NO: 266828 - DNA, 20 bp, Artificial Sequence
  Description of Artificial Sequence: Synthetic oligonucleotide
  Target: ATXN1; (+) strand; PAM type: YTN; PAM sequence: CTC
ccgggtccaagtgattctcc

SEQ ID NO: 266829 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 266830 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagta

SEQ ID NO: 266831 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtagct

SEQ ID NO: 266832 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtagctggga

SEQ ID NO: 266833 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctgggactacag

SEQ ID NO: 266834 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcatgcaccac

SEQ ID NO: 266835 - DNA, 20 bp, Artificial Sequence
  Description of Artificial Sequence: Synthetic oligonucleotide
  Target: ATXN1; (+) strand; PAM type: YTN; PAM sequence: CTA
caggcatgcaccaccatgcc

SEQ ID NO: 266836 - DNA, 20 bp, Artificial Sequence
  Description of Artificial Sequence: Synthetic oligonucleotide
  Target: ATXN1; (+) strand; PAM type: YTN; PAM sequence: CTA
attttatatatatttttagt

SEQ ID NO: 266837 - DNA, 20 bp, Artificial Sequence
  Description of Artificial Sequence: Synthetic oligonucleotide
  Target: ATXN1; (+) strand; PAM type: YTN; PAM sequence: TTT
tatatatatttttagtagag

SEQ ID NO: 266838 - DNA, 20 bp, Artificial Sequence
  Description of Artificial Sequence: Synthetic oligonucleotide
  Target: ATXN1; (+) strand; PAM type: YTN; PAM sequence: TTT
atatatatttttagtagaga

SEQ ID NO: 266839 - DNA, 20 bp, Artificial Sequence
  Description of Artificial Sequence: Synthetic oligonucleotide
  Target: ATXN1; (+) strand; PAM type: YTN; PAM sequence: TTA
tatatatttttagtagagat

SEQ ID NO: 266840 - DNA, 20 bp, Artificial Sequence
  Description of Artificial Sequence: Synthetic oligonucleotide
  Target: ATXN1; (+) strand; PAM type: YTN; PAM sequence: TTT
ttagtagagataaggtttca

SEQ ID NO: 266841 - DNA, 20 bp, Artificial Sequence
  Description of Artificial Sequence: Synthetic oligonucleotide
  Target: ATXN1; (+) strand; PAM type: YTN; PAM sequence: TTT
tagtagagataaggtttcac

SEQ ID NO: 266842 - DNA, 20 bp, Artificial Sequence
  Description of Artificial Sequence: Synthetic oligonucleotide
  Target: ATXN1; (+) strand; PAM type: YTN; PAM sequence: TTT
agtagagataaggtttcacc

SEQ ID NO: 266843 - DNA, 20 bp, Artificial Sequence
  Description of Artificial Sequence: Synthetic oligonucleotide
  Target: ATXN1; (+) strand; PAM type: YTN; PAM sequence: TTA
gtagagataaggtttcacca

SEQ ID NO: 266844 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgg

SEQ ID NO: 266845 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctggt

SEQ ID NO: 266846 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtcttgaactc

SEQ ID NO: 266847 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctgacctca

SEQ ID NO: 266848 - DNA, 20 bp, Artificial Sequence
  Description of Artificial Sequence: Synthetic oligonucleotide
  Target: ATXN1; (+) strand; PAM type: YTN; PAM sequence: CTT
gaactcctgacctcaggtga

SEQ ID NO: 266849 - DNA, 20 bp, Artificial Sequence
  Description of Artificial Sequence: Synthetic oligonucleotide
  Target: ATXN1; (+) strand; PAM type: YTN; PAM sequence: TTG
aactcctgacctcaggtgat

SEQ ID NO: 266850 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 266851 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccgc

SEQ ID NO: 266852 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccgccttgg

SEQ ID NO: 266853 - DNA, 20 bp, Artificial Sequence
  Description of Artificial Sequence: Synthetic oligonucleotide
  Target: ATXN1; (+) strand; PAM type: YTN; PAM sequence: CTT
ggcttcccaaagtgctggaa

SEQ ID NO: 266854 - DNA, 20 bp, Artificial Sequence
  Description of Artificial Sequence: Synthetic oligonucleotide
  Target: ATXN1; (+) strand; PAM type: YTN; PAM sequence: TTG
gcttcccaaagtgctggaat

SEQ ID NO: 266855 - DNA, 20 bp, Artificial Sequence
  Description of Artificial Sequence: Synthetic oligonucleotide
  Target: ATXN1; (+) strand; PAM type: YTN; PAM sequence: CTT
cccaaagtgctggaattact

SEQ ID NO: 266856 - DNA, 20 bp, Artificial Sequence
  Description of Artificial Sequence: Synthetic oligonucleotide
  Target: ATXN1; (+) strand; PAM type: YTN; PAM sequence: TTC
ccaaagtgctggaattactg

SEQ ID NO: 266857 - DNA, 20 bp, Artificial Sequence
  Description of Artificial Sequence: Synthetic oligonucleotide
  Target: ATXN1; (+) strand; PAM type: YTN; PAM sequence: CTG
gaattactgtgcctggccta

SEQ ID NO: 266858 - DNA, 20 bp, Artificial Sequence
  Description of Artificial Sequence: Synthetic oligonucleotide
  Target: ATXN1; (+) strand; PAM type: YTN; PAM sequence: TTA
ctgtgcctggcctagtcatt

SEQ ID NO: 266859 - DNA, 20 bp, Artificial Sequence
  Description of Artificial Sequence: Synthetic oligonucleotide
  Target: ATXN1; (+) strand; PAM type: YTN; PAM sequence: CTG
tgcctggcctagtcattaat

SEQ ID NO: 266860 - DNA, 20 bp, Artificial Sequence
  Description of Artificial Sequence: Synthetic oligonucleotide
  Target: ATXN1; (+) strand; PAM type: YTN; PAM sequence: CTG
gcctagtcattaatattttg

SEQ ID NO: 266861 - DNA, 20 bp, Artificial Sequence
  Description of Artificial Sequence: Synthetic oligonucleotide
  Target: ATXN1; (+) strand; PAM type: YTN; PAM sequence: CTA
gtcattaatattttgattaa

SEQ ID NO: 266862 - DNA, 20 bp, Artificial Sequence
  Description of Artificial Sequence: Synthetic oligonucleotide
  Target: ATXN1; (+) strand; PAM type: YTN; PAM sequence: TTA
atattttgattaacgcctac

SEQ ID NO: 266863 - DNA, 20 bp, Artificial Sequence
  Description of Artificial Sequence: Synthetic oligonucleotide
  Target: ATXN1; (+) strand; PAM type: YTN; PAM sequence: TTT
tgattaacgcctacccctgt

SEQ ID NO: 266864 - DNA, 20 bp, Artificial Sequence
  Description of Artificial Sequence: Synthetic oligonucleotide
  Target: ATXN1; (+) strand; PAM type: YTN; PAM sequence: TTT
gattaacgcctacccctgtg

SEQ ID NO: 266865 - DNA, 20 bp, Artificial Sequence
  Description of Artificial Sequence: Synthetic oligonucleotide
  Target: ATXN1; (+) strand; PAM type: YTN; PAM sequence: TTG
attaacgcctacccctgtga

SEQ ID NO: 266866 - DNA, 20 bp, Artificial Sequence
  Description of Artificial Sequence: Synthetic oligonucleotide
  Target: ATXN1; (+) strand; PAM type: YTN; PAM sequence: TTA
acgcctacccctgtgatcaa

SEQ ID NO: 266867 - DNA, 20 bp, Artificial Sequence
  Description of Artificial Sequence: Synthetic oligonucleotide
  Target: ATXN1; (+) strand; PAM type: YTN; PAM sequence: CTA
cccctgtgatcaacgacaac

SEQ ID NO: 266868 - DNA, 20 bp, Artificial Sequence
  Description of Artificial Sequence: Synthetic oligonucleotide
  Target: ATXN1; (+) strand; PAM type: YTN; PAM sequence: CTG
tgatcaacgacaacttattc

SEQ ID NO: 266869 - DNA, 20 bp, Artificial Sequence
  Description of Artificial Sequence: Synthetic oligonucleotide
  Target: ATXN1; (+) strand; PAM type: YTN; PAM sequence: CTT
attcaggaagaagggttctt

SEQ ID NO: 266870 - DNA, 20 bp, Artificial Sequence
  Description of Artificial Sequence: Synthetic oligonucleotide
  Target: ATXN1; (+) strand; PAM type: YTN; PAM sequence: TTA
ttcaggaagaagggttcttt

SEQ ID NO: 266871 - DNA, 20 bp, Artificial Sequence
  Description of Artificial Sequence: Synthetic oligonucleotide
  Target: ATXN1; (+) strand; PAM type: YTN; PAM sequence: TTC
aggaagaagggttctttcta

SEQ ID NO: 266872 - DNA, 20 bp, Artificial Sequence
  Description of Artificial Sequence: Synthetic oligonucleotide
  Target: ATXN1; (+) strand; PAM type: YTN; PAM sequence: TTC
tttctactctagtatgcttc

SEQ ID NO: 266873 - DNA, 20 bp, Artificial Sequence
  Description of Artificial Sequence: Synthetic oligonucleotide
  Target: ATXN1; (+) strand; PAM type: YTN; PAM sequence: CTT
tctactctagtatgcttcca

SEQ ID NO: 266874 - DNA, 20 bp, Artificial Sequence
  Description of Artificial Sequence: Synthetic oligonucleotide
  Target: ATXN1; (+) strand; PAM type: YTN; PAM sequence: TTT
ctactctagtatgcttccag

SEQ ID NO: 266875 - DNA, 20 bp, Artificial Sequence
  Description of Artificial Sequence: Synthetic oligonucleotide
  Target: ATXN1; (+) strand; PAM type: YTN; PAM sequence: TTC
tactctagtatgcttccagt

SEQ ID NO: 266876 - DNA, 20 bp, Artificial Sequence
  Description of Artificial Sequence: Synthetic oligonucleotide
  Target: ATXN1; (+) strand; PAM type: YTN; PAM sequence: CTA
ctctagtatgcttccagtta

SEQ ID NO: 266877 - DNA, 20 bp, Artificial Sequence
  Description of Artificial Sequence: Synthetic oligonucleotide
  Target: ATXN1; (+) strand; PAM type: YTN; PAM sequence: CTC
tagtatgcttccagttattt

SEQ ID NO: 266878 - DNA, 20 bp, Artificial Sequence
  Description of Artificial Sequence: Synthetic oligonucleotide
  Target: ATXN1; (+) strand; PAM type: YTN; PAM sequence: CTA
gtatgcttccagttatttac

SEQ ID NO: 266879 - DNA, 20 bp, Artificial Sequence
  Description of Artificial Sequence: Synthetic oligonucleotide
  Target: ATXN1; (+) strand; PAM type: YTN; PAM sequence: CTT
ccagttatttactgtgtatc

SEQ ID NO: 266880 - DNA, 20 bp, Artificial Sequence
  Description of Artificial Sequence: Synthetic oligonucleotide
  Target: ATXN1; (+) strand; PAM type: YTN; PAM sequence: TTC
cagttatttactgtgtatct

SEQ ID NO: 266881 - DNA, 20 bp, Artificial Sequence
  Description of Artificial Sequence: Synthetic oligonucleotide
  Target: ATXN1; (+) strand; PAM type: YTN; PAM sequence: TTA
tttactgtgtatctagctag

SEQ ID NO: 266882 - DNA, 20 bp, Artificial Sequence
  Description of Artificial Sequence: Synthetic oligonucleotide
  Target: ATXN1; (+) strand; PAM type: YTN; PAM sequence: TTT
actgtgtatctagctaggtt

SEQ ID NO: 266883 - DNA, 20 bp, Artificial Sequence
  Description of Artificial Sequence: Synthetic oligonucleotide
  Target: ATXN1; (+) strand; PAM type: YTN; PAM sequence: TTA
ctgtgtatctagctaggttg

SEQ ID NO: 266884 - DNA, 20 bp, Artificial Sequence
  Description of Artificial Sequence: Synthetic oligonucleotide
  Target: ATXN1; (+) strand; PAM type: YTN; PAM sequence: CTG
tgtatctagctaggttgtga

SEQ ID NO: 266885 - DNA, 20 bp, Artificial Sequence
  Description of Artificial Sequence: Synthetic oligonucleotide
  Target: ATXN1; (+) strand; PAM type: YTN; PAM sequence: CTA
gctaggttgtgaaaagaaaa

SEQ ID NO: 266886 - DNA, 20 bp, Artificial Sequence
  Description of Artificial Sequence: Synthetic oligonucleotide
  Target: ATXN1; (+) strand; PAM type: YTN; PAM sequence: CTA
ggttgtgaaaagaaaagaat

SEQ ID NO: 266887 - DNA, 20 bp, Artificial Sequence
  Description of Artificial Sequence: Synthetic oligonucleotide
  Target: ATXN1; (+) strand; PAM type: YTN; PAM sequence: TTG
tgaaaagaaaagaatatgaa

SEQ ID NO: 266888 - DNA, 20 bp, Artificial Sequence
  Description of Artificial Sequence: Synthetic oligonucleotide
  Target: ATXN1; (+) strand; PAM type: YTN; PAM sequence: TTC
atgaaacctaactggtctat

SEQ ID NO: 266889 - DNA, 20 bp, Artificial Sequence
  Description of Artificial Sequence: Synthetic oligonucleotide
  Target: ATXN1; (+) strand; PAM type: YTN; PAM sequence: CTA
actggtctatcatctacttt

SEQ ID NO: 266890 - DNA, 20 bp, Artificial Sequence
  Description of Artificial Sequence: Synthetic oligonucleotide
  Target: ATXN1; (+) strand; PAM type: YTN; PAM sequence: CTG
gtctatcatctactttacca

SEQ ID NO: 266891 - DNA, 20 bp, Artificial Sequence
  Description of Artificial Sequence: Synthetic oligonucleotide
  Target: ATXN1; (+) strand; PAM type: YTN; PAM sequence: CTA
tcatctactttaccaaattt

SEQ ID NO: 266892 - DNA, 20 bp, Artificial Sequence
  Description of Artificial Sequence: Synthetic oligonucleotide
  Target: ATXN1; (+) strand; PAM type: YTN; PAM sequence: CTA
ctttaccaaatttcttctaa

SEQ ID NO: 266893 - DNA, 20 bp, Artificial Sequence
  Description of Artificial Sequence: Synthetic oligonucleotide
  Target: ATXN1; (+) strand; PAM type: YTN; PAM sequence: CTT
taccaaatttcttctaaaaa

SEQ ID NO: 266894 - DNA, 20 bp, Artificial Sequence
  Description of Artificial Sequence: Synthetic oligonucleotide
  Target: ATXN1; (+) strand; PAM type: YTN; PAM sequence: TTT
accaaatttcttctaaaaaa

SEQ ID NO: 266895 - DNA, 20 bp, Artificial Sequence
  Description of Artificial Sequence: Synthetic oligonucleotide
  Target: ATXN1; (+) strand; PAM type: YTN; PAM sequence: TTA
ccaaatttcttctaaaaaag

SEQ ID NO: 266896 - DNA, 20 bp, Artificial Sequence
  Description of Artificial Sequence: Synthetic oligonucleotide
  Target: ATXN1; (+) strand; PAM type: YTN; PAM sequence: TTT
cttctaaaaaagcaaccatc

SEQ ID NO: 266897 - DNA, 20 bp, Artificial Sequence
  Description of Artificial Sequence: Synthetic oligonucleotide
  Target: ATXN1; (+) strand; PAM type: YTN; PAM sequence: TTC
ttctaaaaaagcaaccatca

SEQ ID NO: 266898 - DNA, 20 bp, Artificial Sequence
  Description of Artificial Sequence: Synthetic oligonucleotide
  Target: ATXN1; (+) strand; PAM type: YTN; PAM sequence: CTT
ctaaaaaagcaaccatcaaa

SEQ ID NO: 266899 - DNA, 20 bp, Artificial Sequence
  Description of Artificial Sequence: Synthetic oligonucleotide
  Target: ATXN1; (+) strand; PAM type: YTN; PAM sequence: TTC
taaaaaagcaaccatcaaac

SEQ ID NO: 266900 - DNA, 20 bp, Artificial Sequence
  Description of Artificial Sequence: Synthetic oligonucleotide
  Target: ATXN1; (+) strand; PAM type: YTN; PAM sequence: CTA
aaaaagcaaccatcaaaccc

SEQ ID NO: 266901 - DNA, 20 bp, Artificial Sequence
  Description of Artificial Sequence: Synthetic oligonucleotide
  Target: ATXN1; (+) strand; PAM type: YTN; PAM sequence: TTT
gaagcttctaactttaatgc

SEQ ID NO: 266902 - DNA, 20 bp, Artificial Sequence
  Description of Artificial Sequence: Synthetic oligonucleotide
  Target: ATXN1; (+) strand; PAM type: YTN; PAM sequence: TTG
aagcttctaactttaatgcc

SEQ ID NO: 266903 - DNA, 20 bp, Artificial Sequence
  Description of Artificial Sequence: Synthetic oligonucleotide
  Target: ATXN1; (+) strand; PAM type: YTN; PAM sequence: CTT
ctaactttaatgccattcac

SEQ ID NO: 266904 - DNA, 20 bp, Artificial Sequence
  Description of Artificial Sequence: Synthetic oligonucleotide
  Target: ATXN1; (+) strand; PAM type: YTN; PAM sequence: TTC
taactttaatgccattcaca

SEQ ID NO: 266905 - DNA, 20 bp, Artificial Sequence
  Description of Artificial Sequence: Synthetic oligonucleotide
  Target: ATXN1; (+) strand; PAM type: YTN; PAM sequence: CTA
actttaatgccattcacatt

SEQ ID NO: 266906 - DNA, 20 bp, Artificial Sequence
  Description of Artificial Sequence: Synthetic oligonucleotide
  Target: ATXN1; (+) strand; PAM type: YTN; PAM sequence: CTT
taatgccattcacattagtt

SEQ ID NO: 266907 - DNA, 20 bp, Artificial Sequence
  Description of Artificial Sequence: Synthetic oligonucleotide
  Target: ATXN1; (+) strand; PAM type: YTN; PAM sequence: TTT
aatgccattcacattagttg

SEQ ID NO: 266908 - DNA, 20 bp, Artificial Sequence
  Description of Artificial Sequence: Synthetic oligonucleotide
  Target: ATXN1; (+) strand; PAM type: YTN; PAM sequence: TTA
atgccattcacattagttgt

SEQ ID NO: 266909 - DNA, 20 bp, Artificial Sequence
  Description of Artificial Sequence: Synthetic oligonucleotide
  Target: ATXN1; (+) strand; PAM type: YTN; PAM sequence: TTC
acattagttgtatttcttat

SEQ ID NO: 266910 - DNA, 20 bp, Artificial Sequence
  Description of Artificial Sequence: Synthetic oligonucleotide
  Target: ATXN1; (+) strand; PAM type: YTN; PAM sequence: TTA
gttgtatttcttattcatat

SEQ ID NO: 266911 - DNA, 20 bp, Artificial Sequence
  Description of Artificial Sequence: Synthetic oligonucleotide
  Target: ATXN1; (+) strand; PAM type: YTN; PAM sequence: TTG
tatttcttattcatatgaga

SEQ ID NO: 266912 - DNA, 20 bp, Artificial Sequence
  Description of Artificial Sequence: Synthetic oligonucleotide
  Target: ATXN1; (+) strand; PAM type: YTN; PAM sequence: TTT
cttattcatatgagagaact

SEQ ID NO: 266913 - DNA, 20 bp, Artificial Sequence
  Description of Artificial Sequence: Synthetic oligonucleotide
  Target: ATXN1; (+) strand; PAM type: YTN; PAM sequence: TTC
ttattcatatgagagaacta

SEQ ID NO: 266914 - DNA, 20 bp, Artificial Sequence
  Description of Artificial Sequence: Synthetic oligonucleotide
  Target: ATXN1; (+) strand; PAM type: YTN; PAM sequence: CTT
attcatatgagagaactatc

SEQ ID NO: 266915 - DNA, 20 bp, Artificial Sequence
  Description of Artificial Sequence: Synthetic oligonucleotide
  Target: ATXN1; (+) strand; PAM type: YTN; PAM sequence: TTA
ttcatatgagagaactatct

SEQ ID NO: 266916 - DNA, 20 bp, Artificial Sequence
  Description of Artificial Sequence: Synthetic oligonucleotide
  Target: ATXN1; (+) strand; PAM type: YTN; PAM sequence: TTC
atatgagagaactatcttta

SEQ ID NO: 266917 - DNA, 20 bp, Artificial Sequence
  Description of Artificial Sequence: Synthetic oligonucleotide
  Target: ATXN1; (+) strand; PAM type: YTN; PAM sequence: CTA
tctttatgacctgtgcacta

SEQ ID NO: 266918 - DNA, 20 bp, Artificial Sequence
  Description of Artificial Sequence: Synthetic oligonucleotide
  Target: ATXN1; (+) strand; PAM type: YTN; PAM sequence: CTT
tatgacctgtgcactataaa

SEQ ID NO: 266919 - DNA, 20 bp, Artificial Sequence
  Description of Artificial Sequence: Synthetic oligonucleotide
  Target: ATXN1; (+) strand; PAM type: YTN; PAM sequence: TTT
atgacctgtgcactataaag

SEQ ID NO: 266920 - DNA, 20 bp, Artificial Sequence
  Description of Artificial Sequence: Synthetic oligonucleotide
  Target: ATXN1; (+) strand; PAM type: YTN; PAM sequence: TTA
tgacctgtgcactataaaga

SEQ ID NO: 266921 - DNA, 20 bp, Artificial Sequence
  Description of Artificial Sequence: Synthetic oligonucleotide
  Target: ATXN1; (+) strand; PAM type: YTN; PAM sequence: CTG
tgcactataaagaatgatga

SEQ ID NO: 266922 - DNA, 20 bp, Artificial Sequence
  Description of Artificial Sequence: Synthetic oligonucleotide
  Target: ATXN1; (+) strand; PAM type: YTN; PAM sequence: CTA
taaagaatgatgagtattta

SEQ ID NO: 266923 - DNA, 20 bp, Artificial Sequence
  Description of Artificial Sequence: Synthetic oligonucleotide
  Target: ATXN1; (+) strand; PAM type: YTN; PAM sequence: TTT
aaacactaagtgttgaatta

SEQ ID NO: 266924 - DNA, 20 bp, Artificial Sequence
  Description of Artificial Sequence: Synthetic oligonucleotide
  Target: ATXN1; (+) strand; PAM type: YTN; PAM sequence: TTA
aacactaagtgttgaattaa

SEQ ID NO: 266925 - DNA, 20 bp, Artificial Sequence
  Description of Artificial Sequence: Synthetic oligonucleotide
  Target: ATXN1; (+) strand; PAM type: YTN; PAM sequence: CTA
agtgttgaattaacagttat

SEQ ID NO: 266926 - DNA, 20 bp, Artificial Sequence
  Description of Artificial Sequence: Synthetic oligonucleotide
  Target: ATXN1; (+) strand; PAM type: YTN; PAM sequence: TTG
aattaacagttatataataa

SEQ ID NO: 266927 - DNA, 20 bp, Artificial Sequence
  Description of Artificial Sequence: Synthetic oligonucleotide
  Target: ATXN1; (+) strand; PAM type: YTN; PAM sequence: TTA
acagttatataataatccaa

SEQ ID NO: 266928 - DNA, 20 bp, Artificial Sequence
  Description of Artificial Sequence: Synthetic oligonucleotide
  Target: ATXN1; (+) strand; PAM type: YTN; PAM sequence: TTA
tataataatccaaaaaaaaa

SEQ ID NO: 266929 - DNA, 20 bp, Artificial Sequence
  Description of Artificial Sequence: Synthetic oligonucleotide
  Target: ATXN1; (+) strand; PAM type: YTN; PAM sequence: CTG
tacttctccactgtatcaaa

SEQ ID NO: 266930 - DNA, 20 bp, Artificial Sequence
  Description of Artificial Sequence: Synthetic oligonucleotide
  Target: ATXN1; (+) strand; PAM type: YTN; PAM sequence: CTT
ctccactgtatcaaaatgta

SEQ ID NO: 266931 - DNA, 20 bp, Artificial Sequence
  Description of Artificial Sequence: Synthetic oligonucleotide
  Target: ATXN1; (+) strand; PAM type: YTN; PAM sequence: TTC
tccactgtatcaaaatgtac

SEQ ID NO: 266932 - DNA, 20 bp, Artificial Sequence
  Description of Artificial Sequence: Synthetic oligonucleotide
  Target: ATXN1; (+) strand; PAM type: YTN; PAM sequence: CTC
cactgtatcaaaatgtactt

SEQ ID NO: 266933 - DNA, 20 bp, Artificial Sequence
  Description of Artificial Sequence: Synthetic oligonucleotide
  Target: ATXN1; (+) strand; PAM type: YTN; PAM sequence: CTG
tatcaaaatgtacttaatag

SEQ ID NO: 266934 - DNA, 20 bp, Artificial Sequence
  Description of Artificial Sequence: Synthetic oligonucleotide
  Target: ATXN1; (+) strand; PAM type: YTN; PAM sequence: CTT
aataggtatttattgtttca

SEQ ID NO: 266935 - DNA, 20 bp, Artificial Sequence
  Description of Artificial Sequence: Synthetic oligonucleotide
  Target: ATXN1; (+) strand; PAM type: YTN; PAM sequence: TTA
ataggtatttattgtttcag

SEQ ID NO: 266936 - DNA, 20 bp, Artificial Sequence
  Description of Artificial Sequence: Synthetic oligonucleotide
  Target: ATXN1; (+) strand; PAM type: YTN; PAM sequence: TTT
attgtttcaggaatatacaa

SEQ ID NO: 266937 - DNA, 20 bp, Artificial Sequence
  Description of Artificial Sequence: Synthetic oligonucleotide
  Target: ATXN1; (+) strand; PAM type: YTN; PAM sequence: TTA
ttgtttcaggaatatacaat

SEQ ID NO: 266938 - DNA, 20 bp, Artificial Sequence
  Description of Artificial Sequence: Synthetic oligonucleotide
  Target: ATXN1; (+) strand; PAM type: YTN; PAM sequence: TTG
tttcaggaatatacaatgtc

SEQ ID NO: 266939 - DNA, 20 bp, Artificial Sequence
  Description of Artificial Sequence: Synthetic oligonucleotide
  Target: ATXN1; (+) strand; PAM type: YTN; PAM sequence: TTT
caggaatatacaatgtcttc

SEQ ID NO: 266940 - DNA, 20 bp, Artificial Sequence
  Description of Artificial Sequence: Synthetic oligonucleotide
  Target: ATXN1; (+) strand; PAM type: YTN; PAM sequence: TTC
aggaatatacaatgtcttct

SEQ ID NO: 266941 - DNA, 20 bp, Artificial Sequence
  Description of Artificial Sequence: Synthetic oligonucleotide
  Target: ATXN1; (+) strand; PAM type: YTN; PAM sequence: CTT
ctatcatttaaatcattttg

SEQ ID NO: 266942 - DNA, 20 bp, Artificial Sequence
  Description of Artificial Sequence: Synthetic oligonucleotide
  Target: ATXN1; (+) strand; PAM type: YTN; PAM sequence: TTC
tatcatttaaatcattttgt

SEQ ID NO: 266943 - DNA, 20 bp, Artificial Sequence
  Description of Artificial Sequence: Synthetic oligonucleotide
  Target: ATXN1; (+) strand; PAM type: YTN; PAM sequence: CTA
tcatttaaatcattttgtca

SEQ ID NO: 266944 - DNA, 20 bp, Artificial Sequence
  Description of Artificial Sequence: Synthetic oligonucleotide
  Target: ATXN1; (+) strand; PAM type: YTN; PAM sequence: TTT
aaatcattttgtcaatttaa

SEQ ID NO: 266945 - DNA, 20 bp, Artificial Sequence
  Description of Artificial Sequence: Synthetic oligonucleotide
  Target: ATXN1; (+) strand; PAM type: YTN; PAM sequence: TTA
aatcattttgtcaatttaaa

SEQ ID NO: 266946 - DNA, 20 bp, Artificial Sequence
  Description of Artificial Sequence: Synthetic oligonucleotide
  Target: ATXN1; (+) strand; PAM type: YTN; PAM sequence: TTT
tgtcaatttaaaataatgac

SEQ ID NO: 266947 - DNA, 20 bp, Artificial Sequence
  Description of Artificial Sequence: Synthetic oligonucleotide
  Target: ATXN1; (+) strand; PAM type: YTN; PAM sequence: TTT
gtcaatttaaaataatgacc

SEQ ID NO: 266948 - DNA, 20 bp, Artificial Sequence
  Description of Artificial Sequence: Synthetic oligonucleotide
  Target: ATXN1; (+) strand; PAM type: YTN; PAM sequence: TTG
tcaatttaaaataatgacct

SEQ ID NO: 266949 - DNA, 20 bp, Artificial Sequence
  Description of Artificial Sequence: Synthetic oligonucleotide
  Target: ATXN1; (+) strand; PAM type: YTN; PAM sequence: TTT
aaaataatgacctggctggg

SEQ ID NO: 266950 - DNA, 20 bp, Artificial Sequence
  Description of Artificial Sequence: Synthetic oligonucleotide
  Target: ATXN1; (+) strand; PAM type: YTN; PAM sequence: TTA
aaataatgacctggctgggc

SEQ ID NO: 266951 - DNA, 20 bp, Artificial Sequence
  Description of Artificial Sequence: Synthetic oligonucleotide
  Target: ATXN1; (+) strand; PAM type: YTN; PAM sequence: CTG
gctgggcacactacaccctg

SEQ ID NO: 266952 - DNA, 20 bp, Artificial Sequence
  Description of Artificial Sequence: Synthetic oligonucleotide
  Target: ATXN1; (+) strand; PAM type: YTN; PAM sequence: CTG
ggcacactacaccctgtcaa

SEQ ID NO: 266953 - DNA, 20 bp, Artificial Sequence
  Description of Artificial Sequence: Synthetic oligonucleotide
  Target: ATXN1; (+) strand; PAM type: YTN; PAM sequence: CTA
caccctgtcaaacaaaactg

SEQ ID NO: 266954 - DNA, 20 bp, Artificial Sequence
  Description of Artificial Sequence: Synthetic oligonucleotide
  Target: ATXN1; (+) strand; PAM type: YTN; PAM sequence: CTG
tcaaacaaaactgatttact

SEQ ID NO: 266955 - DNA, 20 bp, Artificial Sequence
  Description of Artificial Sequence: Synthetic oligonucleotide
  Target: ATXN1; (+) strand; PAM type: YTN; PAM sequence: CTG
atttactttatctcatacaa

SEQ ID NO: 266956 - DNA, 20 bp, Artificial Sequence
  Description of Artificial Sequence: Synthetic oligonucleotide
  Target: ATXN1; (+) strand; PAM type: YTN; PAM sequence: TTT
actttatctcatacaaaaca

SEQ ID NO: 266957 - DNA, 20 bp, Artificial Sequence
  Description of Artificial Sequence: Synthetic oligonucleotide
  Target: ATXN1; (+) strand; PAM type: YTN; PAM sequence: TTA
ctttatctcatacaaaacat

SEQ ID NO: 266958 - DNA, 20 bp, Artificial Sequence
  Description of Artificial Sequence: Synthetic oligonucleotide
  Target: ATXN1; (+) strand; PAM type: YTN; PAM sequence: CTT
tatctcatacaaaacatcct

SEQ ID NO: 266959 - DNA, 20 bp, Artificial Sequence
  Description of Artificial Sequence: Synthetic oligonucleotide
  Target: ATXN1; (+) strand; PAM type: YTN; PAM sequence: TTT
atctcatacaaaacatcctg

SEQ ID NO: 266960 - DNA, 20 bp, Artificial Sequence
  Description of Artificial Sequence: Synthetic oligonucleotide
  Target: ATXN1; (+) strand; PAM type: YTN; PAM sequence: TTA
tctcatacaaaacatcctga

SEQ ID NO: 266961 - DNA, 20 bp, Artificial Sequence
  Description of Artificial Sequence: Synthetic oligonucleotide
  Target: ATXN1; (+) strand; PAM type: YTN; PAM sequence: CTC
atacaaaacatcctgaaaat

SEQ ID NO: 266962 - DNA, 20 bp, Artificial Sequence
  Description of Artificial Sequence: Synthetic oligonucleotide
  Target: ATXN1; (+) strand; PAM type: YTN; PAM sequence: CTG
aaaatatgggatgctctgaa

SEQ ID NO: 266963 - DNA, 20 bp, Artificial Sequence
  Description of Artificial Sequence: Synthetic oligonucleotide
  Target: ATXN1; (+) strand; PAM type: YTN; PAM sequence: CTC
tgaaagtgccaacagctacc

SEQ ID NO: 266964 - DNA, 20 bp, Artificial Sequence
  Description of Artificial Sequence: Synthetic oligonucleotide
  Target: ATXN1; (+) strand; PAM type: YTN; PAM sequence: CTG
aaagtgccaacagctaccct

SEQ ID NO: 266965 - DNA, 20 bp, Artificial Sequence
  Description of Artificial Sequence: Synthetic oligonucleotide
  Target: ATXN1; (+) strand; PAM type: YTN; PAM sequence: CTA
cccttggagtttttcttttt

SEQ ID NO: 266966 - DNA, 20 bp, Artificial Sequence
  Description of Artificial Sequence: Synthetic oligonucleotide
  Target: ATXN1; (+) strand; PAM type: YTN; PAM sequence: CTT
ggagtttttctttttccaaa

SEQ ID NO: 266967 - DNA, 20 bp, Artificial Sequence
  Description of Artificial Sequence: Synthetic oligonucleotide
  Target: ATXN1; (+) strand; PAM type: YTN; PAM sequence: TTG
gagtttttctttttccaaaa

SEQ ID NO: 266968 - DNA, 20 bp, Artificial Sequence
  Description of Artificial Sequence: Synthetic oligonucleotide
  Target: ATXN1; (+) strand; PAM type: YTN; PAM sequence: TTT
ttctttttccaaaaattatt

SEQ ID NO: 266969 - DNA, 20 bp, Artificial Sequence
  Description of Artificial Sequence: Synthetic oligonucleotide
  Target: ATXN1; (+) strand; PAM type: YTN; PAM sequence: TTT
tctttttccaaaaattattt

SEQ ID NO: 266970 - DNA, 20 bp, Artificial Sequence
  Description of Artificial Sequence: Synthetic oligonucleotide
  Target: ATXN1; (+) strand; PAM type: YTN; PAM sequence: TTT
ctttttccaaaaattatttc

SEQ ID NO: 266971 - DNA, 20 bp, Artificial Sequence
  Description of Artificial Sequence: Synthetic oligonucleotide
  Target: ATXN1; (+) strand; PAM type: YTN; PAM sequence: TTC
tttttccaaaaattatttct

SEQ ID NO: 266972 - DNA, 20 bp, Artificial Sequence
  Description of Artificial Sequence: Synthetic oligonucleotide
  Target: ATXN1; (+) strand; PAM type: YTN; PAM sequence: CTT
tttccaaaaattatttcttt

SEQ ID NO: 266973 - DNA, 20 bp, Artificial Sequence
  Description of Artificial Sequence: Synthetic oligonucleotide
  Target: ATXN1; (+) strand; PAM type: YTN; PAM sequence: TTT
ttccaaaaattatttctttc

SEQ ID NO: 266974 - DNA, 20 bp, Artificial Sequence
  Description of Artificial Sequence: Synthetic oligonucleotide
  Target: ATXN1; (+) strand; PAM type: YTN; PAM sequence: TTT
tccaaaaattatttctttca

SEQ ID NO: 266975 - DNA, 20 bp, Artificial Sequence
  Description of Artificial Sequence: Synthetic oligonucleotide
  Target: ATXN1; (+) strand; PAM type: YTN; PAM sequence: TTT
ccaaaaattatttctttcaa

SEQ ID NO: 266976 - DNA, 20 bp, Artificial Sequence
  Description of Artificial Sequence: Synthetic oligonucleotide
  Target: ATXN1; (+) strand; PAM type: YTN; PAM sequence: TTC
caaaaattatttctttcaat

SEQ ID NO: 266977 - DNA, 20 bp, Artificial Sequence
  Description of Artificial Sequence: Synthetic oligonucleotide
  Target: ATXN1; (+) strand; PAM type: YTN; PAM sequence: TTA
tttctttcaattccagtccc

SEQ ID NO: 266978 - DNA, 20 bp, Artificial Sequence
  Description of Artificial Sequence: Synthetic oligonucleotide
  Target: ATXN1; (+) strand; PAM type: YTN; PAM sequence: TTT
ctttcaattccagtcccaga

SEQ ID NO: 266979 - DNA, 20 bp, Artificial Sequence
  Description of Artificial Sequence: Synthetic oligonucleotide
  Target: ATXN1; (+) strand; PAM type: YTN; PAM sequence: TTC
tttcaattccagtcccagat

SEQ ID NO: 266980 - DNA, 20 bp, Artificial Sequence
  Description of Artificial Sequence: Synthetic oligonucleotide
  Target: ATXN1; (+) strand; PAM type: YTN; PAM sequence: CTT
tcaattccagtcccagatct

SEQ ID NO: 266981 - DNA, 20 bp, Artificial Sequence
  Description of Artificial Sequence: Synthetic oligonucleotide
  Target: ATXN1; (+) strand; PAM type: YTN; PAM sequence: TTT
caattccagtcccagatctt

SEQ ID NO: 266982 - DNA, 20 bp, Artificial Sequence
  Description of Artificial Sequence: Synthetic oligonucleotide
  Target: ATXN1; (+) strand; PAM type: YTN; PAM sequence: TTC
aattccagtcccagatcttc

SEQ ID NO: 266983 - DNA, 20 bp, Artificial Sequence
  Description of Artificial Sequence: Synthetic oligonucleotide
  Target: ATXN1; (+) strand; PAM type: YTN; PAM sequence: TTC
cagtcccagatcttcactac

SEQ ID NO: 266984 - DNA, 20 bp, Artificial Sequence
  Description of Artificial Sequence: Synthetic oligonucleotide
  Target: ATXN1; (+) strand; PAM type: YTN; PAM sequence: CTT
cactaccagcccttatttca

SEQ ID NO: 266985 - DNA, 20 bp, Artificial Sequence
  Description of Artificial Sequence: Synthetic oligonucleotide
  Target: ATXN1; (+) strand; PAM type: YTN; PAM sequence: TTC
actaccagcccttatttcag

SEQ ID NO: 266986 - DNA, 20 bp, Artificial Sequence
  Description of Artificial Sequence: Synthetic oligonucleotide
  Target: ATXN1; (+) strand; PAM type: YTN; PAM sequence: CTA
ccagcccttatttcagctat

SEQ ID NO: 266987 - DNA, 20 bp, Artificial Sequence
  Description of Artificial Sequence: Synthetic oligonucleotide
  Target: ATXN1; (+) strand; PAM type: YTN; PAM sequence: CTT
atttcagctatggtagaagg

SEQ ID NO: 266988 - DNA, 20 bp, Artificial Sequence
  Description of Artificial Sequence: Synthetic oligonucleotide
  Target: ATXN1; (+) strand; PAM type: YTN; PAM sequence: TTA
tttcagctatggtagaagga

SEQ ID NO: 266989 - DNA, 20 bp, Artificial Sequence
  Description of Artificial Sequence: Synthetic oligonucleotide
  Target: ATXN1; (+) strand; PAM type: YTN; PAM sequence: TTT
cagctatggtagaaggagtg

SEQ ID NO: 266990 - DNA, 20 bp, Artificial Sequence
  Description of Artificial Sequence: Synthetic oligonucleotide
  Target: ATXN1; (+) strand; PAM type: YTN; PAM sequence: TTC
agctatggtagaaggagtga

SEQ ID NO: 266991 - DNA, 20 bp, Artificial Sequence
  Description of Artificial Sequence: Synthetic oligonucleotide
  Target: ATXN1; (+) strand; PAM type: YTN; PAM sequence: CTA
tggtagaaggagtgaatata

SEQ ID NO: 266992 - DNA, 20 bp, Artificial Sequence
  Description of Artificial Sequence: Synthetic oligonucleotide
  Target: ATXN1; (+) strand; PAM type: YTN; PAM sequence: CTT
ctgttgagtatacaaaacgt

SEQ ID NO: 266993 - DNA, 20 bp, Artificial Sequence
  Description of Artificial Sequence: Synthetic oligonucleotide
  Target: ATXN1; (+) strand; PAM type: YTN; PAM sequence: TTC
tgttgagtatacaaaacgtg

SEQ ID NO: 266994 - DNA, 20 bp, Artificial Sequence
  Description of Artificial Sequence: Synthetic oligonucleotide
  Target: ATXN1; (+) strand; PAM type: YTN; PAM sequence: CTG
ttgagtatacaaaacgtgct

SEQ ID NO: 266995 - DNA, 20 bp, Artificial Sequence
  Description of Artificial Sequence: Synthetic oligonucleotide
  Target: ATXN1; (+) strand; PAM type: YTN; PAM sequence: TTG
agtatacaaaacgtgctaga

SEQ ID NO: 266996 - DNA, 20 bp, Artificial Sequence
  Description of Artificial Sequence: Synthetic oligonucleotide
  Target: ATXN1; (+) strand; PAM type: YTN; PAM sequence: CTA
gaaatggtcagttacaccct

SEQ ID NO: 266997 - DNA, 20 bp, Artificial Sequence
  Description of Artificial Sequence: Synthetic oligonucleotide
  Target: ATXN1; (+) strand; PAM type: YTN; PAM sequence: TTA
caccctaaatgtctttccca

SEQ ID NO: 266998 - DNA, 20 bp, Artificial Sequence
  Description of Artificial Sequence: Synthetic oligonucleotide
  Target: ATXN1; (+) strand; PAM type: YTN; PAM sequence: CTA
aatgtctttcccatcataag

SEQ ID NO: 266999 - DNA, 20 bp, Artificial Sequence
  Description of Artificial Sequence: Synthetic oligonucleotide
  Target: ATXN1; (+) strand; PAM type: YTN; PAM sequence: CTT
tcccatcataagcacacagt

SEQ ID NO: 267000 - DNA, 20 bp, Artificial Sequence
  Description of Artificial Sequence: Synthetic oligonucleotide
  Target: ATXN1; (+) strand; PAM type: YTN; PAM sequence: TTT
cccatcataagcacacagtt

SEQ ID NO: 267001 - DNA, 20 bp, Artificial Sequence
  Description of Artificial Sequence: Synthetic oligonucleotide
  Target: ATXN1; (+) strand; PAM type: YTN; PAM sequence: TTC
ccatcataagcacacagttt

SEQ ID NO: 267002 - DNA, 20 bp, Artificial Sequence
  Description of Artificial Sequence: Synthetic oligonucleotide
  Target: ATXN1; (+) strand; PAM type: YTN; PAM sequence: TTT
catgcaattatctcgacttg

SEQ ID NO: 267003 - DNA, 20 bp, Artificial Sequence
  Description of Artificial Sequence: Synthetic oligonucleotide
  Target: ATXN1; (+) strand; PAM type: YTN; PAM sequence: TTC
atgcaattatctcgacttga

SEQ ID NO: 267004 - DNA, 20 bp, Artificial Sequence
  Description of Artificial Sequence: Synthetic oligonucleotide
  Target: ATXN1; (+) strand; PAM type: YTN; PAM sequence: TTA
tctcgacttgagtgtggtca

SEQ ID NO: 267005 - DNA, 20 bp, Artificial Sequence
  Description of Artificial Sequence: Synthetic oligonucleotide
  Target: ATXN1; (+) strand; PAM type: YTN; PAM sequence: CTC
gacttgagtgtggtcattca

SEQ ID NO: 267006 - DNA, 20 bp, Artificial Sequence
  Description of Artificial Sequence: Synthetic oligonucleotide
  Target: ATXN1; (+) strand; PAM type: YTN; PAM sequence: CTT
gagtgtggtcattcagtgga

SEQ ID NO: 267007 - DNA, 20 bp, Artificial Sequence
  Description of Artificial Sequence: Synthetic oligonucleotide
  Target: ATXN1; (+) strand; PAM type: YTN; PAM sequence: TTG
agtgtggtcattcagtggaa

SEQ ID NO: 267008 - DNA, 20 bp, Artificial Sequence
  Description of Artificial Sequence: Synthetic oligonucleotide
  Target: ATXN1; (+) strand; PAM type: YTN; PAM sequence: TTC
agtggaacaaatgacaacgg

SEQ ID NO: 267009 - DNA, 20 bp, Artificial Sequence
  Description of Artificial Sequence: Synthetic oligonucleotide
  Target: ATXN1; (+) strand; PAM type: YTN; PAM sequence: TTG
agactacaaaaactctttta

SEQ ID NO: 267010 - DNA, 20 bp, Artificial Sequence
  Description of Artificial Sequence: Synthetic oligonucleotide
  Target: ATXN1; (+) strand; PAM type: YTN; PAM sequence: CTA
caaaaactcttttagtcgtg

SEQ ID NO: 267011 - DNA, 20 bp, Artificial Sequence
  Description of Artificial Sequence: Synthetic oligonucleotide
  Target: ATXN1; (+) strand; PAM type: YTN; PAM sequence: CTC
ttttagtcgtgaagggaaag

SEQ ID NO: 267012 - DNA, 20 bp, Artificial Sequence
  Description of Artificial Sequence: Synthetic oligonucleotide
  Target: ATXN1; (+) strand; PAM type: YTN; PAM sequence: CTT
ttagtcgtgaagggaaaggc

SEQ ID NO: 267013 - DNA, 20 bp, Artificial Sequence
  Description of Artificial Sequence: Synthetic oligonucleotide
  Target: ATXN1; (+) strand; PAM type: YTN; PAM sequence: TTT
tagtcgtgaagggaaaggca

SEQ ID NO: 267014 - DNA, 20 bp, Artificial Sequence
  Description of Artificial Sequence: Synthetic oligonucleotide
  Target: ATXN1; (+) strand; PAM type: YTN; PAM sequence: TTT
agtcgtgaagggaaaggcaa

SEQ ID NO: 267015 - DNA, 20 bp, Artificial Sequence
  Description of Artificial Sequence: Synthetic oligonucleotide
  Target: ATXN1; (+) strand; PAM type: YTN; PAM sequence: TTA
gtcgtgaagggaaaggcaac

SEQ ID NO: 267016 - DNA, 20 bp, Artificial Sequence
  Description of Artificial Sequence: Synthetic oligonucleotide
  Target: ATXN1; (+) strand; PAM type: YTN; PAM sequence: CTT
cctgtcatctgtgggtcttc

SEQ ID NO: 267017 - DNA, 20 bp, Artificial Sequence
  Description of Artificial Sequence: Synthetic oligonucleotide
  Target: ATXN1; (+) strand; PAM type: YTN; PAM sequence: TTC
ctgtcatctgtgggtcttca

SEQ ID NO: 267018 - DNA, 20 bp, Artificial Sequence
  Description of Artificial Sequence: Synthetic oligonucleotide
  Target: ATXN1; (+) strand; PAM type: YTN; PAM sequence: CTG
tcatctgtgggtcttcaatg

SEQ ID NO: 267019 - DNA, 20 bp, Artificial Sequence
  Description of Artificial Sequence: Synthetic oligonucleotide
  Target: ATXN1; (+) strand; PAM type: YTN; PAM sequence: CTG
tgggtcttcaatgctctggg

SEQ ID NO: 267020 - DNA, 20 bp, Artificial Sequence
  Description of Artificial Sequence: Synthetic oligonucleotide
  Target: ATXN1; (+) strand; PAM type: YTN; PAM sequence: CTT
caatgctctggggacaccct

SEQ ID NO: 267021 - DNA, 20 bp, Artificial Sequence
  Description of Artificial Sequence: Synthetic oligonucleotide
  Target: ATXN1; (+) strand; PAM type: YTN; PAM sequence: TTC
aatgctctggggacaccctt

SEQ ID NO: 267022 - DNA, 20 bp, Artificial Sequence
  Description of Artificial Sequence: Synthetic oligonucleotide
  Target: ATXN1; (+) strand; PAM type: YTN; PAM sequence: CTC
tggggacaccctttcatcag

SEQ ID NO: 267023 - DNA, 20 bp, Artificial Sequence
  Description of Artificial Sequence: Synthetic oligonucleotide
  Target: ATXN1; (+) strand; PAM type: YTN; PAM sequence: CTG
gggacaccctttcatcagtc

SEQ ID NO: 267024 - DNA, 20 bp, Artificial Sequence
  Description of Artificial Sequence: Synthetic oligonucleotide
  Target: ATXN1; (+) strand; PAM type: YTN; PAM sequence: CTT
tcatcagtctcccttgttcc

SEQ ID NO: 267025 - DNA, 20 bp, Artificial Sequence
  Description of Artificial Sequence: Synthetic oligonucleotide
  Target: ATXN1; (+) strand; PAM type: YTN; PAM sequence: TTT
catcagtctcccttgttccc

SEQ ID NO: 267026 - DNA, 20 bp, Artificial Sequence
  Description of Artificial Sequence: Synthetic oligonucleotide
  Target: ATXN1; (+) strand; PAM type: YTN; PAM sequence: TTC
atcagtctcccttgttcccc

SEQ ID NO: 267027 - DNA, 20 bp, Artificial Sequence
  Description of Artificial Sequence: Synthetic oligonucleotide
  Target: ATXN1; (+) strand; PAM type: YTN; PAM sequence: CTC
ccttgttccccatttccttg

SEQ ID NO: 267028 - DNA, 20 bp, Artificial Sequence
  Description of Artificial Sequence: Synthetic oligonucleotide
  Target: ATXN1; (+) strand; PAM type: YTN; PAM sequence: CTT
gttccccatttccttgcaaa

SEQ ID NO: 267029 - DNA, 20 bp, Artificial Sequence
  Description of Artificial Sequence: Synthetic oligonucleotide
  Target: ATXN1; (+) strand; PAM type: YTN; PAM sequence: TTG
ttccccatttccttgcaaag

SEQ ID NO: 267030 - DNA, 20 bp, Artificial Sequence
  Description of Artificial Sequence: Synthetic oligonucleotide
  Target: ATXN1; (+) strand; PAM type: YTN; PAM sequence: TTC
cccatttccttgcaaagacc

SEQ ID NO: 267031 - DNA, 20 bp, Artificial Sequence
  Description of Artificial Sequence: Synthetic oligonucleotide
  Target: ATXN1; (+) strand; PAM type: YTN; PAM sequence: TTT
ccttgcaaagacccaccttg

SEQ ID NO: 267032 - DNA, 20 bp, Artificial Sequence
  Description of Artificial Sequence: Synthetic oligonucleotide
  Target: ATXN1; (+) strand; PAM type: YTN; PAM sequence: TTC
cttgcaaagacccaccttga

SEQ ID NO: 267033 - DNA, 20 bp, Artificial Sequence
  Description of Artificial Sequence: Synthetic oligonucleotide
  Target: ATXN1; (+) strand; PAM type: YTN; PAM sequence: CTT
gcaaagacccaccttgagtc

SEQ ID NO: 267034 - DNA, 20 bp, Artificial Sequence
  Description of Artificial Sequence: Synthetic oligonucleotide
  Target: ATXN1; (+) strand; PAM type: YTN; PAM sequence: TTG
caaagacccaccttgagtct

SEQ ID NO: 267035 - DNA, 20 bp, Artificial Sequence
  Description of Artificial Sequence: Synthetic oligonucleotide
  Target: ATXN1; (+) strand; PAM type: YTN; PAM sequence: CTT
gagtctctttcttcgtgaaa

SEQ ID NO: 267036 - DNA, 20 bp, Artificial Sequence
  Description of Artificial Sequence: Synthetic oligonucleotide
  Target: ATXN1; (+) strand; PAM type: YTN; PAM sequence: TTG
agtctctttcttcgtgaaaa

SEQ ID NO: 267037 - DNA, 20 bp, Artificial Sequence
  Description of Artificial Sequence: Synthetic oligonucleotide
  Target: ATXN1; (+) strand; PAM type: YTN; PAM sequence: CTC
tttcttcgtgaaaaatgtct

SEQ ID NO: 267038 - DNA, 20 bp, Artificial Sequence
  Description of Artificial Sequence: Synthetic oligonucleotide
  Target: ATXN1; (+) strand; PAM type: YTN; PAM sequence: CTT
tcttcgtgaaaaatgtcttg

SEQ ID NO: 267039 - DNA, 20 bp, Artificial Sequence
  Description of Artificial Sequence: Synthetic oligonucleotide
  Target: ATXN1; (+) strand; PAM type: YTN; PAM sequence: TTT
cttcgtgaaaaatgtcttgg

SEQ ID NO: 267040 - DNA, 20 bp, Artificial Sequence
  Description of Artificial Sequence: Synthetic oligonucleotide
  Target: ATXN1; (+) strand; PAM type: YTN; PAM sequence: TTC
ttcgtgaaaaatgtcttggc

SEQ ID NO: 267041 - DNA, 20 bp, Artificial Sequence
  Description of Artificial Sequence: Synthetic oligonucleotide
  Target: ATXN1; (+) strand; PAM type: YTN; PAM sequence: CTT
cgtgaaaaatgtcttggcat

SEQ ID NO: 267042 - DNA, 20 bp, Artificial Sequence
  Description of Artificial Sequence: Synthetic oligonucleotide
  Target: ATXN1; (+) strand; PAM type: YTN; PAM sequence: TTC
gtgaaaaatgtcttggcatc

SEQ ID NO: 267043 - DNA, 20 bp, Artificial Sequence
  Description of Artificial Sequence: Synthetic oligonucleotide
  Target: ATXN1; (+) strand; PAM type: YTN; PAM sequence: CTT
ggcatctccagggccacaca

SEQ ID NO: 267044 - DNA, 20 bp, Artificial Sequence
  Description of Artificial Sequence: Synthetic oligonucleotide
  Target: ATXN1; (+) strand; PAM type: YTN; PAM sequence: TTG
gcatctccagggccacacag

SEQ ID NO: 267045 - DNA, 20 bp, Artificial Sequence
  Description of Artificial Sequence: Synthetic oligonucleotide
  Target: ATXN1; (+) strand; PAM type: YTN; PAM sequence: CTC
cagggccacacagacgaagc

SEQ ID NO: 267046 - DNA, 20 bp, Artificial Sequence
  Description of Artificial Sequence: Synthetic oligonucleotide
  Target: ATXN1; (+) strand; PAM type: YTN; PAM sequence: CTC
tcaggagaaaatgtcaccca

SEQ ID NO: 267047 - DNA, 20 bp, Artificial Sequence
  Description of Artificial Sequence: Synthetic oligonucleotide
  Target: ATXN1; (+) strand; PAM type: YTN; PAM sequence: CTC
aggagaaaatgtcacccaaa

SEQ ID NO: 267048 - DNA, 20 bp, Artificial Sequence
  Description of Artificial Sequence: Synthetic oligonucleotide
  Target: ATXN1; (+) strand; PAM type: YTN; PAM sequence: TTG
cctaggggcttccacagaga

SEQ ID NO: 267049 - DNA, 20 bp, Artificial Sequence
  Description of Artificial Sequence: Synthetic oligonucleotide
  Target: ATXN1; (+) strand; PAM type: YTN; PAM sequence: CTA
ggggcttccacagagaagtg

SEQ ID NO: 267050 - DNA, 20 bp, Artificial Sequence
  Description of Artificial Sequence: Synthetic oligonucleotide
  Target: ATXN1; (+) strand; PAM type: YTN; PAM sequence: CTT
ccacagagaagtggccatgg

SEQ ID NO: 267051 - DNA, 20 bp, Artificial Sequence
  Description of Artificial Sequence: Synthetic oligonucleotide
  Target: ATXN1; (+) strand; PAM type: YTN; PAM sequence: TTC
cacagagaagtggccatgga

SEQ ID NO: 267052 - DNA, 20 bp, Artificial Sequence
  Description of Artificial Sequence: Synthetic oligonucleotide
  Target: ATXN1; (+) strand; PAM type: YTN; PAM sequence: CTC
tgccaatgtcacttgactgt

SEQ ID NO: 267053 - DNA, 20 bp, Artificial Sequence
  Description of Artificial Sequence: Synthetic oligonucleotide
  Target: ATXN1; (+) strand; PAM type: YTN; PAM sequence: CTG
ccaatgtcacttgactgtcc

SEQ ID NO: 267054 - DNA, 20 bp, Artificial Sequence
  Description of Artificial Sequence: Synthetic oligonucleotide
  Target: ATXN1; (+) strand; PAM type: YTN; PAM sequence: CTT
gactgtccattttagatttc

SEQ ID NO: 267055 - DNA, 20 bp, Artificial Sequence
  Description of Artificial Sequence: Synthetic oligonucleotide
  Target: ATXN1; (+) strand; PAM type: YTN; PAM sequence: TTG
actgtccattttagatttca

SEQ ID NO: 267056 - DNA, 20 bp, Artificial Sequence
  Description of Artificial Sequence: Synthetic oligonucleotide
  Target: ATXN1; (+) strand; PAM type: YTN; PAM sequence: CTG
tccattttagatttcatcta

SEQ ID NO: 267057 - DNA, 20 bp, Artificial Sequence
  Description of Artificial Sequence: Synthetic oligonucleotide
  Target: ATXN1; (+) strand; PAM type: YTN; PAM sequence: TTT
tagatttcatctaggcaagg

SEQ ID NO: 267058 - DNA, 20 bp, Artificial Sequence
  Description of Artificial Sequence: Synthetic oligonucleotide
  Target: ATXN1; (+) strand; PAM type: YTN; PAM sequence: TTT
agatttcatctaggcaaggc

SEQ ID NO: 267059 - DNA, 20 bp, Artificial Sequence
  Description of Artificial Sequence: Synthetic oligonucleotide
  Target: ATXN1; (+) strand; PAM type: YTN; PAM sequence: TTA
gatttcatctaggcaaggcc

SEQ ID NO: 267060 - DNA, 20 bp, Artificial Sequence
  Description of Artificial Sequence: Synthetic oligonucleotide
  Target: ATXN1; (+) strand; PAM type: YTN; PAM sequence: TTT
catctaggcaaggccacttt

SEQ ID NO: 267061 - DNA, 20 bp, Artificial Sequence
  Description of Artificial Sequence: Synthetic oligonucleotide
  Target: ATXN1; (+) strand; PAM type: YTN; PAM sequence: TTC
atctaggcaaggccactttg

SEQ ID NO: 267062 - DNA, 20 bp, Artificial Sequence
  Description of Artificial Sequence: Synthetic oligonucleotide
  Target: ATXN1; (+) strand; PAM type: YTN; PAM sequence: CTA
ggcaaggccactttggacag

SEQ ID NO: 267063 - DNA, 20 bp, Artificial Sequence
  Description of Artificial Sequence: Synthetic oligonucleotide
  Target: ATXN1; (+) strand; PAM type: YTN; PAM sequence: CTT
tggacagggactttaagata

SEQ ID NO: 267064 - DNA, 20 bp, Artificial Sequence
  Description of Artificial Sequence: Synthetic oligonucleotide
  Target: ATXN1; (+) strand; PAM type: YTN; PAM sequence: TTT
ggacagggactttaagatac

SEQ ID NO: 267065 - DNA, 20 bp, Artificial Sequence
  Description of Artificial Sequence: Synthetic oligonucleotide
  Target: ATXN1; (+) strand; PAM type: YTN; PAM sequence: TTG
gacagggactttaagataca

SEQ ID NO: 267066 - DNA, 20 bp, Artificial Sequence
  Description of Artificial Sequence: Synthetic oligonucleotide
  Target: ATXN1; (+) strand; PAM type: YTN; PAM sequence: CTT
taagatacaatccacagtat

SEQ ID NO: 267067 - DNA, 20 bp, Artificial Sequence
  Description of Artificial Sequence: Synthetic oligonucleotide
  Target: ATXN1; (+) strand; PAM type: YTN; PAM sequence: TTT
aagatacaatccacagtatt

SEQ ID NO: 267068 - DNA, 20 bp, Artificial Sequence
  Description of Artificial Sequence: Synthetic oligonucleotide
  Target: ATXN1; (+) strand; PAM type: YTN; PAM sequence: TTA
agatacaatccacagtattt

SEQ ID NO: 267069 - DNA, 20 bp, Artificial Sequence
  Description of Artificial Sequence: Synthetic oligonucleotide
  Target: ATXN1; (+) strand; PAM type: YTN; PAM sequence: TTT
ctatgttctttggatccaaa

SEQ ID NO: 267070 - DNA, 20 bp, Artificial Sequence
  Description of Artificial Sequence: Synthetic oligonucleotide
  Target: ATXN1; (+) strand; PAM type: YTN; PAM sequence: TTC
tatgttctttggatccaaat

SEQ ID NO: 267071 - DNA, 20 bp, Artificial Sequence
  Description of Artificial Sequence: Synthetic oligonucleotide
  Target: ATXN1; (+) strand; PAM type: YTN; PAM sequence: CTA
tgttctttggatccaaatcg

SEQ ID NO: 267072 - DNA, 20 bp, Artificial Sequence
  Description of Artificial Sequence: Synthetic oligonucleotide
  Target: ATXN1; (+) strand; PAM type: YTN; PAM sequence: TTC
tttggatccaaatcggaaaa

SEQ ID NO: 267073 - DNA, 20 bp, Artificial Sequence
  Description of Artificial Sequence: Synthetic oligonucleotide
  Target: ATXN1; (+) strand; PAM type: YTN; PAM sequence: CTT
tggatccaaatcggaaaatg

SEQ ID NO: 267074 - DNA, 20 bp, Artificial Sequence
  Description of Artificial Sequence: Synthetic oligonucleotide
  Target: ATXN1; (+) strand; PAM type: YTN; PAM sequence: TTT
ggatccaaatcggaaaatgg

SEQ ID NO: 267075 - DNA, 20 bp, Artificial Sequence
  Description of Artificial Sequence: Synthetic oligonucleotide
  Target: ATXN1; (+) strand; PAM type: YTN; PAM sequence: TTG
gatccaaatcggaaaatggc

SEQ ID NO: 267076 - DNA, 20 bp, Artificial Sequence
  Description of Artificial Sequence: Synthetic oligonucleotide
  Target: ATXN1; (+) strand; PAM type: YTN; PAM sequence: TTT
agtgccaattcaatgtggca

SEQ ID NO: 267077 - DNA, 20 bp, Artificial Sequence
  Description of Artificial Sequence: Synthetic oligonucleotide
  Target: ATXN1; (+) strand; PAM type: YTN; PAM sequence: TTA
gtgccaattcaatgtggcat

SEQ ID NO: 267078 - DNA, 20 bp, Artificial Sequence
  Description of Artificial Sequence: Synthetic oligonucleotide
  Target: ATXN1; (+) strand; PAM type: YTN; PAM sequence: TTC
aatgtggcataatgagagga

SEQ ID NO: 267079 - DNA, 20 bp, Artificial Sequence
  Description of Artificial Sequence: Synthetic oligonucleotide
  Target: ATXN1; (+) strand; PAM type: YTN; PAM sequence: TTA
agaagattacaaagtgagcc

SEQ ID NO: 267080 - DNA, 20 bp, Artificial Sequence
  Description of Artificial Sequence: Synthetic oligonucleotide
  Target: ATXN1; (+) strand; PAM type: YTN; PAM sequence: TTA
caaagtgagccatattcctc

SEQ ID NO: 267081 - DNA, 20 bp, Artificial Sequence
  Description of Artificial Sequence: Synthetic oligonucleotide
  Target: ATXN1; (+) strand; PAM type: YTN; PAM sequence: TTC
ctcttcaaggctgggtgcat

SEQ ID NO: 267082 - DNA, 20 bp, Artificial Sequence
  Description of Artificial Sequence: Synthetic oligonucleotide
  Target: ATXN1; (+) strand; PAM type: YTN; PAM sequence: CTC
ttcaaggctgggtgcatgga

SEQ ID NO: 267083 - DNA, 20 bp, Artificial Sequence
  Description of Artificial Sequence: Synthetic oligonucleotide
  Target: ATXN1; (+) strand; PAM type: YTN; PAM sequence: CTT
caaggctgggtgcatggata

SEQ ID NO: 267084 - DNA, 20 bp, Artificial Sequence
  Description of Artificial Sequence: Synthetic oligonucleotide
  Target: ATXN1; (+) strand; PAM type: YTN; PAM sequence: TTC
aaggctgggtgcatggataa

SEQ ID NO: 267085 - DNA, 20 bp, Artificial Sequence
  Description of Artificial Sequence: Synthetic oligonucleotide
  Target: ATXN1; (+) strand; PAM type: YTN; PAM sequence: CTG
ggtgcatggataaattacca

SEQ ID NO: 267086 - DNA, 20 bp, Artificial Sequence
  Description of Artificial Sequence: Synthetic oligonucleotide
  Target: ATXN1; (+) strand; PAM type: YTN; PAM sequence: TTA
ccagagctcagtaagaaggc

SEQ ID NO: 267087 - DNA, 20 bp, Artificial Sequence
  Description of Artificial Sequence: Synthetic oligonucleotide
  Target: ATXN1; (+) strand; PAM type: YTN; PAM sequence: CTC
agtaagaaggctctcgttac

SEQ ID NO: 267088 - DNA, 20 bp, Artificial Sequence
  Description of Artificial Sequence: Synthetic oligonucleotide
  Target: ATXN1; (+) strand; PAM type: YTN; PAM sequence: CTC
tcgttacactggatggcttt

SEQ ID NO: 267089 - DNA, 20 bp, Artificial Sequence
  Description of Artificial Sequence: Synthetic oligonucleotide
  Target: ATXN1; (+) strand; PAM type: YTN; PAM sequence: CTC
gttacactggatggctttca

SEQ ID NO: 267090 - DNA, 20 bp, Artificial Sequence
  Description of Artificial Sequence: Synthetic oligonucleotide
  Target: ATXN1; (+) strand; PAM type: YTN; PAM sequence: TTA
cactggatggctttcaggcc

SEQ ID NO: 267091 - DNA, 20 bp, Artificial Sequence
  Description of Artificial Sequence: Synthetic oligonucleotide
  Target: ATXN1; (+) strand; PAM type: YTN; PAM sequence: CTG
gatggctttcaggccagacc

SEQ ID NO: 267092 - DNA, 20 bp, Artificial Sequence
  Description of Artificial Sequence: Synthetic oligonucleotide
  Target: ATXN1; (+) strand; PAM type: YTN; PAM sequence: CTT
tcaggccagacctgtcaaca

SEQ ID NO: 267093 - DNA, 20 bp, Artificial Sequence
  Description of Artificial Sequence: Synthetic oligonucleotide
  Target: ATXN1; (+) strand; PAM type: YTN; PAM sequence: TTT
caggccagacctgtcaacag

SEQ ID NO: 267094 - DNA, 20 bp, Artificial Sequence
  Description of Artificial Sequence: Synthetic oligonucleotide
  Target: ATXN1; (+) strand; PAM type: YTN; PAM sequence: TTC
aggccagacctgtcaacagg

SEQ ID NO: 267095 - DNA, 20 bp, Artificial Sequence
  Description of Artificial Sequence: Synthetic oligonucleotide
  Target: ATXN1; (+) strand; PAM type: YTN; PAM sequence: CTG
tcaacaggaaaaggggccaa

SEQ ID NO: 267096 - DNA, 20 bp, Artificial Sequence
  Description of Artificial Sequence: Synthetic oligonucleotide
  Target: ATXN1; (+) strand; PAM type: YTN; PAM sequence: CTG
tcatggtgtttcccttcctt

SEQ ID NO: 267097 - DNA, 20 bp, Artificial Sequence
  Description of Artificial Sequence: Synthetic oligonucleotide
  Target: ATXN1; (+) strand; PAM type: YTN; PAM sequence: TTT
cccttccttctgcctccctt

SEQ ID NO: 267098 - DNA, 20 bp, Artificial Sequence
  Description of Artificial Sequence: Synthetic oligonucleotide
  Target: ATXN1; (+) strand; PAM type: YTN; PAM sequence: TTC
ccttccttctgcctcccttg

SEQ ID NO: 267099 - DNA, 20 bp, Artificial Sequence
  Description of Artificial Sequence: Synthetic oligonucleotide
  Target: ATXN1; (+) strand; PAM type: YTN; PAM sequence: CTT
ccttctgcctcccttgacct

SEQ ID NO: 267100 - DNA, 20 bp, Artificial Sequence
  Description of Artificial Sequence: Synthetic oligonucleotide
  Target: ATXN1; (+) strand; PAM type: YTN; PAM sequence: TTC
cttctgcctcccttgacctc

SEQ ID NO: 267101 - DNA, 20 bp, Artificial Sequence
  Description of Artificial Sequence: Synthetic oligonucleotide
  Target: ATXN1; (+) strand; PAM type: YTN; PAM sequence: CTT
ctgcctcccttgacctctga

SEQ ID NO: 267102 - DNA, 20 bp, Artificial Sequence
  Description of Artificial Sequence: Synthetic oligonucleotide
  Target: ATXN1; (+) strand; PAM type: YTN; PAM sequence: TTC
tgcctcccttgacctctgat

SEQ ID NO: 267103 - DNA, 20 bp, Artificial Sequence
  Description of Artificial Sequence: Synthetic oligonucleotide
  Target: ATXN1; (+) strand; PAM type: YTN; PAM sequence: CTG
cctcccttgacctctgattc

SEQ ID NO: 267104 - DNA, 20 bp, Artificial Sequence
  Description of Artificial Sequence: Synthetic oligonucleotide
  Target: ATXN1; (+) strand; PAM type: YTN; PAM sequence: CTC
ccttgacctctgattcctcc

SEQ ID NO: 267105 - DNA, 20 bp, Artificial Sequence
  Description of Artificial Sequence: Synthetic oligonucleotide
  Target: ATXN1; (+) strand; PAM type: YTN; PAM sequence: CTT
gacctctgattcctcccaaa

SEQ ID NO: 267106 - DNA, 20 bp, Artificial Sequence
  Description of Artificial Sequence: Synthetic oligonucleotide
  Target: ATXN1; (+) strand; PAM type: YTN; PAM sequence: TTG
acctctgattcctcccaaac

SEQ ID NO: 267107 - DNA, 20 bp, Artificial Sequence
  Description of Artificial Sequence: Synthetic oligonucleotide
  Target: ATXN1; (+) strand; PAM type: YTN; PAM sequence: CTC
tgattcctcccaaacatcta

SEQ ID NO: 267108 - DNA, 20 bp, Artificial Sequence
  Description of Artificial Sequence: Synthetic oligonucleotide
  Target: ATXN1; (+) strand; PAM type: YTN; PAM sequence: CTG
attcctcccaaacatctact

SEQ ID NO: 267109 - DNA, 20 bp, Artificial Sequence
  Description of Artificial Sequence: Synthetic oligonucleotide
  Target: ATXN1; (+) strand; PAM type: YTN; PAM sequence: TTC
ctcccaaacatctactcatg

SEQ ID NO: 267110 - DNA, 20 bp, Artificial Sequence
  Description of Artificial Sequence: Synthetic oligonucleotide
  Target: ATXN1; (+) strand; PAM type: YTN; PAM sequence: CTC
ccaaacatctactcatgtct

SEQ ID NO: 267111 - DNA, 20 bp, Artificial Sequence
  Description of Artificial Sequence: Synthetic oligonucleotide
  Target: ATXN1; (+) strand; PAM type: YTN; PAM sequence: CTA
ctcatgtctccaactctgca

SEQ ID NO: 267112 - DNA, 20 bp, Artificial Sequence
  Description of Artificial Sequence: Synthetic oligonucleotide
  Target: ATXN1; (+) strand; PAM type: YTN; PAM sequence: CTC
atgtctccaactctgcatgc

SEQ ID NO: 267113 - DNA, 20 bp, Artificial Sequence
  Description of Artificial Sequence: Synthetic oligonucleotide
  Target: ATXN1; (+) strand; PAM type: YTN; PAM sequence: CTC
caactctgcatgccagtgct

SEQ ID NO: 267114 - DNA, 20 bp, Artificial Sequence
  Description of Artificial Sequence: Synthetic oligonucleotide
  Target: ATXN1; (+) strand; PAM type: YTN; PAM sequence: CTC
tgcatgccagtgctgataaa

SEQ ID NO: 267115 - DNA, 20 bp, Artificial Sequence
  Description of Artificial Sequence: Synthetic oligonucleotide
  Target: ATXN1; (+) strand; PAM type: YTN; PAM sequence: CTG
catgccagtgctgataaaca

SEQ ID NO: 267116 - DNA, 20 bp, Artificial Sequence
  Description of Artificial Sequence: Synthetic oligonucleotide
  Target: ATXN1; (+) strand; PAM type: YTN; PAM sequence: CTG
ataaacaagcaaaacattaa

SEQ ID NO: 267117 - DNA, 20 bp, Artificial Sequence
  Description of Artificial Sequence: Synthetic oligonucleotide
  Target: ATXN1; (+) strand; PAM type: YTN; PAM sequence: TTA
acctaattcacaagaaaaac

SEQ ID NO: 267118 - DNA, 20 bp, Artificial Sequence
  Description of Artificial Sequence: Synthetic oligonucleotide
  Target: ATXN1; (+) strand; PAM type: YTN; PAM sequence: CTA
attcacaagaaaaactgata

SEQ ID NO: 267119 - DNA, 20 bp, Artificial Sequence
  Description of Artificial Sequence: Synthetic oligonucleotide
  Target: ATXN1; (+) strand; PAM type: YTN; PAM sequence: TTC
acaagaaaaactgataccat

SEQ ID NO: 267120 - DNA, 20 bp, Artificial Sequence
  Description of Artificial Sequence: Synthetic oligonucleotide
  Target: ATXN1; (+) strand; PAM type: YTN; PAM sequence: CTG
ataccatcagatgctttgag

SEQ ID NO: 267121 - DNA, 20 bp, Artificial Sequence
  Description of Artificial Sequence: Synthetic oligonucleotide
  Target: ATXN1; (+) strand; PAM type: YTN; PAM sequence: CTT
tgagatcgcctaacatcttg

SEQ ID NO: 267122 - DNA, 20 bp, Artificial Sequence
  Description of Artificial Sequence: Synthetic oligonucleotide
  Target: ATXN1; (+) strand; PAM type: YTN; PAM sequence: TTT
gagatcgcctaacatcttgg

SEQ ID NO: 267123 - DNA, 20 bp, Artificial Sequence
  Description of Artificial Sequence: Synthetic oligonucleotide
  Target: ATXN1; (+) strand; PAM type: YTN; PAM sequence: TTG
agatcgcctaacatcttggc

SEQ ID NO: 267124 - DNA, 20 bp, Artificial Sequence
  Description of Artificial Sequence: Synthetic oligonucleotide
  Target: ATXN1; (+) strand; PAM type: YTN; PAM sequence: CTA
acatcttggcccggcagtcc

SEQ ID NO: 267125 - DNA, 20 bp, Artificial Sequence
  Description of Artificial Sequence: Synthetic oligonucleotide
  Target: ATXN1; (+) strand; PAM type: YTN; PAM sequence: CTT
ggcccggcagtccccacatt

SEQ ID NO: 267126 - DNA, 20 bp, Artificial Sequence
  Description of Artificial Sequence: Synthetic oligonucleotide
  Target: ATXN1; (+) strand; PAM type: YTN; PAM sequence: TTG
gcccggcagtccccacattc

SEQ ID NO: 267127 - DNA, 20 bp, Artificial Sequence
  Description of Artificial Sequence: Synthetic oligonucleotide
  Target: ATXN1; (+) strand; PAM type: YTN; PAM sequence: TTC
tgcctggactacccattaat

SEQ ID NO: 267128 - DNA, 20 bp, Artificial Sequence
  Description of Artificial Sequence: Synthetic oligonucleotide
  Target: ATXN1; (+) strand; PAM type: YTN; PAM sequence: CTG
cctggactacccattaattc

SEQ ID NO: 267129 - DNA, 20 bp, Artificial Sequence
  Description of Artificial Sequence: Synthetic oligonucleotide
  Target: ATXN1; (+) strand; PAM type: YTN; PAM sequence: CTG
gactacccattaattcattt

SEQ ID NO: 267130 - DNA, 20 bp, Artificial Sequence
  Description of Artificial Sequence: Synthetic oligonucleotide
  Target: ATXN1; (+) strand; PAM type: YTN; PAM sequence: CTA
cccattaattcatttgttat

SEQ ID NO: 267131 - DNA, 20 bp, Artificial Sequence
  Description of Artificial Sequence: Synthetic oligonucleotide
  Target: ATXN1; (+) strand; PAM type: YTN; PAM sequence: TTA
attcatttgttattctccgt

SEQ ID NO: 267132 - DNA, 20 bp, Artificial Sequence
  Description of Artificial Sequence: Synthetic oligonucleotide
  Target: ATXN1; (+) strand; PAM type: YTN; PAM sequence: TTC
atttgttattctccgtggga

SEQ ID NO: 267133 - DNA, 20 bp, Artificial Sequence
  Description of Artificial Sequence: Synthetic oligonucleotide
  Target: ATXN1; (+) strand; PAM type: YTN; PAM sequence: TTT
gttattctccgtgggattct

SEQ ID NO: 267134 - DNA, 20 bp, Artificial Sequence
  Description of Artificial Sequence: Synthetic oligonucleotide
  Target: ATXN1; (+) strand; PAM type: YTN; PAM sequence: TTG
ttattctccgtgggattcta

SEQ ID NO: 267135 - DNA, 20 bp, Artificial Sequence
  Description of Artificial Sequence: Synthetic oligonucleotide
  Target: ATXN1; (+) strand; PAM type: YTN; PAM sequence: TTA
ttctccgtgggattctatct

SEQ ID NO: 267136 - DNA, 20 bp, Artificial Sequence
  Description of Artificial Sequence: Synthetic oligonucleotide
  Target: ATXN1; (+) strand; PAM type: YTN; PAM sequence: TTC
tccgtgggattctatctgta

SEQ ID NO: 267137 - DNA, 20 bp, Artificial Sequence
  Description of Artificial Sequence: Synthetic oligonucleotide
  Target: ATXN1; (+) strand; PAM type: YTN; PAM sequence: CTC
cgtgggattctatctgtacc

SEQ ID NO: 267138 - DNA, 20 bp, Artificial Sequence
  Description of Artificial Sequence: Synthetic oligonucleotide
  Target: ATXN1; (+) strand; PAM type: YTN; PAM sequence: TTC
tatctgtaccagaaagacca

SEQ ID NO: 267139 - DNA, 20 bp, Artificial Sequence
  Description of Artificial Sequence: Synthetic oligonucleotide
  Target: ATXN1; (+) strand; PAM type: YTN; PAM sequence: CTA
tctgtaccagaaagaccatg

SEQ ID NO: 267140 - DNA, 20 bp, Artificial Sequence
  Description of Artificial Sequence: Synthetic oligonucleotide
  Target: ATXN1; (+) strand; PAM type: YTN; PAM sequence: CTG
taccagaaagaccatgtggt

SEQ ID NO: 267141 - DNA, 20 bp, Artificial Sequence
  Description of Artificial Sequence: Synthetic oligonucleotide
  Target: ATXN1; (+) strand; PAM type: YTN; PAM sequence: CTT
agtaagtgacactcccatga

SEQ ID NO: 267142 - DNA, 20 bp, Artificial Sequence
  Description of Artificial Sequence: Synthetic oligonucleotide
  Target: ATXN1; (+) strand; PAM type: YTN; PAM sequence: TTA
gtaagtgacactcccatgat

SEQ ID NO: 267143 - DNA, 20 bp, Artificial Sequence
  Description of Artificial Sequence: Synthetic oligonucleotide
  Target: ATXN1; (+) strand; PAM type: YTN; PAM sequence: CTC
ccatgatacacttagtaagt

SEQ ID NO: 267144 - DNA, 20 bp, Artificial Sequence
  Description of Artificial Sequence: Synthetic oligonucleotide
  Target: ATXN1; (+) strand; PAM type: YTN; PAM sequence: CTT
agtaagtgacgttttcctcc

SEQ ID NO: 267145 - DNA, 20 bp, Artificial Sequence
  Description of Artificial Sequence: Synthetic oligonucleotide
  Target: ATXN1; (+) strand; PAM type: YTN; PAM sequence: TTA
gtaagtgacgttttcctcct

SEQ ID NO: 267146 - DNA, 20 bp, Artificial Sequence
  Description of Artificial Sequence: Synthetic oligonucleotide
  Target: ATXN1; (+) strand; PAM type: YTN; PAM sequence: TTT
tcctcctggaggcctgccca

SEQ ID NO: 267147 - DNA, 20 bp, Artificial Sequence
  Description of Artificial Sequence: Synthetic oligonucleotide
  Target: ATXN1; (+) strand; PAM type: YTN; PAM sequence: TTT
cctcctggaggcctgcccag

SEQ ID NO: 267148 - DNA, 20 bp, Artificial Sequence
  Description of Artificial Sequence: Synthetic oligonucleotide
  Target: ATXN1; (+) strand; PAM type: YTN; PAM sequence: TTC
ctcctggaggcctgcccaga

SEQ ID NO: 267149 - DNA, 20 bp, Artificial Sequence
  Description of Artificial Sequence: Synthetic oligonucleotide
  Target: ATXN1; (+) strand; PAM type: YTN; PAM sequence: CTC
ctggaggcctgcccagatga

SEQ ID NO: 267150 - DNA, 20 bp, Artificial Sequence
  Description of Artificial Sequence: Synthetic oligonucleotide
  Target: ATXN1; (+) strand; PAM type: YTN; PAM sequence: CTG
gaggcctgcccagatgaggg

SEQ ID NO: 267151 - DNA, 20 bp, Artificial Sequence
  Description of Artificial Sequence: Synthetic oligonucleotide
  Target: ATXN1; (+) strand; PAM type: YTN; PAM sequence: CTG
cccagatgagggaaatggaa

SEQ ID NO: 267152 - DNA, 20 bp, Artificial Sequence
  Description of Artificial Sequence: Synthetic oligonucleotide
  Target: ATXN1; (+) strand; PAM type: YTN; PAM sequence: CTC
tttgagcaaggtgactgcca

SEQ ID NO: 267153 - DNA, 20 bp, Artificial Sequence
  Description of Artificial Sequence: Synthetic oligonucleotide
  Target: ATXN1; (+) strand; PAM type: YTN; PAM sequence: CTT
tgagcaaggtgactgccaac

SEQ ID NO: 267154 - DNA, 20 bp, Artificial Sequence
  Description of Artificial Sequence: Synthetic oligonucleotide
  Target: ATXN1; (+) strand; PAM type: YTN; PAM sequence: TTT
gagcaaggtgactgccaact

SEQ ID NO: 267155 - DNA, 20 bp, Artificial Sequence
  Description of Artificial Sequence: Synthetic oligonucleotide
  Target: ATXN1; (+) strand; PAM type: YTN; PAM sequence: TTG
agcaaggtgactgccaactc

SEQ ID NO: 267156 - DNA, 20 bp, Artificial Sequence
  Description of Artificial Sequence: Synthetic oligonucleotide
  Target: ATXN1; (+) strand; PAM type: YTN; PAM sequence: CTG
ccaactcccttctgaccctc

SEQ ID NO: 267157 - DNA, 20 bp, Artificial Sequence
  Description of Artificial Sequence: Synthetic oligonucleotide
  Target: ATXN1; (+) strand; PAM type: YTN; PAM sequence: CTC
ccttctgaccctctcgaggc

SEQ ID NO: 267158 - DNA, 20 bp, Artificial Sequence
  Description of Artificial Sequence: Synthetic oligonucleotide
  Target: ATXN1; (+) strand; PAM type: YTN; PAM sequence: CTT
ctgaccctctcgaggccacc

SEQ ID NO: 267159 - DNA, 20 bp, Artificial Sequence
  Description of Artificial Sequence: Synthetic oligonucleotide
  Target: ATXN1; (+) strand; PAM type: YTN; PAM sequence: TTC
tgaccctctcgaggccaccc

SEQ ID NO: 267160 - DNA, 20 bp, Artificial Sequence
  Description of Artificial Sequence: Synthetic oligonucleotide
  Target: ATXN1; (+) strand; PAM type: YTN; PAM sequence: CTG
accctctcgaggccaccctc

SEQ ID NO: 267161 - DNA, 20 bp, Artificial Sequence
  Description of Artificial Sequence: Synthetic oligonucleotide
  Target: ATXN1; (+) strand; PAM type: YTN; PAM sequence: CTC
tcgaggccaccctcttccac

SEQ ID NO: 267162 - DNA, 20 bp, Artificial Sequence
  Description of Artificial Sequence: Synthetic oligonucleotide
  Target: ATXN1; (+) strand; PAM type: YTN; PAM sequence: CTC
gaggccaccctcttccacca

SEQ ID NO: 267163 - DNA, 20 bp, Artificial Sequence
  Description of Artificial Sequence: Synthetic oligonucleotide
  Target: ATXN1; (+) strand; PAM type: YTN; PAM sequence: CTC
ttccaccaccactcccttac

SEQ ID NO: 267164 - DNA, 20 bp, Artificial Sequence
  Description of Artificial Sequence: Synthetic oligonucleotide
  Target: ATXN1; (+) strand; PAM type: YTN; PAM sequence: CTT
ccaccaccactcccttactt

SEQ ID NO: 267165 - DNA, 20 bp, Artificial Sequence
  Description of Artificial Sequence: Synthetic oligonucleotide
  Target: ATXN1; (+) strand; PAM type: YTN; PAM sequence: TTC
caccaccactcccttacttg

SEQ ID NO: 267166 - DNA, 20 bp, Artificial Sequence
  Description of Artificial Sequence: Synthetic oligonucleotide
  Target: ATXN1; (+) strand; PAM type: YTN; PAM sequence: CTC
ccttacttgcctttaacgaa

SEQ ID NO: 267167 - DNA, 20 bp, Artificial Sequence
  Description of Artificial Sequence: Synthetic oligonucleotide
  Target: ATXN1; (+) strand; PAM type: YTN; PAM sequence: CTT
acttgcctttaacgaagtgc

SEQ ID NO: 267168 - DNA, 20 bp, Artificial Sequence
  Description of Artificial Sequence: Synthetic oligonucleotide
  Target: ATXN1; (+) strand; PAM type: YTN; PAM sequence: TTA
cttgcctttaacgaagtgcc

SEQ ID NO: 267169 - DNA, 20 bp, Artificial Sequence
  Description of Artificial Sequence: Synthetic oligonucleotide
  Target: ATXN1; (+) strand; PAM type: YTN; PAM sequence: CTT
gcctttaacgaagtgccagc

SEQ ID NO: 267170 - DNA, 20 bp, Artificial Sequence
  Description of Artificial Sequence: Synthetic oligonucleotide
  Target: ATXN1; (+) strand; PAM type: YTN; PAM sequence: TTG
cctttaacgaagtgccagcc

SEQ ID NO: 267171 - DNA, 20 bp, Artificial Sequence
  Description of Artificial Sequence: Synthetic oligonucleotide
  Target: ATXN1; (+) strand; PAM type: YTN; PAM sequence: CTT
taacgaagtgccagccagca

SEQ ID NO: 267172 - DNA, 20 bp, Artificial Sequence
  Description of Artificial Sequence: Synthetic oligonucleotide
  Target: ATXN1; (+) strand; PAM type: YTN; PAM sequence: TTT
aacgaagtgccagccagcac

SEQ ID NO: 267173 - DNA, 20 bp, Artificial Sequence
  Description of Artificial Sequence: Synthetic oligonucleotide
  Target: ATXN1; (+) strand; PAM type: YTN; PAM sequence: TTA
acgaagtgccagccagcacg

SEQ ID NO: 267174 - DNA, 20 bp, Artificial Sequence
  Description of Artificial Sequence: Synthetic oligonucleotide
  Target: ATXN1; (+) strand; PAM type: YTN; PAM sequence: TTG
ctaggacaactggcgtcact

SEQ ID NO: 267175 - DNA, 20 bp, Artificial Sequence
  Description of Artificial Sequence: Synthetic oligonucleotide
  Target: ATXN1; (+) strand; PAM type: YTN; PAM sequence: CTA
ggacaactggcgtcactgcg

SEQ ID NO: 267176 - DNA, 20 bp, Artificial Sequence
  Description of Artificial Sequence: Synthetic oligonucleotide
  Target: ATXN1; (+) strand; PAM type: YTN; PAM sequence: CTG
gcgtcactgcggaggcacag

SEQ ID NO: 267177 - DNA, 20 bp, Artificial Sequence
  Description of Artificial Sequence: Synthetic oligonucleotide
  Target: ATXN1; (+) strand; PAM type: YTN; PAM sequence: CTG
cggaggcacagaaatagatc

SEQ ID NO: 267178 - DNA, 20 bp, Artificial Sequence
  Description of Artificial Sequence: Synthetic oligonucleotide
  Target: ATXN1; (+) strand; PAM type: YTN; PAM sequence: CTA
ggaacctggattataaacgc

SEQ ID NO: 267179 - DNA, 20 bp, Artificial Sequence
  Description of Artificial Sequence: Synthetic oligonucleotide
  Target: ATXN1; (+) strand; PAM type: YTN; PAM sequence: CTG
gattataaacgccaatgaca

SEQ ID NO: 267180 - DNA, 20 bp, Artificial Sequence
  Description of Artificial Sequence: Synthetic oligonucleotide
  Target: ATXN1; (+) strand; PAM type: YTN; PAM sequence: TTA
taaacgccaatgacagtgat

SEQ ID NO: 267181 - DNA, 20 bp, Artificial Sequence
  Description of Artificial Sequence: Synthetic oligonucleotide
  Target: ATXN1; (+) strand; PAM type: YTN; PAM sequence: CTG
attggcagctaatctgtccc

SEQ ID NO: 267182 - DNA, 20 bp, Artificial Sequence
  Description of Artificial Sequence: Synthetic oligonucleotide
  Target: ATXN1; (+) strand; PAM type: YTN; PAM sequence: TTG
gcagctaatctgtcccctat

SEQ ID NO: 267183 - DNA, 20 bp, Artificial Sequence
  Description of Artificial Sequence: Synthetic oligonucleotide
  Target: ATXN1; (+) strand; PAM type: YTN; PAM sequence: CTA
atctgtcccctatagcaagt

SEQ ID NO: 267184 - DNA, 20 bp, Artificial Sequence
  Description of Artificial Sequence: Synthetic oligonucleotide
  Target: ATXN1; (+) strand; PAM type: YTN; PAM sequence: CTG
tcccctatagcaagtgaccg

SEQ ID NO: 267185 - DNA, 20 bp, Artificial Sequence
  Description of Artificial Sequence: Synthetic oligonucleotide
  Target: ATXN1; (+) strand; PAM type: YTN; PAM sequence: CTA
tagcaagtgaccgagtaaca

SEQ ID NO: 267186 - DNA, 20 bp, Artificial Sequence
  Description of Artificial Sequence: Synthetic oligonucleotide
  Target: ATXN1; (+) strand; PAM type: YTN; PAM sequence: CTA
cccagtgggcagctctcacc

SEQ ID NO: 267187 - DNA, 20 bp, Artificial Sequence
  Description of Artificial Sequence: Synthetic oligonucleotide
  Target: ATXN1; (+) strand; PAM type: YTN; PAM sequence: CTC
tcaccttgacacactaccct

SEQ ID NO: 267188 - DNA, 20 bp, Artificial Sequence
  Description of Artificial Sequence: Synthetic oligonucleotide
  Target: ATXN1; (+) strand; PAM type: YTN; PAM sequence: CTC
accttgacacactacccttt

SEQ ID NO: 267189 - DNA, 20 bp, Artificial Sequence
  Description of Artificial Sequence: Synthetic oligonucleotide
  Target: ATXN1; (+) strand; PAM type: YTN; PAM sequence: CTT
gacacactaccctttcatct

SEQ ID NO: 267190 - DNA, 20 bp, Artificial Sequence
  Description of Artificial Sequence: Synthetic oligonucleotide
  Target: ATXN1; (+) strand; PAM type: YTN; PAM sequence: TTG
acacactaccctttcatcta

SEQ ID NO: 267191 - DNA, 20 bp, Artificial Sequence
  Description of Artificial Sequence: Synthetic oligonucleotide
  Target: ATXN1; (+) strand; PAM type: YTN; PAM sequence: CTA
ccctttcatctacatttgtg

SEQ ID NO: 267192 - DNA, 20 bp, Artificial Sequence
  Description of Artificial Sequence: Synthetic oligonucleotide
  Target: ATXN1; (+) strand; PAM type: YTN; PAM sequence: CTT
tcatctacatttgtgcttga

SEQ ID NO: 267193 - DNA, 20 bp, Artificial Sequence
  Description of Artificial Sequence: Synthetic oligonucleotide
  Target: ATXN1; (+) strand; PAM type: YTN; PAM sequence: TTT
catctacatttgtgcttgat

SEQ ID NO: 267194 - DNA, 20 bp, Artificial Sequence
  Description of Artificial Sequence: Synthetic oligonucleotide
  Target: ATXN1; (+) strand; PAM type: YTN; PAM sequence: TTC
atctacatttgtgcttgatg

SEQ ID NO: 267195 - DNA, 20 bp, Artificial Sequence
  Description of Artificial Sequence: Synthetic oligonucleotide
  Target: ATXN1; (+) strand; PAM type: YTN; PAM sequence: CTA
catttgtgcttgatgtggta

SEQ ID NO: 267196 - DNA, 20 bp, Artificial Sequence
  Description of Artificial Sequence: Synthetic oligonucleotide
  Target: ATXN1; (+) strand; PAM type: YTN; PAM sequence: TTT
gtgcttgatgtggtagtgac

SEQ ID NO: 267197 - DNA, 20 bp, Artificial Sequence
  Description of Artificial Sequence: Synthetic oligonucleotide
  Target: ATXN1; (+) strand; PAM type: YTN; PAM sequence: TTG
tgcttgatgtggtagtgact

SEQ ID NO: 267198 - DNA, 20 bp, Artificial Sequence
  Description of Artificial Sequence: Synthetic oligonucleotide
  Target: ATXN1; (+) strand; PAM type: YTN; PAM sequence: CTT
gatgtggtagtgactgagaa

SEQ ID NO: 267199 - DNA, 20 bp, Artificial Sequence
  Description of Artificial Sequence: Synthetic oligonucleotide
  Target: ATXN1; (+) strand; PAM type: YTN; PAM sequence: TTG
atgtggtagtgactgagaag

SEQ ID NO: 267200 - DNA, 20 bp, Artificial Sequence
  Description of Artificial Sequence: Synthetic oligonucleotide
  Target: ATXN1; (+) strand; PAM type: YTN; PAM sequence: CTG
agaaggggcaaggaactagc

SEQ ID NO: 267201 - DNA, 20 bp, Artificial Sequence
  Description of Artificial Sequence: Synthetic oligonucleotide
  Target: ATXN1; (+) strand; PAM type: YTN; PAM sequence: CTA
gctttagataggagctgcat

SEQ ID NO: 267202 - DNA, 20 bp, Artificial Sequence
  Description of Artificial Sequence: Synthetic oligonucleotide
  Target: ATXN1; (+) strand; PAM type: YTN; PAM sequence: CTT
tagataggagctgcatgact

SEQ ID NO: 267203 - DNA, 20 bp, Artificial Sequence
  Description of Artificial Sequence: Synthetic oligonucleotide
  Target: ATXN1; (+) strand; PAM type: YTN; PAM sequence: TTT
agataggagctgcatgactc

SEQ ID NO: 267204 - DNA, 20 bp, Artificial Sequence
  Description of Artificial Sequence: Synthetic oligonucleotide
  Target: ATXN1; (+) strand; PAM type: YTN; PAM sequence: TTA
gataggagctgcatgactct

SEQ ID NO: 267205 - DNA, 20 bp, Artificial Sequence
  Description of Artificial Sequence: Synthetic oligonucleotide
  Target: ATXN1; (+) strand; PAM type: YTN; PAM sequence: CTG
catgactctgttttgaatta

SEQ ID NO: 267206 - DNA, 20 bp, Artificial Sequence
  Description of Artificial Sequence: Synthetic oligonucleotide
  Target: ATXN1; (+) strand; PAM type: YTN; PAM sequence: CTC
tgttttgaattatgtgagcc

SEQ ID NO: 267207 - DNA, 20 bp, Artificial Sequence
  Description of Artificial Sequence: Synthetic oligonucleotide
  Target: ATXN1; (+) strand; PAM type: YTN; PAM sequence: CTG
ttttgaattatgtgagccag

SEQ ID NO: 267208 - DNA, 20 bp, Artificial Sequence
  Description of Artificial Sequence: Synthetic oligonucleotide
  Target: ATXN1; (+) strand; PAM type: YTN; PAM sequence: TTT
tgaattatgtgagccagtag

SEQ ID NO: 267209 - DNA, 20 bp, Artificial Sequence
  Description of Artificial Sequence: Synthetic oligonucleotide
  Target: ATXN1; (+) strand; PAM type: YTN; PAM sequence: TTT
gaattatgtgagccagtaga

SEQ ID NO: 267210 - DNA, 20 bp, Artificial Sequence
  Description of Artificial Sequence: Synthetic oligonucleotide
  Target: ATXN1; (+) strand; PAM type: YTN; PAM sequence: TTG
aattatgtgagccagtagat

SEQ ID NO: 267211 - DNA, 20 bp, Artificial Sequence
  Description of Artificial Sequence: Synthetic oligonucleotide
  Target: ATXN1; (+) strand; PAM type: YTN; PAM sequence: TTA
tgtgagccagtagatatgta

SEQ ID NO: 267212 - DNA, 20 bp, Artificial Sequence
  Description of Artificial Sequence: Synthetic oligonucleotide
  Target: ATXN1; (+) strand; PAM type: YTN; PAM sequence: CTG
acatttgcacctttaatttg

SEQ ID NO: 267213 - DNA, 20 bp, Artificial Sequence
  Description of Artificial Sequence: Synthetic oligonucleotide
  Target: ATXN1; (+) strand; PAM type: YTN; PAM sequence: TTT
gcacctttaatttgttagtt

SEQ ID NO: 267214 - DNA, 20 bp, Artificial Sequence
  Description of Artificial Sequence: Synthetic oligonucleotide
  Target: ATXN1; (+) strand; PAM type: YTN; PAM sequence: TTG
cacctttaatttgttagttt

SEQ ID NO: 267215 - DNA, 20 bp, Artificial Sequence
  Description of Artificial Sequence: Synthetic oligonucleotide
  Target: ATXN1; (+) strand; PAM type: YTN; PAM sequence: CTT
taatttgttagtttcctgaa

SEQ ID NO: 267216 - DNA, 20 bp, Artificial Sequence
  Description of Artificial Sequence: Synthetic oligonucleotide
  Target: ATXN1; (+) strand; PAM type: YTN; PAM sequence: TTT
aatttgttagtttcctgaaa

SEQ ID NO: 267217 - DNA, 20 bp, Artificial Sequence
  Description of Artificial Sequence: Synthetic oligonucleotide
  Target: ATXN1; (+) strand; PAM type: YTN; PAM sequence: TTA
atttgttagtttcctgaaaa

SEQ ID NO: 267218 - DNA, 20 bp, Artificial Sequence
  Description of Artificial Sequence: Synthetic oligonucleotide
  Target: ATXN1; (+) strand; PAM type: YTN; PAM sequence: TTT
gttagtttcctgaaaattag

SEQ ID NO: 267219 - DNA, 20 bp, Artificial Sequence
  Description of Artificial Sequence: Synthetic oligonucleotide
  Target: ATXN1; (+) strand; PAM type: YTN; PAM sequence: TTG
ttagtttcctgaaaattagg

SEQ ID NO: 267220 - DNA, 20 bp, Artificial Sequence
  Description of Artificial Sequence: Synthetic oligonucleotide
  Target: ATXN1; (+) strand; PAM type: YTN; PAM sequence: TTA
gtttcctgaaaattagggag

SEQ ID NO: 267221 - DNA, 20 bp, Artificial Sequence
  Description of Artificial Sequence: Synthetic oligonucleotide
  Target: ATXN1; (+) strand; PAM type: YTN; PAM sequence: TTT
cctgaaaattagggaggaag

SEQ ID NO: 267222 - DNA, 20 bp, Artificial Sequence
  Description of Artificial Sequence: Synthetic oligonucleotide
  Target: ATXN1; (+) strand; PAM type: YTN; PAM sequence: TTC
ctgaaaattagggaggaagg

SEQ ID NO: 267223 - DNA, 20 bp, Artificial Sequence
  Description of Artificial Sequence: Synthetic oligonucleotide
  Target: ATXN1; (+) strand; PAM type: YTN; PAM sequence: CTG
aaaattagggaggaaggctg

SEQ ID NO: 267224 - DNA, 20 bp, Artificial Sequence
  Description of Artificial Sequence: Synthetic oligonucleotide
  Target: ATXN1; (+) strand; PAM type: YTN; PAM sequence: TTA
gggaggaaggctgttcacaa

SEQ ID NO: 267225 - DNA, 20 bp, Artificial Sequence
  Description of Artificial Sequence: Synthetic oligonucleotide
  Target: ATXN1; (+) strand; PAM type: YTN; PAM sequence: CTG
ttcacaagccgaagtatgac

SEQ ID NO: 267226 - DNA, 20 bp, Artificial Sequence
  Description of Artificial Sequence: Synthetic oligonucleotide
  Target: ATXN1; (+) strand; PAM type: YTN; PAM sequence: TTC
acaagccgaagtatgacagc

SEQ ID NO: 267227 - DNA, 20 bp, Artificial Sequence
  Description of Artificial Sequence: Synthetic oligonucleotide
  Target: ATXN1; (+) strand; PAM type: YTN; PAM sequence: TTG
aggttgccaaacagaaggaa

SEQ ID NO: 267228 - DNA, 20 bp, Artificial Sequence
  Description of Artificial Sequence: Synthetic oligonucleotide
  Target: ATXN1; (+) strand; PAM type: YTN; PAM sequence: TTG
ccaaacagaaggaaaaaaca

SEQ ID NO: 267229 - DNA, 20 bp, Artificial Sequence
  Description of Artificial Sequence: Synthetic oligonucleotide
  Target: ATXN1; (+) strand; PAM type: YTN; PAM sequence: CTG
tttggacaagcaatagcttt

SEQ ID NO: 267230 - DNA, 20 bp, Artificial Sequence
  Description of Artificial Sequence: Synthetic oligonucleotide
  Target: ATXN1; (+) strand; PAM type: YTN; PAM sequence: TTT
ggacaagcaatagctttctc

SEQ ID NO: 267231 - DNA, 20 bp, Artificial Sequence
  Description of Artificial Sequence: Synthetic oligonucleotide
  Target: ATXN1; (+) strand; PAM type: YTN; PAM sequence: TTG
gacaagcaatagctttctcc

SEQ ID NO: 267232 - DNA, 20 bp, Artificial Sequence
  Description of Artificial Sequence: Synthetic oligonucleotide
  Target: ATXN1; (+) strand; PAM type: YTN; PAM sequence: CTT
tctcctttctgaacaatagc

SEQ ID NO: 267233 - DNA, 20 bp, Artificial Sequence
  Description of Artificial Sequence: Synthetic oligonucleotide
  Target: ATXN1; (+) strand; PAM type: YTN; PAM sequence: TTT
ctcctttctgaacaatagcg

SEQ ID NO: 267234 - DNA, 20 bp, Artificial Sequence
  Description of Artificial Sequence: Synthetic oligonucleotide
  Target: ATXN1; (+) strand; PAM type: YTN; PAM sequence: TTC
tcctttctgaacaatagcgt

SEQ ID NO: 267235 - DNA, 20 bp, Artificial Sequence
  Description of Artificial Sequence: Synthetic oligonucleotide
  Target: ATXN1; (+) strand; PAM type: YTN; PAM sequence: CTC
ctttctgaacaatagcgttc

SEQ ID NO: 267236 - DNA, 20 bp, Artificial Sequence
  Description of Artificial Sequence: Synthetic oligonucleotide
  Target: ATXN1; (+) strand; PAM type: YTN; PAM sequence: CTT
tctgaacaatagcgttctac

SEQ ID NO: 267237 - DNA, 20 bp, Artificial Sequence
  Description of Artificial Sequence: Synthetic oligonucleotide
  Target: ATXN1; (+) strand; PAM type: YTN; PAM sequence: TTT
ctgaacaatagcgttctact

SEQ ID NO: 267238 - DNA, 20 bp, Artificial Sequence
  Description of Artificial Sequence: Synthetic oligonucleotide
  Target: ATXN1; (+) strand; PAM type: YTN; PAM sequence: TTC
tgaacaatagcgttctactc

SEQ ID NO: 267239 - DNA, 20 bp, Artificial Sequence
  Description of Artificial Sequence: Synthetic oligonucleotide
  Target: ATXN1; (+) strand; PAM type: YTN; PAM sequence: CTG
aacaatagcgttctactctt

SEQ ID NO: 267240 - DNA, 20 bp, Artificial Sequence
  Description of Artificial Sequence: Synthetic oligonucleotide
  Target: ATXN1; (+) strand; PAM type: YTN; PAM sequence: TTC
tactcttctaccttctttta

SEQ ID NO: 267241 - DNA, 20 bp, Artificial Sequence
  Description of Artificial Sequence: Synthetic oligonucleotide
  Target: ATXN1; (+) strand; PAM type: YTN; PAM sequence: CTA
ctcttctaccttcttttaga

SEQ ID NO: 267242 - DNA, 20 bp, Artificial Sequence
  Description of Artificial Sequence: Synthetic oligonucleotide
  Target: ATXN1; (+) strand; PAM type: YTN; PAM sequence: CTC
ttctaccttcttttagagat

SEQ ID NO: 267243 - DNA, 20 bp, Artificial Sequence
  Description of Artificial Sequence: Synthetic oligonucleotide
  Target: ATXN1; (+) strand; PAM type: YTN; PAM sequence: CTT
ctaccttcttttagagatca

SEQ ID NO: 267244 - DNA, 20 bp, Artificial Sequence
  Description of Artificial Sequence: Synthetic oligonucleotide
  Target: ATXN1; (+) strand; PAM type: YTN; PAM sequence: TTC
taccttcttttagagatcaa

SEQ ID NO: 267245 - DNA, 20 bp, Artificial Sequence
  Description of Artificial Sequence: Synthetic oligonucleotide
  Target: ATXN1; (+) strand; PAM type: YTN; PAM sequence: CTA
ccttcttttagagatcaaag

SEQ ID NO: 267246 - DNA, 20 bp, Artificial Sequence
  Description of Artificial Sequence: Synthetic oligonucleotide
  Target: ATXN1; (+) strand; PAM type: YTN; PAM sequence: CTT
cttttagagatcaaagaagg

SEQ ID NO: 267247 - DNA, 20 bp, Artificial Sequence
  Description of Artificial Sequence: Synthetic oligonucleotide
  Target: ATXN1; (+) strand; PAM type: YTN; PAM sequence: TTC
ttttagagatcaaagaagga

SEQ ID NO: 267248 - DNA, 20 bp, Artificial Sequence
  Description of Artificial Sequence: Synthetic oligonucleotide
  Target: ATXN1; (+) strand; PAM type: YTN; PAM sequence: CTT
ttagagatcaaagaaggaaa

SEQ ID NO: 267249 - DNA, 20 bp, Artificial Sequence
  Description of Artificial Sequence: Synthetic oligonucleotide
  Target: ATXN1; (+) strand; PAM type: YTN; PAM sequence: TTT
tagagatcaaagaaggaaaa

SEQ ID NO: 267250 - DNA, 20 bp, Artificial Sequence
  Description of Artificial Sequence: Synthetic oligonucleotide
  Target: ATXN1; (+) strand; PAM type: YTN; PAM sequence: TTT
agagatcaaagaaggaaaag

SEQ ID NO: 267251 - DNA, 20 bp, Artificial Sequence
  Description of Artificial Sequence: Synthetic oligonucleotide
  Target: ATXN1; (+) strand; PAM type: YTN; PAM sequence: TTA
gagatcaaagaaggaaaagg

SEQ ID NO: 267252 - DNA, 20 bp, Artificial Sequence
  Description of Artificial Sequence: Synthetic oligonucleotide
  Target: ATXN1; (+) strand; PAM type: YTN; PAM sequence: CTA
gggcttgccatggttgaaga

SEQ ID NO: 267253 - DNA, 20 bp, Artificial Sequence
  Description of Artificial Sequence: Synthetic oligonucleotide
  Target: ATXN1; (+) strand; PAM type: YTN; PAM sequence: CTT
gccatggttgaagaagagaa

SEQ ID NO: 267254 - DNA, 20 bp, Artificial Sequence
  Description of Artificial Sequence: Synthetic oligonucleotide
  Target: ATXN1; (+) strand; PAM type: YTN; PAM sequence: TTG
ccatggttgaagaagagaat

SEQ ID NO: 267255 - DNA, 20 bp, Artificial Sequence
  Description of Artificial Sequence: Synthetic oligonucleotide
  Target: ATXN1; (+) strand; PAM type: YTN; PAM sequence: TTG
aagaagagaataatctttgt

SEQ ID NO: 267256 - DNA, 20 bp, Artificial Sequence
  Description of Artificial Sequence: Synthetic oligonucleotide
  Target: ATXN1; (+) strand; PAM type: YTN; PAM sequence: CTT
tgtgcccagttctctttgtt

SEQ ID NO: 267257 - DNA, 20 bp, Artificial Sequence
  Description of Artificial Sequence: Synthetic oligonucleotide
  Target: ATXN1; (+) strand; PAM type: YTN; PAM sequence: TTT
gtgcccagttctctttgttc

SEQ ID NO: 267258 - DNA, 20 bp, Artificial Sequence
  Description of Artificial Sequence: Synthetic oligonucleotide
  Target: ATXN1; (+) strand; PAM type: YTN; PAM sequence: TTG
tgcccagttctctttgttct

SEQ ID NO: 267259 - DNA, 20 bp, Artificial Sequence
  Description of Artificial Sequence: Synthetic oligonucleotide
  Target: ATXN1; (+) strand; PAM type: YTN; PAM sequence: TTC
tctttgttctgcagggtgag

SEQ ID NO: 267260 - DNA, 20 bp, Artificial Sequence
  Description of Artificial Sequence: Synthetic oligonucleotide
  Target: ATXN1; (+) strand; PAM type: YTN; PAM sequence: CTC
tttgttctgcagggtgagtt

SEQ ID NO: 267261 - DNA, 20 bp, Artificial Sequence
  Description of Artificial Sequence: Synthetic oligonucleotide
  Target: ATXN1; (+) strand; PAM type: YTN; PAM sequence: CTT
tgttctgcagggtgagtttt

SEQ ID NO: 267262 - DNA, 20 bp, Artificial Sequence
  Description of Artificial Sequence: Synthetic oligonucleotide
  Target: ATXN1; (+) strand; PAM type: YTN; PAM sequence: TTT
gttctgcagggtgagtttta

SEQ ID NO: 267263 - DNA, 20 bp, Artificial Sequence
  Description of Artificial Sequence: Synthetic oligonucleotide
  Target: ATXN1; (+) strand; PAM type: YTN; PAM sequence: TTG
ttctgcagggtgagttttac

SEQ ID NO: 267264 - DNA, 20 bp, Artificial Sequence
  Description of Artificial Sequence: Synthetic oligonucleotide
  Target: ATXN1; (+) strand; PAM type: YTN; PAM sequence: TTC
tgcagggtgagttttacaat

SEQ ID NO: 267265 - DNA, 20 bp, Artificial Sequence
  Description of Artificial Sequence: Synthetic oligonucleotide
  Target: ATXN1; (+) strand; PAM type: YTN; PAM sequence: CTG
cagggtgagttttacaatgc

SEQ ID NO: 267266 - DNA, 20 bp, Artificial Sequence
  Description of Artificial Sequence: Synthetic oligonucleotide
  Target: ATXN1; (+) strand; PAM type: YTN; PAM sequence: TTT
tacaatgcttataacgggta

SEQ ID NO: 267267 - DNA, 20 bp, Artificial Sequence
  Description of Artificial Sequence: Synthetic oligonucleotide
  Target: ATXN1; (+) strand; PAM type: YTN; PAM sequence: TTT
acaatgcttataacgggtag

SEQ ID NO: 267268 - DNA, 20 bp, Artificial Sequence
  Description of Artificial Sequence: Synthetic oligonucleotide
  Target: ATXN1; (+) strand; PAM type: YTN; PAM sequence: TTA
caatgcttataacgggtagc

SEQ ID NO: 267269 - DNA, 20 bp, Artificial Sequence
  Description of Artificial Sequence: Synthetic oligonucleotide
  Target: ATXN1; (+) strand; PAM type: YTN; PAM sequence: CTT
ataacgggtagcaactcgta

SEQ ID NO: 267270 - DNA, 20 bp, Artificial Sequence
  Description of Artificial Sequence: Synthetic oligonucleotide
  Target: ATXN1; (+) strand; PAM type: YTN; PAM sequence: TTA
taacgggtagcaactcgtag

SEQ ID NO: 267271 - DNA, 20 bp, Artificial Sequence
  Description of Artificial Sequence: Synthetic oligonucleotide
  Target: ATXN1; (+) strand; PAM type: YTN; PAM sequence: CTC
gtaggagccccatgcattaa

SEQ ID NO: 267272 - DNA, 20 bp, Artificial Sequence
  Description of Artificial Sequence: Synthetic oligonucleotide
  Target: ATXN1; (+) strand; PAM type: YTN; PAM sequence: TTA
agactgcctatcaaagtctt

SEQ ID NO: 267273 - DNA, 20 bp, Artificial Sequence
  Description of Artificial Sequence: Synthetic oligonucleotide
  Target: ATXN1; (+) strand; PAM type: YTN; PAM sequence: CTG
cctatcaaagtcttggattt

SEQ ID NO: 267274 - DNA, 20 bp, Artificial Sequence
  Description of Artificial Sequence: Synthetic oligonucleotide
  Target: ATXN1; (+) strand; PAM type: YTN; PAM sequence: CTA
tcaaagtcttggattttagc

SEQ ID NO: 267275 - DNA, 20 bp, Artificial Sequence
  Description of Artificial Sequence: Synthetic oligonucleotide
  Target: ATXN1; (+) strand; PAM type: YTN; PAM sequence: CTT
ggattttagccctggagaaa

SEQ ID NO: 267276 - DNA, 20 bp, Artificial Sequence
  Description of Artificial Sequence: Synthetic oligonucleotide
  Target: ATXN1; (+) strand; PAM type: YTN; PAM sequence: TTG
gattttagccctggagaaat

SEQ ID NO: 267277 - DNA, 20 bp, Artificial Sequence
  Description of Artificial Sequence: Synthetic oligonucleotide
  Target: ATXN1; (+) strand; PAM type: YTN; PAM sequence: TTT
tagccctggagaaattacat

SEQ ID NO: 267278 - DNA, 20 bp, Artificial Sequence
  Description of Artificial Sequence: Synthetic oligonucleotide
  Target: ATXN1; (+) strand; PAM type: YTN; PAM sequence: TTT
agccctggagaaattacatt

SEQ ID NO: 267279 - DNA, 20 bp, Artificial Sequence
  Description of Artificial Sequence: Synthetic oligonucleotide
  Target: ATXN1; (+) strand; PAM type: YTN; PAM sequence: TTA
gccctggagaaattacattt

SEQ ID NO: 267280 - DNA, 20 bp, Artificial Sequence
  Description of Artificial Sequence: Synthetic oligonucleotide
  Target: ATXN1; (+) strand; PAM type: YTN; PAM sequence: CTG
gagaaattacattttttttt

SEQ ID NO: 267281 - DNA, 20 bp, Artificial Sequence
  Description of Artificial Sequence: Synthetic oligonucleotide
  Target: ATXN1; (+) strand; PAM type: YTN; PAM sequence: TTA
cattttttttttcaattcta

SEQ ID NO: 267282 - DNA, 20 bp, Artificial Sequence
  Description of Artificial Sequence: Synthetic oligonucleotide
  Target: ATXN1; (+) strand; PAM type: YTN; PAM sequence: TTT
tttttttcaattctatgcaa

SEQ ID NO: 267283 - DNA, 20 bp, Artificial Sequence
  Description of Artificial Sequence: Synthetic oligonucleotide
  Target: ATXN1; (+) strand; PAM type: YTN; PAM sequence: TTT
ttttttcaattctatgcaag

SEQ ID NO: 267284 - DNA, 20 bp, Artificial Sequence
  Description of Artificial Sequence: Synthetic oligonucleotide
  Target: ATXN1; (+) strand; PAM type: YTN; PAM sequence: TTT
tttttcaattctatgcaagc

SEQ ID NO: 267285 - DNA, 20 bp, Artificial Sequence
  Description of Artificial Sequence: Synthetic oligonucleotide
  Target: ATXN1; (+) strand; PAM type: YTN; PAM sequence: TTT
ttttcaattctatgcaagcc

SEQ ID NO: 267286 - DNA, 20 bp, Artificial Sequence
  Description of Artificial Sequence: Synthetic oligonucleotide
  Target: ATXN1; (+) strand; PAM type: YTN; PAM sequence: TTT
tttcaattctatgcaagcca

SEQ ID NO: 267287 - DNA, 20 bp, Artificial Sequence
  Description of Artificial Sequence: Synthetic oligonucleotide
  Target: ATXN1; (+) strand; PAM type: YTN; PAM sequence: TTT
ttcaattctatgcaagccac

SEQ ID NO: 267288 - DNA, 20 bp, Artificial Sequence
  Description of Artificial Sequence: Synthetic oligonucleotide
  Target: ATXN1; (+) strand; PAM type: YTN; PAM sequence: TTT
tcaattctatgcaagccaca

SEQ ID NO: 267289 - DNA, 20 bp, Artificial Sequence
  Description of Artificial Sequence: Synthetic oligonucleotide
  Target: ATXN1; (+) strand; PAM type: YTN; PAM sequence: TTT
caattctatgcaagccacaa

SEQ ID NO: 267290 - DNA, 20 bp, Artificial Sequence
  Description of Artificial Sequence: Synthetic oligonucleotide
  Target: ATXN1; (+) strand; PAM type: YTN; PAM sequence: TTC
aattctatgcaagccacaaa

SEQ ID NO: 267291 - DNA, 20 bp, Artificial Sequence
  Description of Artificial Sequence: Synthetic oligonucleotide
  Target: ATXN1; (+) strand; PAM type: YTN; PAM sequence: TTC
tatgcaagccacaaaggctt

SEQ ID NO: 267292 - DNA, 20 bp, Artificial Sequence
  Description of Artificial Sequence: Synthetic oligonucleotide
  Target: ATXN1; (+) strand; PAM type: YTN; PAM sequence: CTA
tgcaagccacaaaggcttgg

SEQ ID NO: 267293 - DNA, 20 bp, Artificial Sequence
  Description of Artificial Sequence: Synthetic oligonucleotide
  Target: ATXN1; (+) strand; PAM type: YTN; PAM sequence: CTT
gggaagaagaaaggaaaaat

SEQ ID NO: 267294 - DNA, 20 bp, Artificial Sequence
  Description of Artificial Sequence: Synthetic oligonucleotide
  Target: ATXN1; (+) strand; PAM type: YTN; PAM sequence: TTG
ggaagaagaaaggaaaaatg

SEQ ID NO: 267295 - DNA, 20 bp, Artificial Sequence
  Description of Artificial Sequence: Synthetic oligonucleotide
  Target: ATXN1; (+) strand; PAM type: YTN; PAM sequence: CTA
atggaaactttagaaaacca

SEQ ID NO: 267296 - DNA, 20 bp, Artificial Sequence
  Description of Artificial Sequence: Synthetic oligonucleotide
  Target: ATXN1; (+) strand; PAM type: YTN; PAM sequence: CTT
tagaaaaccattttatcaag

SEQ ID NO: 267297 - DNA, 20 bp, Artificial Sequence
  Description of Artificial Sequence: Synthetic oligonucleotide
  Target: ATXN1; (+) strand; PAM type: YTN; PAM sequence: TTT
agaaaaccattttatcaaga

SEQ ID NO: 267298 - DNA, 20 bp, Artificial Sequence
  Description of Artificial Sequence: Synthetic oligonucleotide
  Target: ATXN1; (+) strand; PAM type: YTN; PAM sequence: TTA
gaaaaccattttatcaagag

SEQ ID NO: 267299 - DNA, 20 bp, Artificial Sequence
  Description of Artificial Sequence: Synthetic oligonucleotide
  Target: ATXN1; (+) strand; PAM type: YTN; PAM sequence: TTT
tatcaagagcatttttattt

SEQ ID NO: 267300 - DNA, 20 bp, Artificial Sequence
  Description of Artificial Sequence: Synthetic oligonucleotide
  Target: ATXN1; (+) strand; PAM type: YTN; PAM sequence: TTT
atcaagagcatttttatttc

SEQ ID NO: 267301 - DNA, 20 bp, Artificial Sequence
  Description of Artificial Sequence: Synthetic oligonucleotide
  Target: ATXN1; (+) strand; PAM type: YTN; PAM sequence: TTA
tcaagagcatttttatttcc

SEQ ID NO: 267302 - DNA, 20 bp, Artificial Sequence
  Description of Artificial Sequence: Synthetic oligonucleotide
  Target: ATXN1; (+) strand; PAM type: YTN; PAM sequence: TTT
ttatttccagatgcacaaag

SEQ ID NO: 267303 - DNA, 20 bp, Artificial Sequence
  Description of Artificial Sequence: Synthetic oligonucleotide
  Target: ATXN1; (+) strand; PAM type: YTN; PAM sequence: TTT
tatttccagatgcacaaagg

SEQ ID NO: 267304 - DNA, 20 bp, Artificial Sequence
  Description of Artificial Sequence: Synthetic oligonucleotide
  Target: ATXN1; (+) strand; PAM type: YTN; PAM sequence: TTT
atttccagatgcacaaagga

SEQ ID NO: 267305 - DNA, 20 bp, Artificial Sequence
  Description of Artificial Sequence: Synthetic oligonucleotide
  Target: ATXN1; (+) strand; PAM type: YTN; PAM sequence: TTA
tttccagatgcacaaaggaa

SEQ ID NO: 267306 - DNA, 20 bp, Artificial Sequence
  Description of Artificial Sequence: Synthetic oligonucleotide
  Target: ATXN1; (+) strand; PAM type: YTN; PAM sequence: TTT
ccagatgcacaaaggaaggc

SEQ ID NO: 267307 - DNA, 20 bp, Artificial Sequence
  Description of Artificial Sequence: Synthetic oligonucleotide
  Target: ATXN1; (+) strand; PAM type: YTN; PAM sequence: TTC
cagatgcacaaaggaaggct

SEQ ID NO: 267308 - DNA, 20 bp, Artificial Sequence
  Description of Artificial Sequence: Synthetic oligonucleotide
  Target: ATXN1; (+) strand; PAM type: YTN; PAM sequence: CTG
gtgaggatggctgatgtgca

SEQ ID NO: 267309 - DNA, 20 bp, Artificial Sequence
  Description of Artificial Sequence: Synthetic oligonucleotide
  Target: ATXN1; (+) strand; PAM type: YTN; PAM sequence: CTG
atgtgcagattgaaacacgt

SEQ ID NO: 267310 - DNA, 20 bp, Artificial Sequence
  Description of Artificial Sequence: Synthetic oligonucleotide
  Target: ATXN1; (+) strand; PAM type: YTN; PAM sequence: TTG
aaacacgtaaccaacagcct

SEQ ID NO: 267311 - DNA, 20 bp, Artificial Sequence
  Description of Artificial Sequence: Synthetic oligonucleotide
  Target: ATXN1; (+) strand; PAM type: YTN; PAM sequence: CTG
ggacctgtgcaggggtccag

SEQ ID NO: 267312 - DNA, 20 bp, Artificial Sequence
  Description of Artificial Sequence: Synthetic oligonucleotide
  Target: ATXN1; (+) strand; PAM type: YTN; PAM sequence: CTG
tgcaggggtccagcagcgaa

SEQ ID NO: 267313 - DNA, 20 bp, Artificial Sequence
  Description of Artificial Sequence: Synthetic oligonucleotide
  Target: ATXN1; (+) strand; PAM type: YTN; PAM sequence: TTC
tgacagcaatgtgggcaggt

SEQ ID NO: 267314 - DNA, 20 bp, Artificial Sequence
  Description of Artificial Sequence: Synthetic oligonucleotide
  Target: ATXN1; (+) strand; PAM type: YTN; PAM sequence: CTG
acagcaatgtgggcaggtca

SEQ ID NO: 267315 - DNA, 20 bp, Artificial Sequence
  Description of Artificial Sequence: Synthetic oligonucleotide
  Target: ATXN1; (+) strand; PAM type: YTN; PAM sequence: CTC
ccagtgccaggcactcaaga

SEQ ID NO: 267316 - DNA, 20 bp, Artificial Sequence
  Description of Artificial Sequence: Synthetic oligonucleotide
  Target: ATXN1; (+) strand; PAM type: YTN; PAM sequence: CTC
aagactgggaaatgatcaca

SEQ ID NO: 267317 - DNA, 20 bp, Artificial Sequence
  Description of Artificial Sequence: Synthetic oligonucleotide
  Target: ATXN1; (+) strand; PAM type: YTN; PAM sequence: CTG
ggaaatgatcacaagatgct

SEQ ID NO: 267318 - DNA, 20 bp, Artificial Sequence
  Description of Artificial Sequence: Synthetic oligonucleotide
  Target: ATXN1; (+) strand; PAM type: YTN; PAM sequence: CTG
tttaaaaatgtattgagaaa

SEQ ID NO: 267319 - DNA, 20 bp, Artificial Sequence
  Description of Artificial Sequence: Synthetic oligonucleotide
  Target: ATXN1; (+) strand; PAM type: YTN; PAM sequence: TTT
aaaaatgtattgagaaagaa

SEQ ID NO: 267320 - DNA, 20 bp, Artificial Sequence
  Description of Artificial Sequence: Synthetic oligonucleotide
  Target: ATXN1; (+) strand; PAM type: YTN; PAM sequence: TTA
aaaatgtattgagaaagaag

SEQ ID NO: 267321 - DNA, 20 bp, Artificial Sequence
  Description of Artificial Sequence: Synthetic oligonucleotide
  Target: ATXN1; (+) strand; PAM type: YTN; PAM sequence: TTG
agaaagaagtagaatttaaa

SEQ ID NO: 267322 - DNA, 20 bp, Artificial Sequence
  Description of Artificial Sequence: Synthetic oligonucleotide
  Target: ATXN1; (+) strand; PAM type: YTN; PAM sequence: TTT
aaaagtagaagaagatggtt

SEQ ID NO: 267323 - DNA, 20 bp, Artificial Sequence
  Description of Artificial Sequence: Synthetic oligonucleotide
  Target: ATXN1; (+) strand; PAM type: YTN; PAM sequence: TTA
aaagtagaagaagatggtta

SEQ ID NO: 267324 - DNA, 20 bp, Artificial Sequence
  Description of Artificial Sequence: Synthetic oligonucleotide
  Target: ATXN1; (+) strand; PAM type: YTN; PAM sequence: TTA
agagtccaaagagcatgatg

SEQ ID NO: 267325 - DNA, 20 bp, Artificial Sequence
  Description of Artificial Sequence: Synthetic oligonucleotide
  Target: ATXN1; (+) strand; PAM type: YTN; PAM sequence: CTG
tctgagttttggaaataaaa

SEQ ID NO: 267326 - DNA, 20 bp, Artificial Sequence
  Description of Artificial Sequence: Synthetic oligonucleotide
  Target: ATXN1; (+) strand; PAM type: YTN; PAM sequence: CTG
agttttggaaataaaagatt

SEQ ID NO: 267327 - DNA, 20 bp, Artificial Sequence
  Description of Artificial Sequence: Synthetic oligonucleotide
  Target: ATXN1; (+) strand; PAM type: YTN; PAM sequence: TTT
tggaaataaaagattatgat

SEQ ID NO: 267328 - DNA, 20 bp, Artificial Sequence
  Description of Artificial Sequence: Synthetic oligonucleotide
  Target: ATXN1; (+) strand; PAM type: YTN; PAM sequence: TTT
ggaaataaaagattatgata

SEQ ID NO: 267329 - DNA, 20 bp, Artificial Sequence
  Description of Artificial Sequence: Synthetic oligonucleotide
  Target: ATXN1; (+) strand; PAM type: YTN; PAM sequence: TTG
gaaataaaagattatgatag

SEQ ID NO: 267330 - DNA, 20 bp, Artificial Sequence
  Description of Artificial Sequence: Synthetic oligonucleotide
  Target: ATXN1; (+) strand; PAM type: YTN; PAM sequence: TTA
tgatagaggatagccatttg

SEQ ID NO: 267331 - DNA, 20 bp, Artificial Sequence
  Description of Artificial Sequence: Synthetic oligonucleotide
  Target: ATXN1; (+) strand; PAM type: YTN; PAM sequence: TTT
gtataccatttatgtttcca

SEQ ID NO: 267332 - DNA, 20 bp, Artificial Sequence
  Description of Artificial Sequence: Synthetic oligonucleotide
  Target: ATXN1; (+) strand; PAM type: YTN; PAM sequence: TTG
tataccatttatgtttccat

SEQ ID NO: 267333 - DNA, 20 bp, Artificial Sequence
  Description of Artificial Sequence: Synthetic oligonucleotide
  Target: ATXN1; (+) strand; PAM type: YTN; PAM sequence: TTT
atgtttccatttaaggagac

SEQ ID NO: 267334 - DNA, 20 bp, Artificial Sequence
  Description of Artificial Sequence: Synthetic oligonucleotide
  Target: ATXN1; (+) strand; PAM type: YTN; PAM sequence: TTA
tgtttccatttaaggagact

SEQ ID NO: 267335 - DNA, 20 bp, Artificial Sequence
  Description of Artificial Sequence: Synthetic oligonucleotide
  Target: ATXN1; (+) strand; PAM type: YTN; PAM sequence: TTT
ccatttaaggagactctcct

SEQ ID NO: 267336 - DNA, 20 bp, Artificial Sequence
  Description of Artificial Sequence: Synthetic oligonucleotide
  Target: ATXN1; (+) strand; PAM type: YTN; PAM sequence: TTC
catttaaggagactctcctt

SEQ ID NO: 267337 - DNA, 20 bp, Artificial Sequence
  Description of Artificial Sequence: Synthetic oligonucleotide
  Target: ATXN1; (+) strand; PAM type: YTN; PAM sequence: TTT
aaggagactctccttaagca

SEQ ID NO: 267338 - DNA, 20 bp, Artificial Sequence
  Description of Artificial Sequence: Synthetic oligonucleotide
  Target: ATXN1; (+) strand; PAM type: YTN; PAM sequence: TTA
aggagactctccttaagcaa

SEQ ID NO: 267339 - DNA, 20 bp, Artificial Sequence
  Description of Artificial Sequence: Synthetic oligonucleotide
  Target: ATXN1; (+) strand; PAM type: YTN; PAM sequence: CTC
tccttaagcaagttgtttca

SEQ ID NO: 267340 - DNA, 20 bp, Artificial Sequence
  Description of Artificial Sequence: Synthetic oligonucleotide
  Target: ATXN1; (+) strand; PAM type: YTN; PAM sequence: CTC
cttaagcaagttgtttcagg

SEQ ID NO: 267341 - DNA, 20 bp, Artificial Sequence
  Description of Artificial Sequence: Synthetic oligonucleotide
  Target: ATXN1; (+) strand; PAM type: YTN; PAM sequence: CTT
aagcaagttgtttcaggaat

SEQ ID NO: 267342 - DNA, 20 bp, Artificial Sequence
  Description of Artificial Sequence: Synthetic oligonucleotide
  Target: ATXN1; (+) strand; PAM type: YTN; PAM sequence: TTA
agcaagttgtttcaggaata

SEQ ID NO: 267343 - DNA, 20 bp, Artificial Sequence
  Description of Artificial Sequence: Synthetic oligonucleotide
  Target: ATXN1; (+) strand; PAM type: YTN; PAM sequence: TTG
tttcaggaatataagcacaa

SEQ ID NO: 267344 - DNA, 20 bp, Artificial Sequence
  Description of Artificial Sequence: Synthetic oligonucleotide
  Target: ATXN1; (+) strand; PAM type: YTN; PAM sequence: TTT
caggaatataagcacaaata

SEQ ID NO: 267345 - DNA, 20 bp, Artificial Sequence
  Description of Artificial Sequence: Synthetic oligonucleotide
  Target: ATXN1; (+) strand; PAM type: YTN; PAM sequence: TTC
aggaatataagcacaaatac

SEQ ID NO: 267346 - DNA, 20 bp, Artificial Sequence
  Description of Artificial Sequence: Synthetic oligonucleotide
  Target: ATXN1; (+) strand; PAM type: YTN; PAM sequence: TTG
ctctgaaaacttaatttctc

SEQ ID NO: 267347 - DNA, 20 bp, Artificial Sequence
  Description of Artificial Sequence: Synthetic oligonucleotide
  Target: ATXN1; (+) strand; PAM type: YTN; PAM sequence: CTC
tgaaaacttaatttctctaa

SEQ ID NO: 267348 - DNA, 20 bp, Artificial Sequence
  Description of Artificial Sequence: Synthetic oligonucleotide
  Target: ATXN1; (+) strand; PAM type: YTN; PAM sequence: CTG
aaaacttaatttctctaaca

SEQ ID NO: 267349 - DNA, 20 bp, Artificial Sequence
  Description of Artificial Sequence: Synthetic oligonucleotide
  Target: ATXN1; (+) strand; PAM type: YTN; PAM sequence: CTT
aatttctctaacataggttt

SEQ ID NO: 267350 - DNA, 20 bp, Artificial Sequence
  Description of Artificial Sequence: Synthetic oligonucleotide
  Target: ATXN1; (+) strand; PAM type: YTN; PAM sequence: TTA
atttctctaacataggtttg

SEQ ID NO: 267351 - DNA, 20 bp, Artificial Sequence
  Description of Artificial Sequence: Synthetic oligonucleotide
  Target: ATXN1; (+) strand; PAM type: YTN; PAM sequence: TTT
ctctaacataggtttgaaac

SEQ ID NO: 267352 - DNA, 20 bp, Artificial Sequence
  Description of Artificial Sequence: Synthetic oligonucleotide
  Target: ATXN1; (+) strand; PAM type: YTN; PAM sequence: TTC
tctaacataggtttgaaaca

SEQ ID NO: 267353 - DNA, 20 bp, Artificial Sequence
  Description of Artificial Sequence: Synthetic oligonucleotide
  Target: ATXN1; (+) strand; PAM type: YTN; PAM sequence: CTC
taacataggtttgaaacagc

SEQ ID NO: 267354 - DNA, 20 bp, Artificial Sequence
  Description of Artificial Sequence: Synthetic oligonucleotide
  Target: ATXN1; (+) strand; PAM type: YTN; PAM sequence: CTA
acataggtttgaaacagcta

SEQ ID NO: 267355 - DNA, 20 bp, Artificial Sequence
  Description of Artificial Sequence: Synthetic oligonucleotide
  Target: ATXN1; (+) strand; PAM type: YTN; PAM sequence: TTT
gaaacagctaatttgctatc

SEQ ID NO: 267356 - DNA, 20 bp, Artificial Sequence
  Description of Artificial Sequence: Synthetic oligonucleotide
  Target: ATXN1; (+) strand; PAM type: YTN; PAM sequence: TTG
aaacagctaatttgctatca

SEQ ID NO: 267357 - DNA, 20 bp, Artificial Sequence
  Description of Artificial Sequence: Synthetic oligonucleotide
  Target: ATXN1; (+) strand; PAM type: YTN; PAM sequence: CTA
atttgctatcacacctcaaa

SEQ ID NO: 267358 - DNA, 20 bp, Artificial Sequence
  Description of Artificial Sequence: Synthetic oligonucleotide
  Target: ATXN1; (+) strand; PAM type: YTN; PAM sequence: TTT
gctatcacacctcaaaatca

SEQ ID NO: 267359 - DNA, 20 bp, Artificial Sequence
  Description of Artificial Sequence: Synthetic oligonucleotide
  Target: ATXN1; (+) strand; PAM type: YTN; PAM sequence: TTG
ctatcacacctcaaaatcat

SEQ ID NO: 267360 - DNA, 20 bp, Artificial Sequence
  Description of Artificial Sequence: Synthetic oligonucleotide
  Target: ATXN1; (+) strand; PAM type: YTN; PAM sequence: CTA
tcacacctcaaaatcatttt

SEQ ID NO: 267361 - DNA, 20 bp, Artificial Sequence
  Description of Artificial Sequence: Synthetic oligonucleotide
  Target: ATXN1; (+) strand; PAM type: YTN; PAM sequence: CTC
aaaatcattttatacttgtc

SEQ ID NO: 267362 - DNA, 20 bp, Artificial Sequence
  Description of Artificial Sequence: Synthetic oligonucleotide
  Target: ATXN1; (+) strand; PAM type: YTN; PAM sequence: TTT
tatacttgtcaaaaatgact

SEQ ID NO: 267363 - DNA, 20 bp, Artificial Sequence
  Description of Artificial Sequence: Synthetic oligonucleotide
  Target: ATXN1; (+) strand; PAM type: YTN; PAM sequence: TTT
atacttgtcaaaaatgactt

SEQ ID NO: 267364 - DNA, 20 bp, Artificial Sequence
  Description of Artificial Sequence: Synthetic oligonucleotide
  Target: ATXN1; (+) strand; PAM type: YTN; PAM sequence: TTA
tacttgtcaaaaatgacttt

SEQ ID NO: 267365 - DNA, 20 bp, Artificial Sequence
  Description of Artificial Sequence: Synthetic oligonucleotide
  Target: ATXN1; (+) strand; PAM type: YTN; PAM sequence: CTT
gtcaaaaatgactttttctg

SEQ ID NO: 267366 - DNA, 20 bp, Artificial Sequence
  Description of Artificial Sequence: Synthetic oligonucleotide
  Target: ATXN1; (+) strand; PAM type: YTN; PAM sequence: TTG
tcaaaaatgactttttctga

SEQ ID NO: 267367 - DNA, 20 bp, Artificial Sequence
  Description of Artificial Sequence: Synthetic oligonucleotide
  Target: ATXN1; (+) strand; PAM type: YTN; PAM sequence: CTT
tttctgaatcatgtaacata

SEQ ID NO: 267368 - DNA, 20 bp, Artificial Sequence
  Description of Artificial Sequence: Synthetic oligonucleotide
  Target: ATXN1; (+) strand; PAM type: YTN; PAM sequence: TTT
ttctgaatcatgtaacatac

SEQ ID NO: 267369 - DNA, 20 bp, Artificial Sequence
  Description of Artificial Sequence: Synthetic oligonucleotide
  Target: ATXN1; (+) strand; PAM type: YTN; PAM sequence: TTT
tctgaatcatgtaacatact

SEQ ID NO: 267370 - DNA, 20 bp, Artificial Sequence
  Description of Artificial Sequence: Synthetic oligonucleotide
  Target: ATXN1; (+) strand; PAM type: YTN; PAM sequence: TTT
ctgaatcatgtaacatactt

SEQ ID NO: 267371 - DNA, 20 bp, Artificial Sequence
  Description of Artificial Sequence: Synthetic oligonucleotide
  Target: ATXN1; (+) strand; PAM type: YTN; PAM sequence: TTC
tgaatcatgtaacatacttg

SEQ ID NO: 267372 - DNA, 20 bp, Artificial Sequence
  Description of Artificial Sequence: Synthetic oligonucleotide
  Target: ATXN1; (+) strand; PAM type: YTN; PAM sequence: CTG
aatcatgtaacatacttgtt

SEQ ID NO: 267373 - DNA, 20 bp, Artificial Sequence
  Description of Artificial Sequence: Synthetic oligonucleotide
  Target: ATXN1; (+) strand; PAM type: YTN; PAM sequence: CTT
gtttaggtgtctggaaaagg

SEQ ID NO: 267374 - DNA, 20 bp, Artificial Sequence
  Description of Artificial Sequence: Synthetic oligonucleotide
  Target: ATXN1; (+) strand; PAM type: YTN; PAM sequence: TTG
tttaggtgtctggaaaaggt

SEQ ID NO: 267375 - DNA, 20 bp, Artificial Sequence
  Description of Artificial Sequence: Synthetic oligonucleotide
  Target: ATXN1; (+) strand; PAM type: YTN; PAM sequence: TTT
aggtgtctggaaaaggttaa

SEQ ID NO: 267376 - DNA, 20 bp, Artificial Sequence
  Description of Artificial Sequence: Synthetic oligonucleotide
  Target: ATXN1; (+) strand; PAM type: YTN; PAM sequence: TTA
ggtgtctggaaaaggttaac

SEQ ID NO: 267377 - DNA, 20 bp, Artificial Sequence
  Description of Artificial Sequence: Synthetic oligonucleotide
  Target: ATXN1; (+) strand; PAM type: YTN; PAM sequence: CTG
gaaaaggttaacataatctt

SEQ ID NO: 267378 - DNA, 20 bp, Artificial Sequence
  Description of Artificial Sequence: Synthetic oligonucleotide
  Target: ATXN1; (+) strand; PAM type: YTN; PAM sequence: TTA
acataatcttcaggatttat

SEQ ID NO: 267379 - DNA, 20 bp, Artificial Sequence
  Description of Artificial Sequence: Synthetic oligonucleotide
  Target: ATXN1; (+) strand; PAM type: YTN; PAM sequence: CTT
caggatttatagaagatgga

SEQ ID NO: 267380 - DNA, 20 bp, Artificial Sequence
  Description of Artificial Sequence: Synthetic oligonucleotide
  Target: ATXN1; (+) strand; PAM type: YTN; PAM sequence: TTC
aggatttatagaagatggat

SEQ ID NO: 267381 - DNA, 20 bp, Artificial Sequence
  Description of Artificial Sequence: Synthetic oligonucleotide
  Target: ATXN1; (+) strand; PAM type: YTN; PAM sequence: TTT
atagaagatggattaattct

SEQ ID NO: 267382 - DNA, 20 bp, Artificial Sequence
  Description of Artificial Sequence: Synthetic oligonucleotide
  Target: ATXN1; (+) strand; PAM type: YTN; PAM sequence: TTA
tagaagatggattaattctt

SEQ ID NO: 267383 - DNA, 20 bp, Artificial Sequence
  Description of Artificial Sequence: Synthetic oligonucleotide
  Target: ATXN1; (+) strand; PAM type: YTN; PAM sequence: TTA
attctttcagtctacaattc

SEQ ID NO: 267384 - DNA, 20 bp, Artificial Sequence
  Description of Artificial Sequence: Synthetic oligonucleotide
  Target: ATXN1; (+) strand; PAM type: YTN; PAM sequence: TTC
tttcagtctacaattctact

SEQ ID NO: 267385 - DNA, 20 bp, Artificial Sequence
  Description of Artificial Sequence: Synthetic oligonucleotide
  Target: ATXN1; (+) strand; PAM type: YTN; PAM sequence: CTT
tcagtctacaattctactta

SEQ ID NO: 267386 - DNA, 20 bp, Artificial Sequence
  Description of Artificial Sequence: Synthetic oligonucleotide
  Target: ATXN1; (+) strand; PAM type: YTN; PAM sequence: TTT
cagtctacaattctacttag

SEQ ID NO: 267387 - DNA, 20 bp, Artificial Sequence
  Description of Artificial Sequence: Synthetic oligonucleotide
  Target: ATXN1; (+) strand; PAM type: YTN; PAM sequence: TTC
agtctacaattctacttagc

SEQ ID NO: 267388 - DNA, 20 bp, Artificial Sequence
  Description of Artificial Sequence: Synthetic oligonucleotide
  Target: ATXN1; (+) strand; PAM type: YTN; PAM sequence: CTA
caattctacttagcaataat

SEQ ID NO: 267389 - DNA, 20 bp, Artificial Sequence
  Description of Artificial Sequence: Synthetic oligonucleotide
  Target: ATXN1; (+) strand; PAM type: YTN; PAM sequence: TTC
tacttagcaataatttatta

SEQ ID NO: 267390 - DNA, 20 bp, Artificial Sequence
  Description of Artificial Sequence: Synthetic oligonucleotide
  Target: ATXN1; (+) strand; PAM type: YTN; PAM sequence: CTA
cttagcaataatttattaca

SEQ ID NO: 267391 - DNA, 20 bp, Artificial Sequence
  Description of Artificial Sequence: Synthetic oligonucleotide
  Target: ATXN1; (+) strand; PAM type: YTN; PAM sequence: CTT
agcaataatttattacatag

SEQ ID NO: 267392 - DNA, 20 bp, Artificial Sequence
  Description of Artificial Sequence: Synthetic oligonucleotide
  Target: ATXN1; (+) strand; PAM type: YTN; PAM sequence: TTA
gcaataatttattacatagc

SEQ ID NO: 267393 - DNA, 20 bp, Artificial Sequence
  Description of Artificial Sequence: Synthetic oligonucleotide
  Target: ATXN1; (+) strand; PAM type: YTN; PAM sequence: TTT
attacatagctaccactgga

SEQ ID NO: 267394 - DNA, 20 bp, Artificial Sequence
  Description of Artificial Sequence: Synthetic oligonucleotide
  Target: ATXN1; (+) strand; PAM type: YTN; PAM sequence: TTA
ttacatagctaccactggaa

SEQ ID NO: 267395 - DNA, 20 bp, Artificial Sequence
  Description of Artificial Sequence: Synthetic oligonucleotide
  Target: ATXN1; (+) strand; PAM type: YTN; PAM sequence: TTA
catagctaccactggaaatt

SEQ ID NO: 267396 - DNA, 20 bp, Artificial Sequence
  Description of Artificial Sequence: Synthetic oligonucleotide
  Target: ATXN1; (+) strand; PAM type: YTN; PAM sequence: CTA
ccactggaaatttaacatga

SEQ ID NO: 267397 - DNA, 20 bp, Artificial Sequence
  Description of Artificial Sequence: Synthetic oligonucleotide
  Target: ATXN1; (+) strand; PAM type: YTN; PAM sequence: CTG
gaaatttaacatgaatttaa

SEQ ID NO: 267398 - DNA, 20 bp, Artificial Sequence
  Description of Artificial Sequence: Synthetic oligonucleotide
  Target: ATXN1; (+) strand; PAM type: YTN; PAM sequence: TTT
aacatgaatttaagttggag

SEQ ID NO: 267399 - DNA, 20 bp, Artificial Sequence
  Description of Artificial Sequence: Synthetic oligonucleotide
  Target: ATXN1; (+) strand; PAM type: YTN; PAM sequence: TTA
acatgaatttaagttggaga

SEQ ID NO: 267400 - DNA, 20 bp, Artificial Sequence
  Description of Artificial Sequence: Synthetic oligonucleotide
  Target: ATXN1; (+) strand; PAM type: YTN; PAM sequence: TTT
aagttggagacatggttaat

SEQ ID NO: 267401 - DNA, 20 bp, Artificial Sequence
  Description of Artificial Sequence: Synthetic oligonucleotide
  Target: ATXN1; (+) strand; PAM type: YTN; PAM sequence: TTA
agttggagacatggttaata

SEQ ID NO: 267402 - DNA, 20 bp, Artificial Sequence
  Description of Artificial Sequence: Synthetic oligonucleotide
  Target: ATXN1; (+) strand; PAM type: YTN; PAM sequence: TTG
gagacatggttaatattttt

SEQ ID NO: 267403 - DNA, 20 bp, Artificial Sequence
  Description of Artificial Sequence: Synthetic oligonucleotide
  Target: ATXN1; (+) strand; PAM type: YTN; PAM sequence: TTA
atatttttatggtataatat

SEQ ID NO: 267404 - DNA, 20 bp, Artificial Sequence
  Description of Artificial Sequence: Synthetic oligonucleotide
  Target: ATXN1; (+) strand; PAM type: YTN; PAM sequence: TTT
ttatggtataatatgattct

SEQ ID NO: 267405 - DNA, 20 bp, Artificial Sequence
  Description of Artificial Sequence: Synthetic oligonucleotide
  Target: ATXN1; (+) strand; PAM type: YTN; PAM sequence: TTT
tatggtataatatgattctt

SEQ ID NO: 267406 - DNA, 20 bp, Artificial Sequence
  Description of Artificial Sequence: Synthetic oligonucleotide
  Target: ATXN1; (+) strand; PAM type: YTN; PAM sequence: TTT
atggtataatatgattcttt

SEQ ID NO: 267407 - DNA, 20 bp, Artificial Sequence
  Description of Artificial Sequence: Synthetic oligonucleotide
  Target: ATXN1; (+) strand; PAM type: YTN; PAM sequence: TTA
tggtataatatgattctttt

SEQ ID NO: 267408 - DNA, 20 bp, Artificial Sequence
  Description of Artificial Sequence: Synthetic oligonucleotide
  Target: ATXN1; (+) strand; PAM type: YTN; PAM sequence: TTC
ttttacaaaagtgaaaaatt

SEQ ID NO: 267409 - DNA, 20 bp, Artificial Sequence
  Description of Artificial Sequence: Synthetic oligonucleotide
  Target: ATXN1; (+) strand; PAM type: YTN; PAM sequence: CTT
ttacaaaagtgaaaaattta

SEQ ID NO: 267410 - DNA, 20 bp, Artificial Sequence
  Description of Artificial Sequence: Synthetic oligonucleotide
  Target: ATXN1; (+) strand; PAM type: YTN; PAM sequence: TTT
tacaaaagtgaaaaatttag

SEQ ID NO: 267411 - DNA, 20 bp, Artificial Sequence
  Description of Artificial Sequence: Synthetic oligonucleotide
  Target: ATXN1; (+) strand; PAM type: YTN; PAM sequence: TTT
acaaaagtgaaaaatttaga

SEQ ID NO: 267412 - DNA, 20 bp, Artificial Sequence
  Description of Artificial Sequence: Synthetic oligonucleotide
  Target: ATXN1; (+) strand; PAM type: YTN; PAM sequence: TTA
caaaagtgaaaaatttagat

SEQ ID NO: 267413 - DNA, 20 bp, Artificial Sequence
  Description of Artificial Sequence: Synthetic oligonucleotide
  Target: ATXN1; (+) strand; PAM type: YTN; PAM sequence: TTT
agataattaaaaaatgaagt

SEQ ID NO: 267414 - DNA, 20 bp, Artificial Sequence
  Description of Artificial Sequence: Synthetic oligonucleotide
  Target: ATXN1; (+) strand; PAM type: YTN; PAM sequence: TTA
gataattaaaaaatgaagtt

SEQ ID NO: 267415 - DNA, 20 bp, Artificial Sequence
  Description of Artificial Sequence: Synthetic oligonucleotide
  Target: ATXN1; (+) strand; PAM type: YTN; PAM sequence: TTA
aaaaatgaagttacctttct

SEQ ID NO: 267416 - DNA, 20 bp, Artificial Sequence
  Description of Artificial Sequence: Synthetic oligonucleotide
  Target: ATXN1; (+) strand; PAM type: YTN; PAM sequence: TTA
cctttctatttgtctgttta

SEQ ID NO: 267417 - DNA, 20 bp, Artificial Sequence
  Description of Artificial Sequence: Synthetic oligonucleotide
  Target: ATXN1; (+) strand; PAM type: YTN; PAM sequence: CTT
tctatttgtctgtttacatt

SEQ ID NO: 267418 - DNA, 20 bp, Artificial Sequence
  Description of Artificial Sequence: Synthetic oligonucleotide
  Target: ATXN1; (+) strand; PAM type: YTN; PAM sequence: TTT
ctatttgtctgtttacatta

SEQ ID NO: 267419 - DNA, 20 bp, Artificial Sequence
  Description of Artificial Sequence: Synthetic oligonucleotide
  Target: ATXN1; (+) strand; PAM type: YTN; PAM sequence: TTC
tatttgtctgtttacattag

SEQ ID NO: 267420 - DNA, 20 bp, Artificial Sequence
  Description of Artificial Sequence: Synthetic oligonucleotide
  Target: ATXN1; (+) strand; PAM type: YTN; PAM sequence: CTA
tttgtctgtttacattagtc

SEQ ID NO: 267421 - DNA, 20 bp, Artificial Sequence
  Description of Artificial Sequence: Synthetic oligonucleotide
  Target: ATXN1; (+) strand; PAM type: YTN; PAM sequence: TTT
gtctgtttacattagtccta

SEQ ID NO: 267422 - DNA, 20 bp, Artificial Sequence
  Description of Artificial Sequence: Synthetic oligonucleotide
  Target: ATXN1; (+) strand; PAM type: YTN; PAM sequence: TTG
tctgtttacattagtcctaa

SEQ ID NO: 267423 - DNA, 20 bp, Artificial Sequence
  Description of Artificial Sequence: Synthetic oligonucleotide
  Target: ATXN1; (+) strand; PAM type: YTN; PAM sequence: CTG
tttacattagtcctaaggag

SEQ ID NO: 267424 - DNA, 20 bp, Artificial Sequence
  Description of Artificial Sequence: Synthetic oligonucleotide
  Target: ATXN1; (+) strand; PAM type: YTN; PAM sequence: TTT
acattagtcctaaggagtaa

SEQ ID NO: 267425 - DNA, 20 bp, Artificial Sequence
  Description of Artificial Sequence: Synthetic oligonucleotide
  Target: ATXN1; (+) strand; PAM type: YTN; PAM sequence: TTA
cattagtcctaaggagtaat

SEQ ID NO: 267426 - DNA, 20 bp, Artificial Sequence
  Description of Artificial Sequence: Synthetic oligonucleotide
  Target: ATXN1; (+) strand; PAM type: YTN; PAM sequence: TTA
gtcctaaggagtaatttatg

SEQ ID NO: 267427 - DNA, 20 bp, Artificial Sequence
  Description of Artificial Sequence: Synthetic oligonucleotide
  Target: ATXN1; (+) strand; PAM type: YTN; PAM sequence: CTA
aggagtaatttatgtgttgt

SEQ ID NO: 267428 - DNA, 20 bp, Artificial Sequence
  Description of Artificial Sequence: Synthetic oligonucleotide
  Target: ATXN1; (+) strand; PAM type: YTN; PAM sequence: TTT
atgtgttgttaagaaccaat

SEQ ID NO: 267429 - DNA, 20 bp, Artificial Sequence
  Description of Artificial Sequence: Synthetic oligonucleotide
  Target: ATXN1; (+) strand; PAM type: YTN; PAM sequence: TTA
tgtgttgttaagaaccaata

SEQ ID NO: 267430 - DNA, 20 bp, Artificial Sequence
  Description of Artificial Sequence: Synthetic oligonucleotide
  Target: ATXN1; (+) strand; PAM type: YTN; PAM sequence: TTG
ttaagaaccaatagattttg

SEQ ID NO: 267431 - DNA, 20 bp, Artificial Sequence
  Description of Artificial Sequence: Synthetic oligonucleotide
  Target: ATXN1; (+) strand; PAM type: YTN; PAM sequence: TTA
agaaccaatagattttgttt

SEQ ID NO: 267432 - DNA, 20 bp, Artificial Sequence
  Description of Artificial Sequence: Synthetic oligonucleotide
  Target: ATXN1; (+) strand; PAM type: YTN; PAM sequence: TTT
tgtttgggttctatgactaa

SEQ ID NO: 267433 - DNA, 20 bp, Artificial Sequence
  Description of Artificial Sequence: Synthetic oligonucleotide
  Target: ATXN1; (+) strand; PAM type: YTN; PAM sequence: TTT
gtttgggttctatgactaaa

SEQ ID NO: 267434 - DNA, 20 bp, Artificial Sequence
  Description of Artificial Sequence: Synthetic oligonucleotide
  Target: ATXN1; (+) strand; PAM type: YTN; PAM sequence: TTG
tttgggttctatgactaaac

SEQ ID NO: 267435 - DNA, 20 bp, Artificial Sequence
  Description of Artificial Sequence: Synthetic oligonucleotide
  Target: ATXN1; (+) strand; PAM type: YTN; PAM sequence: TTT
gggttctatgactaaacaat

SEQ ID NO: 267436 - DNA, 20 bp, Artificial Sequence
  Description of Artificial Sequence: Synthetic oligonucleotide
  Target: ATXN1; (+) strand; PAM type: YTN; PAM sequence: TTG
ggttctatgactaaacaatg

SEQ ID NO: 267437 - DNA, 20 bp, Artificial Sequence
  Description of Artificial Sequence: Synthetic oligonucleotide
  Target: ATXN1; (+) strand; PAM type: YTN; PAM sequence: TTC
tatgactaaacaatgtcaac

SEQ ID NO: 267438 - DNA, 20 bp, Artificial Sequence
  Description of Artificial Sequence: Synthetic oligonucleotide
  Target: ATXN1; (+) strand; PAM type: YTN; PAM sequence: CTA
tgactaaacaatgtcaacta

SEQ ID NO: 267439 - DNA, 20 bp, Artificial Sequence
  Description of Artificial Sequence: Synthetic oligonucleotide
  Target: ATXN1; (+) strand; PAM type: YTN; PAM sequence: CTA
aacaatgtcaactagttctt

SEQ ID NO: 267440 - DNA, 20 bp, Artificial Sequence
  Description of Artificial Sequence: Synthetic oligonucleotide
  Target: ATXN1; (+) strand; PAM type: YTN; PAM sequence: CTA
gttcttatcactattcagtc

SEQ ID NO: 267441 - DNA, 20 bp, Artificial Sequence
  Description of Artificial Sequence: Synthetic oligonucleotide
  Target: ATXN1; (+) strand; PAM type: YTN; PAM sequence: TTC
ttatcactattcagtcatcc

SEQ ID NO: 267442 - DNA, 20 bp, Artificial Sequence
  Description of Artificial Sequence: Synthetic oligonucleotide
  Target: ATXN1; (+) strand; PAM type: YTN; PAM sequence: CTT
atcactattcagtcatccct

SEQ ID NO: 267443 - DNA, 20 bp, Artificial Sequence
  Description of Artificial Sequence: Synthetic oligonucleotide
  Target: ATXN1; (+) strand; PAM type: YTN; PAM sequence: TTA
tcactattcagtcatccctg

SEQ ID NO: 267444 - DNA, 20 bp, Artificial Sequence
  Description of Artificial Sequence: Synthetic oligonucleotide
  Target: ATXN1; (+) strand; PAM type: YTN; PAM sequence: CTA
ttcagtcatccctgcccttc

SEQ ID NO: 267445 - DNA, 20 bp, Artificial Sequence
  Description of Artificial Sequence: Synthetic oligonucleotide
  Target: ATXN1; (+) strand; PAM type: YTN; PAM sequence: TTC
agtcatccctgcccttcttt

SEQ ID NO: 267446 - DNA, 20 bp, Artificial Sequence
  Description of Artificial Sequence: Synthetic oligonucleotide
  Target: ATXN1; (+) strand; PAM type: YTN; PAM sequence: CTG
cccttctttattgtggattc

SEQ ID NO: 267447 - DNA, 20 bp, Artificial Sequence
  Description of Artificial Sequence: Synthetic oligonucleotide
  Target: ATXN1; (+) strand; PAM type: YTN; PAM sequence: CTT
ctttattgtggattcttgaa

SEQ ID NO: 267448 - DNA, 20 bp, Artificial Sequence
  Description of Artificial Sequence: Synthetic oligonucleotide
  Target: ATXN1; (+) strand; PAM type: YTN; PAM sequence: TTC
tttattgtggattcttgaac

SEQ ID NO: 267449 - DNA, 20 bp, Artificial Sequence
  Description of Artificial Sequence: Synthetic oligonucleotide
  Target: ATXN1; (+) strand; PAM type: YTN; PAM sequence: CTT
tattgtggattcttgaacat

SEQ ID NO: 267450 - DNA, 20 bp, Artificial Sequence
  Description of Artificial Sequence: Synthetic oligonucleotide
  Target: ATXN1; (+) strand; PAM type: YTN; PAM sequence: TTT
attgtggattcttgaacatt

SEQ ID NO: 267451 - DNA, 20 bp, Artificial Sequence
  Description of Artificial Sequence: Synthetic oligonucleotide
  Target: ATXN1; (+) strand; PAM type: YTN; PAM sequence: TTA
ttgtggattcttgaacattg

SEQ ID NO: 267452 - DNA, 20 bp, Artificial Sequence
  Description of Artificial Sequence: Synthetic oligonucleotide
  Target: ATXN1; (+) strand; PAM type: YTN; PAM sequence: TTG
tggattcttgaacattgagc

SEQ ID NO: 267453 - DNA, 20 bp, Artificial Sequence
  Description of Artificial Sequence: Synthetic oligonucleotide
  Target: ATXN1; (+) strand; PAM type: YTN; PAM sequence: TTC
ttgaacattgagcacttcga

SEQ ID NO: 267454 - DNA, 20 bp, Artificial Sequence
  Description of Artificial Sequence: Synthetic oligonucleotide
  Target: ATXN1; (+) strand; PAM type: YTN; PAM sequence: CTT
gaacattgagcacttcgaat

SEQ ID NO: 267455 - DNA, 20 bp, Artificial Sequence
  Description of Artificial Sequence: Synthetic oligonucleotide
  Target: ATXN1; (+) strand; PAM type: YTN; PAM sequence: TTG
aacattgagcacttcgaatt

SEQ ID NO: 267456 - DNA, 20 bp, Artificial Sequence
  Description of Artificial Sequence: Synthetic oligonucleotide
  Target: ATXN1; (+) strand; PAM type: YTN; PAM sequence: TTG
agcacttcgaatttatacca

SEQ ID NO: 267457 - DNA, 20 bp, Artificial Sequence
  Description of Artificial Sequence: Synthetic oligonucleotide
  Target: ATXN1; (+) strand; PAM type: YTN; PAM sequence: CTT
cgaatttataccacctaaaa

SEQ ID NO: 267458 - DNA, 20 bp, Artificial Sequence
  Description of Artificial Sequence: Synthetic oligonucleotide
  Target: ATXN1; (+) strand; PAM type: YTN; PAM sequence: TTC
gaatttataccacctaaaaa

SEQ ID NO: 267459 - DNA, 20 bp, Artificial Sequence
  Description of Artificial Sequence: Synthetic oligonucleotide
  Target: ATXN1; (+) strand; PAM type: YTN; PAM sequence: TTT
ataccacctaaaaaatacat

SEQ ID NO: 267460 - DNA, 20 bp, Artificial Sequence
  Description of Artificial Sequence: Synthetic oligonucleotide
  Target: ATXN1; (+) strand; PAM type: YTN; PAM sequence: TTA
taccacctaaaaaatacatc

SEQ ID NO: 267461 - DNA, 20 bp, Artificial Sequence
  Description of Artificial Sequence: Synthetic oligonucleotide
  Target: ATXN1; (+) strand; PAM type: YTN; PAM sequence: CTA
aaaaatacatctttagtttt

SEQ ID NO: 267462 - DNA, 20 bp, Artificial Sequence
  Description of Artificial Sequence: Synthetic oligonucleotide
  Target: ATXN1; (+) strand; PAM type: YTN; PAM sequence: CTT
tagttttgtttgggtttttc

SEQ ID NO: 267463 - DNA, 20 bp, Artificial Sequence
  Description of Artificial Sequence: Synthetic oligonucleotide
  Target: ATXN1; (+) strand; PAM type: YTN; PAM sequence: TTT
agttttgtttgggtttttct

SEQ ID NO: 267464 - DNA, 20 bp, Artificial Sequence
  Description of Artificial Sequence: Synthetic oligonucleotide
  Target: ATXN1; (+) strand; PAM type: YTN; PAM sequence: TTA
gttttgtttgggtttttctg

SEQ ID NO: 267465 - DNA, 20 bp, Artificial Sequence
  Description of Artificial Sequence: Synthetic oligonucleotide
  Target: ATXN1; (+) strand; PAM type: YTN; PAM sequence: TTT
tgtttgggtttttctgtaca

SEQ ID NO: 267466 - DNA, 20 bp, Artificial Sequence
  Description of Artificial Sequence: Synthetic oligonucleotide
  Target: ATXN1; (+) strand; PAM type: YTN; PAM sequence: TTT
gtttgggtttttctgtacaa

SEQ ID NO: 267467 - DNA, 20 bp, Artificial Sequence
  Description of Artificial Sequence: Synthetic oligonucleotide
  Target: ATXN1; (+) strand; PAM type: YTN; PAM sequence: TTG
tttgggtttttctgtacaaa

SEQ ID NO: 267468 - DNA, 20 bp, Artificial Sequence
  Description of Artificial Sequence: Synthetic oligonucleotide
  Target: ATXN1; (+) strand; PAM type: YTN; PAM sequence: TTT
gggtttttctgtacaaagtt

SEQ ID NO: 267469 - DNA, 20 bp, Artificial Sequence
  Description of Artificial Sequence: Synthetic oligonucleotide
  Target: ATXN1; (+) strand; PAM type: YTN; PAM sequence: TTG
ggtttttctgtacaaagttc

SEQ ID NO: 267470 - DNA, 20 bp, Artificial Sequence
  Description of Artificial Sequence: Synthetic oligonucleotide
  Target: ATXN1; (+) strand; PAM type: YTN; PAM sequence: TTT
ttctgtacaaagttcagttg

SEQ ID NO: 267471 - DNA, 20 bp, Artificial Sequence
  Description of Artificial Sequence: Synthetic oligonucleotide
  Target: ATXN1; (+) strand; PAM type: YTN; PAM sequence: TTT
tctgtacaaagttcagttgg

SEQ ID NO: 267472 - DNA, 20 bp, Artificial Sequence
  Description of Artificial Sequence: Synthetic oligonucleotide
  Target: ATXN1; (+) strand; PAM type: YTN; PAM sequence: TTT
ctgtacaaagttcagttgga

SEQ ID NO: 267473 - DNA, 20 bp, Artificial Sequence
  Description of Artificial Sequence: Synthetic oligonucleotide
  Target: ATXN1; (+) strand; PAM type: YTN; PAM sequence: TTC
tgtacaaagttcagttggaa

SEQ ID NO: 267474 - DNA, 20 bp, Artificial Sequence
  Description of Artificial Sequence: Synthetic oligonucleotide
  Target: ATXN1; (+) strand; PAM type: YTN; PAM sequence: CTG
tacaaagttcagttggaaac

SEQ ID NO: 267475 - DNA, 20 bp, Artificial Sequence
  Description of Artificial Sequence: Synthetic oligonucleotide
  Target: ATXN1; (+) strand; PAM type: YTN; PAM sequence: TTC
agttggaaacactgccctta

SEQ ID NO: 267476 - DNA, 20 bp, Artificial Sequence
  Description of Artificial Sequence: Synthetic oligonucleotide
  Target: ATXN1; (+) strand; PAM type: YTN; PAM sequence: TTG
gaaacactgcccttactaat

SEQ ID NO: 267477 - DNA, 20 bp, Artificial Sequence
  Description of Artificial Sequence: Synthetic oligonucleotide
  Target: ATXN1; (+) strand; PAM type: YTN; PAM sequence: CTG
cccttactaatgctgggagg

SEQ ID NO: 267478 - DNA, 20 bp, Artificial Sequence
  Description of Artificial Sequence: Synthetic oligonucleotide
  Target: ATXN1; (+) strand; PAM type: YTN; PAM sequence: CTT
actaatgctgggaggcatca

SEQ ID NO: 267479 - DNA, 20 bp, Artificial Sequence
  Description of Artificial Sequence: Synthetic oligonucleotide
  Target: ATXN1; (+) strand; PAM type: YTN; PAM sequence: TTA
ctaatgctgggaggcatcat

SEQ ID NO: 267480 - DNA, 20 bp, Artificial Sequence
  Description of Artificial Sequence: Synthetic oligonucleotide
  Target: ATXN1; (+) strand; PAM type: YTN; PAM sequence: CTA
atgctgggaggcatcattct

SEQ ID NO: 267481 - DNA, 20 bp, Artificial Sequence
  Description of Artificial Sequence: Synthetic oligonucleotide
  Target: ATXN1; (+) strand; PAM type: YTN; PAM sequence: CTG
ggaggcatcattctttaggc

SEQ ID NO: 267482 - DNA, 20 bp, Artificial Sequence
  Description of Artificial Sequence: Synthetic oligonucleotide
  Target: ATXN1; (+) strand; PAM type: YTN; PAM sequence: TTC
tttaggcatcccaagttctt

SEQ ID NO: 267483 - DNA, 20 bp, Artificial Sequence
  Description of Artificial Sequence: Synthetic oligonucleotide
  Target: ATXN1; (+) strand; PAM type: YTN; PAM sequence: CTT
taggcatcccaagttcttgc

SEQ ID NO: 267484 - DNA, 20 bp, Artificial Sequence
  Description of Artificial Sequence: Synthetic oligonucleotide
  Target: ATXN1; (+) strand; PAM type: YTN; PAM sequence: TTT
aggcatcccaagttcttgct

SEQ ID NO: 267485 - DNA, 20 bp, Artificial Sequence
  Description of Artificial Sequence: Synthetic oligonucleotide
  Target: ATXN1; (+) strand; PAM type: YTN; PAM sequence: TTA
ggcatcccaagttcttgctt

SEQ ID NO: 267486 - DNA, 20 bp, Artificial Sequence
  Description of Artificial Sequence: Synthetic oligonucleotide
  Target: ATXN1; (+) strand; PAM type: YTN; PAM sequence: TTC
ttgcttcaacttttacatat

SEQ ID NO: 267487 - DNA, 20 bp, Artificial Sequence
  Description of Artificial Sequence: Synthetic oligonucleotide
  Target: ATXN1; (+) strand; PAM type: YTN; PAM sequence: CTT
gcttcaacttttacatataa

SEQ ID NO: 267488 - DNA, 20 bp, Artificial Sequence
  Description of Artificial Sequence: Synthetic oligonucleotide
  Target: ATXN1; (+) strand; PAM type: YTN; PAM sequence: TTG
cttcaacttttacatataaa

SEQ ID NO: 267489 - DNA, 20 bp, Artificial Sequence
  Description of Artificial Sequence: Synthetic oligonucleotide
  Target: ATXN1; (+) strand; PAM type: YTN; PAM sequence: CTT
caacttttacatataaagat

SEQ ID NO: 267490 - DNA, 20 bp, Artificial Sequence
  Description of Artificial Sequence: Synthetic oligonucleotide
  Target: ATXN1; (+) strand; PAM type: YTN; PAM sequence: TTC
aacttttacatataaagatc

SEQ ID NO: 267491 - DNA, 20 bp, Artificial Sequence
  Description of Artificial Sequence: Synthetic oligonucleotide
  Target: ATXN1; (+) strand; PAM type: YTN; PAM sequence: CTT
ttacatataaagatccaaaa

SEQ ID NO: 267492 - DNA, 20 bp, Artificial Sequence
  Description of Artificial Sequence: Synthetic oligonucleotide
  Target: ATXN1; (+) strand; PAM type: YTN; PAM sequence: TTT
tacatataaagatccaaaat

SEQ ID NO: 267493 - DNA, 20 bp, Artificial Sequence
  Description of Artificial Sequence: Synthetic oligonucleotide
  Target: ATXN1; (+) strand; PAM type: YTN; PAM sequence: TTT
acatataaagatccaaaatg

SEQ ID NO: 267494 - DNA, 20 bp, Artificial Sequence
  Description of Artificial Sequence: Synthetic oligonucleotide
  Target: ATXN1; (+) strand; PAM type: YTN; PAM sequence: TTA
catataaagatccaaaatgt

SEQ ID NO: 267495 - DNA, 20 bp, Artificial Sequence
  Description of Artificial Sequence: Synthetic oligonucleotide
  Target: ATXN1; (+) strand; PAM type: YTN; PAM sequence: CTG
atgcctataatcccagcatt

SEQ ID NO: 267496 - DNA, 20 bp, Artificial Sequence
  Description of Artificial Sequence: Synthetic oligonucleotide
  Target: ATXN1; (+) strand; PAM type: YTN; PAM sequence: CTA
taatcccagcattttgggaa

SEQ ID NO: 267497 - DNA, 20 bp, Artificial Sequence
  Description of Artificial Sequence: Synthetic oligonucleotide
  Target: ATXN1; (+) strand; PAM type: YTN; PAM sequence: TTT
tgggaagccgaggtgggcag

SEQ ID NO: 267498 - DNA, 20 bp, Artificial Sequence
  Description of Artificial Sequence: Synthetic oligonucleotide
  Target: ATXN1; (+) strand; PAM type: YTN; PAM sequence: TTT
gggaagccgaggtgggcaga

SEQ ID NO: 267499 - DNA, 20 bp, Artificial Sequence
  Description of Artificial Sequence: Synthetic oligonucleotide
  Target: ATXN1; (+) strand; PAM type: YTN; PAM sequence: TTG
ggaagccgaggtgggcagat

SEQ ID NO: 267500 - DNA, 20 bp, Artificial Sequence
  Description of Artificial Sequence: Synthetic oligonucleotide
  Target: ATXN1; (+) strand; PAM type: YTN; PAM sequence: CTT
gagctcaagagtttgagatc

SEQ ID NO: 267501 - DNA, 20 bp, Artificial Sequence
  Description of Artificial Sequence: Synthetic oligonucleotide
  Target: ATXN1; (+) strand; PAM type: YTN; PAM sequence: TTG
agctcaagagtttgagatca

SEQ ID NO: 267502 - DNA, 20 bp, Artificial Sequence
  Description of Artificial Sequence: Synthetic oligonucleotide
  Target: ATXN1; (+) strand; PAM type: YTN; PAM sequence: CTC
aagagtttgagatcagcctg

SEQ ID NO: 267503 - DNA, 20 bp, Artificial Sequence
  Description of Artificial Sequence: Synthetic oligonucleotide
  Target: ATXN1; (+) strand; PAM type: YTN; PAM sequence: TTT
gagatcagcctggccaacat

SEQ ID NO: 267504 - DNA, 20 bp, Artificial Sequence
  Description of Artificial Sequence: Synthetic oligonucleotide
  Target: ATXN1; (+) strand; PAM type: YTN; PAM sequence: TTG
agatcagcctggccaacatg

SEQ ID NO: 267505 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccttg

SEQ ID NO: 267506 - DNA, 20 bp, Artificial Sequence
  Description of Artificial Sequence: Synthetic oligonucleotide
  Target: ATXN1; (+) strand; PAM type: YTN; PAM sequence: CTT
gtctctacaaaaaatacaaa

SEQ ID NO: 267507 - DNA, 20 bp, Artificial Sequence
  Description of Artificial Sequence: Synthetic oligonucleotide
  Target: ATXN1; (+) strand; PAM type: YTN; PAM sequence: TTG
tctctacaaaaaatacaaaa

SEQ ID NO: 267508 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaatacaaaaatta

SEQ ID NO: 267509 - DNA, 20 bp, Artificial Sequence
  Description of Artificial Sequence: Synthetic oligonucleotide
  Target: ATXN1; (+) strand; PAM type: YTN; PAM sequence: CTA
caaaaaatacaaaaattagc

SEQ ID NO: 267510 - DNA, 20 bp, Artificial Sequence
  Description of Artificial Sequence: Synthetic oligonucleotide
  Target: ATXN1; (+) strand; PAM type: YTN; PAM sequence: TTA
gccgggcattgtgaggcaca

SEQ ID NO: 267511 - DNA, 20 bp, Artificial Sequence
  Description of Artificial Sequence: Synthetic oligonucleotide
  Target: ATXN1; (+) strand; PAM type: YTN; PAM sequence: TTG
tgaggcacacctgtaatccc

SEQ ID NO: 267512 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 267513 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 267514 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 267515 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 267516 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 267517 - DNA, 20 bp, Artificial Sequence
  Description of Artificial Sequence: Synthetic oligonucleotide
  Target: ATXN1; (+) strand; PAM type: YTN; PAM sequence: CTT
gaacccagaaggtggaggtt

SEQ ID NO: 267518 - DNA, 20 bp, Artificial Sequence
  Description of Artificial Sequence: Synthetic oligonucleotide
  Target: ATXN1; (+) strand; PAM type: YTN; PAM sequence: TTG
aacccagaaggtggaggttg

SEQ ID NO: 267519 - DNA, 20 bp, Artificial Sequence
  Description of Artificial Sequence: Synthetic oligonucleotide
  Target: ATXN1; (+) strand; PAM type: YTN; PAM sequence: TTG
cagtgagttaagatcgtgcc

SEQ ID NO: 267520 - DNA, 20 bp, Artificial Sequence
  Description of Artificial Sequence: Synthetic oligonucleotide
  Target: ATXN1; (+) strand; PAM type: YTN; PAM sequence: TTA
agatcgtgccactgccctcc

SEQ ID NO: 267521 - DNA, 20 bp, Artificial Sequence
  Description of Artificial Sequence: Synthetic oligonucleotide
  Target: ATXN1; (+) strand; PAM type: YTN; PAM sequence: CTG
ccctccagcctgggcaacac

SEQ ID NO: 267522 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacacagcaa

SEQ ID NO: 267523 - DNA, 20 bp, Artificial Sequence
  Description of Artificial Sequence: Synthetic oligonucleotide
  Target: ATXN1; (+) strand; PAM type: YTN; PAM sequence: CTG
ggcaacacagcaagagactt

SEQ ID NO: 267524 - DNA, 20 bp, Artificial Sequence
  Description of Artificial Sequence: Synthetic oligonucleotide
  Target: ATXN1; (+) strand; PAM type: YTN; PAM sequence: CTT
catctgcaaaaaaaaaaaaa

SEQ ID NO: 267525 - DNA, 20 bp, Artificial Sequence
  Description of Artificial Sequence: Synthetic oligonucleotide
  Target: ATXN1; (+) strand; PAM type: YTN; PAM sequence: TTC
atctgcaaaaaaaaaaaaaa

SEQ ID NO: 267526 - DNA, 20 bp, Artificial Sequence
  Description of Artificial Sequence: Synthetic oligonucleotide
  Target: ATXN1; (+) strand; PAM type: YTN; PAM sequence: CTG
caaaaaaaaaaaaaaaaaaa

SEQ ID NO: 267527 - DNA, 20 bp, Artificial Sequence
  Description of Artificial Sequence: Synthetic oligonucleotide
  Target: ATXN1; (+) strand; PAM type: YTN; PAM sequence: CTA
aaatgatcctgaagaaaatg

SEQ ID NO: 267528 - DNA, 20 bp, Artificial Sequence
  Description of Artificial Sequence: Synthetic oligonucleotide
  Target: ATXN1; (+) strand; PAM type: YTN; PAM sequence: CTG
aagaaaatggtggcctggtg

SEQ ID NO: 267529 - DNA, 20 bp, Artificial Sequence
  Description of Artificial Sequence: Synthetic oligonucleotide
  Target: ATXN1; (+) strand; PAM type: YTN; PAM sequence: CTG
gtggccatgtgctacaaatc

SEQ ID NO: 267530 - DNA, 20 bp, Artificial Sequence
  Description of Artificial Sequence: Synthetic oligonucleotide
  Target: ATXN1; (+) strand; PAM type: YTN; PAM sequence: CTA
caaatcctcatgctatgttt

SEQ ID NO: 267531 - DNA, 20 bp, Artificial Sequence
  Description of Artificial Sequence: Synthetic oligonucleotide
  Target: ATXN1; (+) strand; PAM type: YTN; PAM sequence: CTC
atgctatgtttttgtcagtg

SEQ ID NO: 267532 - DNA, 20 bp, Artificial Sequence
  Description of Artificial Sequence: Synthetic oligonucleotide
  Target: ATXN1; (+) strand; PAM type: YTN; PAM sequence: CTA
tgtttttgtcagtgttcaaa

SEQ ID NO: 267533 - DNA, 20 bp, Artificial Sequence
  Description of Artificial Sequence: Synthetic oligonucleotide
  Target: ATXN1; (+) strand; PAM type: YTN; PAM sequence: TTT
ttgtcagtgttcaaaccaaa

SEQ ID NO: 267534 - DNA, 20 bp, Artificial Sequence
  Description of Artificial Sequence: Synthetic oligonucleotide
  Target: ATXN1; (+) strand; PAM type: YTN; PAM sequence: TTT
tgtcagtgttcaaaccaaac

SEQ ID NO: 267535 - DNA, 20 bp, Artificial Sequence
  Description of Artificial Sequence: Synthetic oligonucleotide
  Target: ATXN1; (+) strand; PAM type: YTN; PAM sequence: TTT
gtcagtgttcaaaccaaaca

SEQ ID NO: 267536 - DNA, 20 bp, Artificial Sequence
  Description of Artificial Sequence: Synthetic oligonucleotide
  Target: ATXN1; (+) strand; PAM type: YTN; PAM sequence: TTG
tcagtgttcaaaccaaacaa

SEQ ID NO: 267537 - DNA, 20 bp, Artificial Sequence
  Description of Artificial Sequence: Synthetic oligonucleotide
  Target: ATXN1; (+) strand; PAM type: YTN; PAM sequence: TTC
aaaccaaacaatttctgatg

SEQ ID NO: 267538 - DNA, 20 bp, Artificial Sequence
  Description of Artificial Sequence: Synthetic oligonucleotide
  Target: ATXN1; (+) strand; PAM type: YTN; PAM sequence: TTT
ctgatggaaggaaagctctg

SEQ ID NO: 267539 - DNA, 20 bp, Artificial Sequence
  Description of Artificial Sequence: Synthetic oligonucleotide
  Target: ATXN1; (+) strand; PAM type: YTN; PAM sequence: TTC
tgatggaaggaaagctctgg

SEQ ID NO: 267540 - DNA, 20 bp, Artificial Sequence
  Description of Artificial Sequence: Synthetic oligonucleotide
  Target: ATXN1; (+) strand; PAM type: YTN; PAM sequence: CTG
atggaaggaaagctctggct

SEQ ID NO: 267541 - DNA, 20 bp, Artificial Sequence
  Description of Artificial Sequence: Synthetic oligonucleotide
  Target: ATXN1; (+) strand; PAM type: YTN; PAM sequence: CTC
tggctctgagctctcacatg

SEQ ID NO: 267542 - DNA, 20 bp, Artificial Sequence
  Description of Artificial Sequence: Synthetic oligonucleotide
  Target: ATXN1; (+) strand; PAM type: YTN; PAM sequence: CTG
gctctgagctctcacatgcc

SEQ ID NO: 267543 - DNA, 20 bp, Artificial Sequence
  Description of Artificial Sequence: Synthetic oligonucleotide
  Target: ATXN1; (+) strand; PAM type: YTN; PAM sequence: CTC
tgagctctcacatgcccaga

SEQ ID NO: 267544 - DNA, 20 bp, Artificial Sequence
  Description of Artificial Sequence: Synthetic oligonucleotide
  Target: ATXN1; (+) strand; PAM type: YTN; PAM sequence: CTG
agctctcacatgcccagaca

SEQ ID NO: 267545 - DNA, 20 bp, Artificial Sequence
  Description of Artificial Sequence: Synthetic oligonucleotide
  Target: ATXN1; (+) strand; PAM type: YTN; PAM sequence: CTC
tcacatgcccagacacagaa

SEQ ID NO: 267546 - DNA, 20 bp, Artificial Sequence
  Description of Artificial Sequence: Synthetic oligonucleotide
  Target: ATXN1; (+) strand; PAM type: YTN; PAM sequence: CTC
acatgcccagacacagaagt

SEQ ID NO: 267547 - DNA, 20 bp, Artificial Sequence
  Description of Artificial Sequence: Synthetic oligonucleotide
  Target: ATXN1; (+) strand; PAM type: YTN; PAM sequence: CTA
ttcctagtctcttctcaaag

SEQ ID NO: 267548 - DNA, 20 bp, Artificial Sequence
  Description of Artificial Sequence: Synthetic oligonucleotide
  Target: ATXN1; (+) strand; PAM type: YTN; PAM sequence: TTC
ctagtctcttctcaaagcat

SEQ ID NO: 267549 - DNA, 20 bp, Artificial Sequence
  Description of Artificial Sequence: Synthetic oligonucleotide
  Target: ATXN1; (+) strand; PAM type: YTN; PAM sequence: CTA
gtctcttctcaaagcatcct

SEQ ID NO: 267550 - DNA, 20 bp, Artificial Sequence
  Description of Artificial Sequence: Synthetic oligonucleotide
  Target: ATXN1; (+) strand; PAM type: YTN; PAM sequence: CTC
ttctcaaagcatcctttgtc

SEQ ID NO: 267551 - DNA, 20 bp, Artificial Sequence
  Description of Artificial Sequence: Synthetic oligonucleotide
  Target: ATXN1; (+) strand; PAM type: YTN; PAM sequence: CTT
ctcaaagcatcctttgtctt

SEQ ID NO: 267552 - DNA, 20 bp, Artificial Sequence
  Description of Artificial Sequence: Synthetic oligonucleotide
  Target: ATXN1; (+) strand; PAM type: YTN; PAM sequence: TTC
tcaaagcatcctttgtcttc

SEQ ID NO: 267553 - DNA, 20 bp, Artificial Sequence
  Description of Artificial Sequence: Synthetic oligonucleotide
  Target: ATXN1; (+) strand; PAM type: YTN; PAM sequence: CTC
aaagcatcctttgtcttctc

SEQ ID NO: 267554 - DNA, 20 bp, Artificial Sequence
  Description of Artificial Sequence: Synthetic oligonucleotide
  Target: ATXN1; (+) strand; PAM type: YTN; PAM sequence: CTT
tgtcttctctaaatacacat

SEQ ID NO: 267555 - DNA, 20 bp, Artificial Sequence
  Description of Artificial Sequence: Synthetic oligonucleotide
  Target: ATXN1; (+) strand; PAM type: YTN; PAM sequence: TTT
gtcttctctaaatacacata

SEQ ID NO: 267556 - DNA, 20 bp, Artificial Sequence
  Description of Artificial Sequence: Synthetic oligonucleotide
  Target: ATXN1; (+) strand; PAM type: YTN; PAM sequence: TTG
tcttctctaaatacacatat

SEQ ID NO: 267557 - DNA, 20 bp, Artificial Sequence
  Description of Artificial Sequence: Synthetic oligonucleotide
  Target: ATXN1; (+) strand; PAM type: YTN; PAM sequence: CTT
ctctaaatacacatatatat

SEQ ID NO: 267558 - DNA, 20 bp, Artificial Sequence
  Description of Artificial Sequence: Synthetic oligonucleotide
  Target: ATXN1; (+) strand; PAM type: YTN; PAM sequence: TTC
tctaaatacacatatatatt

SEQ ID NO: 267559 - DNA, 20 bp, Artificial Sequence
  Description of Artificial Sequence: Synthetic oligonucleotide
  Target: ATXN1; (+) strand; PAM type: YTN; PAM sequence: CTC
taaatacacatatatattgg

SEQ ID NO: 267560 - DNA, 20 bp, Artificial Sequence
  Description of Artificial Sequence: Synthetic oligonucleotide
  Target: ATXN1; (+) strand; PAM type: YTN; PAM sequence: CTA
aatacacatatatattgggt

SEQ ID NO: 267561 - DNA, 20 bp, Artificial Sequence
  Description of Artificial Sequence: Synthetic oligonucleotide
  Target: ATXN1; (+) strand; PAM type: YTN; PAM sequence: TTG
ggttgaaattccacctctgc

SEQ ID NO: 267562 - DNA, 20 bp, Artificial Sequence
  Description of Artificial Sequence: Synthetic oligonucleotide
  Target: ATXN1; (+) strand; PAM type: YTN; PAM sequence: TTG
aaattccacctctgcttgaa

SEQ ID NO: 267563 - DNA, 20 bp, Artificial Sequence
  Description of Artificial Sequence: Synthetic oligonucleotide
  Target: ATXN1; (+) strand; PAM type: YTN; PAM sequence: TTC
cacctctgcttgaaggctca

SEQ ID NO: 267564 - DNA, 20 bp, Artificial Sequence
  Description of Artificial Sequence: Synthetic oligonucleotide
  Target: ATXN1; (+) strand; PAM type: YTN; PAM sequence: CTC
tgcttgaaggctcaatttag

SEQ ID NO: 267565 - DNA, 20 bp, Artificial Sequence
  Description of Artificial Sequence: Synthetic oligonucleotide
  Target: ATXN1; (+) strand; PAM type: YTN; PAM sequence: CTG
cttgaaggctcaatttagat

SEQ ID NO: 267566 - DNA, 20 bp, Artificial Sequence
  Description of Artificial Sequence: Synthetic oligonucleotide
  Target: ATXN1; (+) strand; PAM type: YTN; PAM sequence: CTT
gaaggctcaatttagatgtc

SEQ ID NO: 267567 - DNA, 20 bp, Artificial Sequence
  Description of Artificial Sequence: Synthetic oligonucleotide
  Target: ATXN1; (+) strand; PAM type: YTN; PAM sequence: TTG
aaggctcaatttagatgtct

SEQ ID NO: 267568 - DNA, 20 bp, Artificial Sequence
  Description of Artificial Sequence: Synthetic oligonucleotide
  Target: ATXN1; (+) strand; PAM type: YTN; PAM sequence: CTC
aatttagatgtcttccctga

SEQ ID NO: 267569 - DNA, 20 bp, Artificial Sequence
  Description of Artificial Sequence: Synthetic oligonucleotide
  Target: ATXN1; (+) strand; PAM type: YTN; PAM sequence: TTT
agatgtcttccctgaaattc

SEQ ID NO: 267570 - DNA, 20 bp, Artificial Sequence
  Description of Artificial Sequence: Synthetic oligonucleotide
  Target: ATXN1; (+) strand; PAM type: YTN; PAM sequence: TTA
gatgtcttccctgaaattcc

SEQ ID NO: 267571 - DNA, 20 bp, Artificial Sequence
  Description of Artificial Sequence: Synthetic oligonucleotide
  Target: ATXN1; (+) strand; PAM type: YTN; PAM sequence: CTT
ccctgaaattccagcgctga

SEQ ID NO: 267572 - DNA, 20 bp, Artificial Sequence
  Description of Artificial Sequence: Synthetic oligonucleotide
  Target: ATXN1; (+) strand; PAM type: YTN; PAM sequence: TTC
cctgaaattccagcgctgac

SEQ ID NO: 267573 - DNA, 20 bp, Artificial Sequence
  Description of Artificial Sequence: Synthetic oligonucleotide
  Target: ATXN1; (+) strand; PAM type: YTN; PAM sequence: CTG
aaattccagcgctgacaact

SEQ ID NO: 267574 - DNA, 20 bp, Artificial Sequence
  Description of Artificial Sequence: Synthetic oligonucleotide
  Target: ATXN1; (+) strand; PAM type: YTN; PAM sequence: TTC
cagcgctgacaactcttacc

SEQ ID NO: 267575 - DNA, 20 bp, Artificial Sequence
  Description of Artificial Sequence: Synthetic oligonucleotide
  Target: ATXN1; (+) strand; PAM type: YTN; PAM sequence: CTG
acaactcttacccatcgtcc

SEQ ID NO: 267576 - DNA, 20 bp, Artificial Sequence
  Description of Artificial Sequence: Synthetic oligonucleotide
  Target: ATXN1; (+) strand; PAM type: YTN; PAM sequence: CTC
ttacccatcgtccctttcgg

SEQ ID NO: 267577 - DNA, 20 bp, Artificial Sequence
  Description of Artificial Sequence: Synthetic oligonucleotide
  Target: ATXN1; (+) strand; PAM type: YTN; PAM sequence: CTT
acccatcgtccctttcggta

SEQ ID NO: 267578 - DNA, 20 bp, Artificial Sequence
  Description of Artificial Sequence: Synthetic oligonucleotide
  Target: ATXN1; (+) strand; PAM type: YTN; PAM sequence: TTA
cccatcgtccctttcggtac

SEQ ID NO: 267579 - DNA, 20 bp, Artificial Sequence
  Description of Artificial Sequence: Synthetic oligonucleotide
  Target: ATXN1; (+) strand; PAM type: YTN; PAM sequence: CTT
tcggtacacctgactccgcc

SEQ ID NO: 267580 - DNA, 20 bp, Artificial Sequence
  Description of Artificial Sequence: Synthetic oligonucleotide
  Target: ATXN1; (+) strand; PAM type: YTN; PAM sequence: TTT
cggtacacctgactccgcca

SEQ ID NO: 267581 - DNA, 20 bp, Artificial Sequence
  Description of Artificial Sequence: Synthetic oligonucleotide
  Target: ATXN1; (+) strand; PAM type: YTN; PAM sequence: TTC
ggtacacctgactccgccac

SEQ ID NO: 267582 - DNA, 20 bp, Artificial Sequence
  Description of Artificial Sequence: Synthetic oligonucleotide
  Target: ATXN1; (+) strand; PAM type: YTN; PAM sequence: CTG
actccgccaccaagtacatc

SEQ ID NO: 267583 - DNA, 20 bp, Artificial Sequence
  Description of Artificial Sequence: Synthetic oligonucleotide
  Target: ATXN1; (+) strand; PAM type: YTN; PAM sequence: CTC
cgccaccaagtacatccttc

SEQ ID NO: 267584 - DNA, 20 bp, Artificial Sequence
  Description of Artificial Sequence: Synthetic oligonucleotide
  Target: ATXN1; (+) strand; PAM type: YTN; PAM sequence: CTT
cccatagcaccttcctagag

SEQ ID NO: 267585 - DNA, 20 bp, Artificial Sequence
  Description of Artificial Sequence: Synthetic oligonucleotide
  Target: ATXN1; (+) strand; PAM type: YTN; PAM sequence: TTC
ccatagcaccttcctagagt

SEQ ID NO: 267586 - DNA, 20 bp, Artificial Sequence
  Description of Artificial Sequence: Synthetic oligonucleotide
  Target: ATXN1; (+) strand; PAM type: YTN; PAM sequence: CTT
cctagagtctcaaagggcag

SEQ ID NO: 267587 - DNA, 20 bp, Artificial Sequence
  Description of Artificial Sequence: Synthetic oligonucleotide
  Target: ATXN1; (+) strand; PAM type: YTN; PAM sequence: TTC
ctagagtctcaaagggcagt

SEQ ID NO: 267588 - DNA, 20 bp, Artificial Sequence
  Description of Artificial Sequence: Synthetic oligonucleotide
  Target: ATXN1; (+) strand; PAM type: YTN; PAM sequence: CTA
gagtctcaaagggcagtaag

SEQ ID NO: 267589 - DNA, 20 bp, Artificial Sequence
  Description of Artificial Sequence: Synthetic oligonucleotide
  Target: ATXN1; (+) strand; PAM type: YTN; PAM sequence: CTC
aaagggcagtaagtacagat

SEQ ID NO: 267590 - DNA, 20 bp, Artificial Sequence
  Description of Artificial Sequence: Synthetic oligonucleotide
  Target: ATXN1; (+) strand; PAM type: YTN; PAM sequence: TTA
ctcagccctggatccctgat

SEQ ID NO: 267591 - DNA, 20 bp, Artificial Sequence
  Description of Artificial Sequence: Synthetic oligonucleotide
  Target: ATXN1; (+) strand; PAM type: YTN; PAM sequence: CTC
agccctggatccctgataga

SEQ ID NO: 267592 - DNA, 20 bp, Artificial Sequence
  Description of Artificial Sequence: Synthetic oligonucleotide
  Target: ATXN1; (+) strand; PAM type: YTN; PAM sequence: CTG
gatccctgatagactcaaga

SEQ ID NO: 267593 - DNA, 20 bp, Artificial Sequence
  Description of Artificial Sequence: Synthetic oligonucleotide
  Target: ATXN1; (+) strand; PAM type: YTN; PAM sequence: CTG
atagactcaagaacatcctg

SEQ ID NO: 267594 - DNA, 20 bp, Artificial Sequence
  Description of Artificial Sequence: Synthetic oligonucleotide
  Target: ATXN1; (+) strand; PAM type: YTN; PAM sequence: CTC
aagaacatcctggcacacaa

SEQ ID NO: 267595 - DNA, 20 bp, Artificial Sequence
  Description of Artificial Sequence: Synthetic oligonucleotide
  Target: ATXN1; (+) strand; PAM type: YTN; PAM sequence: CTG
gcacacaacactcttttaat

SEQ ID NO: 267596 - DNA, 20 bp, Artificial Sequence
  Description of Artificial Sequence: Synthetic oligonucleotide
  Target: ATXN1; (+) strand; PAM type: YTN; PAM sequence: CTC
ttttaataaatatcatgtaa

SEQ ID NO: 267597 - DNA, 20 bp, Artificial Sequence
  Description of Artificial Sequence: Synthetic oligonucleotide
  Target: ATXN1; (+) strand; PAM type: YTN; PAM sequence: CTT
ttaataaatatcatgtaatt

SEQ ID NO: 267598 - DNA, 20 bp, Artificial Sequence
  Description of Artificial Sequence: Synthetic oligonucleotide
  Target: ATXN1; (+) strand; PAM type: YTN; PAM sequence: TTT
taataaatatcatgtaattg

SEQ ID NO: 267599 - DNA, 20 bp, Artificial Sequence
  Description of Artificial Sequence: Synthetic oligonucleotide
  Target: ATXN1; (+) strand; PAM type: YTN; PAM sequence: TTT
aataaatatcatgtaattga

SEQ ID NO: 267600 - DNA, 20 bp, Artificial Sequence
  Description of Artificial Sequence: Synthetic oligonucleotide
  Target: ATXN1; (+) strand; PAM type: YTN; PAM sequence: TTA
ataaatatcatgtaattgag

SEQ ID NO: 267601 - DNA, 20 bp, Artificial Sequence
  Description of Artificial Sequence: Synthetic oligonucleotide
  Target: ATXN1; (+) strand; PAM type: YTN; PAM sequence: TTG
agtgaactctaaacttaaag

SEQ ID NO: 267602 - DNA, 20 bp, Artificial Sequence
  Description of Artificial Sequence: Synthetic oligonucleotide
  Target: ATXN1; (+) strand; PAM type: YTN; PAM sequence: CTC
taaacttaaagaggacacaa

SEQ ID NO: 267603 - DNA, 20 bp, Artificial Sequence
  Description of Artificial Sequence: Synthetic oligonucleotide
  Target: ATXN1; (+) strand; PAM type: YTN; PAM sequence: CTA
aacttaaagaggacacaaaa

SEQ ID NO: 267604 - DNA, 20 bp, Artificial Sequence
  Description of Artificial Sequence: Synthetic oligonucleotide
  Target: ATXN1; (+) strand; PAM type: YTN; PAM sequence: CTT
aaagaggacacaaaagcatt

SEQ ID NO: 267605 - DNA, 20 bp, Artificial Sequence
  Description of Artificial Sequence: Synthetic oligonucleotide
  Target: ATXN1; (+) strand; PAM type: YTN; PAM sequence: TTA
aagaggacacaaaagcattt

SEQ ID NO: 267606 - DNA, 20 bp, Artificial Sequence
  Description of Artificial Sequence: Synthetic oligonucleotide
  Target: ATXN1; (+) strand; PAM type: YTN; PAM sequence: TTT
taccttggcactattcagtt

SEQ ID NO: 267607 - DNA, 20 bp, Artificial Sequence
  Description of Artificial Sequence: Synthetic oligonucleotide
  Target: ATXN1; (+) strand; PAM type: YTN; PAM sequence: TTT
accttggcactattcagtta

SEQ ID NO: 267608 - DNA, 20 bp, Artificial Sequence
  Description of Artificial Sequence: Synthetic oligonucleotide
  Target: ATXN1; (+) strand; PAM type: YTN; PAM sequence: TTA
ccttggcactattcagttac

SEQ ID NO: 267609 - DNA, 20 bp, Artificial Sequence
  Description of Artificial Sequence: Synthetic oligonucleotide
  Target: ATXN1; (+) strand; PAM type: YTN; PAM sequence: CTT
ggcactattcagttacaaag

SEQ ID NO: 267610 - DNA, 20 bp, Artificial Sequence
  Description of Artificial Sequence: Synthetic oligonucleotide
  Target: ATXN1; (+) strand; PAM type: YTN; PAM sequence: TTG
gcactattcagttacaaagc

SEQ ID NO: 267611 - DNA, 20 bp, Artificial Sequence
  Description of Artificial Sequence: Synthetic oligonucleotide
  Target: ATXN1; (+) strand; PAM type: YTN; PAM sequence: CTA
ttcagttacaaagcagcctg

SEQ ID NO: 267612 - DNA, 20 bp, Artificial Sequence
  Description of Artificial Sequence: Synthetic oligonucleotide
  Target: ATXN1; (+) strand; PAM type: YTN; PAM sequence: TTC
agttacaaagcagcctgacc

SEQ ID NO: 267613 - DNA, 20 bp, Artificial Sequence
  Description of Artificial Sequence: Synthetic oligonucleotide
  Target: ATXN1; (+) strand; PAM type: YTN; PAM sequence: TTA
caaagcagcctgaccaggct

SEQ ID NO: 267614 - DNA, 20 bp, Artificial Sequence
  Description of Artificial Sequence: Synthetic oligonucleotide
  Target: ATXN1; (+) strand; PAM type: YTN; PAM sequence: CTG
accaggctgttgatgttgtt

SEQ ID NO: 267615 - DNA, 20 bp, Artificial Sequence
  Description of Artificial Sequence: Synthetic oligonucleotide
  Target: ATXN1; (+) strand; PAM type: YTN; PAM sequence: CTG
ttgatgttgtttcaccccat

SEQ ID NO: 267616 - DNA, 20 bp, Artificial Sequence
  Description of Artificial Sequence: Synthetic oligonucleotide
  Target: ATXN1; (+) strand; PAM type: YTN; PAM sequence: TTG
atgttgtttcaccccataga

SEQ ID NO: 267617 - DNA, 20 bp, Artificial Sequence
  Description of Artificial Sequence: Synthetic oligonucleotide
  Target: ATXN1; (+) strand; PAM type: YTN; PAM sequence: TTG
tttcaccccatagaacacaa

SEQ ID NO: 267618 - DNA, 20 bp, Artificial Sequence
  Description of Artificial Sequence: Synthetic oligonucleotide
  Target: ATXN1; (+) strand; PAM type: YTN; PAM sequence: TTT
caccccatagaacacaaatg

SEQ ID NO: 267619 - DNA, 20 bp, Artificial Sequence
  Description of Artificial Sequence: Synthetic oligonucleotide
  Target: ATXN1; (+) strand; PAM type: YTN; PAM sequence: TTC
accccatagaacacaaatgt

SEQ ID NO: 267620 - DNA, 20 bp, Artificial Sequence
  Description of Artificial Sequence: Synthetic oligonucleotide
  Target: ATXN1; (+) strand; PAM type: YTN; PAM sequence: TTG
taaaagatccatgaactttt

SEQ ID NO: 267621 - DNA, 20 bp, Artificial Sequence
  Description of Artificial Sequence: Synthetic oligonucleotide
  Target: ATXN1; (+) strand; PAM type: YTN; PAM sequence: CTT
ttttccttccacaacgtctg

SEQ ID NO: 267622 - DNA, 20 bp, Artificial Sequence
  Description of Artificial Sequence: Synthetic oligonucleotide
  Target: ATXN1; (+) strand; PAM type: YTN; PAM sequence: TTT
tttccttccacaacgtctgg

SEQ ID NO: 267623 - DNA, 20 bp, Artificial Sequence
  Description of Artificial Sequence: Synthetic oligonucleotide
  Target: ATXN1; (+) strand; PAM type: YTN; PAM sequence: TTT
ttccttccacaacgtctggg

SEQ ID NO: 267624 - DNA, 20 bp, Artificial Sequence
  Description of Artificial Sequence: Synthetic oligonucleotide
  Target: ATXN1; (+) strand; PAM type: YTN; PAM sequence: TTT
tccttccacaacgtctgggt

SEQ ID NO: 267625 - DNA, 20 bp, Artificial Sequence
  Description of Artificial Sequence: Synthetic oligonucleotide
  Target: ATXN1; (+) strand; PAM type: YTN; PAM sequence: TTT
ccttccacaacgtctgggtg

SEQ ID NO: 267626 - DNA, 20 bp, Artificial Sequence
  Description of Artificial Sequence: Synthetic oligonucleotide
  Target: ATXN1; (+) strand; PAM type: YTN; PAM sequence: TTC
cttccacaacgtctgggtgt

SEQ ID NO: 267627 - DNA, 20 bp, Artificial Sequence
  Description of Artificial Sequence: Synthetic oligonucleotide
  Target: ATXN1; (+) strand; PAM type: YTN; PAM sequence: CTT
ccacaacgtctgggtgttct

SEQ ID NO: 267628 - DNA, 20 bp, Artificial Sequence
  Description of Artificial Sequence: Synthetic oligonucleotide
  Target: ATXN1; (+) strand; PAM type: YTN; PAM sequence: TTC
cacaacgtctgggtgttctt

SEQ ID NO: 267629 - DNA, 20 bp, Artificial Sequence
  Description of Artificial Sequence: Synthetic oligonucleotide
  Target: ATXN1; (+) strand; PAM type: YTN; PAM sequence: CTG
ggtgttctttgcattttcct

SEQ ID NO: 267630 - DNA, 20 bp, Artificial Sequence
  Description of Artificial Sequence: Synthetic oligonucleotide
  Target: ATXN1; (+) strand; PAM type: YTN; PAM sequence: TTC
tttgcattttcctcctcctc

SEQ ID NO: 267631 - DNA, 20 bp, Artificial Sequence
  Description of Artificial Sequence: Synthetic oligonucleotide
  Target: ATXN1; (+) strand; PAM type: YTN; PAM sequence: CTT
tgcattttcctcctcctctc

SEQ ID NO: 267632 - DNA, 20 bp, Artificial Sequence
  Description of Artificial Sequence: Synthetic oligonucleotide
  Target: ATXN1; (+) strand; PAM type: YTN; PAM sequence: TTT
gcattttcctcctcctctcc

SEQ ID NO: 267633 - DNA, 20 bp, Artificial Sequence
  Description of Artificial Sequence: Synthetic oligonucleotide
  Target: ATXN1; (+) strand; PAM type: YTN; PAM sequence: TTG
cattttcctcctcctctcca

SEQ ID NO: 267634 - DNA, 20 bp, Artificial Sequence
  Description of Artificial Sequence: Synthetic oligonucleotide
  Target: ATXN1; (+) strand; PAM type: YTN; PAM sequence: TTT
tcctcctcctctccaagatg

SEQ ID NO: 267635 - DNA, 20 bp, Artificial Sequence
  Description of Artificial Sequence: Synthetic oligonucleotide
  Target: ATXN1; (+) strand; PAM type: YTN; PAM sequence: TTT
cctcctcctctccaagatgc

SEQ ID NO: 267636 - DNA, 20 bp, Artificial Sequence
  Description of Artificial Sequence: Synthetic oligonucleotide
  Target: ATXN1; (+) strand; PAM type: YTN; PAM sequence: TTC
ctcctcctctccaagatgct

SEQ ID NO: 267637 - DNA, 20 bp, Artificial Sequence
  Description of Artificial Sequence: Synthetic oligonucleotide
  Target: ATXN1; (+) strand; PAM type: YTN; PAM sequence: CTC
ctcctctccaagatgctgag

SEQ ID NO: 267638 - DNA, 20 bp, Artificial Sequence
  Description of Artificial Sequence: Synthetic oligonucleotide
  Target: ATXN1; (+) strand; PAM type: YTN; PAM sequence: CTC
ctctccaagatgctgagagg

SEQ ID NO: 267639 - DNA, 20 bp, Artificial Sequence
  Description of Artificial Sequence: Synthetic oligonucleotide
  Target: ATXN1; (+) strand; PAM type: YTN; PAM sequence: CTC
tccaagatgctgagaggagg

SEQ ID NO: 267640 - DNA, 20 bp, Artificial Sequence
  Description of Artificial Sequence: Synthetic oligonucleotide
  Target: ATXN1; (+) strand; PAM type: YTN; PAM sequence: CTC
caagatgctgagaggaggag

SEQ ID NO: 267641 - DNA, 20 bp, Artificial Sequence
  Description of Artificial Sequence: Synthetic oligonucleotide
  Target: ATXN1; (+) strand; PAM type: YTN; PAM sequence: CTG
agaggaggagctgagtactt

SEQ ID NO: 267642 - DNA, 20 bp, Artificial Sequence
  Description of Artificial Sequence: Synthetic oligonucleotide
  Target: ATXN1; (+) strand; PAM type: YTN; PAM sequence: CTG
agtacttgaggaagaaggtg

SEQ ID NO: 267643 - DNA, 20 bp, Artificial Sequence
  Description of Artificial Sequence: Synthetic oligonucleotide
  Target: ATXN1; (+) strand; PAM type: YTN; PAM sequence: CTT
gaggaagaaggtgctgaggg

SEQ ID NO: 267644 - DNA, 20 bp, Artificial Sequence
  Description of Artificial Sequence: Synthetic oligonucleotide
  Target: ATXN1; (+) strand; PAM type: YTN; PAM sequence: TTG
aggaagaaggtgctgagggg

SEQ ID NO: 267645 - DNA, 20 bp, Artificial Sequence
  Description of Artificial Sequence: Synthetic oligonucleotide
  Target: ATXN1; (+) strand; PAM type: YTN; PAM sequence: CTG
aggggaaagggtgtgcctgg

SEQ ID NO: 267646 - DNA, 20 bp, Artificial Sequence
  Description of Artificial Sequence: Synthetic oligonucleotide
  Target: ATXN1; (+) strand; PAM type: YTN; PAM sequence: CTG
ggatgggctacgctttgtca

SEQ ID NO: 267647 - DNA, 20 bp, Artificial Sequence
  Description of Artificial Sequence: Synthetic oligonucleotide
  Target: ATXN1; (+) strand; PAM type: YTN; PAM sequence: CTA
cgctttgtcagttgcctcag

SEQ ID NO: 267648 - DNA, 20 bp, Artificial Sequence
  Description of Artificial Sequence: Synthetic oligonucleotide
  Target: ATXN1; (+) strand; PAM type: YTN; PAM sequence: CTT
tgtcagttgcctcaggaggt

SEQ ID NO: 267649 - DNA, 20 bp, Artificial Sequence
  Description of Artificial Sequence: Synthetic oligonucleotide
  Target: ATXN1; (+) strand; PAM type: YTN; PAM sequence: TTT
gtcagttgcctcaggaggta

SEQ ID NO: 267650 - DNA, 20 bp, Artificial Sequence
  Description of Artificial Sequence: Synthetic oligonucleotide
  Target: ATXN1; (+) strand; PAM type: YTN; PAM sequence: TTG
tcagttgcctcaggaggtag

SEQ ID NO: 267651 - DNA, 20 bp, Artificial Sequence
  Description of Artificial Sequence: Synthetic oligonucleotide
  Target: ATXN1; (+) strand; PAM type: YTN; PAM sequence: TTG
cctcaggaggtagctctgac

SEQ ID NO: 267652 - DNA, 20 bp, Artificial Sequence
  Description of Artificial Sequence: Synthetic oligonucleotide
  Target: ATXN1; (+) strand; PAM type: YTN; PAM sequence: CTC
aggaggtagctctgacacca

SEQ ID NO: 267653 - DNA, 20 bp, Artificial Sequence
  Description of Artificial Sequence: Synthetic oligonucleotide
  Target: ATXN1; (+) strand; PAM type: YTN; PAM sequence: CTC
tgacaccacttcttagaagc

SEQ ID NO: 267654 - DNA, 20 bp, Artificial Sequence
  Description of Artificial Sequence: Synthetic oligonucleotide
  Target: ATXN1; (+) strand; PAM type: YTN; PAM sequence: CTG
acaccacttcttagaagcag

SEQ ID NO: 267655 - DNA, 20 bp, Artificial Sequence
  Description of Artificial Sequence: Synthetic oligonucleotide
  Target: ATXN1; (+) strand; PAM type: YTN; PAM sequence: CTT
cttagaagcagtgactcctg

SEQ ID NO: 267656 - DNA, 20 bp, Artificial Sequence
  Description of Artificial Sequence: Synthetic oligonucleotide
  Target: ATXN1; (+) strand; PAM type: YTN; PAM sequence: TTC
ttagaagcagtgactcctgc

SEQ ID NO: 267657 - DNA, 20 bp, Artificial Sequence
  Description of Artificial Sequence: Synthetic oligonucleotide
  Target: ATXN1; (+) strand; PAM type: YTN; PAM sequence: CTT
agaagcagtgactcctgcaa

SEQ ID NO: 267658 - DNA, 20 bp, Artificial Sequence
  Description of Artificial Sequence: Synthetic oligonucleotide
  Target: ATXN1; (+) strand; PAM type: YTN; PAM sequence: TTA
gaagcagtgactcctgcaaa

SEQ ID NO: 267659 - DNA, 20 bp, Artificial Sequence
  Description of Artificial Sequence: Synthetic oligonucleotide
  Target: ATXN1; (+) strand; PAM type: YTN; PAM sequence: CTC
ctgcaaagaccctgccaaag

SEQ ID NO: 267660 - DNA, 20 bp, Artificial Sequence
  Description of Artificial Sequence: Synthetic oligonucleotide
  Target: ATXN1; (+) strand; PAM type: YTN; PAM sequence: CTG
caaagaccctgccaaaggtg

SEQ ID NO: 267661 - DNA, 20 bp, Artificial Sequence
  Description of Artificial Sequence: Synthetic oligonucleotide
  Target: ATXN1; (+) strand; PAM type: YTN; PAM sequence: CTG
ccaaaggtgcccatcccaaa

SEQ ID NO: 267662 - DNA, 20 bp, Artificial Sequence
  Description of Artificial Sequence: Synthetic oligonucleotide
  Target: ATXN1; (+) strand; PAM type: YTN; PAM sequence: CTA
gtgaagctgtcaatcagaag

SEQ ID NO: 267663 - DNA, 20 bp, Artificial Sequence
  Description of Artificial Sequence: Synthetic oligonucleotide
  Target: ATXN1; (+) strand; PAM type: YTN; PAM sequence: CTG
tcaatcagaagccattcaag

SEQ ID NO: 267664 - DNA, 20 bp, Artificial Sequence
  Description of Artificial Sequence: Synthetic oligonucleotide
  Target: ATXN1; (+) strand; PAM type: YTN; PAM sequence: TTC
aaggaagtctgaggaagaga

SEQ ID NO: 267665 - DNA, 20 bp, Artificial Sequence
  Description of Artificial Sequence: Synthetic oligonucleotide
  Target: ATXN1; (+) strand; PAM type: YTN; PAM sequence: CTG
aggaagagagagaaatgggt

SEQ ID NO: 267666 - DNA, 20 bp, Artificial Sequence
  Description of Artificial Sequence: Synthetic oligonucleotide
  Target: ATXN1; (+) strand; PAM type: YTN; PAM sequence: CTC
tagaagacttgaagctatcc

SEQ ID NO: 267667 - DNA, 20 bp, Artificial Sequence
  Description of Artificial Sequence: Synthetic oligonucleotide
  Target: ATXN1; (+) strand; PAM type: YTN; PAM sequence: CTA
gaagacttgaagctatcccc

SEQ ID NO: 267668 - DNA, 20 bp, Artificial Sequence
  Description of Artificial Sequence: Synthetic oligonucleotide
  Target: ATXN1; (+) strand; PAM type: YTN; PAM sequence: CTT
gaagctatccccagtgcact

SEQ ID NO: 267669 - DNA, 20 bp, Artificial Sequence
  Description of Artificial Sequence: Synthetic oligonucleotide
  Target: ATXN1; (+) strand; PAM type: YTN; PAM sequence: TTG
aagctatccccagtgcactt

SEQ ID NO: 267670 - DNA, 20 bp, Artificial Sequence
  Description of Artificial Sequence: Synthetic oligonucleotide
  Target: ATXN1; (+) strand; PAM type: YTN; PAM sequence: CTA
tccccagtgcacttggatgg

SEQ ID NO: 267671 - DNA, 20 bp, Artificial Sequence
  Description of Artificial Sequence: Synthetic oligonucleotide
  Target: ATXN1; (+) strand; PAM type: YTN; PAM sequence: CTT
ggatggaatgagctcagtca

SEQ ID NO: 267672 - DNA, 20 bp, Artificial Sequence
  Description of Artificial Sequence: Synthetic oligonucleotide
  Target: ATXN1; (+) strand; PAM type: YTN; PAM sequence: TTG
gatggaatgagctcagtcat

SEQ ID NO: 267673 - DNA, 20 bp, Artificial Sequence
  Description of Artificial Sequence: Synthetic oligonucleotide
  Target: ATXN1; (+) strand; PAM type: YTN; PAM sequence: CTC
agtcataacctctctgcctt

SEQ ID NO: 267674 - DNA, 20 bp, Artificial Sequence
  Description of Artificial Sequence: Synthetic oligonucleotide
  Target: ATXN1; (+) strand; PAM type: YTN; PAM sequence: CTC
tctgcctttacaatctgtag

SEQ ID NO: 267675 - DNA, 20 bp, Artificial Sequence
  Description of Artificial Sequence: Synthetic oligonucleotide
  Target: ATXN1; (+) strand; PAM type: YTN; PAM sequence: CTC
tgcctttacaatctgtaggt

SEQ ID NO: 267676 - DNA, 20 bp, Artificial Sequence
  Description of Artificial Sequence: Synthetic oligonucleotide
  Target: ATXN1; (+) strand; PAM type: YTN; PAM sequence: CTG
cctttacaatctgtaggtca

SEQ ID NO: 267677 - DNA, 20 bp, Artificial Sequence
  Description of Artificial Sequence: Synthetic oligonucleotide
  Target: ATXN1; (+) strand; PAM type: YTN; PAM sequence: CTT
tacaatctgtaggtcaatct

SEQ ID NO: 267678 - DNA, 20 bp, Artificial Sequence
  Description of Artificial Sequence: Synthetic oligonucleotide
  Target: ATXN1; (+) strand; PAM type: YTN; PAM sequence: TTT
acaatctgtaggtcaatctg

SEQ ID NO: 267679 - DNA, 20 bp, Artificial Sequence
  Description of Artificial Sequence: Synthetic oligonucleotide
  Target: ATXN1; (+) strand; PAM type: YTN; PAM sequence: TTA
caatctgtaggtcaatctgc

SEQ ID NO: 267680 - DNA, 20 bp, Artificial Sequence
  Description of Artificial Sequence: Synthetic oligonucleotide
  Target: ATXN1; (+) strand; PAM type: YTN; PAM sequence: CTG
taggtcaatctgcaggagca

SEQ ID NO: 267681 - DNA, 20 bp, Artificial Sequence
  Description of Artificial Sequence: Synthetic oligonucleotide
  Target: ATXN1; (+) strand; PAM type: YTN; PAM sequence: CTG
caggagcattacaagcaagg

SEQ ID NO: 267682 - DNA, 20 bp, Artificial Sequence
  Description of Artificial Sequence: Synthetic oligonucleotide
  Target: ATXN1; (+) strand; PAM type: YTN; PAM sequence: TTA
caagcaaggatttaagaaaa

SEQ ID NO: 267683 - DNA, 20 bp, Artificial Sequence
  Description of Artificial Sequence: Synthetic oligonucleotide
  Target: ATXN1; (+) strand; PAM type: YTN; PAM sequence: TTT
aagaaaaaggagattgttct

SEQ ID NO: 267684 - DNA, 20 bp, Artificial Sequence
  Description of Artificial Sequence: Synthetic oligonucleotide
  Target: ATXN1; (+) strand; PAM type: YTN; PAM sequence: TTA
agaaaaaggagattgttctc

SEQ ID NO: 267685 - DNA, 20 bp, Artificial Sequence
  Description of Artificial Sequence: Synthetic oligonucleotide
  Target: ATXN1; (+) strand; PAM type: YTN; PAM sequence: TTG
ttctccctcacttgtccaaa

SEQ ID NO: 267686 - DNA, 20 bp, Artificial Sequence
  Description of Artificial Sequence: Synthetic oligonucleotide
  Target: ATXN1; (+) strand; PAM type: YTN; PAM sequence: TTC
tccctcacttgtccaaaagt

SEQ ID NO: 267687 - DNA, 20 bp, Artificial Sequence
  Description of Artificial Sequence: Synthetic oligonucleotide
  Target: ATXN1; (+) strand; PAM type: YTN; PAM sequence: CTC
cctcacttgtccaaaagtgg

SEQ ID NO: 267688 - DNA, 20 bp, Artificial Sequence
  Description of Artificial Sequence: Synthetic oligonucleotide
  Target: ATXN1; (+) strand; PAM type: YTN; PAM sequence: CTC
acttgtccaaaagtggtgga

SEQ ID NO: 267689 - DNA, 20 bp, Artificial Sequence
  Description of Artificial Sequence: Synthetic oligonucleotide
  Target: ATXN1; (+) strand; PAM type: YTN; PAM sequence: CTT
gtccaaaagtggtggaatct

SEQ ID NO: 267690 - DNA, 20 bp, Artificial Sequence
  Description of Artificial Sequence: Synthetic oligonucleotide
  Target: ATXN1; (+) strand; PAM type: YTN; PAM sequence: TTG
tccaaaagtggtggaatctc

SEQ ID NO: 267691 - DNA, 20 bp, Artificial Sequence
  Description of Artificial Sequence: Synthetic oligonucleotide
  Target: ATXN1; (+) strand; PAM type: YTN; PAM sequence: CTC
cccttctctcctgaccctct

SEQ ID NO: 267692 - DNA, 20 bp, Artificial Sequence
  Description of Artificial Sequence: Synthetic oligonucleotide
  Target: ATXN1; (+) strand; PAM type: YTN; PAM sequence: CTT
ctctcctgaccctcttatct

SEQ ID NO: 267693 - DNA, 20 bp, Artificial Sequence
  Description of Artificial Sequence: Synthetic oligonucleotide
  Target: ATXN1; (+) strand; PAM type: YTN; PAM sequence: TTC
tctcctgaccctcttatcta

SEQ ID NO: 267694 - DNA, 20 bp, Artificial Sequence
  Description of Artificial Sequence: Synthetic oligonucleotide
  Target: ATXN1; (+) strand; PAM type: YTN; PAM sequence: CTC
tcctgaccctcttatctact

SEQ ID NO: 267695 - DNA, 20 bp, Artificial Sequence
  Description of Artificial Sequence: Synthetic oligonucleotide
  Target: ATXN1; (+) strand; PAM type: YTN; PAM sequence: CTC
ctgaccctcttatctacttc

SEQ ID NO: 267696 - DNA, 20 bp, Artificial Sequence
  Description of Artificial Sequence: Synthetic oligonucleotide
  Target: ATXN1; (+) strand; PAM type: YTN; PAM sequence: CTG
accctcttatctacttcaga

SEQ ID NO: 267697 - DNA, 20 bp, Artificial Sequence
  Description of Artificial Sequence: Synthetic oligonucleotide
  Target: ATXN1; (+) strand; PAM type: YTN; PAM sequence: CTC
ttatctacttcagatttttt

SEQ ID NO: 267698 - DNA, 20 bp, Artificial Sequence
  Description of Artificial Sequence: Synthetic oligonucleotide
  Target: ATXN1; (+) strand; PAM type: YTN; PAM sequence: CTT
atctacttcagatttttttt

SEQ ID NO: 267699 - DNA, 20 bp, Artificial Sequence
  Description of Artificial Sequence: Synthetic oligonucleotide
  Target: ATXN1; (+) strand; PAM type: YTN; PAM sequence: TTA
tctacttcagattttttttt

SEQ ID NO: 267700 - DNA, 20 bp, Artificial Sequence
  Description of Artificial Sequence: Synthetic oligonucleotide
  Target: ATXN1; (+) strand; PAM type: YTN; PAM sequence: CTA
cttcagattttttttttgta

SEQ ID NO: 267701 - DNA, 20 bp, Artificial Sequence
  Description of Artificial Sequence: Synthetic oligonucleotide
  Target: ATXN1; (+) strand; PAM type: YTN; PAM sequence: CTT
cagattttttttttgtaacg

SEQ ID NO: 267702 - DNA, 20 bp, Artificial Sequence
  Description of Artificial Sequence: Synthetic oligonucleotide
  Target: ATXN1; (+) strand; PAM type: YTN; PAM sequence: TTC
agattttttttttgtaacgc

SEQ ID NO: 267703 - DNA, 20 bp, Artificial Sequence
  Description of Artificial Sequence: Synthetic oligonucleotide
  Target: ATXN1; (+) strand; PAM type: YTN; PAM sequence: TTT
tttttttgtaacgctggaga

SEQ ID NO: 267704 - DNA, 20 bp, Artificial Sequence
  Description of Artificial Sequence: Synthetic oligonucleotide
  Target: ATXN1; (+) strand; PAM type: YTN; PAM sequence: TTT
ttttttgtaacgctggagaa

SEQ ID NO: 267705 - DNA, 20 bp, Artificial Sequence
  Description of Artificial Sequence: Synthetic oligonucleotide
  Target: ATXN1; (+) strand; PAM type: YTN; PAM sequence: TTT
tttttgtaacgctggagaat

SEQ ID NO: 267706 - DNA, 20 bp, Artificial Sequence
  Description of Artificial Sequence: Synthetic oligonucleotide
  Target: ATXN1; (+) strand; PAM type: YTN; PAM sequence: TTT
ttttgtaacgctggagaatt

SEQ ID NO: 267707 - DNA, 20 bp, Artificial Sequence
  Description of Artificial Sequence: Synthetic oligonucleotide
  Target: ATXN1; (+) strand; PAM type: YTN; PAM sequence: TTT
tttgtaacgctggagaattt

SEQ ID NO: 267708 - DNA, 20 bp, Artificial Sequence
  Description of Artificial Sequence: Synthetic oligonucleotide
  Target: ATXN1; (+) strand; PAM type: YTN; PAM sequence: TTT
ttgtaacgctggagaatttg

SEQ ID NO: 267709 - DNA, 20 bp, Artificial Sequence
  Description of Artificial Sequence: Synthetic oligonucleotide
  Target: ATXN1; (+) strand; PAM type: YTN; PAM sequence: TTT
tgtaacgctggagaatttgg

SEQ ID NO: 267710 - DNA, 20 bp, Artificial Sequence
  Description of Artificial Sequence: Synthetic oligonucleotide
  Target: ATXN1; (+) strand; PAM type: YTN; PAM sequence: TTT
gtaacgctggagaatttggt

SEQ ID NO: 267711 - DNA, 20 bp, Artificial Sequence
  Description of Artificial Sequence: Synthetic oligonucleotide
  Target: ATXN1; (+) strand; PAM type: YTN; PAM sequence: TTG
taacgctggagaatttggta

SEQ ID NO: 267712 - DNA, 20 bp, Artificial Sequence
  Description of Artificial Sequence: Synthetic oligonucleotide
  Target: ATXN1; (+) strand; PAM type: YTN; PAM sequence: CTG
gagaatttggtatcacagat

SEQ ID NO: 267713 - DNA, 20 bp, Artificial Sequence
  Description of Artificial Sequence: Synthetic oligonucleotide
  Target: ATXN1; (+) strand; PAM type: YTN; PAM sequence: TTT
ggtatcacagatggcaaatc

SEQ ID NO: 267714 - DNA, 20 bp, Artificial Sequence
  Description of Artificial Sequence: Synthetic oligonucleotide
  Target: ATXN1; (+) strand; PAM type: YTN; PAM sequence: TTG
gtatcacagatggcaaatct

SEQ ID NO: 267715 - DNA, 20 bp, Artificial Sequence
  Description of Artificial Sequence: Synthetic oligonucleotide
  Target: ATXN1; (+) strand; PAM type: YTN; PAM sequence: CTA
aaaggtacaaactgacagac

SEQ ID NO: 267716 - DNA, 20 bp, Artificial Sequence
  Description of Artificial Sequence: Synthetic oligonucleotide
  Target: ATXN1; (+) strand; PAM type: YTN; PAM sequence: CTG
acagacacagagggaaattc

SEQ ID NO: 267717 - DNA, 20 bp, Artificial Sequence
  Description of Artificial Sequence: Synthetic oligonucleotide
  Target: ATXN1; (+) strand; PAM type: YTN; PAM sequence: TTC
ccagattgctcttattagag

SEQ ID NO: 267718 - DNA, 20 bp, Artificial Sequence
  Description of Artificial Sequence: Synthetic oligonucleotide
  Target: ATXN1; (+) strand; PAM type: YTN; PAM sequence: TTG
ctcttattagagtgtgcgtg

SEQ ID NO: 267719 - DNA, 20 bp, Artificial Sequence
  Description of Artificial Sequence: Synthetic oligonucleotide
  Target: ATXN1; (+) strand; PAM type: YTN; PAM sequence: CTC
ttattagagtgtgcgtgtgt

SEQ ID NO: 267720 - DNA, 20 bp, Artificial Sequence
  Description of Artificial Sequence: Synthetic oligonucleotide
  Target: ATXN1; (+) strand; PAM type: YTN; PAM sequence: CTT
attagagtgtgcgtgtgtgt

SEQ ID NO: 267721 - DNA, 20 bp, Artificial Sequence
  Description of Artificial Sequence: Synthetic oligonucleotide
  Target: ATXN1; (+) strand; PAM type: YTN; PAM sequence: TTA
ttagagtgtgcgtgtgtgtg

SEQ ID NO: 267722 - DNA, 20 bp, Artificial Sequence
  Description of Artificial Sequence: Synthetic oligonucleotide
  Target: ATXN1; (+) strand; PAM type: YTN; PAM sequence: TTA
gagtgtgcgtgtgtgtgcaa

SEQ ID NO: 267723 - DNA, 20 bp, Artificial Sequence
  Description of Artificial Sequence: Synthetic oligonucleotide
  Target: ATXN1; (+) strand; PAM type: YTN; PAM sequence: TTC
tcttagtctggagattcaga

SEQ ID NO: 267724 - DNA, 20 bp, Artificial Sequence
  Description of Artificial Sequence: Synthetic oligonucleotide
  Target: ATXN1; (+) strand; PAM type: YTN; PAM sequence: CTC
ttagtctggagattcagagt

SEQ ID NO: 267725 - DNA, 20 bp, Artificial Sequence
  Description of Artificial Sequence: Synthetic oligonucleotide
  Target: ATXN1; (+) strand; PAM type: YTN; PAM sequence: CTT
agtctggagattcagagtaa

SEQ ID NO: 267726 - DNA, 20 bp, Artificial Sequence
  Description of Artificial Sequence: Synthetic oligonucleotide
  Target: ATXN1; (+) strand; PAM type: YTN; PAM sequence: TTA
gtctggagattcagagtaag

SEQ ID NO: 267727 - DNA, 20 bp, Artificial Sequence
  Description of Artificial Sequence: Synthetic oligonucleotide
  Target: ATXN1; (+) strand; PAM type: YTN; PAM sequence: CTG
gagattcagagtaagagaaa

SEQ ID NO: 267728 - DNA, 20 bp, Artificial Sequence
  Description of Artificial Sequence: Synthetic oligonucleotide
  Target: ATXN1; (+) strand; PAM type: YTN; PAM sequence: TTC
agagtaagagaaattcagct

SEQ ID NO: 267729 - DNA, 20 bp, Artificial Sequence
  Description of Artificial Sequence: Synthetic oligonucleotide
  Target: ATXN1; (+) strand; PAM type: YTN; PAM sequence: TTC
agctcccattttttaagact

SEQ ID NO: 267730 - DNA, 20 bp, Artificial Sequence
  Description of Artificial Sequence: Synthetic oligonucleotide
  Target: ATXN1; (+) strand; PAM type: YTN; PAM sequence: CTC
ccattttttaagacttacac

SEQ ID NO: 267731 - DNA, 20 bp, Artificial Sequence
  Description of Artificial Sequence: Synthetic oligonucleotide
  Target: ATXN1; (+) strand; PAM type: YTN; PAM sequence: TTT
tttaagacttacacagacag

SEQ ID NO: 267732 - DNA, 20 bp, Artificial Sequence
  Description of Artificial Sequence: Synthetic oligonucleotide
  Target: ATXN1; (+) strand; PAM type: YTN; PAM sequence: TTT
ttaagacttacacagacagc

SEQ ID NO: 267733 - DNA, 20 bp, Artificial Sequence
  Description of Artificial Sequence: Synthetic oligonucleotide
  Target: ATXN1; (+) strand; PAM type: YTN; PAM sequence: TTT
taagacttacacagacagca

SEQ ID NO: 267734 - DNA, 20 bp, Artificial Sequence
  Description of Artificial Sequence: Synthetic oligonucleotide
  Target: ATXN1; (+) strand; PAM type: YTN; PAM sequence: TTT
aagacttacacagacagcat

SEQ ID NO: 267735 - DNA, 20 bp, Artificial Sequence
  Description of Artificial Sequence: Synthetic oligonucleotide
  Target: ATXN1; (+) strand; PAM type: YTN; PAM sequence: TTA
agacttacacagacagcata

SEQ ID NO: 267736 - DNA, 20 bp, Artificial Sequence
  Description of Artificial Sequence: Synthetic oligonucleotide
  Target: ATXN1; (+) strand; PAM type: YTN; PAM sequence: CTT
acacagacagcataatgctg

SEQ ID NO: 267737 - DNA, 20 bp, Artificial Sequence
  Description of Artificial Sequence: Synthetic oligonucleotide
  Target: ATXN1; (+) strand; PAM type: YTN; PAM sequence: TTA
cacagacagcataatgctgt

SEQ ID NO: 267738 - DNA, 20 bp, Artificial Sequence
  Description of Artificial Sequence: Synthetic oligonucleotide
  Target: ATXN1; (+) strand; PAM type: YTN; PAM sequence: CTG
tttacacaggtacagaggta

SEQ ID NO: 267739 - DNA, 20 bp, Artificial Sequence
  Description of Artificial Sequence: Synthetic oligonucleotide
  Target: ATXN1; (+) strand; PAM type: YTN; PAM sequence: TTT
acacaggtacagaggtattt

SEQ ID NO: 267740 - DNA, 20 bp, Artificial Sequence
  Description of Artificial Sequence: Synthetic oligonucleotide
  Target: ATXN1; (+) strand; PAM type: YTN; PAM sequence: TTA
cacaggtacagaggtattta

SEQ ID NO: 267741 - DNA, 20 bp, Artificial Sequence
  Description of Artificial Sequence: Synthetic oligonucleotide
  Target: ATXN1; (+) strand; PAM type: YTN; PAM sequence: TTT
attttagtctctccatttct

SEQ ID NO: 267742 - DNA, 20 bp, Artificial Sequence
  Description of Artificial Sequence: Synthetic oligonucleotide
  Target: ATXN1; (+) strand; PAM type: YTN; PAM sequence: TTA
ttttagtctctccatttctt

SEQ ID NO: 267743 - DNA, 20 bp, Artificial Sequence
  Description of Artificial Sequence: Synthetic oligonucleotide
  Target: ATXN1; (+) strand; PAM type: YTN; PAM sequence: TTT
tagtctctccatttcttcct

SEQ ID NO: 267744 - DNA, 20 bp, Artificial Sequence
  Description of Artificial Sequence: Synthetic oligonucleotide
  Target: ATXN1; (+) strand; PAM type: YTN; PAM sequence: TTT
agtctctccatttcttccta

SEQ ID NO: 267745 - DNA, 20 bp, Artificial Sequence
  Description of Artificial Sequence: Synthetic oligonucleotide
  Target: ATXN1; (+) strand; PAM type: YTN; PAM sequence: TTA
gtctctccatttcttcctag

SEQ ID NO: 267746 - DNA, 20 bp, Artificial Sequence
  Description of Artificial Sequence: Synthetic oligonucleotide
  Target: ATXN1; (+) strand; PAM type: YTN; PAM sequence: CTC
tccatttcttcctaggaata

SEQ ID NO: 267747 - DNA, 20 bp, Artificial Sequence
  Description of Artificial Sequence: Synthetic oligonucleotide
  Target: ATXN1; (+) strand; PAM type: YTN; PAM sequence: CTC
catttcttcctaggaataaa

SEQ ID NO: 267748 - DNA, 20 bp, Artificial Sequence
  Description of Artificial Sequence: Synthetic oligonucleotide
  Target: ATXN1; (+) strand; PAM type: YTN; PAM sequence: TTT
cttcctaggaataaagtaat

SEQ ID NO: 267749 - DNA, 20 bp, Artificial Sequence
  Description of Artificial Sequence: Synthetic oligonucleotide
  Target: ATXN1; (+) strand; PAM type: YTN; PAM sequence: TTC
ttcctaggaataaagtaatg

SEQ ID NO: 267750 - DNA, 20 bp, Artificial Sequence
  Description of Artificial Sequence: Synthetic oligonucleotide
  Target: ATXN1; (+) strand; PAM type: YTN; PAM sequence: CTT
cctaggaataaagtaatgcc

SEQ ID NO: 267751 - DNA, 20 bp, Artificial Sequence
  Description of Artificial Sequence: Synthetic oligonucleotide
  Target: ATXN1; (+) strand; PAM type: YTN; PAM sequence: TTC
ctaggaataaagtaatgcct

SEQ ID NO: 267752 - DNA, 20 bp, Artificial Sequence
  Description of Artificial Sequence: Synthetic oligonucleotide
  Target: ATXN1; (+) strand; PAM type: YTN; PAM sequence: CTA
ggaataaagtaatgcctgca

SEQ ID NO: 267753 - DNA, 20 bp, Artificial Sequence
  Description of Artificial Sequence: Synthetic oligonucleotide
  Target: ATXN1; (+) strand; PAM type: YTN; PAM sequence: CTG
cactcagagcagttattctg

SEQ ID NO: 267754 - DNA, 20 bp, Artificial Sequence
  Description of Artificial Sequence: Synthetic oligonucleotide
  Target: ATXN1; (+) strand; PAM type: YTN; PAM sequence: CTC
agagcagttattctgaaaag

SEQ ID NO: 267755 - DNA, 20 bp, Artificial Sequence
  Description of Artificial Sequence: Synthetic oligonucleotide
  Target: ATXN1; (+) strand; PAM type: YTN; PAM sequence: TTA
ttctgaaaagggagtccata

SEQ ID NO: 267756 - DNA, 20 bp, Artificial Sequence
  Description of Artificial Sequence: Synthetic oligonucleotide
  Target: ATXN1; (+) strand; PAM type: YTN; PAM sequence: TTC
tgaaaagggagtccatagac

SEQ ID NO: 267757 - DNA, 20 bp, Artificial Sequence
  Description of Artificial Sequence: Synthetic oligonucleotide
  Target: ATXN1; (+) strand; PAM type: YTN; PAM sequence: CTG
aaaagggagtccatagacac

SEQ ID NO: 267758 - DNA, 20 bp, Artificial Sequence
  Description of Artificial Sequence: Synthetic oligonucleotide
  Target: ATXN1; (+) strand; PAM type: YTN; PAM sequence: TTC
cagaaacctttattattgct

SEQ ID NO: 267759 - DNA, 20 bp, Artificial Sequence
  Description of Artificial Sequence: Synthetic oligonucleotide
  Target: ATXN1; (+) strand; PAM type: YTN; PAM sequence: CTT
tattattgctgtcctcaaaa

SEQ ID NO: 267760 - DNA, 20 bp, Artificial Sequence
  Description of Artificial Sequence: Synthetic oligonucleotide
  Target: ATXN1; (+) strand; PAM type: YTN; PAM sequence: TTT
attattgctgtcctcaaaag

SEQ ID NO: 267761 - DNA, 20 bp, Artificial Sequence
  Description of Artificial Sequence: Synthetic oligonucleotide
  Target: ATXN1; (+) strand; PAM type: YTN; PAM sequence: TTA
ttattgctgtcctcaaaagc

SEQ ID NO: 267762 - DNA, 20 bp, Artificial Sequence
  Description of Artificial Sequence: Synthetic oligonucleotide
  Target: ATXN1; (+) strand; PAM type: YTN; PAM sequence: TTA
ttgctgtcctcaaaagctaa

SEQ ID NO: 267763 - DNA, 20 bp, Artificial Sequence
  Description of Artificial Sequence: Synthetic oligonucleotide
  Target: ATXN1; (+) strand; PAM type: YTN; PAM sequence: TTG
ctgtcctcaaaagctaacta

SEQ ID NO: 267764 - DNA, 20 bp, Artificial Sequence
  Description of Artificial Sequence: Synthetic oligonucleotide
  Target: ATXN1; (+) strand; PAM type: YTN; PAM sequence: CTG
tcctcaaaagctaactagca

SEQ ID NO: 267765 - DNA, 20 bp, Artificial Sequence
  Description of Artificial Sequence: Synthetic oligonucleotide
  Target: ATXN1; (+) strand; PAM type: YTN; PAM sequence: CTC
aaaagctaactagcacaatg

SEQ ID NO: 267766 - DNA, 20 bp, Artificial Sequence
  Description of Artificial Sequence: Synthetic oligonucleotide
  Target: ATXN1; (+) strand; PAM type: YTN; PAM sequence: CTA
actagcacaatgcctcccta

SEQ ID NO: 267767 - DNA, 20 bp, Artificial Sequence
  Description of Artificial Sequence: Synthetic oligonucleotide
  Target: ATXN1; (+) strand; PAM type: YTN; PAM sequence: CTA
gcacaatgcctccctaagaa

SEQ ID NO: 267768 - DNA, 20 bp, Artificial Sequence
  Description of Artificial Sequence: Synthetic oligonucleotide
  Target: ATXN1; (+) strand; PAM type: YTN; PAM sequence: CTC
cctaagaaagcttttgtgaa

SEQ ID NO: 267769 - DNA, 20 bp, Artificial Sequence
  Description of Artificial Sequence: Synthetic oligonucleotide
  Target: ATXN1; (+) strand; PAM type: YTN; PAM sequence: CTA
agaaagcttttgtgaacttc

SEQ ID NO: 267770 - DNA, 20 bp, Artificial Sequence
  Description of Artificial Sequence: Synthetic oligonucleotide
  Target: ATXN1; (+) strand; PAM type: YTN; PAM sequence: CTT
ttgtgaacttcccatcacac

SEQ ID NO: 267771 - DNA, 20 bp, Artificial Sequence
  Description of Artificial Sequence: Synthetic oligonucleotide
  Target: ATXN1; (+) strand; PAM type: YTN; PAM sequence: TTT
tgtgaacttcccatcacaca

SEQ ID NO: 267772 - DNA, 20 bp, Artificial Sequence
  Description of Artificial Sequence: Synthetic oligonucleotide
  Target: ATXN1; (+) strand; PAM type: YTN; PAM sequence: TTT
gtgaacttcccatcacacac

SEQ ID NO: 267773 - DNA, 20 bp, Artificial Sequence
  Description of Artificial Sequence: Synthetic oligonucleotide
  Target: ATXN1; (+) strand; PAM type: YTN; PAM sequence: TTG
tgaacttcccatcacacacc

SEQ ID NO: 267774 - DNA, 20 bp, Artificial Sequence
  Description of Artificial Sequence: Synthetic oligonucleotide
  Target: ATXN1; (+) strand; PAM type: YTN; PAM sequence: CTT
cccatcacacaccacagaga

SEQ ID NO: 267775 - DNA, 20 bp, Artificial Sequence
  Description of Artificial Sequence: Synthetic oligonucleotide
  Target: ATXN1; (+) strand; PAM type: YTN; PAM sequence: TTC
ccatcacacaccacagagac

SEQ ID NO: 267776 - DNA, 20 bp, Artificial Sequence
  Description of Artificial Sequence: Synthetic oligonucleotide
  Target: ATXN1; (+) strand; PAM type: YTN; PAM sequence: TTA
aatgggtttcatttgtacca

SEQ ID NO: 267777 - DNA, 20 bp, Artificial Sequence
  Description of Artificial Sequence: Synthetic oligonucleotide
  Target: ATXN1; (+) strand; PAM type: YTN; PAM sequence: TTT
catttgtaccagcacaccat

SEQ ID NO: 267778 - DNA, 20 bp, Artificial Sequence
  Description of Artificial Sequence: Synthetic oligonucleotide
  Target: ATXN1; (+) strand; PAM type: YTN; PAM sequence: TTC
atttgtaccagcacaccatt

SEQ ID NO: 267779 - DNA, 20 bp, Artificial Sequence
  Description of Artificial Sequence: Synthetic oligonucleotide
  Target: ATXN1; (+) strand; PAM type: YTN; PAM sequence: TTT
gtaccagcacaccatttttt

SEQ ID NO: 267780 - DNA, 20 bp, Artificial Sequence
  Description of Artificial Sequence: Synthetic oligonucleotide
  Target: ATXN1; (+) strand; PAM type: YTN; PAM sequence: TTG
taccagcacaccattttttc

SEQ ID NO: 267781 - DNA, 20 bp, Artificial Sequence
  Description of Artificial Sequence: Synthetic oligonucleotide
  Target: ATXN1; (+) strand; PAM type: YTN; PAM sequence: TTT
tttcattctaaggtgtgcac

SEQ ID NO: 267782 - DNA, 20 bp, Artificial Sequence
  Description of Artificial Sequence: Synthetic oligonucleotide
  Target: ATXN1; (+) strand; PAM type: YTN; PAM sequence: TTT
ttcattctaaggtgtgcact

SEQ ID NO: 267783 - DNA, 20 bp, Artificial Sequence
  Description of Artificial Sequence: Synthetic oligonucleotide
  Target: ATXN1; (+) strand; PAM type: YTN; PAM sequence: TTT
tcattctaaggtgtgcacta

SEQ ID NO: 267784 - DNA, 20 bp, Artificial Sequence
  Description of Artificial Sequence: Synthetic oligonucleotide
  Target: ATXN1; (+) strand; PAM type: YTN; PAM sequence: TTT
cattctaaggtgtgcactag

SEQ ID NO: 267785 - DNA, 20 bp, Artificial Sequence
  Description of Artificial Sequence: Synthetic oligonucleotide
  Target: ATXN1; (+) strand; PAM type: YTN; PAM sequence: TTC
attctaaggtgtgcactaga

SEQ ID NO: 267786 - DNA, 20 bp, Artificial Sequence
  Description of Artificial Sequence: Synthetic oligonucleotide
  Target: ATXN1; (+) strand; PAM type: YTN; PAM sequence: TTC
taaggtgtgcactagaatga

SEQ ID NO: 267787 - DNA, 20 bp, Artificial Sequence
  Description of Artificial Sequence: Synthetic oligonucleotide
  Target: ATXN1; (+) strand; PAM type: YTN; PAM sequence: CTA
aggtgtgcactagaatgaag

SEQ ID NO: 267788 - DNA, 20 bp, Artificial Sequence
  Description of Artificial Sequence: Synthetic oligonucleotide
  Target: ATXN1; (+) strand; PAM type: YTN; PAM sequence: CTA
gaatgaagtgttattcagtc

SEQ ID NO: 267789 - DNA, 20 bp, Artificial Sequence
  Description of Artificial Sequence: Synthetic oligonucleotide
  Target: ATXN1; (+) strand; PAM type: YTN; PAM sequence: TTA
ttcagtcagcccctttctag

SEQ ID NO: 267790 - DNA, 20 bp, Artificial Sequence
  Description of Artificial Sequence: Synthetic oligonucleotide
  Target: ATXN1; (+) strand; PAM type: YTN; PAM sequence: TTC
agtcagcccctttctaggga

SEQ ID NO: 267791 - DNA, 20 bp, Artificial Sequence
  Description of Artificial Sequence: Synthetic oligonucleotide
  Target: ATXN1; (+) strand; PAM type: YTN; PAM sequence: CTT
tctagggagatacagcactt

SEQ ID NO: 267792 - DNA, 20 bp, Artificial Sequence
  Description of Artificial Sequence: Synthetic oligonucleotide
  Target: ATXN1; (+) strand; PAM type: YTN; PAM sequence: TTT
ctagggagatacagcacttc

SEQ ID NO: 267793 - DNA, 20 bp, Artificial Sequence
  Description of Artificial Sequence: Synthetic oligonucleotide
  Target: ATXN1; (+) strand; PAM type: YTN; PAM sequence: TTC
tagggagatacagcacttca

SEQ ID NO: 267794 - DNA, 20 bp, Artificial Sequence
  Description of Artificial Sequence: Synthetic oligonucleotide
  Target: ATXN1; (+) strand; PAM type: YTN; PAM sequence: CTA
gggagatacagcacttcagg

SEQ ID NO: 267795 - DNA, 20 bp, Artificial Sequence
  Description of Artificial Sequence: Synthetic oligonucleotide
  Target: ATXN1; (+) strand; PAM type: YTN; PAM sequence: CTT
caggcccatccctactttga

SEQ ID NO: 267796 - DNA, 20 bp, Artificial Sequence
  Description of Artificial Sequence: Synthetic oligonucleotide
  Target: ATXN1; (+) strand; PAM type: YTN; PAM sequence: TTC
aggcccatccctactttgaa

SEQ ID NO: 267797 - DNA, 20 bp, Artificial Sequence
  Description of Artificial Sequence: Synthetic oligonucleotide
  Target: ATXN1; (+) strand; PAM type: YTN; PAM sequence: CTA
ctttgaaaagaaatatgaac

SEQ ID NO: 267798 - DNA, 20 bp, Artificial Sequence
  Description of Artificial Sequence: Synthetic oligonucleotide
  Target: ATXN1; (+) strand; PAM type: YTN; PAM sequence: CTT
tgaaaagaaatatgaacgta

SEQ ID NO: 267799 - DNA, 20 bp, Artificial Sequence
  Description of Artificial Sequence: Synthetic oligonucleotide
  Target: ATXN1; (+) strand; PAM type: YTN; PAM sequence: TTT
gaaaagaaatatgaacgtaa

SEQ ID NO: 267800 - DNA, 20 bp, Artificial Sequence
  Description of Artificial Sequence: Synthetic oligonucleotide
  Target: ATXN1; (+) strand; PAM type: YTN; PAM sequence: TTG
aaaagaaatatgaacgtaag

SEQ ID NO: 267801 - DNA, 20 bp, Artificial Sequence
  Description of Artificial Sequence: Synthetic oligonucleotide
  Target: ATXN1; (+) strand; PAM type: YTN; PAM sequence: TTC
acagaaagccagggcaggat

SEQ ID NO: 267802 - DNA, 20 bp, Artificial Sequence
  Description of Artificial Sequence: Synthetic oligonucleotide
  Target: ATXN1; (+) strand; PAM type: YTN; PAM sequence: CTC
acaaacaagtgacaaagcaa

SEQ ID NO: 267803 - DNA, 20 bp, Artificial Sequence
  Description of Artificial Sequence: Synthetic oligonucleotide
  Target: ATXN1; (+) strand; PAM type: YTN; PAM sequence: CTC
aaatggaaaaggagaggaaa

SEQ ID NO: 267804 - DNA, 20 bp, Artificial Sequence
  Description of Artificial Sequence: Synthetic oligonucleotide
  Target: ATXN1; (+) strand; PAM type: YTN; PAM sequence: CTT
ttaaaaaaagtattagaaaa

SEQ ID NO: 267805 - DNA, 20 bp, Artificial Sequence
  Description of Artificial Sequence: Synthetic oligonucleotide
  Target: ATXN1; (+) strand; PAM type: YTN; PAM sequence: TTT
taaaaaaagtattagaaaat

SEQ ID NO: 267806 - DNA, 20 bp, Artificial Sequence
  Description of Artificial Sequence: Synthetic oligonucleotide
  Target: ATXN1; (+) strand; PAM type: YTN; PAM sequence: TTT
aaaaaaagtattagaaaatc

SEQ ID NO: 267807 - DNA, 20 bp, Artificial Sequence
  Description of Artificial Sequence: Synthetic oligonucleotide
  Target: ATXN1; (+) strand; PAM type: YTN; PAM sequence: TTA
aaaaaagtattagaaaatcc

SEQ ID NO: 267808 - DNA, 20 bp, Artificial Sequence
  Description of Artificial Sequence: Synthetic oligonucleotide
  Target: ATXN1; (+) strand; PAM type: YTN; PAM sequence: TTA
gaaaatccccaaactctact

SEQ ID NO: 267809 - DNA, 20 bp, Artificial Sequence
  Description of Artificial Sequence: Synthetic oligonucleotide
  Target: ATXN1; (+) strand; PAM type: YTN; PAM sequence: CTC
tactgataggtctagaattt

SEQ ID NO: 267810 - DNA, 20 bp, Artificial Sequence
  Description of Artificial Sequence: Synthetic oligonucleotide
  Target: ATXN1; (+) strand; PAM type: YTN; PAM sequence: CTA
ctgataggtctagaattttt

SEQ ID NO: 267811 - DNA, 20 bp, Artificial Sequence
  Description of Artificial Sequence: Synthetic oligonucleotide
  Target: ATXN1; (+) strand; PAM type: YTN; PAM sequence: CTG
ataggtctagaatttttttt

SEQ ID NO: 267812 - DNA, 20 bp, Artificial Sequence
  Description of Artificial Sequence: Synthetic oligonucleotide
  Target: ATXN1; (+) strand; PAM type: YTN; PAM sequence: CTA
gaatttttttttttttacac

SEQ ID NO: 267813 - DNA, 20 bp, Artificial Sequence
  Description of Artificial Sequence: Synthetic oligonucleotide
  Target: ATXN1; (+) strand; PAM type: YTN; PAM sequence: TTT
ttttttttttacacaaattg

SEQ ID NO: 267814 - DNA, 20 bp, Artificial Sequence
  Description of Artificial Sequence: Synthetic oligonucleotide
  Target: ATXN1; (+) strand; PAM type: YTN; PAM sequence: TTT
tttttttttacacaaattgt

SEQ ID NO: 267815 - DNA, 20 bp, Artificial Sequence
  Description of Artificial Sequence: Synthetic oligonucleotide
  Target: ATXN1; (+) strand; PAM type: YTN; PAM sequence: TTT
ttttttttacacaaattgtt

SEQ ID NO: 267816 - DNA, 20 bp, Artificial Sequence
  Description of Artificial Sequence: Synthetic oligonucleotide
  Target: ATXN1; (+) strand; PAM type: YTN; PAM sequence: TTT
tttttttacacaaattgttc

SEQ ID NO: 267817 - DNA, 20 bp, Artificial Sequence
  Description of Artificial Sequence: Synthetic oligonucleotide
  Target: ATXN1; (+) strand; PAM type: YTN; PAM sequence: TTT
ttttttacacaaattgttcc

SEQ ID NO: 267818 - DNA, 20 bp, Artificial Sequence
  Description of Artificial Sequence: Synthetic oligonucleotide
  Target: ATXN1; (+) strand; PAM type: YTN; PAM sequence: TTT
tttttacacaaattgttccc

SEQ ID NO: 267819 - DNA, 20 bp, Artificial Sequence
  Description of Artificial Sequence: Synthetic oligonucleotide
  Target: ATXN1; (+) strand; PAM type: YTN; PAM sequence: TTT
ttttacacaaattgttccct

SEQ ID NO: 267820 - DNA, 20 bp, Artificial Sequence
  Description of Artificial Sequence: Synthetic oligonucleotide
  Target: ATXN1; (+) strand; PAM type: YTN; PAM sequence: TTT
tttacacaaattgttccctc

SEQ ID NO: 267821 - DNA, 20 bp, Artificial Sequence
  Description of Artificial Sequence: Synthetic oligonucleotide
  Target: ATXN1; (+) strand; PAM type: YTN; PAM sequence: TTT
ttacacaaattgttccctcc

SEQ ID NO: 267822 - DNA, 20 bp, Artificial Sequence
  Description of Artificial Sequence: Synthetic oligonucleotide
  Target: ATXN1; (+) strand; PAM type: YTN; PAM sequence: TTT
tacacaaattgttccctcct

SEQ ID NO: 267823 - DNA, 20 bp, Artificial Sequence
  Description of Artificial Sequence: Synthetic oligonucleotide
  Target: ATXN1; (+) strand; PAM type: YTN; PAM sequence: TTT
acacaaattgttccctcctc

SEQ ID NO: 267824 - DNA, 20 bp, Artificial Sequence
  Description of Artificial Sequence: Synthetic oligonucleotide
  Target: ATXN1; (+) strand; PAM type: YTN; PAM sequence: TTA
cacaaattgttccctcctca

SEQ ID NO: 267825 - DNA, 20 bp, Artificial Sequence
  Description of Artificial Sequence: Synthetic oligonucleotide
  Target: ATXN1; (+) strand; PAM type: YTN; PAM sequence: TTG
ttccctcctcacatttcttt

SEQ ID NO: 267826 - DNA, 20 bp, Artificial Sequence
  Description of Artificial Sequence: Synthetic oligonucleotide
  Target: ATXN1; (+) strand; PAM type: YTN; PAM sequence: TTC
cctcctcacatttctttata

SEQ ID NO: 267827 - DNA, 20 bp, Artificial Sequence
  Description of Artificial Sequence: Synthetic oligonucleotide
  Target: ATXN1; (+) strand; PAM type: YTN; PAM sequence: CTC
ctcacatttctttatacaca

SEQ ID NO: 267828 - DNA, 20 bp, Artificial Sequence
  Description of Artificial Sequence: Synthetic oligonucleotide
  Target: ATXN1; (+) strand; PAM type: YTN; PAM sequence: CTC
acatttctttatacacatca

SEQ ID NO: 267829 - DNA, 20 bp, Artificial Sequence
  Description of Artificial Sequence: Synthetic oligonucleotide
  Target: ATXN1; (+) strand; PAM type: YTN; PAM sequence: TTT
ctttatacacatcaagtatc

SEQ ID NO: 267830 - DNA, 20 bp, Artificial Sequence
  Description of Artificial Sequence: Synthetic oligonucleotide
  Target: ATXN1; (+) strand; PAM type: YTN; PAM sequence: TTC
tttatacacatcaagtatcc

SEQ ID NO: 267831 - DNA, 20 bp, Artificial Sequence
  Description of Artificial Sequence: Synthetic oligonucleotide
  Target: ATXN1; (+) strand; PAM type: YTN; PAM sequence: CTT
tatacacatcaagtatccac

SEQ ID NO: 267832 - DNA, 20 bp, Artificial Sequence
  Description of Artificial Sequence: Synthetic oligonucleotide
  Target: ATXN1; (+) strand; PAM type: YTN; PAM sequence: TTT
atacacatcaagtatccact

SEQ ID NO: 267833 - DNA, 20 bp, Artificial Sequence
  Description of Artificial Sequence: Synthetic oligonucleotide
  Target: ATXN1; (+) strand; PAM type: YTN; PAM sequence: TTA
tacacatcaagtatccactt

SEQ ID NO: 267834 - DNA, 20 bp, Artificial Sequence
  Description of Artificial Sequence: Synthetic oligonucleotide
  Target: ATXN1; (+) strand; PAM type: YTN; PAM sequence: CTT
ctaaggaaaatagtctagac

SEQ ID NO: 267835 - DNA, 20 bp, Artificial Sequence
  Description of Artificial Sequence: Synthetic oligonucleotide
  Target: ATXN1; (+) strand; PAM type: YTN; PAM sequence: TTC
taaggaaaatagtctagact

SEQ ID NO: 267836 - DNA, 20 bp, Artificial Sequence
  Description of Artificial Sequence: Synthetic oligonucleotide
  Target: ATXN1; (+) strand; PAM type: YTN; PAM sequence: CTA
aggaaaatagtctagactct

SEQ ID NO: 267837 - DNA, 20 bp, Artificial Sequence
  Description of Artificial Sequence: Synthetic oligonucleotide
  Target: ATXN1; (+) strand; PAM type: YTN; PAM sequence: CTA
gactctccatcccttcccca

SEQ ID NO: 267838 - DNA, 20 bp, Artificial Sequence
  Description of Artificial Sequence: Synthetic oligonucleotide
  Target: ATXN1; (+) strand; PAM type: YTN; PAM sequence: CTC
tccatcccttccccacaccc

SEQ ID NO: 267839 - DNA, 20 bp, Artificial Sequence
  Description of Artificial Sequence: Synthetic oligonucleotide
  Target: ATXN1; (+) strand; PAM type: YTN; PAM sequence: CTC
catcccttccccacaccctt

SEQ ID NO: 267840 - DNA, 20 bp, Artificial Sequence
  Description of Artificial Sequence: Synthetic oligonucleotide
  Target: ATXN1; (+) strand; PAM type: YTN; PAM sequence: CTT
ccccacacccttaaactgct

SEQ ID NO: 267841 - DNA, 20 bp, Artificial Sequence
  Description of Artificial Sequence: Synthetic oligonucleotide
  Target: ATXN1; (+) strand; PAM type: YTN; PAM sequence: TTC
cccacacccttaaactgcta

SEQ ID NO: 267842 - DNA, 20 bp, Artificial Sequence
  Description of Artificial Sequence: Synthetic oligonucleotide
  Target: ATXN1; (+) strand; PAM type: YTN; PAM sequence: CTT
aaactgctatcagattcaag

SEQ ID NO: 267843 - DNA, 20 bp, Artificial Sequence
  Description of Artificial Sequence: Synthetic oligonucleotide
  Target: ATXN1; (+) strand; PAM type: YTN; PAM sequence: TTA
aactgctatcagattcaagc

SEQ ID NO: 267844 - DNA, 20 bp, Artificial Sequence
  Description of Artificial Sequence: Synthetic oligonucleotide
  Target: ATXN1; (+) strand; PAM type: YTN; PAM sequence: CTG
ctatcagattcaagcattct

SEQ ID NO: 267845 - DNA, 20 bp, Artificial Sequence
  Description of Artificial Sequence: Synthetic oligonucleotide
  Target: ATXN1; (+) strand; PAM type: YTN; PAM sequence: CTA
tcagattcaagcattctcat

SEQ ID NO: 267846 - DNA, 20 bp, Artificial Sequence
  Description of Artificial Sequence: Synthetic oligonucleotide
  Target: ATXN1; (+) strand; PAM type: YTN; PAM sequence: TTC
aagcattctcatcagaacag

SEQ ID NO: 267847 - DNA, 20 bp, Artificial Sequence
  Description of Artificial Sequence: Synthetic oligonucleotide
  Target: ATXN1; (+) strand; PAM type: YTN; PAM sequence: TTC
tcatcagaacagcatgtatg

SEQ ID NO: 267848 - DNA, 20 bp, Artificial Sequence
  Description of Artificial Sequence: Synthetic oligonucleotide
  Target: ATXN1; (+) strand; PAM type: YTN; PAM sequence: CTC
atcagaacagcatgtatgtt

SEQ ID NO: 267849 - DNA, 20 bp, Artificial Sequence
  Description of Artificial Sequence: Synthetic oligonucleotide
  Target: ATXN1; (+) strand; PAM type: YTN; PAM sequence: TTC
cttttcctaatggctcaggc

SEQ ID NO: 267850 - DNA, 20 bp, Artificial Sequence
  Description of Artificial Sequence: Synthetic oligonucleotide
  Target: ATXN1; (+) strand; PAM type: YTN; PAM sequence: CTT
ttcctaatggctcaggccca

SEQ ID NO: 267851 - DNA, 20 bp, Artificial Sequence
  Description of Artificial Sequence: Synthetic oligonucleotide
  Target: ATXN1; (+) strand; PAM type: YTN; PAM sequence: TTT
tcctaatggctcaggcccac

SEQ ID NO: 267852 - DNA, 20 bp, Artificial Sequence
  Description of Artificial Sequence: Synthetic oligonucleotide
  Target: ATXN1; (+) strand; PAM type: YTN; PAM sequence: TTT
cctaatggctcaggcccaca

SEQ ID NO: 267853 - DNA, 20 bp, Artificial Sequence
  Description of Artificial Sequence: Synthetic oligonucleotide
  Target: ATXN1; (+) strand; PAM type: YTN; PAM sequence: TTC
ctaatggctcaggcccacac

SEQ ID NO: 267854 - DNA, 20 bp, Artificial Sequence
  Description of Artificial Sequence: Synthetic oligonucleotide
  Target: ATXN1; (+) strand; PAM type: YTN; PAM sequence: CTA
atggctcaggcccacacatg

SEQ ID NO: 267855 - DNA, 20 bp, Artificial Sequence
  Description of Artificial Sequence: Synthetic oligonucleotide
  Target: ATXN1; (+) strand; PAM type: YTN; PAM sequence: CTC
aggcccacacatgagaggca

SEQ ID NO: 267856 - DNA, 20 bp, Artificial Sequence
  Description of Artificial Sequence: Synthetic oligonucleotide
  Target: ATXN1; (+) strand; PAM type: YTN; PAM sequence: TTC
acttagtgaatgtcatttag

SEQ ID NO: 267857 - DNA, 20 bp, Artificial Sequence
  Description of Artificial Sequence: Synthetic oligonucleotide
  Target: ATXN1; (+) strand; PAM type: YTN; PAM sequence: CTT
agtgaatgtcatttaggcat

SEQ ID NO: 267858 - DNA, 20 bp, Artificial Sequence
  Description of Artificial Sequence: Synthetic oligonucleotide
  Target: ATXN1; (+) strand; PAM type: YTN; PAM sequence: TTA
gtgaatgtcatttaggcatt

SEQ ID NO: 267859 - DNA, 20 bp, Artificial Sequence
  Description of Artificial Sequence: Synthetic oligonucleotide
  Target: ATXN1; (+) strand; PAM type: YTN; PAM sequence: TTT
aggcattcactcaatgaata

SEQ ID NO: 267860 - DNA, 20 bp, Artificial Sequence
  Description of Artificial Sequence: Synthetic oligonucleotide
  Target: ATXN1; (+) strand; PAM type: YTN; PAM sequence: TTA
ggcattcactcaatgaatat

SEQ ID NO: 267861 - DNA, 20 bp, Artificial Sequence
  Description of Artificial Sequence: Synthetic oligonucleotide
  Target: ATXN1; (+) strand; PAM type: YTN; PAM sequence: TTC
actcaatgaatatttactga

SEQ ID NO: 267862 - DNA, 20 bp, Artificial Sequence
  Description of Artificial Sequence: Synthetic oligonucleotide
  Target: ATXN1; (+) strand; PAM type: YTN; PAM sequence: CTC
aatgaatatttactgactgc

SEQ ID NO: 267863 - DNA, 20 bp, Artificial Sequence
  Description of Artificial Sequence: Synthetic oligonucleotide
  Target: ATXN1; (+) strand; PAM type: YTN; PAM sequence: TTT
actgactgcccattatggga

SEQ ID NO: 267864 - DNA, 20 bp, Artificial Sequence
  Description of Artificial Sequence: Synthetic oligonucleotide
  Target: ATXN1; (+) strand; PAM type: YTN; PAM sequence: TTA
ctgactgcccattatgggaa

SEQ ID NO: 267865 - DNA, 20 bp, Artificial Sequence
  Description of Artificial Sequence: Synthetic oligonucleotide
  Target: ATXN1; (+) strand; PAM type: YTN; PAM sequence: CTG
actgcccattatgggaacaa

SEQ ID NO: 267866 - DNA, 20 bp, Artificial Sequence
  Description of Artificial Sequence: Synthetic oligonucleotide
  Target: ATXN1; (+) strand; PAM type: YTN; PAM sequence: CTG
cccattatgggaacaagcag

SEQ ID NO: 267867 - DNA, 20 bp, Artificial Sequence
  Description of Artificial Sequence: Synthetic oligonucleotide
  Target: ATXN1; (+) strand; PAM type: YTN; PAM sequence: TTA
tgggaacaagcagtatttta

SEQ ID NO: 267868 - DNA, 20 bp, Artificial Sequence
  Description of Artificial Sequence: Synthetic oligonucleotide
  Target: ATXN1; (+) strand; PAM type: YTN; PAM sequence: TTT
taggtactattcattcacca

SEQ ID NO: 267869 - DNA, 20 bp, Artificial Sequence
  Description of Artificial Sequence: Synthetic oligonucleotide
  Target: ATXN1; (+) strand; PAM type: YTN; PAM sequence: TTT
aggtactattcattcaccag

SEQ ID NO: 267870 - DNA, 20 bp, Artificial Sequence
  Description of Artificial Sequence: Synthetic oligonucleotide
  Target: ATXN1; (+) strand; PAM type: YTN; PAM sequence: TTA
ggtactattcattcaccagg

SEQ ID NO: 267871 - DNA, 20 bp, Artificial Sequence
  Description of Artificial Sequence: Synthetic oligonucleotide
  Target: ATXN1; (+) strand; PAM type: YTN; PAM sequence: CTA
ttcattcaccagggaagaat

SEQ ID NO: 267872 - DNA, 20 bp, Artificial Sequence
  Description of Artificial Sequence: Synthetic oligonucleotide
  Target: ATXN1; (+) strand; PAM type: YTN; PAM sequence: TTC
attcaccagggaagaataag

SEQ ID NO: 267873 - DNA, 20 bp, Artificial Sequence
  Description of Artificial Sequence: Synthetic oligonucleotide
  Target: ATXN1; (+) strand; PAM type: YTN; PAM sequence: TTC
accagggaagaataagaatg

SEQ ID NO: 267874 - DNA, 20 bp, Artificial Sequence
  Description of Artificial Sequence: Synthetic oligonucleotide
  Target: ATXN1; (+) strand; PAM type: YTN; PAM sequence: CTC
cttttgcagagcttgcagac

SEQ ID NO: 267875 - DNA, 20 bp, Artificial Sequence
  Description of Artificial Sequence: Synthetic oligonucleotide
  Target: ATXN1; (+) strand; PAM type: YTN; PAM sequence: CTT
ttgcagagcttgcagactag

SEQ ID NO: 267876 - DNA, 20 bp, Artificial Sequence
  Description of Artificial Sequence: Synthetic oligonucleotide
  Target: ATXN1; (+) strand; PAM type: YTN; PAM sequence: TTT
tgcagagcttgcagactagt

SEQ ID NO: 267877 - DNA, 20 bp, Artificial Sequence
  Description of Artificial Sequence: Synthetic oligonucleotide
  Target: ATXN1; (+) strand; PAM type: YTN; PAM sequence: TTT
gcagagcttgcagactagtt

SEQ ID NO: 267878 - DNA, 20 bp, Artificial Sequence
  Description of Artificial Sequence: Synthetic oligonucleotide
  Target: ATXN1; (+) strand; PAM type: YTN; PAM sequence: TTG
cagagcttgcagactagttg

SEQ ID NO: 267879 - DNA, 20 bp, Artificial Sequence
  Description of Artificial Sequence: Synthetic oligonucleotide
  Target: ATXN1; (+) strand; PAM type: YTN; PAM sequence: CTT
gcagactagttgaggagact

SEQ ID NO: 267880 - DNA, 20 bp, Artificial Sequence
  Description of Artificial Sequence: Synthetic oligonucleotide
  Target: ATXN1; (+) strand; PAM type: YTN; PAM sequence: TTG
cagactagttgaggagactg

SEQ ID NO: 267881 - DNA, 20 bp, Artificial Sequence
  Description of Artificial Sequence: Synthetic oligonucleotide
  Target: ATXN1; (+) strand; PAM type: YTN; PAM sequence: CTA
gttgaggagactgatgatta

SEQ ID NO: 267882 - DNA, 20 bp, Artificial Sequence
  Description of Artificial Sequence: Synthetic oligonucleotide
  Target: ATXN1; (+) strand; PAM type: YTN; PAM sequence: TTG
aggagactgatgattaacaa

SEQ ID NO: 267883 - DNA, 20 bp, Artificial Sequence
  Description of Artificial Sequence: Synthetic oligonucleotide
  Target: ATXN1; (+) strand; PAM type: YTN; PAM sequence: CTG
atgattaacaaataaatata

SEQ ID NO: 267884 - DNA, 20 bp, Artificial Sequence
  Description of Artificial Sequence: Synthetic oligonucleotide
  Target: ATXN1; (+) strand; PAM type: YTN; PAM sequence: TTA
acaaataaatatataatatg

SEQ ID NO: 267885 - DNA, 20 bp, Artificial Sequence
  Description of Artificial Sequence: Synthetic oligonucleotide
  Target: ATXN1; (+) strand; PAM type: YTN; PAM sequence: CTT
aaaagaaaaacacagaaggc

SEQ ID NO: 267886 - DNA, 20 bp, Artificial Sequence
  Description of Artificial Sequence: Synthetic oligonucleotide
  Target: ATXN1; (+) strand; PAM type: YTN; PAM sequence: TTA
aaagaaaaacacagaaggct

SEQ ID NO: 267887 - DNA, 20 bp, Artificial Sequence
  Description of Artificial Sequence: Synthetic oligonucleotide
  Target: ATXN1; (+) strand; PAM type: YTN; PAM sequence: CTA
gaggactgagagggatgggg

SEQ ID NO: 267888 - DNA, 20 bp, Artificial Sequence
  Description of Artificial Sequence: Synthetic oligonucleotide
  Target: ATXN1; (+) strand; PAM type: YTN; PAM sequence: CTG
agagggatggggtggatgct

SEQ ID NO: 267889 - DNA, 20 bp, Artificial Sequence
  Description of Artificial Sequence: Synthetic oligonucleotide
  Target: ATXN1; (+) strand; PAM type: YTN; PAM sequence: CTA
ttttatgtagatcagggaag

SEQ ID NO: 267890 - DNA, 20 bp, Artificial Sequence
  Description of Artificial Sequence: Synthetic oligonucleotide
  Target: ATXN1; (+) strand; PAM type: YTN; PAM sequence: TTT
tatgtagatcagggaaggct

SEQ ID NO: 267891 - DNA, 20 bp, Artificial Sequence
  Description of Artificial Sequence: Synthetic oligonucleotide
  Target: ATXN1; (+) strand; PAM type: YTN; PAM sequence: TTT
atgtagatcagggaaggctg

SEQ ID NO: 267892 - DNA, 20 bp, Artificial Sequence
  Description of Artificial Sequence: Synthetic oligonucleotide
  Target: ATXN1; (+) strand; PAM type: YTN; PAM sequence: TTA
tgtagatcagggaaggctgc

SEQ ID NO: 267893 - DNA, 20 bp, Artificial Sequence
  Description of Artificial Sequence: Synthetic oligonucleotide
  Target: ATXN1; (+) strand; PAM type: YTN; PAM sequence: CTG
ctttgataaggtaactcaag

SEQ ID NO: 267894 - DNA, 20 bp, Artificial Sequence
  Description of Artificial Sequence: Synthetic oligonucleotide
  Target: ATXN1; (+) strand; PAM type: YTN; PAM sequence: CTT
tgataaggtaactcaagaat

SEQ ID NO: 267895 - DNA, 20 bp, Artificial Sequence
  Description of Artificial Sequence: Synthetic oligonucleotide
  Target: ATXN1; (+) strand; PAM type: YTN; PAM sequence: TTT
gataaggtaactcaagaatt

SEQ ID NO: 267896 - DNA, 20 bp, Artificial Sequence
  Description of Artificial Sequence: Synthetic oligonucleotide
  Target: ATXN1; (+) strand; PAM type: YTN; PAM sequence: TTG
ataaggtaactcaagaattc

SEQ ID NO: 267897 - DNA, 20 bp, Artificial Sequence
  Description of Artificial Sequence: Synthetic oligonucleotide
  Target: ATXN1; (+) strand; PAM type: YTN; PAM sequence: CTC
aagaattcctacttaaggaa

SEQ ID NO: 267898 - DNA, 20 bp, Artificial Sequence
  Description of Artificial Sequence: Synthetic oligonucleotide
  Target: ATXN1; (+) strand; PAM type: YTN; PAM sequence: TTC
ctacttaaggaagcagagaa

SEQ ID NO: 267899 - DNA, 20 bp, Artificial Sequence
  Description of Artificial Sequence: Synthetic oligonucleotide
  Target: ATXN1; (+) strand; PAM type: YTN; PAM sequence: CTA
cttaaggaagcagagaagct

SEQ ID NO: 267900 - DNA, 20 bp, Artificial Sequence
  Description of Artificial Sequence: Synthetic oligonucleotide
  Target: ATXN1; (+) strand; PAM type: YTN; PAM sequence: CTT
aaggaagcagagaagcttag

SEQ ID NO: 267901 - DNA, 20 bp, Artificial Sequence
  Description of Artificial Sequence: Synthetic oligonucleotide
  Target: ATXN1; (+) strand; PAM type: YTN; PAM sequence: TTA
aggaagcagagaagcttagg

SEQ ID NO: 267902 - DNA, 20 bp, Artificial Sequence
  Description of Artificial Sequence: Synthetic oligonucleotide
  Target: ATXN1; (+) strand; PAM type: YTN; PAM sequence: CTT
aggaatgaaatatggatcac

SEQ ID NO: 267903 - DNA, 20 bp, Artificial Sequence
  Description of Artificial Sequence: Synthetic oligonucleotide
  Target: ATXN1; (+) strand; PAM type: YTN; PAM sequence: TTA
ggaatgaaatatggatcact

SEQ ID NO: 267904 - DNA, 20 bp, Artificial Sequence
  Description of Artificial Sequence: Synthetic oligonucleotide
  Target: ATXN1; (+) strand; PAM type: YTN; PAM sequence: CTT
tctccttgcttagactctaa

SEQ ID NO: 267905 - DNA, 20 bp, Artificial Sequence
  Description of Artificial Sequence: Synthetic oligonucleotide
  Target: ATXN1; (+) strand; PAM type: YTN; PAM sequence: TTT
ctccttgcttagactctaac

SEQ ID NO: 267906 - DNA, 20 bp, Artificial Sequence
  Description of Artificial Sequence: Synthetic oligonucleotide
  Target: ATXN1; (+) strand; PAM type: YTN; PAM sequence: TTC
tccttgcttagactctaacc

SEQ ID NO: 267907 - DNA, 20 bp, Artificial Sequence
  Description of Artificial Sequence: Synthetic oligonucleotide
  Target: ATXN1; (+) strand; PAM type: YTN; PAM sequence: CTC
cttgcttagactctaaccaa

SEQ ID NO: 267908 - DNA, 20 bp, Artificial Sequence
  Description of Artificial Sequence: Synthetic oligonucleotide
  Target: ATXN1; (+) strand; PAM type: YTN; PAM sequence: CTT
gcttagactctaaccaatat

SEQ ID NO: 267909 - DNA, 20 bp, Artificial Sequence
  Description of Artificial Sequence: Synthetic oligonucleotide
  Target: ATXN1; (+) strand; PAM type: YTN; PAM sequence: TTG
cttagactctaaccaatatt

SEQ ID NO: 267910 - DNA, 20 bp, Artificial Sequence
  Description of Artificial Sequence: Synthetic oligonucleotide
  Target: ATXN1; (+) strand; PAM type: YTN; PAM sequence: CTT
agactctaaccaatatttga

SEQ ID NO: 267911 - DNA, 20 bp, Artificial Sequence
  Description of Artificial Sequence: Synthetic oligonucleotide
  Target: ATXN1; (+) strand; PAM type: YTN; PAM sequence: TTA
gactctaaccaatatttgag

SEQ ID NO: 267912 - DNA, 20 bp, Artificial Sequence
  Description of Artificial Sequence: Synthetic oligonucleotide
  Target: ATXN1; (+) strand; PAM type: YTN; PAM sequence: CTC
taaccaatatttgagcacag

SEQ ID NO: 267913 - DNA, 20 bp, Artificial Sequence
  Description of Artificial Sequence: Synthetic oligonucleotide
  Target: ATXN1; (+) strand; PAM type: YTN; PAM sequence: CTA
accaatatttgagcacagag

SEQ ID NO: 267914 - DNA, 20 bp, Artificial Sequence
  Description of Artificial Sequence: Synthetic oligonucleotide
  Target: ATXN1; (+) strand; PAM type: YTN; PAM sequence: TTT
gagcacagaggtggttttag

SEQ ID NO: 267915 - DNA, 20 bp, Artificial Sequence
  Description of Artificial Sequence: Synthetic oligonucleotide
  Target: ATXN1; (+) strand; PAM type: YTN; PAM sequence: TTG
agcacagaggtggttttaga

SEQ ID NO: 267916 - DNA, 20 bp, Artificial Sequence
  Description of Artificial Sequence: Synthetic oligonucleotide
  Target: ATXN1; (+) strand; PAM type: YTN; PAM sequence: TTT
tagaaaactcaagttcaaaa

SEQ ID NO: 267917 - DNA, 20 bp, Artificial Sequence
  Description of Artificial Sequence: Synthetic oligonucleotide
  Target: ATXN1; (+) strand; PAM type: YTN; PAM sequence: TTT
agaaaactcaagttcaaaaa

SEQ ID NO: 267918 - DNA, 20 bp, Artificial Sequence
  Description of Artificial Sequence: Synthetic oligonucleotide
  Target: ATXN1; (+) strand; PAM type: YTN; PAM sequence: TTA
gaaaactcaagttcaaaaat

SEQ ID NO: 267919 - DNA, 20 bp, Artificial Sequence
  Description of Artificial Sequence: Synthetic oligonucleotide
  Target: ATXN1; (+) strand; PAM type: YTN; PAM sequence: CTC
aagttcaaaaatcgttcctg

SEQ ID NO: 267920 - DNA, 20 bp, Artificial Sequence
  Description of Artificial Sequence: Synthetic oligonucleotide
  Target: ATXN1; (+) strand; PAM type: YTN; PAM sequence: TTC
aaaaatcgttcctgtttatt

SEQ ID NO: 267921 - DNA, 20 bp, Artificial Sequence
  Description of Artificial Sequence: Synthetic oligonucleotide
  Target: ATXN1; (+) strand; PAM type: YTN; PAM sequence: TTC
ctgtttattttcaaaaggac

SEQ ID NO: 267922 - DNA, 20 bp, Artificial Sequence
  Description of Artificial Sequence: Synthetic oligonucleotide
  Target: ATXN1; (+) strand; PAM type: YTN; PAM sequence: CTG
tttattttcaaaaggaccaa

SEQ ID NO: 267923 - DNA, 20 bp, Artificial Sequence
  Description of Artificial Sequence: Synthetic oligonucleotide
  Target: ATXN1; (+) strand; PAM type: YTN; PAM sequence: TTT
attttcaaaaggaccaatga

SEQ ID NO: 267924 - DNA, 20 bp, Artificial Sequence
  Description of Artificial Sequence: Synthetic oligonucleotide
  Target: ATXN1; (+) strand; PAM type: YTN; PAM sequence: TTA
ttttcaaaaggaccaatgag

SEQ ID NO: 267925 - DNA, 20 bp, Artificial Sequence
  Description of Artificial Sequence: Synthetic oligonucleotide
  Target: ATXN1; (+) strand; PAM type: YTN; PAM sequence: TTT
tcaaaaggaccaatgagtgt

SEQ ID NO: 267926 - DNA, 20 bp, Artificial Sequence
  Description of Artificial Sequence: Synthetic oligonucleotide
  Target: ATXN1; (+) strand; PAM type: YTN; PAM sequence: TTT
caaaaggaccaatgagtgtg

SEQ ID NO: 267927 - DNA, 20 bp, Artificial Sequence
  Description of Artificial Sequence: Synthetic oligonucleotide
  Target: ATXN1; (+) strand; PAM type: YTN; PAM sequence: TTC
aaaaggaccaatgagtgtgg

SEQ ID NO: 267928 - DNA, 20 bp, Artificial Sequence
  Description of Artificial Sequence: Synthetic oligonucleotide
  Target: ATXN1; (+) strand; PAM type: YTN; PAM sequence: CTA
aatttaaacagctaaagcta

SEQ ID NO: 267929 - DNA, 20 bp, Artificial Sequence
  Description of Artificial Sequence: Synthetic oligonucleotide
  Target: ATXN1; (+) strand; PAM type: YTN; PAM sequence: TTT
aaacagctaaagctatagtc

SEQ ID NO: 267930 - DNA, 20 bp, Artificial Sequence
  Description of Artificial Sequence: Synthetic oligonucleotide
  Target: ATXN1; (+) strand; PAM type: YTN; PAM sequence: TTA
aacagctaaagctatagtct

SEQ ID NO: 267931 - DNA, 20 bp, Artificial Sequence
  Description of Artificial Sequence: Synthetic oligonucleotide
  Target: ATXN1; (+) strand; PAM type: YTN; PAM sequence: CTA
aagctatagtctaaggacag

SEQ ID NO: 267932 - DNA, 20 bp, Artificial Sequence
  Description of Artificial Sequence: Synthetic oligonucleotide
  Target: ATXN1; (+) strand; PAM type: YTN; PAM sequence: CTA
tagtctaaggacagtctcaa

SEQ ID NO: 267933 - DNA, 20 bp, Artificial Sequence
  Description of Artificial Sequence: Synthetic oligonucleotide
  Target: ATXN1; (+) strand; PAM type: YTN; PAM sequence: CTA
aggacagtctcaaataaata

SEQ ID NO: 267934 - DNA, 20 bp, Artificial Sequence
  Description of Artificial Sequence: Synthetic oligonucleotide
  Target: ATXN1; (+) strand; PAM type: YTN; PAM sequence: CTC
aaataaatacctttgaattg

SEQ ID NO: 267935 - DNA, 20 bp, Artificial Sequence
  Description of Artificial Sequence: Synthetic oligonucleotide
  Target: ATXN1; (+) strand; PAM type: YTN; PAM sequence: CTT
tgaattgtcatatggtgccc

SEQ ID NO: 267936 - DNA, 20 bp, Artificial Sequence
  Description of Artificial Sequence: Synthetic oligonucleotide
  Target: ATXN1; (+) strand; PAM type: YTN; PAM sequence: TTT
gaattgtcatatggtgccca

SEQ ID NO: 267937 - DNA, 20 bp, Artificial Sequence
  Description of Artificial Sequence: Synthetic oligonucleotide
  Target: ATXN1; (+) strand; PAM type: YTN; PAM sequence: TTG
aattgtcatatggtgcccag

SEQ ID NO: 267938 - DNA, 20 bp, Artificial Sequence
  Description of Artificial Sequence: Synthetic oligonucleotide
  Target: ATXN1; (+) strand; PAM type: YTN; PAM sequence: TTG
tcatatggtgcccaggaggg

SEQ ID NO: 267939 - DNA, 20 bp, Artificial Sequence
  Description of Artificial Sequence: Synthetic oligonucleotide
  Target: ATXN1; (+) strand; PAM type: YTN; PAM sequence: CTT
gtggaaagggtttcatggta

SEQ ID NO: 267940 - DNA, 20 bp, Artificial Sequence
  Description of Artificial Sequence: Synthetic oligonucleotide
  Target: ATXN1; (+) strand; PAM type: YTN; PAM sequence: TTG
tggaaagggtttcatggtag

SEQ ID NO: 267941 - DNA, 20 bp, Artificial Sequence
  Description of Artificial Sequence: Synthetic oligonucleotide
  Target: ATXN1; (+) strand; PAM type: YTN; PAM sequence: TTT
catggtagtgaaagatgtaa

SEQ ID NO: 267942 - DNA, 20 bp, Artificial Sequence
  Description of Artificial Sequence: Synthetic oligonucleotide
  Target: ATXN1; (+) strand; PAM type: YTN; PAM sequence: TTC
atggtagtgaaagatgtaat

SEQ ID NO: 267943 - DNA, 20 bp, Artificial Sequence
  Description of Artificial Sequence: Synthetic oligonucleotide
  Target: ATXN1; (+) strand; PAM type: YTN; PAM sequence: CTC
tttttttcttttaaccctaa

SEQ ID NO: 267944 - DNA, 20 bp, Artificial Sequence
  Description of Artificial Sequence: Synthetic oligonucleotide
  Target: ATXN1; (+) strand; PAM type: YTN; PAM sequence: CTT
tttttcttttaaccctaaga

SEQ ID NO: 267945 - DNA, 20 bp, Artificial Sequence
  Description of Artificial Sequence: Synthetic oligonucleotide
  Target: ATXN1; (+) strand; PAM type: YTN; PAM sequence: TTT
ttttcttttaaccctaagac

SEQ ID NO: 267946 - DNA, 20 bp, Artificial Sequence
  Description of Artificial Sequence: Synthetic oligonucleotide
  Target: ATXN1; (+) strand; PAM type: YTN; PAM sequence: TTT
tttcttttaaccctaagact

SEQ ID NO: 267947 - DNA, 20 bp, Artificial Sequence
  Description of Artificial Sequence: Synthetic oligonucleotide
  Target: ATXN1; (+) strand; PAM type: YTN; PAM sequence: TTT
ttcttttaaccctaagactg

SEQ ID NO: 267948 - DNA, 20 bp, Artificial Sequence
  Description of Artificial Sequence: Synthetic oligonucleotide
  Target: ATXN1; (+) strand; PAM type: YTN; PAM sequence: TTT
tcttttaaccctaagactgt

SEQ ID NO: 267949 - DNA, 20 bp, Artificial Sequence
  Description of Artificial Sequence: Synthetic oligonucleotide
  Target: ATXN1; (+) strand; PAM type: YTN; PAM sequence: TTT
cttttaaccctaagactgtg

SEQ ID NO: 267950 - DNA, 20 bp, Artificial Sequence
  Description of Artificial Sequence: Synthetic oligonucleotide
  Target: ATXN1; (+) strand; PAM type: YTN; PAM sequence: TTC
ttttaaccctaagactgtgc

SEQ ID NO: 267951 - DNA, 20 bp, Artificial Sequence
  Description of Artificial Sequence: Synthetic oligonucleotide
  Target: ATXN1; (+) strand; PAM type: YTN; PAM sequence: CTT
ttaaccctaagactgtgctc

SEQ ID NO: 267952 - DNA, 20 bp, Artificial Sequence
  Description of Artificial Sequence: Synthetic oligonucleotide
  Target: ATXN1; (+) strand; PAM type: YTN; PAM sequence: TTT
taaccctaagactgtgctca

SEQ ID NO: 267953 - DNA, 20 bp, Artificial Sequence
  Description of Artificial Sequence: Synthetic oligonucleotide
  Target: ATXN1; (+) strand; PAM type: YTN; PAM sequence: TTT
aaccctaagactgtgctcaa

SEQ ID NO: 267954 - DNA, 20 bp, Artificial Sequence
  Description of Artificial Sequence: Synthetic oligonucleotide
  Target: ATXN1; (+) strand; PAM type: YTN; PAM sequence: TTA
accctaagactgtgctcaat

SEQ ID NO: 267955 - DNA, 20 bp, Artificial Sequence
  Description of Artificial Sequence: Synthetic oligonucleotide
  Target: ATXN1; (+) strand; PAM type: YTN; PAM sequence: CTA
agactgtgctcaatgtttta

SEQ ID NO: 267956 - DNA, 20 bp, Artificial Sequence
  Description of Artificial Sequence: Synthetic oligonucleotide
  Target: ATXN1; (+) strand; PAM type: YTN; PAM sequence: CTG
tgctcaatgttttaaaaaca

SEQ ID NO: 267957 - DNA, 20 bp, Artificial Sequence
  Description of Artificial Sequence: Synthetic oligonucleotide
  Target: ATXN1; (+) strand; PAM type: YTN; PAM sequence: CTC
aatgttttaaaaacagttgt

SEQ ID NO: 267958 - DNA, 20 bp, Artificial Sequence
  Description of Artificial Sequence: Synthetic oligonucleotide
  Target: ATXN1; (+) strand; PAM type: YTN; PAM sequence: TTT
taaaaacagttgtaaatgag

SEQ ID NO: 267959 - DNA, 20 bp, Artificial Sequence
  Description of Artificial Sequence: Synthetic oligonucleotide
  Target: ATXN1; (+) strand; PAM type: YTN; PAM sequence: TTT
aaaaacagttgtaaatgagg

SEQ ID NO: 267960 - DNA, 20 bp, Artificial Sequence
  Description of Artificial Sequence: Synthetic oligonucleotide
  Target: ATXN1; (+) strand; PAM type: YTN; PAM sequence: TTA
aaaacagttgtaaatgaggt

SEQ ID NO: 267961 - DNA, 20 bp, Artificial Sequence
  Description of Artificial Sequence: Synthetic oligonucleotide
  Target: ATXN1; (+) strand; PAM type: YTN; PAM sequence: TTG
taaatgaggtagtgccaaat

SEQ ID NO: 267962 - DNA, 20 bp, Artificial Sequence
  Description of Artificial Sequence: Synthetic oligonucleotide
  Target: ATXN1; (+) strand; PAM type: YTN; PAM sequence: TTG
atttttaggaacccaagaag

SEQ ID NO: 267963 - DNA, 20 bp, Artificial Sequence
  Description of Artificial Sequence: Synthetic oligonucleotide
  Target: ATXN1; (+) strand; PAM type: YTN; PAM sequence: TTT
ttaggaacccaagaaggtaa

SEQ ID NO: 267964 - DNA, 20 bp, Artificial Sequence
  Description of Artificial Sequence: Synthetic oligonucleotide
  Target: ATXN1; (+) strand; PAM type: YTN; PAM sequence: TTT
taggaacccaagaaggtaaa

SEQ ID NO: 267965 - DNA, 20 bp, Artificial Sequence
  Description of Artificial Sequence: Synthetic oligonucleotide
  Target: ATXN1; (+) strand; PAM type: YTN; PAM sequence: TTT
aggaacccaagaaggtaaaa

SEQ ID NO: 267966 - DNA, 20 bp, Artificial Sequence
  Description of Artificial Sequence: Synthetic oligonucleotide
  Target: ATXN1; (+) strand; PAM type: YTN; PAM sequence: TTA
ggaacccaagaaggtaaaat

SEQ ID NO: 267967 - DNA, 20 bp, Artificial Sequence
  Description of Artificial Sequence: Synthetic oligonucleotide
  Target: ATXN1; (+) strand; PAM type: YTN; PAM sequence: TTC
aattggcctcatctaaggct

SEQ ID NO: 267968 - DNA, 20 bp, Artificial Sequence
  Description of Artificial Sequence: Synthetic oligonucleotide
  Target: ATXN1; (+) strand; PAM type: YTN; PAM sequence: TTG
gcctcatctaaggctgatac

SEQ ID NO: 267969 - DNA, 20 bp, Artificial Sequence
  Description of Artificial Sequence: Synthetic oligonucleotide
  Target: ATXN1; (+) strand; PAM type: YTN; PAM sequence: CTC
atctaaggctgatactttat

SEQ ID NO: 267970 - DNA, 20 bp, Artificial Sequence
  Description of Artificial Sequence: Synthetic oligonucleotide
  Target: ATXN1; (+) strand; PAM type: YTN; PAM sequence: CTA
aggctgatactttatgcaac

SEQ ID NO: 267971 - DNA, 20 bp, Artificial Sequence
  Description of Artificial Sequence: Synthetic oligonucleotide
  Target: ATXN1; (+) strand; PAM type: YTN; PAM sequence: CTG
atactttatgcaacttgaga

SEQ ID NO: 267972 - DNA, 20 bp, Artificial Sequence
  Description of Artificial Sequence: Synthetic oligonucleotide
  Target: ATXN1; (+) strand; PAM type: YTN; PAM sequence: CTT
tatgcaacttgagacactta

SEQ ID NO: 267973 - DNA, 20 bp, Artificial Sequence
  Description of Artificial Sequence: Synthetic oligonucleotide
  Target: ATXN1; (+) strand; PAM type: YTN; PAM sequence: TTT
atgcaacttgagacacttag

SEQ ID NO: 267974 - DNA, 20 bp, Artificial Sequence
  Description of Artificial Sequence: Synthetic oligonucleotide
  Target: ATXN1; (+) strand; PAM type: YTN; PAM sequence: TTA
tgcaacttgagacacttagg

SEQ ID NO: 267975 - DNA, 20 bp, Artificial Sequence
  Description of Artificial Sequence: Synthetic oligonucleotide
  Target: ATXN1; (+) strand; PAM type: YTN; PAM sequence: CTT
gagacacttagggtaaaaac

SEQ ID NO: 267976 - DNA, 20 bp, Artificial Sequence
  Description of Artificial Sequence: Synthetic oligonucleotide
  Target: ATXN1; (+) strand; PAM type: YTN; PAM sequence: TTG
agacacttagggtaaaaacc

SEQ ID NO: 267977 - DNA, 20 bp, Artificial Sequence
  Description of Artificial Sequence: Synthetic oligonucleotide
  Target: ATXN1; (+) strand; PAM type: YTN; PAM sequence: CTT
agggtaaaaaccaccactgg

SEQ ID NO: 267978 - DNA, 20 bp, Artificial Sequence
  Description of Artificial Sequence: Synthetic oligonucleotide
  Target: ATXN1; (+) strand; PAM type: YTN; PAM sequence: TTA
gggtaaaaaccaccactgga

SEQ ID NO: 267979 - DNA, 20 bp, Artificial Sequence
  Description of Artificial Sequence: Synthetic oligonucleotide
  Target: ATXN1; (+) strand; PAM type: YTN; PAM sequence: CTG
gaggtgatttaactcaattt

SEQ ID NO: 267980 - DNA, 20 bp, Artificial Sequence
  Description of Artificial Sequence: Synthetic oligonucleotide
  Target: ATXN1; (+) strand; PAM type: YTN; PAM sequence: TTT
aactcaattttctcaagttg

SEQ ID NO: 267981 - DNA, 20 bp, Artificial Sequence
  Description of Artificial Sequence: Synthetic oligonucleotide
  Target: ATXN1; (+) strand; PAM type: YTN; PAM sequence: TTA
actcaattttctcaagttgt

SEQ ID NO: 267982 - DNA, 20 bp, Artificial Sequence
  Description of Artificial Sequence: Synthetic oligonucleotide
  Target: ATXN1; (+) strand; PAM type: YTN; PAM sequence: CTC
aattttctcaagttgtccat

SEQ ID NO: 267983 - DNA, 20 bp, Artificial Sequence
  Description of Artificial Sequence: Synthetic oligonucleotide
  Target: ATXN1; (+) strand; PAM type: YTN; PAM sequence: TTT
tctcaagttgtccatcataa

SEQ ID NO: 267984 - DNA, 20 bp, Artificial Sequence
  Description of Artificial Sequence: Synthetic oligonucleotide
  Target: ATXN1; (+) strand; PAM type: YTN; PAM sequence: TTT
ctcaagttgtccatcataaa

SEQ ID NO: 267985 - DNA, 20 bp, Artificial Sequence
  Description of Artificial Sequence: Synthetic oligonucleotide
  Target: ATXN1; (+) strand; PAM type: YTN; PAM sequence: TTC
tcaagttgtccatcataaaa

SEQ ID NO: 267986 - DNA, 20 bp, Artificial Sequence
  Description of Artificial Sequence: Synthetic oligonucleotide
  Target: ATXN1; (+) strand; PAM type: YTN; PAM sequence: CTC
aagttgtccatcataaaatg

SEQ ID NO: 267987 - DNA, 20 bp, Artificial Sequence
  Description of Artificial Sequence: Synthetic oligonucleotide
  Target: ATXN1; (+) strand; PAM type: YTN; PAM sequence: TTG
tccatcataaaatgagtccc

SEQ ID NO: 267988 - DNA, 20 bp, Artificial Sequence
  Description of Artificial Sequence: Synthetic oligonucleotide
  Target: ATXN1; (+) strand; PAM type: YTN; PAM sequence: TTA
tatggctaacaacagcattg

SEQ ID NO: 267989 - DNA, 20 bp, Artificial Sequence
  Description of Artificial Sequence: Synthetic oligonucleotide
  Target: ATXN1; (+) strand; PAM type: YTN; PAM sequence: CTA
acaacagcattgtgcataaa

SEQ ID NO: 267990 - DNA, 20 bp, Artificial Sequence
  Description of Artificial Sequence: Synthetic oligonucleotide
  Target: ATXN1; (+) strand; PAM type: YTN; PAM sequence: TTG
tgcataaaatccaggtctgc

SEQ ID NO: 267991 - DNA, 20 bp, Artificial Sequence
  Description of Artificial Sequence: Synthetic oligonucleotide
  Target: ATXN1; (+) strand; PAM type: YTN; PAM sequence: CTG
ctaactctgagttcagtgtc

SEQ ID NO: 267992 - DNA, 20 bp, Artificial Sequence
  Description of Artificial Sequence: Synthetic oligonucleotide
  Target: ATXN1; (+) strand; PAM type: YTN; PAM sequence: CTA
actctgagttcagtgtcagc

SEQ ID NO: 267993 - DNA, 20 bp, Artificial Sequence
  Description of Artificial Sequence: Synthetic oligonucleotide
  Target: ATXN1; (+) strand; PAM type: YTN; PAM sequence: CTC
tgagttcagtgtcagcatca

SEQ ID NO: 267994 - DNA, 20 bp, Artificial Sequence
  Description of Artificial Sequence: Synthetic oligonucleotide
  Target: ATXN1; (+) strand; PAM type: YTN; PAM sequence: CTG
agttcagtgtcagcatcatt

SEQ ID NO: 267995 - DNA, 20 bp, Artificial Sequence
  Description of Artificial Sequence: Synthetic oligonucleotide
  Target: ATXN1; (+) strand; PAM type: YTN; PAM sequence: TTC
agtgtcagcatcattctctt

SEQ ID NO: 267996 - DNA, 20 bp, Artificial Sequence
  Description of Artificial Sequence: Synthetic oligonucleotide
  Target: ATXN1; (+) strand; PAM type: YTN; PAM sequence: TTC
tcttcttgtacaagatcccc

SEQ ID NO: 267997 - DNA, 20 bp, Artificial Sequence
  Description of Artificial Sequence: Synthetic oligonucleotide
  Target: ATXN1; (+) strand; PAM type: YTN; PAM sequence: CTC
ttcttgtacaagatcccccc

SEQ ID NO: 267998 - DNA, 20 bp, Artificial Sequence
  Description of Artificial Sequence: Synthetic oligonucleotide
  Target: ATXN1; (+) strand; PAM type: YTN; PAM sequence: CTT
cttgtacaagatcccccctc

SEQ ID NO: 267999 - DNA, 20 bp, Artificial Sequence
  Description of Artificial Sequence: Synthetic oligonucleotide
  Target: ATXN1; (+) strand; PAM type: YTN; PAM sequence: TTC
ttgtacaagatcccccctcc

SEQ ID NO: 268000 - DNA, 20 bp, Artificial Sequence
  Description of Artificial Sequence: Synthetic oligonucleotide
  Target: ATXN1; (+) strand; PAM type: YTN; PAM sequence: CTT
gtacaagatcccccctcccc

SEQ ID NO: 268001 - DNA, 20 bp, Artificial Sequence
  Description of Artificial Sequence: Synthetic oligonucleotide
  Target: ATXN1; (+) strand; PAM type: YTN; PAM sequence: TTG
tacaagatcccccctccccc

SEQ ID NO: 268002 - DNA, 20 bp, Artificial Sequence
  Description of Artificial Sequence: Synthetic oligonucleotide
  Target: ATXN1; (+) strand; PAM type: YTN; PAM sequence: CTC
cccccagcccttacagccag

SEQ ID NO: 268003 - DNA, 20 bp, Artificial Sequence
  Description of Artificial Sequence: Synthetic oligonucleotide
  Target: ATXN1; (+) strand; PAM type: YTN; PAM sequence: CTT
acagccagtctgaaacatct

SEQ ID NO: 268004 - DNA, 20 bp, Artificial Sequence
  Description of Artificial Sequence: Synthetic oligonucleotide
  Target: ATXN1; (+) strand; PAM type: YTN; PAM sequence: TTA
cagccagtctgaaacatctt

SEQ ID NO: 268005 - DNA, 20 bp, Artificial Sequence
  Description of Artificial Sequence: Synthetic oligonucleotide
  Target: ATXN1; (+) strand; PAM type: YTN; PAM sequence: CTG
aaacatcttcaggggcaaag

SEQ ID NO: 268006 - DNA, 20 bp, Artificial Sequence
  Description of Artificial Sequence: Synthetic oligonucleotide
  Target: ATXN1; (+) strand; PAM type: YTN; PAM sequence: CTT
caggggcaaaggccatctgc

SEQ ID NO: 268007 - DNA, 20 bp, Artificial Sequence
  Description of Artificial Sequence: Synthetic oligonucleotide
  Target: ATXN1; (+) strand; PAM type: YTN; PAM sequence: TTC
aggggcaaaggccatctgct

SEQ ID NO: 268008 - DNA, 20 bp, Artificial Sequence
  Description of Artificial Sequence: Synthetic oligonucleotide
  Target: ATXN1; (+) strand; PAM type: YTN; PAM sequence: CTG
ctggcaagtggtggcagatt

SEQ ID NO: 268009 - DNA, 20 bp, Artificial Sequence
  Description of Artificial Sequence: Synthetic oligonucleotide
  Target: ATXN1; (+) strand; PAM type: YTN; PAM sequence: CTG
gcaagtggtggcagatttga

SEQ ID NO: 268010 - DNA, 20 bp, Artificial Sequence
  Description of Artificial Sequence: Synthetic oligonucleotide
  Target: ATXN1; (+) strand; PAM type: YTN; PAM sequence: TTT
gagaggcagttaatgggaca

SEQ ID NO: 268011 - DNA, 20 bp, Artificial Sequence
  Description of Artificial Sequence: Synthetic oligonucleotide
  Target: ATXN1; (+) strand; PAM type: YTN; PAM sequence: TTG
agaggcagttaatgggacat

SEQ ID NO: 268012 - DNA, 20 bp, Artificial Sequence
  Description of Artificial Sequence: Synthetic oligonucleotide
  Target: ATXN1; (+) strand; PAM type: YTN; PAM sequence: TTA
atgggacatgcacaggaatg

SEQ ID NO: 268013 - DNA, 20 bp, Artificial Sequence
  Description of Artificial Sequence: Synthetic oligonucleotide
  Target: ATXN1; (+) strand; PAM type: YTN; PAM sequence: CTG
caaggactgctgagcatggg

SEQ ID NO: 268014 - DNA, 20 bp, Artificial Sequence
  Description of Artificial Sequence: Synthetic oligonucleotide
  Target: ATXN1; (+) strand; PAM type: YTN; PAM sequence: CTG
ctgagcatgggaaccactac

SEQ ID NO: 268015 - DNA, 20 bp, Artificial Sequence
  Description of Artificial Sequence: Synthetic oligonucleotide
  Target: ATXN1; (+) strand; PAM type: YTN; PAM sequence: CTG
agcatgggaaccactacttc

SEQ ID NO: 268016 - DNA, 20 bp, Artificial Sequence
  Description of Artificial Sequence: Synthetic oligonucleotide
  Target: ATXN1; (+) strand; PAM type: YTN; PAM sequence: CTA
cttccaatggctgctgtgat

SEQ ID NO: 268017 - DNA, 20 bp, Artificial Sequence
  Description of Artificial Sequence: Synthetic oligonucleotide
  Target: ATXN1; (+) strand; PAM type: YTN; PAM sequence: CTT
ccaatggctgctgtgattat

SEQ ID NO: 268018 - DNA, 20 bp, Artificial Sequence
  Description of Artificial Sequence: Synthetic oligonucleotide
  Target: ATXN1; (+) strand; PAM type: YTN; PAM sequence: TTC
caatggctgctgtgattatc

SEQ ID NO: 268019 - DNA, 20 bp, Artificial Sequence
  Description of Artificial Sequence: Synthetic oligonucleotide
  Target: ATXN1; (+) strand; PAM type: YTN; PAM sequence: CTG
ctgtgattatcactcacaca

SEQ ID NO: 268020 - DNA, 20 bp, Artificial Sequence
  Description of Artificial Sequence: Synthetic oligonucleotide
  Target: ATXN1; (+) strand; PAM type: YTN; PAM sequence: CTG
tgattatcactcacacattt

SEQ ID NO: 268021 - DNA, 20 bp, Artificial Sequence
  Description of Artificial Sequence: Synthetic oligonucleotide
  Target: ATXN1; (+) strand; PAM type: YTN; PAM sequence: TTA
tcactcacacatttatacac

SEQ ID NO: 268022 - DNA, 20 bp, Artificial Sequence
  Description of Artificial Sequence: Synthetic oligonucleotide
  Target: ATXN1; (+) strand; PAM type: YTN; PAM sequence: CTC
acacatttatacacccactc

SEQ ID NO: 268023 - DNA, 20 bp, Artificial Sequence
  Description of Artificial Sequence: Synthetic oligonucleotide
  Target: ATXN1; (+) strand; PAM type: YTN; PAM sequence: TTT
atacacccactcctagaccc

SEQ ID NO: 268024 - DNA, 20 bp, Artificial Sequence
  Description of Artificial Sequence: Synthetic oligonucleotide
  Target: ATXN1; (+) strand; PAM type: YTN; PAM sequence: TTA
tacacccactcctagaccct

SEQ ID NO: 268025 - DNA, 20 bp, Artificial Sequence
  Description of Artificial Sequence: Synthetic oligonucleotide
  Target: ATXN1; (+) strand; PAM type: YTN; PAM sequence: CTC
ctagaccctgtttatgtgca

SEQ ID NO: 268026 - DNA, 20 bp, Artificial Sequence
  Description of Artificial Sequence: Synthetic oligonucleotide
  Target: ATXN1; (+) strand; PAM type: YTN; PAM sequence: CTA
gaccctgtttatgtgcaaac

SEQ ID NO: 268027 - DNA, 20 bp, Artificial Sequence
  Description of Artificial Sequence: Synthetic oligonucleotide
  Target: ATXN1; (+) strand; PAM type: YTN; PAM sequence: CTG
tttatgtgcaaacatgcatt

SEQ ID NO: 268028 - DNA, 20 bp, Artificial Sequence
  Description of Artificial Sequence: Synthetic oligonucleotide
  Target: ATXN1; (+) strand; PAM type: YTN; PAM sequence: TTT
atgtgcaaacatgcattctt

SEQ ID NO: 268029 - DNA, 20 bp, Artificial Sequence
  Description of Artificial Sequence: Synthetic oligonucleotide
  Target: ATXN1; (+) strand; PAM type: YTN; PAM sequence: TTA
tgtgcaaacatgcattcttt

SEQ ID NO: 268030 - DNA, 20 bp, Artificial Sequence
  Description of Artificial Sequence: Synthetic oligonucleotide
  Target: ATXN1; (+) strand; PAM type: YTN; PAM sequence: TTC
tttgaaaattgcctgccttc

SEQ ID NO: 268031 - DNA, 20 bp, Artificial Sequence
  Description of Artificial Sequence: Synthetic oligonucleotide
  Target: ATXN1; (+) strand; PAM type: YTN; PAM sequence: CTT
tgaaaattgcctgccttctc

SEQ ID NO: 268032 - DNA, 20 bp, Artificial Sequence
  Description of Artificial Sequence: Synthetic oligonucleotide
  Target: ATXN1; (+) strand; PAM type: YTN; PAM sequence: TTT
gaaaattgcctgccttctct

SEQ ID NO: 268033 - DNA, 20 bp, Artificial Sequence
  Description of Artificial Sequence: Synthetic oligonucleotide
  Target: ATXN1; (+) strand; PAM type: YTN; PAM sequence: TTG
aaaattgcctgccttctcta

SEQ ID NO: 268034 - DNA, 20 bp, Artificial Sequence
  Description of Artificial Sequence: Synthetic oligonucleotide
  Target: ATXN1; (+) strand; PAM type: YTN; PAM sequence: TTG
cctgccttctctactgcaac

SEQ ID NO: 268035 - DNA, 20 bp, Artificial Sequence
  Description of Artificial Sequence: Synthetic oligonucleotide
  Target: ATXN1; (+) strand; PAM type: YTN; PAM sequence: CTG
ccttctctactgcaacagtt

SEQ ID NO: 268036 - DNA, 20 bp, Artificial Sequence
  Description of Artificial Sequence: Synthetic oligonucleotide
  Target: ATXN1; (+) strand; PAM type: YTN; PAM sequence: CTT
ctctactgcaacagttctcc

SEQ ID NO: 268037 - DNA, 20 bp, Artificial Sequence
  Description of Artificial Sequence: Synthetic oligonucleotide
  Target: ATXN1; (+) strand; PAM type: YTN; PAM sequence: TTC
tctactgcaacagttctcca

SEQ ID NO: 268038 - DNA, 20 bp, Artificial Sequence
  Description of Artificial Sequence: Synthetic oligonucleotide
  Target: ATXN1; (+) strand; PAM type: YTN; PAM sequence: CTC
tactgcaacagttctccatg

SEQ ID NO: 268039 - DNA, 20 bp, Artificial Sequence
  Description of Artificial Sequence: Synthetic oligonucleotide
  Target: ATXN1; (+) strand; PAM type: YTN; PAM sequence: CTA
ctgcaacagttctccatggc

SEQ ID NO: 268040 - DNA, 20 bp, Artificial Sequence
  Description of Artificial Sequence: Synthetic oligonucleotide
  Target: ATXN1; (+) strand; PAM type: YTN; PAM sequence: CTG
caacagttctccatggcaca

SEQ ID NO: 268041 - DNA, 20 bp, Artificial Sequence
  Description of Artificial Sequence: Synthetic oligonucleotide
  Target: ATXN1; (+) strand; PAM type: YTN; PAM sequence: TTC
tccatggcacaggctttggg

SEQ ID NO: 268042 - DNA, 20 bp, Artificial Sequence
  Description of Artificial Sequence: Synthetic oligonucleotide
  Target: ATXN1; (+) strand; PAM type: YTN; PAM sequence: CTC
catggcacaggctttggggc

SEQ ID NO: 268043 - DNA, 20 bp, Artificial Sequence
  Description of Artificial Sequence: Synthetic oligonucleotide
  Target: ATXN1; (+) strand; PAM type: YTN; PAM sequence: CTT
tggggcatgcaggacactaa

SEQ ID NO: 268044 - DNA, 20 bp, Artificial Sequence
  Description of Artificial Sequence: Synthetic oligonucleotide
  Target: ATXN1; (+) strand; PAM type: YTN; PAM sequence: TTT
ggggcatgcaggacactaaa

SEQ ID NO: 268045 - DNA, 20 bp, Artificial Sequence
  Description of Artificial Sequence: Synthetic oligonucleotide
  Target: ATXN1; (+) strand; PAM type: YTN; PAM sequence: TTG
gggcatgcaggacactaaac

SEQ ID NO: 268046 - DNA, 20 bp, Artificial Sequence
  Description of Artificial Sequence: Synthetic oligonucleotide
  Target: ATXN1; (+) strand; PAM type: YTN; PAM sequence: CTA
aacccaggaagacagaaaac

SEQ ID NO: 268047 - DNA, 20 bp, Artificial Sequence
  Description of Artificial Sequence: Synthetic oligonucleotide
  Target: ATXN1; (+) strand; PAM type: YTN; PAM sequence: TTG
taaacatgtgcccagataat

SEQ ID NO: 268048 - DNA, 20 bp, Artificial Sequence
  Description of Artificial Sequence: Synthetic oligonucleotide
  Target: ATXN1; (+) strand; PAM type: YTN; PAM sequence: TTA
ccaacatcacagtttactaa

SEQ ID NO: 268049 - DNA, 20 bp, Artificial Sequence
  Description of Artificial Sequence: Synthetic oligonucleotide
  Target: ATXN1; (+) strand; PAM type: YTN; PAM sequence: TTT
actaagaaaactaggaaccc

SEQ ID NO: 268050 - DNA, 20 bp, Artificial Sequence
  Description of Artificial Sequence: Synthetic oligonucleotide
  Target: ATXN1; (+) strand; PAM type: YTN; PAM sequence: TTA
ctaagaaaactaggaacccc

SEQ ID NO: 268051 - DNA, 20 bp, Artificial Sequence
  Description of Artificial Sequence: Synthetic oligonucleotide
  Target: ATXN1; (+) strand; PAM type: YTN; PAM sequence: CTA
agaaaactaggaacccccca

SEQ ID NO: 268052 - DNA, 20 bp, Artificial Sequence
  Description of Artificial Sequence: Synthetic oligonucleotide
  Target: ATXN1; (+) strand; PAM type: YTN; PAM sequence: CTA
ggaaccccccactgccccta

SEQ ID NO: 268053 - DNA, 20 bp, Artificial Sequence
  Description of Artificial Sequence: Synthetic oligonucleotide
  Target: ATXN1; (+) strand; PAM type: YTN; PAM sequence: CTG
cccctaccaagcaaatgcgg

SEQ ID NO: 268054 - DNA, 20 bp, Artificial Sequence
  Description of Artificial Sequence: Synthetic oligonucleotide
  Target: ATXN1; (+) strand; PAM type: YTN; PAM sequence: CTA
ccaagcaaatgcggttttga

SEQ ID NO: 268055 - DNA, 20 bp, Artificial Sequence
  Description of Artificial Sequence: Synthetic oligonucleotide
  Target: ATXN1; (+) strand; PAM type: YTN; PAM sequence: TTT
tgaaaagaaagtacttagca

SEQ ID NO: 268056 - DNA, 20 bp, Artificial Sequence
  Description of Artificial Sequence: Synthetic oligonucleotide
  Target: ATXN1; (+) strand; PAM type: YTN; PAM sequence: TTT
gaaaagaaagtacttagcat

SEQ ID NO: 268057 - DNA, 20 bp, Artificial Sequence
  Description of Artificial Sequence: Synthetic oligonucleotide
  Target: ATXN1; (+) strand; PAM type: YTN; PAM sequence: TTG
aaaagaaagtacttagcatg

SEQ ID NO: 268058 - DNA, 20 bp, Artificial Sequence
  Description of Artificial Sequence: Synthetic oligonucleotide
  Target: ATXN1; (+) strand; PAM type: YTN; PAM sequence: CTT
agcatgcacaaagagttcac

SEQ ID NO: 268059 - DNA, 20 bp, Artificial Sequence
  Description of Artificial Sequence: Synthetic oligonucleotide
  Target: ATXN1; (+) strand; PAM type: YTN; PAM sequence: TTA
gcatgcacaaagagttcact

SEQ ID NO: 268060 - DNA, 20 bp, Artificial Sequence
  Description of Artificial Sequence: Synthetic oligonucleotide
  Target: ATXN1; (+) strand; PAM type: YTN; PAM sequence: TTC
actagaatttggtatttcct

SEQ ID NO: 268061 - DNA, 20 bp, Artificial Sequence
  Description of Artificial Sequence: Synthetic oligonucleotide
  Target: ATXN1; (+) strand; PAM type: YTN; PAM sequence: CTA
gaatttggtatttccttgct

SEQ ID NO: 268062 - DNA, 20 bp, Artificial Sequence
  Description of Artificial Sequence: Synthetic oligonucleotide
  Target: ATXN1; (+) strand; PAM type: YTN; PAM sequence: TTT
ggtatttccttgctctctca

SEQ ID NO: 268063 - DNA, 20 bp, Artificial Sequence
  Description of Artificial Sequence: Synthetic oligonucleotide
  Target: ATXN1; (+) strand; PAM type: YTN; PAM sequence: TTG
gtatttccttgctctctcaa

SEQ ID NO: 268064 - DNA, 20 bp, Artificial Sequence
  Description of Artificial Sequence: Synthetic oligonucleotide
  Target: ATXN1; (+) strand; PAM type: YTN; PAM sequence: TTT
ccttgctctctcaacacact

SEQ ID NO: 268065 - DNA, 20 bp, Artificial Sequence
  Description of Artificial Sequence: Synthetic oligonucleotide
  Target: ATXN1; (+) strand; PAM type: YTN; PAM sequence: TTC
cttgctctctcaacacactc

SEQ ID NO: 268066 - DNA, 20 bp, Artificial Sequence
  Description of Artificial Sequence: Synthetic oligonucleotide
  Target: ATXN1; (+) strand; PAM type: YTN; PAM sequence: CTT
gctctctcaacacactccat

SEQ ID NO: 268067 - DNA, 20 bp, Artificial Sequence
  Description of Artificial Sequence: Synthetic oligonucleotide
  Target: ATXN1; (+) strand; PAM type: YTN; PAM sequence: TTG
ctctctcaacacactccatt

SEQ ID NO: 268068 - DNA, 20 bp, Artificial Sequence
  Description of Artificial Sequence: Synthetic oligonucleotide
  Target: ATXN1; (+) strand; PAM type: YTN; PAM sequence: CTC
tctcaacacactccatttac

SEQ ID NO: 268069 - DNA, 20 bp, Artificial Sequence
  Description of Artificial Sequence: Synthetic oligonucleotide
  Target: ATXN1; (+) strand; PAM type: YTN; PAM sequence: CTC
tcaacacactccatttacag

SEQ ID NO: 268070 - DNA, 20 bp, Artificial Sequence
  Description of Artificial Sequence: Synthetic oligonucleotide
  Target: ATXN1; (+) strand; PAM type: YTN; PAM sequence: CTC
aacacactccatttacagaa

SEQ ID NO: 268071 - DNA, 20 bp, Artificial Sequence
  Description of Artificial Sequence: Synthetic oligonucleotide
  Target: ATXN1; (+) strand; PAM type: YTN; PAM sequence: CTC
catttacagaaggattttaa

SEQ ID NO: 268072 - DNA, 20 bp, Artificial Sequence
  Description of Artificial Sequence: Synthetic oligonucleotide
  Target: ATXN1; (+) strand; PAM type: YTN; PAM sequence: TTT
acagaaggattttaaaatta

SEQ ID NO: 268073 - DNA, 20 bp, Artificial Sequence
  Description of Artificial Sequence: Synthetic oligonucleotide
  Target: ATXN1; (+) strand; PAM type: YTN; PAM sequence: TTA
cagaaggattttaaaattac

SEQ ID NO: 268074 - DNA, 20 bp, Artificial Sequence
  Description of Artificial Sequence: Synthetic oligonucleotide
  Target: ATXN1; (+) strand; PAM type: YTN; PAM sequence: TTT
taaaattacttcaagtctgc

SEQ ID NO: 268075 - DNA, 20 bp, Artificial Sequence
  Description of Artificial Sequence: Synthetic oligonucleotide
  Target: ATXN1; (+) strand; PAM type: YTN; PAM sequence: TTT
aaaattacttcaagtctgcc

SEQ ID NO: 268076 - DNA, 20 bp, Artificial Sequence
  Description of Artificial Sequence: Synthetic oligonucleotide
  Target: ATXN1; (+) strand; PAM type: YTN; PAM sequence: TTA
aaattacttcaagtctgcca

SEQ ID NO: 268077 - DNA, 20 bp, Artificial Sequence
  Description of Artificial Sequence: Synthetic oligonucleotide
  Target: ATXN1; (+) strand; PAM type: YTN; PAM sequence: TTA
cttcaagtctgccatgtggc

SEQ ID NO: 268078 - DNA, 20 bp, Artificial Sequence
  Description of Artificial Sequence: Synthetic oligonucleotide
  Target: ATXN1; (+) strand; PAM type: YTN; PAM sequence: CTT
caagtctgccatgtggcatc

SEQ ID NO: 268079 - DNA, 20 bp, Artificial Sequence
  Description of Artificial Sequence: Synthetic oligonucleotide
  Target: ATXN1; (+) strand; PAM type: YTN; PAM sequence: TTC
aagtctgccatgtggcatct

SEQ ID NO: 268080 - DNA, 20 bp, Artificial Sequence
  Description of Artificial Sequence: Synthetic oligonucleotide
  Target: ATXN1; (+) strand; PAM type: YTN; PAM sequence: CTG
ccatgtggcatcttaaagtg

SEQ ID NO: 268081 - DNA, 20 bp, Artificial Sequence
  Description of Artificial Sequence: Synthetic oligonucleotide
  Target: ATXN1; (+) strand; PAM type: YTN; PAM sequence: CTT
aaagtgtacacttcagaagt

SEQ ID NO: 268082 - DNA, 20 bp, Artificial Sequence
  Description of Artificial Sequence: Synthetic oligonucleotide
  Target: ATXN1; (+) strand; PAM type: YTN; PAM sequence: TTA
aagtgtacacttcagaagtc

SEQ ID NO: 268083 - DNA, 20 bp, Artificial Sequence
  Description of Artificial Sequence: Synthetic oligonucleotide
  Target: ATXN1; (+) strand; PAM type: YTN; PAM sequence: CTT
cagaagtcctttgaaaacct

SEQ ID NO: 268084 - DNA, 20 bp, Artificial Sequence
  Description of Artificial Sequence: Synthetic oligonucleotide
  Target: ATXN1; (+) strand; PAM type: YTN; PAM sequence: TTC
agaagtcctttgaaaacctc

SEQ ID NO: 268085 - DNA, 20 bp, Artificial Sequence
  Description of Artificial Sequence: Synthetic oligonucleotide
  Target: ATXN1; (+) strand; PAM type: YTN; PAM sequence: CTT
tgaaaacctcactcaatctt

SEQ ID NO: 268086 - DNA, 20 bp, Artificial Sequence
  Description of Artificial Sequence: Synthetic oligonucleotide
  Target: ATXN1; (+) strand; PAM type: YTN; PAM sequence: TTT
gaaaacctcactcaatcttt

SEQ ID NO: 268087 - DNA, 20 bp, Artificial Sequence
  Description of Artificial Sequence: Synthetic oligonucleotide
  Target: ATXN1; (+) strand; PAM type: YTN; PAM sequence: TTG
aaaacctcactcaatctttg

SEQ ID NO: 268088 - DNA, 20 bp, Artificial Sequence
  Description of Artificial Sequence: Synthetic oligonucleotide
  Target: ATXN1; (+) strand; PAM type: YTN; PAM sequence: CTC
actcaatctttgaggtctga

SEQ ID NO: 268089 - DNA, 20 bp, Artificial Sequence
  Description of Artificial Sequence: Synthetic oligonucleotide
  Target: ATXN1; (+) strand; PAM type: YTN; PAM sequence: CTC
aatctttgaggtctgacagg

SEQ ID NO: 268090 - DNA, 20 bp, Artificial Sequence
  Description of Artificial Sequence: Synthetic oligonucleotide
  Target: ATXN1; (+) strand; PAM type: YTN; PAM sequence: CTT
tgaggtctgacagggtgtca

SEQ ID NO: 268091 - DNA, 20 bp, Artificial Sequence
  Description of Artificial Sequence: Synthetic oligonucleotide
  Target: ATXN1; (+) strand; PAM type: YTN; PAM sequence: TTT
gaggtctgacagggtgtcac

SEQ ID NO: 268092 - DNA, 20 bp, Artificial Sequence
  Description of Artificial Sequence: Synthetic oligonucleotide
  Target: ATXN1; (+) strand; PAM type: YTN; PAM sequence: TTG
aggtctgacagggtgtcaca

SEQ ID NO: 268093 - DNA, 20 bp, Artificial Sequence
  Description of Artificial Sequence: Synthetic oligonucleotide
  Target: ATXN1; (+) strand; PAM type: YTN; PAM sequence: CTG
acagggtgtcacatgaacag

SEQ ID NO: 268094 - DNA, 20 bp, Artificial Sequence
  Description of Artificial Sequence: Synthetic oligonucleotide
  Target: ATXN1; (+) strand; PAM type: YTN; PAM sequence: TTC
aaagcaacggttaaaacaac

SEQ ID NO: 268095 - DNA, 20 bp, Artificial Sequence
  Description of Artificial Sequence: Synthetic oligonucleotide
  Target: ATXN1; (+) strand; PAM type: YTN; PAM sequence: TTA
aaacaacaacaaaaaacccc

SEQ ID NO: 268096 - DNA, 20 bp, Artificial Sequence
  Description of Artificial Sequence: Synthetic oligonucleotide
  Target: ATXN1; (+) strand; PAM type: YTN; PAM sequence: CTA
gatttgaaacaaaagctatc

SEQ ID NO: 268097 - DNA, 20 bp, Artificial Sequence
  Description of Artificial Sequence: Synthetic oligonucleotide
  Target: ATXN1; (+) strand; PAM type: YTN; PAM sequence: TTT
gaaacaaaagctatcttgat

SEQ ID NO: 268098 - DNA, 20 bp, Artificial Sequence
  Description of Artificial Sequence: Synthetic oligonucleotide
  Target: ATXN1; (+) strand; PAM type: YTN; PAM sequence: TTG
aaacaaaagctatcttgatt

SEQ ID NO: 268099 - DNA, 20 bp, Artificial Sequence
  Description of Artificial Sequence: Synthetic oligonucleotide
  Target: ATXN1; (+) strand; PAM type: YTN; PAM sequence: CTA
tcttgattatggtaactgca

SEQ ID NO: 268100 - DNA, 20 bp, Artificial Sequence
  Description of Artificial Sequence: Synthetic oligonucleotide
  Target: ATXN1; (+) strand; PAM type: YTN; PAM sequence: CTT
gattatggtaactgcatgag

SEQ ID NO: 268101 - DNA, 20 bp, Artificial Sequence
  Description of Artificial Sequence: Synthetic oligonucleotide
  Target: ATXN1; (+) strand; PAM type: YTN; PAM sequence: TTG
attatggtaactgcatgagt

SEQ ID NO: 268102 - DNA, 20 bp, Artificial Sequence
  Description of Artificial Sequence: Synthetic oligonucleotide
  Target: ATXN1; (+) strand; PAM type: YTN; PAM sequence: TTA
tggtaactgcatgagttatt

SEQ ID NO: 268103 - DNA, 20 bp, Artificial Sequence
  Description of Artificial Sequence: Synthetic oligonucleotide
  Target: ATXN1; (+) strand; PAM type: YTN; PAM sequence: CTG
catgagttatttaaatagag

SEQ ID NO: 268104 - DNA, 20 bp, Artificial Sequence
  Description of Artificial Sequence: Synthetic oligonucleotide
  Target: ATXN1; (+) strand; PAM type: YTN; PAM sequence: TTA
tttaaatagagcctgaaacc

SEQ ID NO: 268105 - DNA, 20 bp, Artificial Sequence
  Description of Artificial Sequence: Synthetic oligonucleotide
  Target: ATXN1; (+) strand; PAM type: YTN; PAM sequence: TTT
aaatagagcctgaaacctaa

SEQ ID NO: 268106 - DNA, 20 bp, Artificial Sequence
  Description of Artificial Sequence: Synthetic oligonucleotide
  Target: ATXN1; (+) strand; PAM type: YTN; PAM sequence: TTA
aatagagcctgaaacctaaa

SEQ ID NO: 268107 - DNA, 20 bp, Artificial Sequence
  Description of Artificial Sequence: Synthetic oligonucleotide
  Target: ATXN1; (+) strand; PAM type: YTN; PAM sequence: CTG
aaacctaaagcagttttaca

SEQ ID NO: 268108 - DNA, 20 bp, Artificial Sequence
  Description of Artificial Sequence: Synthetic oligonucleotide
  Target: ATXN1; (+) strand; PAM type: YTN; PAM sequence: CTA
aagcagttttacataagaca

SEQ ID NO: 268109 - DNA, 20 bp, Artificial Sequence
  Description of Artificial Sequence: Synthetic oligonucleotide
  Target: ATXN1; (+) strand; PAM type: YTN; PAM sequence: TTT
tacataagacacttgtttcc

SEQ ID NO: 268110 - DNA, 20 bp, Artificial Sequence
  Description of Artificial Sequence: Synthetic oligonucleotide
  Target: ATXN1; (+) strand; PAM type: YTN; PAM sequence: TTT
acataagacacttgtttcct

SEQ ID NO: 268111 - DNA, 20 bp, Artificial Sequence
  Description of Artificial Sequence: Synthetic oligonucleotide
  Target: ATXN1; (+) strand; PAM type: YTN; PAM sequence: TTA
cataagacacttgtttccta

SEQ ID NO: 268112 - DNA, 20 bp, Artificial Sequence
  Description of Artificial Sequence: Synthetic oligonucleotide
  Target: ATXN1; (+) strand; PAM type: YTN; PAM sequence: CTT
gtttcctaggataaaaatgc

SEQ ID NO: 268113 - DNA, 20 bp, Artificial Sequence
  Description of Artificial Sequence: Synthetic oligonucleotide
  Target: ATXN1; (+) strand; PAM type: YTN; PAM sequence: TTG
tttcctaggataaaaatgct

SEQ ID NO: 268114 - DNA, 20 bp, Artificial Sequence
  Description of Artificial Sequence: Synthetic oligonucleotide
  Target: ATXN1; (+) strand; PAM type: YTN; PAM sequence: TTT
cctaggataaaaatgcttta

SEQ ID NO: 268115 - DNA, 20 bp, Artificial Sequence
  Description of Artificial Sequence: Synthetic oligonucleotide
  Target: ATXN1; (+) strand; PAM type: YTN; PAM sequence: TTC
ctaggataaaaatgctttaa

SEQ ID NO: 268116 - DNA, 20 bp, Artificial Sequence
  Description of Artificial Sequence: Synthetic oligonucleotide
  Target: ATXN1; (+) strand; PAM type: YTN; PAM sequence: CTA
ggataaaaatgctttaaaaa

SEQ ID NO: 268117 - DNA, 20 bp, Artificial Sequence
  Description of Artificial Sequence: Synthetic oligonucleotide
  Target: ATXN1; (+) strand; PAM type: YTN; PAM sequence: CTT
taaaaaataccaccagaagt

SEQ ID NO: 268118 - DNA, 20 bp, Artificial Sequence
  Description of Artificial Sequence: Synthetic oligonucleotide
  Target: ATXN1; (+) strand; PAM type: YTN; PAM sequence: TTT
aaaaaataccaccagaagtg

SEQ ID NO: 268119 - DNA, 20 bp, Artificial Sequence
  Description of Artificial Sequence: Synthetic oligonucleotide
  Target: ATXN1; (+) strand; PAM type: YTN; PAM sequence: TTA
aaaaataccaccagaagtgc

SEQ ID NO: 268120 - DNA, 20 bp, Artificial Sequence
  Description of Artificial Sequence: Synthetic oligonucleotide
  Target: ATXN1; (+) strand; PAM type: YTN; PAM sequence: TTC
taacagttacctgattggga

SEQ ID NO: 268121 - DNA, 20 bp, Artificial Sequence
  Description of Artificial Sequence: Synthetic oligonucleotide
  Target: ATXN1; (+) strand; PAM type: YTN; PAM sequence: CTA
acagttacctgattgggaaa

SEQ ID NO: 268122 - DNA, 20 bp, Artificial Sequence
  Description of Artificial Sequence: Synthetic oligonucleotide
  Target: ATXN1; (+) strand; PAM type: YTN; PAM sequence: TTA
cctgattgggaaaatgattt

SEQ ID NO: 268123 - DNA, 20 bp, Artificial Sequence
  Description of Artificial Sequence: Synthetic oligonucleotide
  Target: ATXN1; (+) strand; PAM type: YTN; PAM sequence: CTG
attgggaaaatgatttctag

SEQ ID NO: 268124 - DNA, 20 bp, Artificial Sequence
  Description of Artificial Sequence: Synthetic oligonucleotide
  Target: ATXN1; (+) strand; PAM type: YTN; PAM sequence: TTG
ggaaaatgatttctagtaaa

SEQ ID NO: 268125 - DNA, 20 bp, Artificial Sequence
  Description of Artificial Sequence: Synthetic oligonucleotide
  Target: ATXN1; (+) strand; PAM type: YTN; PAM sequence: TTT
ctagtaaaacacactgtaac

SEQ ID NO: 268126 - DNA, 20 bp, Artificial Sequence
  Description of Artificial Sequence: Synthetic oligonucleotide
  Target: ATXN1; (+) strand; PAM type: YTN; PAM sequence: TTC
tagtaaaacacactgtaact

SEQ ID NO: 268127 - DNA, 20 bp, Artificial Sequence
  Description of Artificial Sequence: Synthetic oligonucleotide
  Target: ATXN1; (+) strand; PAM type: YTN; PAM sequence: CTA
gtaaaacacactgtaactgg

SEQ ID NO: 268128 - DNA, 20 bp, Artificial Sequence
  Description of Artificial Sequence: Synthetic oligonucleotide
  Target: ATXN1; (+) strand; PAM type: YTN; PAM sequence: CTG
taactggagtacccaaatct

SEQ ID NO: 268129 - DNA, 20 bp, Artificial Sequence
  Description of Artificial Sequence: Synthetic oligonucleotide
  Target: ATXN1; (+) strand; PAM type: YTN; PAM sequence: CTG
gagtacccaaatctaacatg

SEQ ID NO: 268130 - DNA, 20 bp, Artificial Sequence
  Description of Artificial Sequence: Synthetic oligonucleotide
  Target: ATXN1; (+) strand; PAM type: YTN; PAM sequence: CTA
acatggcccacaattattcc

SEQ ID NO: 268131 - DNA, 20 bp, Artificial Sequence
  Description of Artificial Sequence: Synthetic oligonucleotide
  Target: ATXN1; (+) strand; PAM type: YTN; PAM sequence: TTA
ttccttgatagtgacagaaa

SEQ ID NO: 268132 - DNA, 20 bp, Artificial Sequence
  Description of Artificial Sequence: Synthetic oligonucleotide
  Target: ATXN1; (+) strand; PAM type: YTN; PAM sequence: TTC
cttgatagtgacagaaactt

SEQ ID NO: 268133 - DNA, 20 bp, Artificial Sequence
  Description of Artificial Sequence: Synthetic oligonucleotide
  Target: ATXN1; (+) strand; PAM type: YTN; PAM sequence: CTT
gatagtgacagaaactttta

SEQ ID NO: 268134 - DNA, 20 bp, Artificial Sequence
  Description of Artificial Sequence: Synthetic oligonucleotide
  Target: ATXN1; (+) strand; PAM type: YTN; PAM sequence: TTG
atagtgacagaaacttttac

SEQ ID NO: 268135 - DNA, 20 bp, Artificial Sequence
  Description of Artificial Sequence: Synthetic oligonucleotide
  Target: ATXN1; (+) strand; PAM type: YTN; PAM sequence: CTT
ttacaataaggtttttttta

SEQ ID NO: 268136 - DNA, 20 bp, Artificial Sequence
  Description of Artificial Sequence: Synthetic oligonucleotide
  Target: ATXN1; (+) strand; PAM type: YTN; PAM sequence: TTT
tacaataaggttttttttaa

SEQ ID NO: 268137 - DNA, 20 bp, Artificial Sequence
  Description of Artificial Sequence: Synthetic oligonucleotide
  Target: ATXN1; (+) strand; PAM type: YTN; PAM sequence: TTT
acaataaggttttttttaaa

SEQ ID NO: 268138 - DNA, 20 bp, Artificial Sequence
  Description of Artificial Sequence: Synthetic oligonucleotide
  Target: ATXN1; (+) strand; PAM type: YTN; PAM sequence: TTA
caataaggttttttttaaaa

SEQ ID NO: 268139 - DNA, 20 bp, Artificial Sequence
  Description of Artificial Sequence: Synthetic oligonucleotide
  Target: ATXN1; (+) strand; PAM type: YTN; PAM sequence: TTT
tttttaaaaaaataagtaaa

SEQ ID NO: 268140 - DNA, 20 bp, Artificial Sequence
  Description of Artificial Sequence: Synthetic oligonucleotide
  Target: ATXN1; (+) strand; PAM type: YTN; PAM sequence: TTT
ttttaaaaaaataagtaaaa

SEQ ID NO: 268141 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaataagtaaaat

SEQ ID NO: 268142 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaataagtaaaata

SEQ ID NO: 268143 - DNA, 20 bp, Artificial Sequence
  Description of Artificial Sequence: Synthetic oligonucleotide
  Target: ATXN1; (+) strand; PAM type: YTN; PAM sequence: TTT
taaaaaaataagtaaaatag

SEQ ID NO: 268144 - DNA, 20 bp, Artificial Sequence
  Description of Artificial Sequence: Synthetic oligonucleotide
  Target: ATXN1; (+) strand; PAM type: YTN; PAM sequence: TTT
aaaaaaataagtaaaatagt

SEQ ID NO: 268145 - DNA, 20 bp, Artificial Sequence
  Description of Artificial Sequence: Synthetic oligonucleotide
  Target: ATXN1; (+) strand; PAM type: YTN; PAM sequence: TTA
aaaaaataagtaaaatagtg

SEQ ID NO: 268146 - DNA, 20 bp, Artificial Sequence
  Description of Artificial Sequence: Synthetic oligonucleotide
  Target: ATXN1; (+) strand; PAM type: YTN; PAM sequence: CTT
tcacaatgctcttcccctta

SEQ ID NO: 268147 - DNA, 20 bp, Artificial Sequence
  Description of Artificial Sequence: Synthetic oligonucleotide
  Target: ATXN1; (+) strand; PAM type: YTN; PAM sequence: TTT
cacaatgctcttccccttat

SEQ ID NO: 268148 - DNA, 20 bp, Artificial Sequence
  Description of Artificial Sequence: Synthetic oligonucleotide
  Target: ATXN1; (+) strand; PAM type: YTN; PAM sequence: TTC
acaatgctcttccccttatg

SEQ ID NO: 268149 - DNA, 20 bp, Artificial Sequence
  Description of Artificial Sequence: Synthetic oligonucleotide
  Target: ATXN1; (+) strand; PAM type: YTN; PAM sequence: CTC
ttccccttatgaggacccta

SEQ ID NO: 268150 - DNA, 20 bp, Artificial Sequence
  Description of Artificial Sequence: Synthetic oligonucleotide
  Target: ATXN1; (+) strand; PAM type: YTN; PAM sequence: CTT
ccccttatgaggaccctaaa

SEQ ID NO: 268151 - DNA, 20 bp, Artificial Sequence
  Description of Artificial Sequence: Synthetic oligonucleotide
  Target: ATXN1; (+) strand; PAM type: YTN; PAM sequence: TTC
cccttatgaggaccctaaac

SEQ ID NO: 268152 - DNA, 20 bp, Artificial Sequence
  Description of Artificial Sequence: Synthetic oligonucleotide
  Target: ATXN1; (+) strand; PAM type: YTN; PAM sequence: CTT
atgaggaccctaaaccaaga

SEQ ID NO: 268153 - DNA, 20 bp, Artificial Sequence
  Description of Artificial Sequence: Synthetic oligonucleotide
  Target: ATXN1; (+) strand; PAM type: YTN; PAM sequence: TTA
tgaggaccctaaaccaagat

SEQ ID NO: 268154 - DNA, 20 bp, Artificial Sequence
  Description of Artificial Sequence: Synthetic oligonucleotide
  Target: ATXN1; (+) strand; PAM type: YTN; PAM sequence: CTA
aaccaagatgctgattgctt

SEQ ID NO: 268155 - DNA, 20 bp, Artificial Sequence
  Description of Artificial Sequence: Synthetic oligonucleotide
  Target: ATXN1; (+) strand; PAM type: YTN; PAM sequence: CTG
attgcttaataaaaaggtag

SEQ ID NO: 268156 - DNA, 20 bp, Artificial Sequence
  Description of Artificial Sequence: Synthetic oligonucleotide
  Target: ATXN1; (+) strand; PAM type: YTN; PAM sequence: TTG
cttaataaaaaggtagtatg

SEQ ID NO: 268157 - DNA, 20 bp, Artificial Sequence
  Description of Artificial Sequence: Synthetic oligonucleotide
  Target: ATXN1; (+) strand; PAM type: YTN; PAM sequence: CTT
aataaaaaggtagtatgggc

SEQ ID NO: 268158 - DNA, 20 bp, Artificial Sequence
  Description of Artificial Sequence: Synthetic oligonucleotide
  Target: ATXN1; (+) strand; PAM type: YTN; PAM sequence: TTA
ataaaaaggtagtatgggct

SEQ ID NO: 268159 - DNA, 20 bp, Artificial Sequence
  Description of Artificial Sequence: Synthetic oligonucleotide
  Target: ATXN1; (+) strand; PAM type: YTN; PAM sequence: CTG
gggatggtggctcatgcctg

SEQ ID NO: 268160 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcaaaacatt

SEQ ID NO: 268161 - DNA, 20 bp, Artificial Sequence
  Description of Artificial Sequence: Synthetic oligonucleotide
  Target: ATXN1; (+) strand; PAM type: YTN; PAM sequence: CTG
taatcaaaacattttgggaa

SEQ ID NO: 268162 - DNA, 20 bp, Artificial Sequence
  Description of Artificial Sequence: Synthetic oligonucleotide
  Target: ATXN1; (+) strand; PAM type: YTN; PAM sequence: TTT
tgggaagcagaggcgggagg

SEQ ID NO: 268163 - DNA, 20 bp, Artificial Sequence
  Description of Artificial Sequence: Synthetic oligonucleotide
  Target: ATXN1; (+) strand; PAM type: YTN; PAM sequence: TTT
gggaagcagaggcgggagga

SEQ ID NO: 268164 - DNA, 20 bp, Artificial Sequence
  Description of Artificial Sequence: Synthetic oligonucleotide
  Target: ATXN1; (+) strand; PAM type: YTN; PAM sequence: TTG
ggaagcagaggcgggaggat

SEQ ID NO: 268165 - DNA, 20 bp, Artificial Sequence
  Description of Artificial Sequence: Synthetic oligonucleotide
  Target: ATXN1; (+) strand; PAM type: YTN; PAM sequence: CTT
gagctcagtagttcaagacc

SEQ ID NO: 268166 - DNA, 20 bp, Artificial Sequence
  Description of Artificial Sequence: Synthetic oligonucleotide
  Target: ATXN1; (+) strand; PAM type: YTN; PAM sequence: TTG
agctcagtagttcaagacca

SEQ ID NO: 268167 - DNA, 20 bp, Artificial Sequence
  Description of Artificial Sequence: Synthetic oligonucleotide
  Target: ATXN1; (+) strand; PAM type: YTN; PAM sequence: CTC
agtagttcaagaccagcctg

SEQ ID NO: 268168 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctgagcaacat

SEQ ID NO: 268169 - DNA, 20 bp, Artificial Sequence
  Description of Artificial Sequence: Synthetic oligonucleotide
  Target: ATXN1; (+) strand; PAM type: YTN; PAM sequence: CTG
agcaacatggtgaaactctg

SEQ ID NO: 268170 - DNA, 20 bp, Artificial Sequence
  Description of Artificial Sequence: Synthetic oligonucleotide
  Target: ATXN1; (+) strand; PAM type: YTN; PAM sequence: CTC
tgtctctaccaaaaatacaa

SEQ ID NO: 268171 - DNA, 20 bp, Artificial Sequence
  Description of Artificial Sequence: Synthetic oligonucleotide
  Target: ATXN1; (+) strand; PAM type: YTN; PAM sequence: CTG
tctctaccaaaaatacaaaa

SEQ ID NO: 268172 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatacaaaaaatt

SEQ ID NO: 268173 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatacaaaaaattag

SEQ ID NO: 268174 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggtgtgca

SEQ ID NO: 268175 - DNA, 20 bp, Artificial Sequence
  Description of Artificial Sequence: Synthetic oligonucleotide
  Target: ATXN1; (+) strand; PAM type: YTN; PAM sequence: CTG
tggtcccagctactctgaag

SEQ ID NO: 268176 - DNA, 20 bp, Artificial Sequence
  Description of Artificial Sequence: Synthetic oligonucleotide
  Target: ATXN1; (+) strand; PAM type: YTN; PAM sequence: CTA
ctctgaaggctgaggtggga

SEQ ID NO: 268177 - DNA, 20 bp, Artificial Sequence
  Description of Artificial Sequence: Synthetic oligonucleotide
  Target: ATXN1; (+) strand; PAM type: YTN; PAM sequence: CTC
tgaaggctgaggtgggaggg

SEQ ID NO: 268178 - DNA, 20 bp, Artificial Sequence
  Description of Artificial Sequence: Synthetic oligonucleotide
  Target: ATXN1; (+) strand; PAM type: YTN; PAM sequence: CTG
aaggctgaggtgggagggtc

SEQ ID NO: 268179 - DNA, 20 bp, Artificial Sequence
  Description of Artificial Sequence: Synthetic oligonucleotide
  Target: ATXN1; (+) strand; PAM type: YTN; PAM sequence: CTG
aggtgggagggtcacttgag

SEQ ID NO: 268180 - DNA, 20 bp, Artificial Sequence
  Description of Artificial Sequence: Synthetic oligonucleotide
  Target: ATXN1; (+) strand; PAM type: YTN; PAM sequence: CTT
gagcttgggaggcagaggtt

SEQ ID NO: 268181 - DNA, 20 bp, Artificial Sequence
  Description of Artificial Sequence: Synthetic oligonucleotide
  Target: ATXN1; (+) strand; PAM type: YTN; PAM sequence: TTG
agcttgggaggcagaggttg

SEQ ID NO: 268182 - DNA, 20 bp, Artificial Sequence
  Description of Artificial Sequence: Synthetic oligonucleotide
  Target: ATXN1; (+) strand; PAM type: YTN; PAM sequence: CTT
gggaggcagaggttgcagtg

SEQ ID NO: 268183 - DNA, 20 bp, Artificial Sequence
  Description of Artificial Sequence: Synthetic oligonucleotide
  Target: ATXN1; (+) strand; PAM type: YTN; PAM sequence: TTG
ggaggcagaggttgcagtga

SEQ ID NO: 268184 - DNA, 20 bp, Artificial Sequence
  Description of Artificial Sequence: Synthetic oligonucleotide
  Target: ATXN1; (+) strand; PAM type: YTN; PAM sequence: TTG
cagtgaatcgagatcttgcc

SEQ ID NO: 268185 - DNA, 20 bp, Artificial Sequence
  Description of Artificial Sequence: Synthetic oligonucleotide
  Target: ATXN1; (+) strand; PAM type: YTN; PAM sequence: CTT
gccattgcactccagcctgg

SEQ ID NO: 268186 - DNA, 20 bp, Artificial Sequence
  Description of Artificial Sequence: Synthetic oligonucleotide
  Target: ATXN1; (+) strand; PAM type: YTN; PAM sequence: TTG
ccattgcactccagcctggg

SEQ ID NO: 268187 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggtgacag

SEQ ID NO: 268188 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagtaa

SEQ ID NO: 268189 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtaaggcacca

SEQ ID NO: 268190 - DNA, 20 bp, Artificial Sequence
  Description of Artificial Sequence: Synthetic oligonucleotide
  Target: ATXN1; (+) strand; PAM type: YTN; PAM sequence: CTC
aattaaaaagaaaaaaatga

SEQ ID NO: 268191 - DNA, 20 bp, Artificial Sequence
  Description of Artificial Sequence: Synthetic oligonucleotide
  Target: ATXN1; (+) strand; PAM type: YTN; PAM sequence: TTA
aaaagaaaaaaatgaaaata

SEQ ID NO: 268192 - DNA, 20 bp, Artificial Sequence
  Description of Artificial Sequence: Synthetic oligonucleotide
  Target: ATXN1; (+) strand; PAM type: YTN; PAM sequence: CTT
gcaaaatattgttttatggg

SEQ ID NO: 268193 - DNA, 20 bp, Artificial Sequence
  Description of Artificial Sequence: Synthetic oligonucleotide
  Target: ATXN1; (+) strand; PAM type: YTN; PAM sequence: TTG
caaaatattgttttatgggg

SEQ ID NO: 268194 - DNA, 20 bp, Artificial Sequence
  Description of Artificial Sequence: Synthetic oligonucleotide
  Target: ATXN1; (+) strand; PAM type: YTN; PAM sequence: TTG
ttttatgggggctcgcgact

SEQ ID NO: 268195 - DNA, 20 bp, Artificial Sequence
  Description of Artificial Sequence: Synthetic oligonucleotide
  Target: ATXN1; (+) strand; PAM type: YTN; PAM sequence: TTT
tatgggggctcgcgacttgc

SEQ ID NO: 268196 - DNA, 20 bp, Artificial Sequence
  Description of Artificial Sequence: Synthetic oligonucleotide
  Target: ATXN1; (+) strand; PAM type: YTN; PAM sequence: TTT
atgggggctcgcgacttgcc

SEQ ID NO: 268197 - DNA, 20 bp, Artificial Sequence
  Description of Artificial Sequence: Synthetic oligonucleotide
  Target: ATXN1; (+) strand; PAM type: YTN; PAM sequence: TTA
tgggggctcgcgacttgccc

SEQ ID NO: 268198 - DNA, 20 bp, Artificial Sequence
  Description of Artificial Sequence: Synthetic oligonucleotide
  Target: ATXN1; (+) strand; PAM type: YTN; PAM sequence: CTC
gcgacttgcccaaggttgcc

SEQ ID NO: 268199 - DNA, 20 bp, Artificial Sequence
  Description of Artificial Sequence: Synthetic oligonucleotide
  Target: ATXN1; (+) strand; PAM type: YTN; PAM sequence: CTT
gcccaaggttgccagtgtac

SEQ ID NO: 268200 - DNA, 20 bp, Artificial Sequence
  Description of Artificial Sequence: Synthetic oligonucleotide
  Target: ATXN1; (+) strand; PAM type: YTN; PAM sequence: TTG
cccaaggttgccagtgtact

SEQ ID NO: 268201 - DNA, 20 bp, Artificial Sequence
  Description of Artificial Sequence: Synthetic oligonucleotide
  Target: ATXN1; (+) strand; PAM type: YTN; PAM sequence: TTG
ccagtgtacttgatctcaac

SEQ ID NO: 268202 - DNA, 20 bp, Artificial Sequence
  Description of Artificial Sequence: Synthetic oligonucleotide
  Target: ATXN1; (+) strand; PAM type: YTN; PAM sequence: CTT
gatctcaacagtaggaatag

SEQ ID NO: 268203 - DNA, 20 bp, Artificial Sequence
  Description of Artificial Sequence: Synthetic oligonucleotide
  Target: ATXN1; (+) strand; PAM type: YTN; PAM sequence: TTG
atctcaacagtaggaatagg

SEQ ID NO: 268204 - DNA, 20 bp, Artificial Sequence
  Description of Artificial Sequence: Synthetic oligonucleotide
  Target: ATXN1; (+) strand; PAM type: YTN; PAM sequence: CTC
aacagtaggaataggattca

SEQ ID NO: 268205 - DNA, 20 bp, Artificial Sequence
  Description of Artificial Sequence: Synthetic oligonucleotide
  Target: ATXN1; (+) strand; PAM type: YTN; PAM sequence: TTC
aggtcagctgattccaggct

SEQ ID NO: 268206 - DNA, 20 bp, Artificial Sequence
  Description of Artificial Sequence: Synthetic oligonucleotide
  Target: ATXN1; (+) strand; PAM type: YTN; PAM sequence: CTG
attccaggctgactgatttc

SEQ ID NO: 268207 - DNA, 20 bp, Artificial Sequence
  Description of Artificial Sequence: Synthetic oligonucleotide
  Target: ATXN1; (+) strand; PAM type: YTN; PAM sequence: TTC
caggctgactgatttccact

SEQ ID NO: 268208 - DNA, 20 bp, Artificial Sequence
  Description of Artificial Sequence: Synthetic oligonucleotide
  Target: ATXN1; (+) strand; PAM type: YTN; PAM sequence: CTG
actgatttccactagaccca

SEQ ID NO: 268209 - DNA, 20 bp, Artificial Sequence
  Description of Artificial Sequence: Synthetic oligonucleotide
  Target: ATXN1; (+) strand; PAM type: YTN; PAM sequence: CTG
atttccactagacccaacgt

SEQ ID NO: 268210 - DNA, 20 bp, Artificial Sequence
  Description of Artificial Sequence: Synthetic oligonucleotide
  Target: ATXN1; (+) strand; PAM type: YTN; PAM sequence: TTT
ccactagacccaacgtgtac

SEQ ID NO: 268211 - DNA, 20 bp, Artificial Sequence
  Description of Artificial Sequence: Synthetic oligonucleotide
  Target: ATXN1; (+) strand; PAM type: YTN; PAM sequence: TTC
cactagacccaacgtgtaca

SEQ ID NO: 268212 - DNA, 20 bp, Artificial Sequence
  Description of Artificial Sequence: Synthetic oligonucleotide
  Target: ATXN1; (+) strand; PAM type: YTN; PAM sequence: CTA
gacccaacgtgtacagaatg

SEQ ID NO: 268213 - DNA, 20 bp, Artificial Sequence
  Description of Artificial Sequence: Synthetic oligonucleotide
  Target: ATXN1; (+) strand; PAM type: YTN; PAM sequence: CTT
cagtgtctcccactgtctgc

SEQ ID NO: 268214 - DNA, 20 bp, Artificial Sequence
  Description of Artificial Sequence: Synthetic oligonucleotide
  Target: ATXN1; (+) strand; PAM type: YTN; PAM sequence: TTC
agtgtctcccactgtctgct

SEQ ID NO: 268215 - DNA, 20 bp, Artificial Sequence
  Description of Artificial Sequence: Synthetic oligonucleotide
  Target: ATXN1; (+) strand; PAM type: YTN; PAM sequence: CTC
ccactgtctgctttcaatga

SEQ ID NO: 268216 - DNA, 20 bp, Artificial Sequence
  Description of Artificial Sequence: Synthetic oligonucleotide
  Target: ATXN1; (+) strand; PAM type: YTN; PAM sequence: CTG
tctgctttcaatgaagcact

SEQ ID NO: 268217 - DNA, 20 bp, Artificial Sequence
  Description of Artificial Sequence: Synthetic oligonucleotide
  Target: ATXN1; (+) strand; PAM type: YTN; PAM sequence: CTG
ctttcaatgaagcactggga

SEQ ID NO: 268218 - DNA, 20 bp, Artificial Sequence
  Description of Artificial Sequence: Synthetic oligonucleotide
  Target: ATXN1; (+) strand; PAM type: YTN; PAM sequence: CTT
tcaatgaagcactgggaaaa

SEQ ID NO: 268219 - DNA, 20 bp, Artificial Sequence
  Description of Artificial Sequence: Synthetic oligonucleotide
  Target: ATXN1; (+) strand; PAM type: YTN; PAM sequence: TTT
caatgaagcactgggaaaat

SEQ ID NO: 268220 - DNA, 20 bp, Artificial Sequence
  Description of Artificial Sequence: Synthetic oligonucleotide
  Target: ATXN1; (+) strand; PAM type: YTN; PAM sequence: TTC
aatgaagcactgggaaaatt

SEQ ID NO: 268221 - DNA, 20 bp, Artificial Sequence
  Description of Artificial Sequence: Synthetic oligonucleotide
  Target: ATXN1; (+) strand; PAM type: YTN; PAM sequence: CTG
ggaaaatttgaatttaataa

SEQ ID NO: 268222 - DNA, 20 bp, Artificial Sequence
  Description of Artificial Sequence: Synthetic oligonucleotide
  Target: ATXN1; (+) strand; PAM type: YTN; PAM sequence: TTT
gaatttaataagctcatatt

SEQ ID NO: 268223 - DNA, 20 bp, Artificial Sequence
  Description of Artificial Sequence: Synthetic oligonucleotide
  Target: ATXN1; (+) strand; PAM type: YTN; PAM sequence: TTG
aatttaataagctcatatta

SEQ ID NO: 268224 - DNA, 20 bp, Artificial Sequence
  Description of Artificial Sequence: Synthetic oligonucleotide
  Target: ATXN1; (+) strand; PAM type: YTN; PAM sequence: TTT
aataagctcatattaatatt

SEQ ID NO: 268225 - DNA, 20 bp, Artificial Sequence
  Description of Artificial Sequence: Synthetic oligonucleotide
  Target: ATXN1; (+) strand; PAM type: YTN; PAM sequence: TTA
ataagctcatattaatatta

SEQ ID NO: 268226 - DNA, 20 bp, Artificial Sequence
  Description of Artificial Sequence: Synthetic oligonucleotide
  Target: ATXN1; (+) strand; PAM type: YTN; PAM sequence: CTC
atattaatattactgattat

SEQ ID NO: 268227 - DNA, 20 bp, Artificial Sequence
  Description of Artificial Sequence: Synthetic oligonucleotide
  Target: ATXN1; (+) strand; PAM type: YTN; PAM sequence: TTA
atattactgattatttaacc

SEQ ID NO: 268228 - DNA, 20 bp, Artificial Sequence
  Description of Artificial Sequence: Synthetic oligonucleotide
  Target: ATXN1; (+) strand; PAM type: YTN; PAM sequence: TTA
ctgattatttaaccctgagg

SEQ ID NO: 268229 - DNA, 20 bp, Artificial Sequence
  Description of Artificial Sequence: Synthetic oligonucleotide
  Target: ATXN1; (+) strand; PAM type: YTN; PAM sequence: CTG
attatttaaccctgaggaga

SEQ ID NO: 268230 - DNA, 20 bp, Artificial Sequence
  Description of Artificial Sequence: Synthetic oligonucleotide
  Target: ATXN1; (+) strand; PAM type: YTN; PAM sequence: TTA
tttaaccctgaggagatgat

SEQ ID NO: 268231 - DNA, 20 bp, Artificial Sequence
  Description of Artificial Sequence: Synthetic oligonucleotide
  Target: ATXN1; (+) strand; PAM type: YTN; PAM sequence: TTT
aaccctgaggagatgatatg

SEQ ID NO: 268232 - DNA, 20 bp, Artificial Sequence
  Description of Artificial Sequence: Synthetic oligonucleotide
  Target: ATXN1; (+) strand; PAM type: YTN; PAM sequence: TTA
accctgaggagatgatatgg

SEQ ID NO: 268233 - DNA, 20 bp, Artificial Sequence
  Description of Artificial Sequence: Synthetic oligonucleotide
  Target: ATXN1; (+) strand; PAM type: YTN; PAM sequence: CTG
aggagatgatatggatacat

SEQ ID NO: 268234 - DNA, 20 bp, Artificial Sequence
  Description of Artificial Sequence: Synthetic oligonucleotide
  Target: ATXN1; (+) strand; PAM type: YTN; PAM sequence: TTT
taatacaaatgtttagaaat

SEQ ID NO: 268235 - DNA, 20 bp, Artificial Sequence
  Description of Artificial Sequence: Synthetic oligonucleotide
  Target: ATXN1; (+) strand; PAM type: YTN; PAM sequence: TTT
aatacaaatgtttagaaatc

SEQ ID NO: 268236 - DNA, 20 bp, Artificial Sequence
  Description of Artificial Sequence: Synthetic oligonucleotide
  Target: ATXN1; (+) strand; PAM type: YTN; PAM sequence: TTA
atacaaatgtttagaaatct

SEQ ID NO: 268237 - DNA, 20 bp, Artificial Sequence
  Description of Artificial Sequence: Synthetic oligonucleotide
  Target: ATXN1; (+) strand; PAM type: YTN; PAM sequence: TTT
agaaatctatgaaaccaaaa

SEQ ID NO: 268238 - DNA, 20 bp, Artificial Sequence
  Description of Artificial Sequence: Synthetic oligonucleotide
  Target: ATXN1; (+) strand; PAM type: YTN; PAM sequence: TTA
gaaatctatgaaaccaaaaa

SEQ ID NO: 268239 - DNA, 20 bp, Artificial Sequence
  Description of Artificial Sequence: Synthetic oligonucleotide
  Target: ATXN1; (+) strand; PAM type: YTN; PAM sequence: CTA
tgaaaccaaaaaaattagga

SEQ ID NO: 268240 - DNA, 20 bp, Artificial Sequence
  Description of Artificial Sequence: Synthetic oligonucleotide
  Target: ATXN1; (+) strand; PAM type: YTN; PAM sequence: TTA
ggaacattttttttccttgt

SEQ ID NO: 268241 - DNA, 20 bp, Artificial Sequence
  Description of Artificial Sequence: Synthetic oligonucleotide
  Target: ATXN1; (+) strand; PAM type: YTN; PAM sequence: TTT
tttttccttgtcaatacttt

SEQ ID NO: 268242 - DNA, 20 bp, Artificial Sequence
  Description of Artificial Sequence: Synthetic oligonucleotide
  Target: ATXN1; (+) strand; PAM type: YTN; PAM sequence: TTT
ttttccttgtcaatactttt

SEQ ID NO: 268243 - DNA, 20 bp, Artificial Sequence
  Description of Artificial Sequence: Synthetic oligonucleotide
  Target: ATXN1; (+) strand; PAM type: YTN; PAM sequence: TTT
tttccttgtcaatacttttc

SEQ ID NO: 268244 - DNA, 20 bp, Artificial Sequence
  Description of Artificial Sequence: Synthetic oligonucleotide
  Target: ATXN1; (+) strand; PAM type: YTN; PAM sequence: TTT
ttccttgtcaatacttttct

SEQ ID NO: 268245 - DNA, 20 bp, Artificial Sequence
  Description of Artificial Sequence: Synthetic oligonucleotide
  Target: ATXN1; (+) strand; PAM type: YTN; PAM sequence: TTT
tccttgtcaatacttttctc

SEQ ID NO: 268246 - DNA, 20 bp, Artificial Sequence
  Description of Artificial Sequence: Synthetic oligonucleotide
  Target: ATXN1; (+) strand; PAM type: YTN; PAM sequence: TTT
ccttgtcaatacttttctcc

SEQ ID NO: 268247 - DNA, 20 bp, Artificial Sequence
  Description of Artificial Sequence: Synthetic oligonucleotide
  Target: ATXN1; (+) strand; PAM type: YTN; PAM sequence: TTC
cttgtcaatacttttctccc

SEQ ID NO: 268248 - DNA, 20 bp, Artificial Sequence
  Description of Artificial Sequence: Synthetic oligonucleotide
  Target: ATXN1; (+) strand; PAM type: YTN; PAM sequence: CTT
gtcaatacttttctccctga

SEQ ID NO: 268249 - DNA, 20 bp, Artificial Sequence
  Description of Artificial Sequence: Synthetic oligonucleotide
  Target: ATXN1; (+) strand; PAM type: YTN; PAM sequence: TTG
tcaatacttttctccctgat

SEQ ID NO: 268250 - DNA, 20 bp, Artificial Sequence
  Description of Artificial Sequence: Synthetic oligonucleotide
  Target: ATXN1; (+) strand; PAM type: YTN; PAM sequence: CTT
ttctccctgatatatgctac

SEQ ID NO: 268251 - DNA, 20 bp, Artificial Sequence
  Description of Artificial Sequence: Synthetic oligonucleotide
  Target: ATXN1; (+) strand; PAM type: YTN; PAM sequence: TTT
tctccctgatatatgctaca

SEQ ID NO: 268252 - DNA, 20 bp, Artificial Sequence
  Description of Artificial Sequence: Synthetic oligonucleotide
  Target: ATXN1; (+) strand; PAM type: YTN; PAM sequence: TTT
ctccctgatatatgctacac

SEQ ID NO: 268253 - DNA, 20 bp, Artificial Sequence
  Description of Artificial Sequence: Synthetic oligonucleotide
  Target: ATXN1; (+) strand; PAM type: YTN; PAM sequence: TTC
tccctgatatatgctacact

SEQ ID NO: 268254 - DNA, 20 bp, Artificial Sequence
  Description of Artificial Sequence: Synthetic oligonucleotide
  Target: ATXN1; (+) strand; PAM type: YTN; PAM sequence: CTC
cctgatatatgctacacttt

SEQ ID NO: 268255 - DNA, 20 bp, Artificial Sequence
  Description of Artificial Sequence: Synthetic oligonucleotide
  Target: ATXN1; (+) strand; PAM type: YTN; PAM sequence: CTG
atatatgctacactttgctc

SEQ ID NO: 268256 - DNA, 20 bp, Artificial Sequence
  Description of Artificial Sequence: Synthetic oligonucleotide
  Target: ATXN1; (+) strand; PAM type: YTN; PAM sequence: CTA
cactttgctctttacaaatc

SEQ ID NO: 268257 - DNA, 20 bp, Artificial Sequence
  Description of Artificial Sequence: Synthetic oligonucleotide
  Target: ATXN1; (+) strand; PAM type: YTN; PAM sequence: CTT
tgctctttacaaatcttgta

SEQ ID NO: 268258 - DNA, 20 bp, Artificial Sequence
  Description of Artificial Sequence: Synthetic oligonucleotide
  Target: ATXN1; (+) strand; PAM type: YTN; PAM sequence: TTT
gctctttacaaatcttgtag

SEQ ID NO: 268259 - DNA, 20 bp, Artificial Sequence
  Description of Artificial Sequence: Synthetic oligonucleotide
  Target: ATXN1; (+) strand; PAM type: YTN; PAM sequence: TTG
ctctttacaaatcttgtagg

SEQ ID NO: 268260 - DNA, 20 bp, Artificial Sequence
  Description of Artificial Sequence: Synthetic oligonucleotide
  Target: ATXN1; (+) strand; PAM type: YTN; PAM sequence: CTC
tttacaaatcttgtaggcaa

SEQ ID NO: 268261 - DNA, 20 bp, Artificial Sequence
  Description of Artificial Sequence: Synthetic oligonucleotide
  Target: ATXN1; (+) strand; PAM type: YTN; PAM sequence: CTT
tacaaatcttgtaggcaact

SEQ ID NO: 268262 - DNA, 20 bp, Artificial Sequence
  Description of Artificial Sequence: Synthetic oligonucleotide
  Target: ATXN1; (+) strand; PAM type: YTN; PAM sequence: TTT
acaaatcttgtaggcaactg

SEQ ID NO: 268263 - DNA, 20 bp, Artificial Sequence
  Description of Artificial Sequence: Synthetic oligonucleotide
  Target: ATXN1; (+) strand; PAM type: YTN; PAM sequence: TTA
caaatcttgtaggcaactgc

SEQ ID NO: 268264 - DNA, 20 bp, Artificial Sequence
  Description of Artificial Sequence: Synthetic oligonucleotide
  Target: ATXN1; (+) strand; PAM type: YTN; PAM sequence: CTT
gtaggcaactgcaaaaaaaa

SEQ ID NO: 268265 - DNA, 20 bp, Artificial Sequence
  Description of Artificial Sequence: Synthetic oligonucleotide
  Target: ATXN1; (+) strand; PAM type: YTN; PAM sequence: TTG
taggcaactgcaaaaaaaat

SEQ ID NO: 268266 - DNA, 20 bp, Artificial Sequence
  Description of Artificial Sequence: Synthetic oligonucleotide
  Target: ATXN1; (+) strand; PAM type: YTN; PAM sequence: CTG
caaaaaaaataggtaataca

SEQ ID NO: 268267 - DNA, 20 bp, Artificial Sequence
  Description of Artificial Sequence: Synthetic oligonucleotide
  Target: ATXN1; (+) strand; PAM type: YTN; PAM sequence: TTC
aaaaaagttttctggctgag

SEQ ID NO: 268268 - DNA, 20 bp, Artificial Sequence
  Description of Artificial Sequence: Synthetic oligonucleotide
  Target: ATXN1; (+) strand; PAM type: YTN; PAM sequence: TTT
tctggctgagttaagaagct

SEQ ID NO: 268269 - DNA, 20 bp, Artificial Sequence
  Description of Artificial Sequence: Synthetic oligonucleotide
  Target: ATXN1; (+) strand; PAM type: YTN; PAM sequence: TTT
ctggctgagttaagaagctg

SEQ ID NO: 268270 - DNA, 20 bp, Artificial Sequence
  Description of Artificial Sequence: Synthetic oligonucleotide
  Target: ATXN1; (+) strand; PAM type: YTN; PAM sequence: TTC
tggctgagttaagaagctgg

SEQ ID NO: 268271 - DNA, 20 bp, Artificial Sequence
  Description of Artificial Sequence: Synthetic oligonucleotide
  Target: ATXN1; (+) strand; PAM type: YTN; PAM sequence: CTG
gctgagttaagaagctggaa

SEQ ID NO: 268272 - DNA, 20 bp, Artificial Sequence
  Description of Artificial Sequence: Synthetic oligonucleotide
  Target: ATXN1; (+) strand; PAM type: YTN; PAM sequence: CTG
agttaagaagctggaaacct

SEQ ID NO: 268273 - DNA, 20 bp, Artificial Sequence
  Description of Artificial Sequence: Synthetic oligonucleotide
  Target: ATXN1; (+) strand; PAM type: YTN; PAM sequence: TTA
agaagctggaaacctaaata

SEQ ID NO: 268274 - DNA, 20 bp, Artificial Sequence
  Description of Artificial Sequence: Synthetic oligonucleotide
  Target: ATXN1; (+) strand; PAM type: YTN; PAM sequence: CTG
gaaacctaaatatatatgtg

SEQ ID NO: 268275 - DNA, 20 bp, Artificial Sequence
  Description of Artificial Sequence: Synthetic oligonucleotide
  Target: ATXN1; (+) strand; PAM type: YTN; PAM sequence: CTA
aatatatatgtgtgtgtgtg

SEQ ID NO: 268276 - DNA, 20 bp, Artificial Sequence
  Description of Artificial Sequence: Synthetic oligonucleotide
  Target: ATXN1; (+) strand; PAM type: YTN; PAM sequence: TTA
cagaaatatatgtatttata

SEQ ID NO: 268277 - DNA, 20 bp, Artificial Sequence
  Description of Artificial Sequence: Synthetic oligonucleotide
  Target: ATXN1; (+) strand; PAM type: YTN; PAM sequence: TTT
atatatacacaaaaacaaca

SEQ ID NO: 268278 - DNA, 20 bp, Artificial Sequence
  Description of Artificial Sequence: Synthetic oligonucleotide
  Target: ATXN1; (+) strand; PAM type: YTN; PAM sequence: TTA
tatatacacaaaaacaacaa

SEQ ID NO: 268279 - DNA, 20 bp, Artificial Sequence
  Description of Artificial Sequence: Synthetic oligonucleotide
  Target: ATXN1; (+) strand; PAM type: YTN; PAM sequence: CTA
gaagaaattggcttgtcatt

SEQ ID NO: 268280 - DNA, 20 bp, Artificial Sequence
  Description of Artificial Sequence: Synthetic oligonucleotide
  Target: ATXN1; (+) strand; PAM type: YTN; PAM sequence: TTG
gcttgtcatttcctaaaatt

SEQ ID NO: 268281 - DNA, 20 bp, Artificial Sequence
  Description of Artificial Sequence: Synthetic oligonucleotide
  Target: ATXN1; (+) strand; PAM type: YTN; PAM sequence: CTT
gtcatttcctaaaatttgaa

SEQ ID NO: 268282 - DNA, 20 bp, Artificial Sequence
  Description of Artificial Sequence: Synthetic oligonucleotide
  Target: ATXN1; (+) strand; PAM type: YTN; PAM sequence: TTG
tcatttcctaaaatttgaag

SEQ ID NO: 268283 - DNA, 20 bp, Artificial Sequence
  Description of Artificial Sequence: Synthetic oligonucleotide
  Target: ATXN1; (+) strand; PAM type: YTN; PAM sequence: TTT
cctaaaatttgaagataata

SEQ ID NO: 268284 - DNA, 20 bp, Artificial Sequence
  Description of Artificial Sequence: Synthetic oligonucleotide
  Target: ATXN1; (+) strand; PAM type: YTN; PAM sequence: TTC
ctaaaatttgaagataatat

SEQ ID NO: 268285 - DNA, 20 bp, Artificial Sequence
  Description of Artificial Sequence: Synthetic oligonucleotide
  Target: ATXN1; (+) strand; PAM type: YTN; PAM sequence: CTA
aaatttgaagataatatctt

SEQ ID NO: 268286 - DNA, 20 bp, Artificial Sequence
  Description of Artificial Sequence: Synthetic oligonucleotide
  Target: ATXN1; (+) strand; PAM type: YTN; PAM sequence: TTT
gaagataatatcttctcgtc

SEQ ID NO: 268287 - DNA, 20 bp, Artificial Sequence
  Description of Artificial Sequence: Synthetic oligonucleotide
  Target: ATXN1; (+) strand; PAM type: YTN; PAM sequence: TTG
aagataatatcttctcgtcc

SEQ ID NO: 268288 - DNA, 20 bp, Artificial Sequence
  Description of Artificial Sequence: Synthetic oligonucleotide
  Target: ATXN1; (+) strand; PAM type: YTN; PAM sequence: CTT
ctcgtcctcagaggtattca

SEQ ID NO: 268289 - DNA, 20 bp, Artificial Sequence
  Description of Artificial Sequence: Synthetic oligonucleotide
  Target: ATXN1; (+) strand; PAM type: YTN; PAM sequence: TTC
tcgtcctcagaggtattcat

SEQ ID NO: 268290 - DNA, 20 bp, Artificial Sequence
  Description of Artificial Sequence: Synthetic oligonucleotide
  Target: ATXN1; (+) strand; PAM type: YTN; PAM sequence: CTC
gtcctcagaggtattcatag

SEQ ID NO: 268291 - DNA, 20 bp, Artificial Sequence
  Description of Artificial Sequence: Synthetic oligonucleotide
  Target: ATXN1; (+) strand; PAM type: YTN; PAM sequence: CTC
agaggtattcataggccatc

SEQ ID NO: 268292 - DNA, 20 bp, Artificial Sequence
  Description of Artificial Sequence: Synthetic oligonucleotide
  Target: ATXN1; (+) strand; PAM type: YTN; PAM sequence: TTC
ataggccatcctgggtttca

SEQ ID NO: 268293 - DNA, 20 bp, Artificial Sequence
  Description of Artificial Sequence: Synthetic oligonucleotide
  Target: ATXN1; (+) strand; PAM type: YTN; PAM sequence: CTG
ggtttcatgtagctattttc

SEQ ID NO: 268294 - DNA, 20 bp, Artificial Sequence
  Description of Artificial Sequence: Synthetic oligonucleotide
  Target: ATXN1; (+) strand; PAM type: YTN; PAM sequence: TTT
catgtagctattttctttcc

SEQ ID NO: 268295 - DNA, 20 bp, Artificial Sequence
  Description of Artificial Sequence: Synthetic oligonucleotide
  Target: ATXN1; (+) strand; PAM type: YTN; PAM sequence: TTC
atgtagctattttctttcct

SEQ ID NO: 268296 - DNA, 20 bp, Artificial Sequence
  Description of Artificial Sequence: Synthetic oligonucleotide
  Target: ATXN1; (+) strand; PAM type: YTN; PAM sequence: CTA
ttttctttcctggtcaaaat

SEQ ID NO: 268297 - DNA, 20 bp, Artificial Sequence
  Description of Artificial Sequence: Synthetic oligonucleotide
  Target: ATXN1; (+) strand; PAM type: YTN; PAM sequence: TTT
tctttcctggtcaaaatctc

SEQ ID NO: 268298 - DNA, 20 bp, Artificial Sequence
  Description of Artificial Sequence: Synthetic oligonucleotide
  Target: ATXN1; (+) strand; PAM type: YTN; PAM sequence: TTT
ctttcctggtcaaaatctcc

SEQ ID NO: 268299 - DNA, 20 bp, Artificial Sequence
  Description of Artificial Sequence: Synthetic oligonucleotide
  Target: ATXN1; (+) strand; PAM type: YTN; PAM sequence: TTC
tttcctggtcaaaatctcct

SEQ ID NO: 268300 - DNA, 20 bp, Artificial Sequence
  Description of Artificial Sequence: Synthetic oligonucleotide
  Target: ATXN1; (+) strand; PAM type: YTN; PAM sequence: CTT
tcctggtcaaaatctcctaa

SEQ ID NO: 268301 - DNA, 20 bp, Artificial Sequence
  Description of Artificial Sequence: Synthetic oligonucleotide
  Target: ATXN1; (+) strand; PAM type: YTN; PAM sequence: TTT
cctggtcaaaatctcctaac

SEQ ID NO: 268302 - DNA, 20 bp, Artificial Sequence
  Description of Artificial Sequence: Synthetic oligonucleotide
  Target: ATXN1; (+) strand; PAM type: YTN; PAM sequence: TTC
ctggtcaaaatctcctaact

SEQ ID NO: 268303 - DNA, 20 bp, Artificial Sequence
  Description of Artificial Sequence: Synthetic oligonucleotide
  Target: ATXN1; (+) strand; PAM type: YTN; PAM sequence: CTG
gtcaaaatctcctaactgtg

SEQ ID NO: 268304 - DNA, 20 bp, Artificial Sequence
  Description of Artificial Sequence: Synthetic oligonucleotide
  Target: ATXN1; (+) strand; PAM type: YTN; PAM sequence: CTC
ctaactgtgttttgtgacac

SEQ ID NO: 268305 - DNA, 20 bp, Artificial Sequence
  Description of Artificial Sequence: Synthetic oligonucleotide
  Target: ATXN1; (+) strand; PAM type: YTN; PAM sequence: CTA
actgtgttttgtgacacagt

SEQ ID NO: 268306 - DNA, 20 bp, Artificial Sequence
  Description of Artificial Sequence: Synthetic oligonucleotide
  Target: ATXN1; (+) strand; PAM type: YTN; PAM sequence: CTG
tgttttgtgacacagtccag

SEQ ID NO: 268307 - DNA, 20 bp, Artificial Sequence
  Description of Artificial Sequence: Synthetic oligonucleotide
  Target: ATXN1; (+) strand; PAM type: YTN; PAM sequence: TTT
tgtgacacagtccagcaaca

SEQ ID NO: 268308 - DNA, 20 bp, Artificial Sequence
  Description of Artificial Sequence: Synthetic oligonucleotide
  Target: ATXN1; (+) strand; PAM type: YTN; PAM sequence: TTT
gtgacacagtccagcaacaa

SEQ ID NO: 268309 - DNA, 20 bp, Artificial Sequence
  Description of Artificial Sequence: Synthetic oligonucleotide
  Target: ATXN1; (+) strand; PAM type: YTN; PAM sequence: TTG
tgacacagtccagcaacaag

SEQ ID NO: 268310 - DNA, 20 bp, Artificial Sequence
  Description of Artificial Sequence: Synthetic oligonucleotide
  Target: ATXN1; (+) strand; PAM type: YTN; PAM sequence: TTC
tctagaaagtaggagggctg

SEQ ID NO: 268311 - DNA, 20 bp, Artificial Sequence
  Description of Artificial Sequence: Synthetic oligonucleotide
  Target: ATXN1; (+) strand; PAM type: YTN; PAM sequence: CTC
tagaaagtaggagggctgag

SEQ ID NO: 268312 - DNA, 20 bp, Artificial Sequence
  Description of Artificial Sequence: Synthetic oligonucleotide
  Target: ATXN1; (+) strand; PAM type: YTN; PAM sequence: CTA
gaaagtaggagggctgagca

SEQ ID NO: 268313 - DNA, 20 bp, Artificial Sequence
  Description of Artificial Sequence: Synthetic oligonucleotide
  Target: ATXN1; (+) strand; PAM type: YTN; PAM sequence: CTG
agcacctttgcattatttcc

SEQ ID NO: 268314 - DNA, 20 bp, Artificial Sequence
  Description of Artificial Sequence: Synthetic oligonucleotide
  Target: ATXN1; (+) strand; PAM type: YTN; PAM sequence: CTT
tgcattatttcctagtggaa

SEQ ID NO: 268315 - DNA, 20 bp, Artificial Sequence
  Description of Artificial Sequence: Synthetic oligonucleotide
  Target: ATXN1; (+) strand; PAM type: YTN; PAM sequence: TTT
gcattatttcctagtggaag

SEQ ID NO: 268316 - DNA, 20 bp, Artificial Sequence
  Description of Artificial Sequence: Synthetic oligonucleotide
  Target: ATXN1; (+) strand; PAM type: YTN; PAM sequence: TTG
cattatttcctagtggaagg

SEQ ID NO: 268317 - DNA, 20 bp, Artificial Sequence
  Description of Artificial Sequence: Synthetic oligonucleotide
  Target: ATXN1; (+) strand; PAM type: YTN; PAM sequence: TTA
tttcctagtggaagggctcc

SEQ ID NO: 268318 - DNA, 20 bp, Artificial Sequence
  Description of Artificial Sequence: Synthetic oligonucleotide
  Target: ATXN1; (+) strand; PAM type: YTN; PAM sequence: TTT
cctagtggaagggctccctg

SEQ ID NO: 268319 - DNA, 20 bp, Artificial Sequence
  Description of Artificial Sequence: Synthetic oligonucleotide
  Target: ATXN1; (+) strand; PAM type: YTN; PAM sequence: TTC
ctagtggaagggctccctga

SEQ ID NO: 268320 - DNA, 20 bp, Artificial Sequence
  Description of Artificial Sequence: Synthetic oligonucleotide
  Target: ATXN1; (+) strand; PAM type: YTN; PAM sequence: CTA
gtggaagggctccctgaagt

SEQ ID NO: 268321 - DNA, 20 bp, Artificial Sequence
  Description of Artificial Sequence: Synthetic oligonucleotide
  Target: ATXN1; (+) strand; PAM type: YTN; PAM sequence: CTC
cctgaagtcacactatgtca

SEQ ID NO: 268322 - DNA, 20 bp, Artificial Sequence
  Description of Artificial Sequence: Synthetic oligonucleotide
  Target: ATXN1; (+) strand; PAM type: YTN; PAM sequence: CTG
aagtcacactatgtcatctc

SEQ ID NO: 268323 - DNA, 20 bp, Artificial Sequence
  Description of Artificial Sequence: Synthetic oligonucleotide
  Target: ATXN1; (+) strand; PAM type: YTN; PAM sequence: CTA
tgtcatctcttccattacct

SEQ ID NO: 268324 - DNA, 20 bp, Artificial Sequence
  Description of Artificial Sequence: Synthetic oligonucleotide
  Target: ATXN1; (+) strand; PAM type: YTN; PAM sequence: CTC
ttccattacctgacactaaa

SEQ ID NO: 268325 - DNA, 20 bp, Artificial Sequence
  Description of Artificial Sequence: Synthetic oligonucleotide
  Target: ATXN1; (+) strand; PAM type: YTN; PAM sequence: CTT
ccattacctgacactaaaac

SEQ ID NO: 268326 - DNA, 20 bp, Artificial Sequence
  Description of Artificial Sequence: Synthetic oligonucleotide
  Target: ATXN1; (+) strand; PAM type: YTN; PAM sequence: TTC
cattacctgacactaaaact

SEQ ID NO: 268327 - DNA, 20 bp, Artificial Sequence
  Description of Artificial Sequence: Synthetic oligonucleotide
  Target: ATXN1; (+) strand; PAM type: YTN; PAM sequence: TTA
cctgacactaaaacttctca

SEQ ID NO: 268328 - DNA, 20 bp, Artificial Sequence
  Description of Artificial Sequence: Synthetic oligonucleotide
  Target: ATXN1; (+) strand; PAM type: YTN; PAM sequence: CTG
acactaaaacttctcatgca

SEQ ID NO: 268329 - DNA, 20 bp, Artificial Sequence
  Description of Artificial Sequence: Synthetic oligonucleotide
  Target: ATXN1; (+) strand; PAM type: YTN; PAM sequence: CTA
aaacttctcatgcaaggcgg

SEQ ID NO: 268330 - DNA, 20 bp, Artificial Sequence
  Description of Artificial Sequence: Synthetic oligonucleotide
  Target: ATXN1; (+) strand; PAM type: YTN; PAM sequence: CTT
ctcatgcaaggcggccatca

SEQ ID NO: 268331 - DNA, 20 bp, Artificial Sequence
  Description of Artificial Sequence: Synthetic oligonucleotide
  Target: ATXN1; (+) strand; PAM type: YTN; PAM sequence: TTC
tcatgcaaggcggccatcag

SEQ ID NO: 268332 - DNA, 20 bp, Artificial Sequence
  Description of Artificial Sequence: Synthetic oligonucleotide
  Target: ATXN1; (+) strand; PAM type: YTN; PAM sequence: CTC
atgcaaggcggccatcaggt

SEQ ID NO: 268333 - DNA, 20 bp, Artificial Sequence
  Description of Artificial Sequence: Synthetic oligonucleotide
  Target: ATXN1; (+) strand; PAM type: YTN; PAM sequence: CTT
tactaatctcaaaatcccaa

SEQ ID NO: 268334 - DNA, 20 bp, Artificial Sequence
  Description of Artificial Sequence: Synthetic oligonucleotide
  Target: ATXN1; (+) strand; PAM type: YTN; PAM sequence: TTT
actaatctcaaaatcccaag

SEQ ID NO: 268335 - DNA, 20 bp, Artificial Sequence
  Description of Artificial Sequence: Synthetic oligonucleotide
  Target: ATXN1; (+) strand; PAM type: YTN; PAM sequence: TTA
ctaatctcaaaatcccaagc

SEQ ID NO: 268336 - DNA, 20 bp, Artificial Sequence
  Description of Artificial Sequence: Synthetic oligonucleotide
  Target: ATXN1; (+) strand; PAM type: YTN; PAM sequence: CTA
atctcaaaatcccaagccag

SEQ ID NO: 268337 - DNA, 20 bp, Artificial Sequence
  Description of Artificial Sequence: Synthetic oligonucleotide
  Target: ATXN1; (+) strand; PAM type: YTN; PAM sequence: CTC
aaaatcccaagccagtaact

SEQ ID NO: 268338 - DNA, 20 bp, Artificial Sequence
  Description of Artificial Sequence: Synthetic oligonucleotide
  Target: ATXN1; (+) strand; PAM type: YTN; PAM sequence: CTG
atcaaaaccagtaaatcagc

SEQ ID NO: 268339 - DNA, 20 bp, Artificial Sequence
  Description of Artificial Sequence: Synthetic oligonucleotide
  Target: ATXN1; (+) strand; PAM type: YTN; PAM sequence: CTC
attttaagtaagggaagcac

SEQ ID NO: 268340 - DNA, 20 bp, Artificial Sequence
  Description of Artificial Sequence: Synthetic oligonucleotide
  Target: ATXN1; (+) strand; PAM type: YTN; PAM sequence: TTT
taagtaagggaagcaccaaa

SEQ ID NO: 268341 - DNA, 20 bp, Artificial Sequence
  Description of Artificial Sequence: Synthetic oligonucleotide
  Target: ATXN1; (+) strand; PAM type: YTN; PAM sequence: TTT
aagtaagggaagcaccaaac

SEQ ID NO: 268342 - DNA, 20 bp, Artificial Sequence
  Description of Artificial Sequence: Synthetic oligonucleotide
  Target: ATXN1; (+) strand; PAM type: YTN; PAM sequence: TTA
agtaagggaagcaccaaaca

SEQ ID NO: 268343 - DNA, 20 bp, Artificial Sequence
  Description of Artificial Sequence: Synthetic oligonucleotide
  Target: ATXN1; (+) strand; PAM type: YTN; PAM sequence: CTG
cttgtaacttgcatacctca

SEQ ID NO: 268344 - DNA, 20 bp, Artificial Sequence
  Description of Artificial Sequence: Synthetic oligonucleotide
  Target: ATXN1; (+) strand; PAM type: YTN; PAM sequence: CTT
gtaacttgcatacctcaaga

SEQ ID NO: 268345 - DNA, 20 bp, Artificial Sequence
  Description of Artificial Sequence: Synthetic oligonucleotide
  Target: ATXN1; (+) strand; PAM type: YTN; PAM sequence: TTG
taacttgcatacctcaagat

SEQ ID NO: 268346 - DNA, 20 bp, Artificial Sequence
  Description of Artificial Sequence: Synthetic oligonucleotide
  Target: ATXN1; (+) strand; PAM type: YTN; PAM sequence: CTT
gcatacctcaagattttaca

SEQ ID NO: 268347 - DNA, 20 bp, Artificial Sequence
  Description of Artificial Sequence: Synthetic oligonucleotide
  Target: ATXN1; (+) strand; PAM type: YTN; PAM sequence: TTG
catacctcaagattttacaa

SEQ ID NO: 268348 - DNA, 20 bp, Artificial Sequence
  Description of Artificial Sequence: Synthetic oligonucleotide
  Target: ATXN1; (+) strand; PAM type: YTN; PAM sequence: CTC
aagattttacaagccagaga

SEQ ID NO: 268349 - DNA, 20 bp, Artificial Sequence
  Description of Artificial Sequence: Synthetic oligonucleotide
  Target: ATXN1; (+) strand; PAM type: YTN; PAM sequence: TTT
tacaagccagagagaaaaat

SEQ ID NO: 268350 - DNA, 20 bp, Artificial Sequence
  Description of Artificial Sequence: Synthetic oligonucleotide
  Target: ATXN1; (+) strand; PAM type: YTN; PAM sequence: TTT
acaagccagagagaaaaatg

SEQ ID NO: 268351 - DNA, 20 bp, Artificial Sequence
  Description of Artificial Sequence: Synthetic oligonucleotide
  Target: ATXN1; (+) strand; PAM type: YTN; PAM sequence: TTA
caagccagagagaaaaatgt

SEQ ID NO: 268352 - DNA, 20 bp, Artificial Sequence
  Description of Artificial Sequence: Synthetic oligonucleotide
  Target: ATXN1; (+) strand; PAM type: YTN; PAM sequence: TTT
tcatcaactgcacatacaga

SEQ ID NO: 268353 - DNA, 20 bp, Artificial Sequence
  Description of Artificial Sequence: Synthetic oligonucleotide
  Target: ATXN1; (+) strand; PAM type: YTN; PAM sequence: TTT
catcaactgcacatacagaa

SEQ ID NO: 268354 - DNA, 20 bp, Artificial Sequence
  Description of Artificial Sequence: Synthetic oligonucleotide
  Target: ATXN1; (+) strand; PAM type: YTN; PAM sequence: TTC
atcaactgcacatacagaag

SEQ ID NO: 268355 - DNA, 20 bp, Artificial Sequence
  Description of Artificial Sequence: Synthetic oligonucleotide
  Target: ATXN1; (+) strand; PAM type: YTN; PAM sequence: CTG
cacatacagaagaataattg

SEQ ID NO: 268356 - DNA, 20 bp, Artificial Sequence
  Description of Artificial Sequence: Synthetic oligonucleotide
  Target: ATXN1; (+) strand; PAM type: YTN; PAM sequence: TTG
ctggatggaaactctgattg

SEQ ID NO: 268357 - DNA, 20 bp, Artificial Sequence
  Description of Artificial Sequence: Synthetic oligonucleotide
  Target: ATXN1; (+) strand; PAM type: YTN; PAM sequence: CTG
gatggaaactctgattgcta

SEQ ID NO: 268358 - DNA, 20 bp, Artificial Sequence
  Description of Artificial Sequence: Synthetic oligonucleotide
  Target: ATXN1; (+) strand; PAM type: YTN; PAM sequence: CTC
tgattgctaatccttagcct

SEQ ID NO: 268359 - DNA, 20 bp, Artificial Sequence
  Description of Artificial Sequence: Synthetic oligonucleotide
  Target: ATXN1; (+) strand; PAM type: YTN; PAM sequence: CTG
attgctaatccttagcctgg

SEQ ID NO: 268360 - DNA, 20 bp, Artificial Sequence
  Description of Artificial Sequence: Synthetic oligonucleotide
  Target: ATXN1; (+) strand; PAM type: YTN; PAM sequence: TTG
ctaatccttagcctggagaa

SEQ ID NO: 268361 - DNA, 20 bp, Artificial Sequence
  Description of Artificial Sequence: Synthetic oligonucleotide
  Target: ATXN1; (+) strand; PAM type: YTN; PAM sequence: CTA
atccttagcctggagaattt

SEQ ID NO: 268362 - DNA, 20 bp, Artificial Sequence
  Description of Artificial Sequence: Synthetic oligonucleotide
  Target: ATXN1; (+) strand; PAM type: YTN; PAM sequence: CTT
agcctggagaattttacccc

SEQ ID NO: 268363 - DNA, 20 bp, Artificial Sequence
  Description of Artificial Sequence: Synthetic oligonucleotide
  Target: ATXN1; (+) strand; PAM type: YTN; PAM sequence: TTA
gcctggagaattttaccccc

SEQ ID NO: 268364 - DNA, 20 bp, Artificial Sequence
  Description of Artificial Sequence: Synthetic oligonucleotide
  Target: ATXN1; (+) strand; PAM type: YTN; PAM sequence: CTG
gagaattttaccccctactc

SEQ ID NO: 268365 - DNA, 20 bp, Artificial Sequence
  Description of Artificial Sequence: Synthetic oligonucleotide
  Target: ATXN1; (+) strand; PAM type: YTN; PAM sequence: TTT
taccccctactcaccaacct

SEQ ID NO: 268366 - DNA, 20 bp, Artificial Sequence
  Description of Artificial Sequence: Synthetic oligonucleotide
  Target: ATXN1; (+) strand; PAM type: YTN; PAM sequence: TTT
accccctactcaccaaccta

SEQ ID NO: 268367 - DNA, 20 bp, Artificial Sequence
  Description of Artificial Sequence: Synthetic oligonucleotide
  Target: ATXN1; (+) strand; PAM type: YTN; PAM sequence: TTA
ccccctactcaccaacctaa

SEQ ID NO: 268368 - DNA, 20 bp, Artificial Sequence
  Description of Artificial Sequence: Synthetic oligonucleotide
  Target: ATXN1; (+) strand; PAM type: YTN; PAM sequence: CTA
ctcaccaacctaaaagaact

SEQ ID NO: 268369 - DNA, 20 bp, Artificial Sequence
  Description of Artificial Sequence: Synthetic oligonucleotide
  Target: ATXN1; (+) strand; PAM type: YTN; PAM sequence: CTC
accaacctaaaagaactgca

SEQ ID NO: 268370 - DNA, 20 bp, Artificial Sequence
  Description of Artificial Sequence: Synthetic oligonucleotide
  Target: ATXN1; (+) strand; PAM type: YTN; PAM sequence: CTA
aaagaactgcaacagcccag

SEQ ID NO: 268371 - DNA, 20 bp, Artificial Sequence
  Description of Artificial Sequence: Synthetic oligonucleotide
  Target: ATXN1; (+) strand; PAM type: YTN; PAM sequence: CTG
caacagcccagtttaaaggg

SEQ ID NO: 268372 - DNA, 20 bp, Artificial Sequence
  Description of Artificial Sequence: Synthetic oligonucleotide
  Target: ATXN1; (+) strand; PAM type: YTN; PAM sequence: TTT
aaaggggctgctctaaatct

SEQ ID NO: 268373 - DNA, 20 bp, Artificial Sequence
  Description of Artificial Sequence: Synthetic oligonucleotide
  Target: ATXN1; (+) strand; PAM type: YTN; PAM sequence: TTA
aaggggctgctctaaatctg

SEQ ID NO: 268374 - DNA, 20 bp, Artificial Sequence
  Description of Artificial Sequence: Synthetic oligonucleotide
  Target: ATXN1; (+) strand; PAM type: YTN; PAM sequence: CTG
ctctaaatctgatactattt

SEQ ID NO: 268375 - DNA, 20 bp, Artificial Sequence
  Description of Artificial Sequence: Synthetic oligonucleotide
  Target: ATXN1; (+) strand; PAM type: YTN; PAM sequence: CTC
taaatctgatactatttgac

SEQ ID NO: 268376 - DNA, 20 bp, Artificial Sequence
  Description of Artificial Sequence: Synthetic oligonucleotide
  Target: ATXN1; (+) strand; PAM type: YTN; PAM sequence: CTA
aatctgatactatttgactg

SEQ ID NO: 268377 - DNA, 20 bp, Artificial Sequence
  Description of Artificial Sequence: Synthetic oligonucleotide
  Target: ATXN1; (+) strand; PAM type: YTN; PAM sequence: CTG
atactatttgactgtaccag

SEQ ID NO: 268378 - DNA, 20 bp, Artificial Sequence
  Description of Artificial Sequence: Synthetic oligonucleotide
  Target: ATXN1; (+) strand; PAM type: YTN; PAM sequence: CTA
tttgactgtaccagtagaaa

SEQ ID NO: 268379 - DNA, 20 bp, Artificial Sequence
  Description of Artificial Sequence: Synthetic oligonucleotide
  Target: ATXN1; (+) strand; PAM type: YTN; PAM sequence: TTT
gactgtaccagtagaaaagg

SEQ ID NO: 268380 - DNA, 20 bp, Artificial Sequence
  Description of Artificial Sequence: Synthetic oligonucleotide
  Target: ATXN1; (+) strand; PAM type: YTN; PAM sequence: TTG
actgtaccagtagaaaaggt

SEQ ID NO: 268381 - DNA, 20 bp, Artificial Sequence
  Description of Artificial Sequence: Synthetic oligonucleotide
  Target: ATXN1; (+) strand; PAM type: YTN; PAM sequence: CTG
taccagtagaaaaggtgttc

SEQ ID NO: 268382 - DNA, 20 bp, Artificial Sequence
  Description of Artificial Sequence: Synthetic oligonucleotide
  Target: ATXN1; (+) strand; PAM type: YTN; PAM sequence: TTC
ctacaatgaaagaatcactg

SEQ ID NO: 268383 - DNA, 20 bp, Artificial Sequence
  Description of Artificial Sequence: Synthetic oligonucleotide
  Target: ATXN1; (+) strand; PAM type: YTN; PAM sequence: CTA
caatgaaagaatcactgtat

SEQ ID NO: 268384 - DNA, 20 bp, Artificial Sequence
  Description of Artificial Sequence: Synthetic oligonucleotide
  Target: ATXN1; (+) strand; PAM type: YTN; PAM sequence: CTG
tattccatccttttattcct

SEQ ID NO: 268385 - DNA, 20 bp, Artificial Sequence
  Description of Artificial Sequence: Synthetic oligonucleotide
  Target: ATXN1; (+) strand; PAM type: YTN; PAM sequence: TTC
catccttttattcctgaagt

SEQ ID NO: 268386 - DNA, 20 bp, Artificial Sequence
  Description of Artificial Sequence: Synthetic oligonucleotide
  Target: ATXN1; (+) strand; PAM type: YTN; PAM sequence: CTT
ttattcctgaagtagatagt

SEQ ID NO: 268387 - DNA, 20 bp, Artificial Sequence
  Description of Artificial Sequence: Synthetic oligonucleotide
  Target: ATXN1; (+) strand; PAM type: YTN; PAM sequence: TTT
tattcctgaagtagatagtt

SEQ ID NO: 268388 - DNA, 20 bp, Artificial Sequence
  Description of Artificial Sequence: Synthetic oligonucleotide
  Target: ATXN1; (+) strand; PAM type: YTN; PAM sequence: TTT
attcctgaagtagatagttt

SEQ ID NO: 268389 - DNA, 20 bp, Artificial Sequence
  Description of Artificial Sequence: Synthetic oligonucleotide
  Target: ATXN1; (+) strand; PAM type: YTN; PAM sequence: TTA
ttcctgaagtagatagtttg

SEQ ID NO: 268390 - DNA, 20 bp, Artificial Sequence
  Description of Artificial Sequence: Synthetic oligonucleotide
  Target: ATXN1; (+) strand; PAM type: YTN; PAM sequence: TTC
ctgaagtagatagtttgcag

SEQ ID NO: 268391 - DNA, 20 bp, Artificial Sequence
  Description of Artificial Sequence: Synthetic oligonucleotide
  Target: ATXN1; (+) strand; PAM type: YTN; PAM sequence: CTG
aagtagatagtttgcagcat

SEQ ID NO: 268392 - DNA, 20 bp, Artificial Sequence
  Description of Artificial Sequence: Synthetic oligonucleotide
  Target: ATXN1; (+) strand; PAM type: YTN; PAM sequence: TTT
gcagcatgccatagaagccg

SEQ ID NO: 268393 - DNA, 20 bp, Artificial Sequence
  Description of Artificial Sequence: Synthetic oligonucleotide
  Target: ATXN1; (+) strand; PAM type: YTN; PAM sequence: TTG
cagcatgccatagaagccga

SEQ ID NO: 268394 - DNA, 20 bp, Artificial Sequence
  Description of Artificial Sequence: Synthetic oligonucleotide
  Target: ATXN1; (+) strand; PAM type: YTN; PAM sequence: TTC
cagcaaatacaaacaggacc

SEQ ID NO: 268395 - DNA, 20 bp, Artificial Sequence
  Description of Artificial Sequence: Synthetic oligonucleotide
  Target: ATXN1; (+) strand; PAM type: YTN; PAM sequence: CTC
ttcccttaaaaaattaaatt

SEQ ID NO: 268396 - DNA, 20 bp, Artificial Sequence
  Description of Artificial Sequence: Synthetic oligonucleotide
  Target: ATXN1; (+) strand; PAM type: YTN; PAM sequence: CTT
cccttaaaaaattaaattcc

SEQ ID NO: 268397 - DNA, 20 bp, Artificial Sequence
  Description of Artificial Sequence: Synthetic oligonucleotide
  Target: ATXN1; (+) strand; PAM type: YTN; PAM sequence: TTC
ccttaaaaaattaaattccc

SEQ ID NO: 268398 - DNA, 20 bp, Artificial Sequence
  Description of Artificial Sequence: Synthetic oligonucleotide
  Target: ATXN1; (+) strand; PAM type: YTN; PAM sequence: CTT
aaaaaattaaattcccttcc

SEQ ID NO: 268399 - DNA, 20 bp, Artificial Sequence
  Description of Artificial Sequence: Synthetic oligonucleotide
  Target: ATXN1; (+) strand; PAM type: YTN; PAM sequence: TTA
aaaaattaaattcccttcca

SEQ ID NO: 268400 - DNA, 20 bp, Artificial Sequence
  Description of Artificial Sequence: Synthetic oligonucleotide
  Target: ATXN1; (+) strand; PAM type: YTN; PAM sequence: TTA
aattcccttccaattaaaaa

SEQ ID NO: 268401 - DNA, 20 bp, Artificial Sequence
  Description of Artificial Sequence: Synthetic oligonucleotide
  Target: ATXN1; (+) strand; PAM type: YTN; PAM sequence: TTC
ccttccaattaaaaaaagaa

SEQ ID NO: 268402 - DNA, 20 bp, Artificial Sequence
  Description of Artificial Sequence: Synthetic oligonucleotide
  Target: ATXN1; (+) strand; PAM type: YTN; PAM sequence: CTT
ccaattaaaaaaagaaatta

SEQ ID NO: 268403 - DNA, 20 bp, Artificial Sequence
  Description of Artificial Sequence: Synthetic oligonucleotide
  Target: ATXN1; (+) strand; PAM type: YTN; PAM sequence: TTC
caattaaaaaaagaaattaa

SEQ ID NO: 268404 - DNA, 20 bp, Artificial Sequence
  Description of Artificial Sequence: Synthetic oligonucleotide
  Target: ATXN1; (+) strand; PAM type: YTN; PAM sequence: TTA
aaaaaagaaattaattggac

SEQ ID NO: 268405 - DNA, 20 bp, Artificial Sequence
  Description of Artificial Sequence: Synthetic oligonucleotide
  Target: ATXN1; (+) strand; PAM type: YTN; PAM sequence: TTA
attggacgatcacctagagc

SEQ ID NO: 268406 - DNA, 20 bp, Artificial Sequence
  Description of Artificial Sequence: Synthetic oligonucleotide
  Target: ATXN1; (+) strand; PAM type: YTN; PAM sequence: TTG
gacgatcacctagagctcat

SEQ ID NO: 268407 - DNA, 20 bp, Artificial Sequence
  Description of Artificial Sequence: Synthetic oligonucleotide
  Target: ATXN1; (+) strand; PAM type: YTN; PAM sequence: CTA
gagctcatgctaatacccct

SEQ ID NO: 268408 - DNA, 20 bp, Artificial Sequence
  Description of Artificial Sequence: Synthetic oligonucleotide
  Target: ATXN1; (+) strand; PAM type: YTN; PAM sequence: CTC
atgctaataccccttcaaca

SEQ ID NO: 268409 - DNA, 20 bp, Artificial Sequence
  Description of Artificial Sequence: Synthetic oligonucleotide
  Target: ATXN1; (+) strand; PAM type: YTN; PAM sequence: CTA
ataccccttcaacacctggc

SEQ ID NO: 268410 - DNA, 20 bp, Artificial Sequence
  Description of Artificial Sequence: Synthetic oligonucleotide
  Target: ATXN1; (+) strand; PAM type: YTN; PAM sequence: CTT
caacacctggctcggttaca

SEQ ID NO: 268411 - DNA, 20 bp, Artificial Sequence
  Description of Artificial Sequence: Synthetic oligonucleotide
  Target: ATXN1; (+) strand; PAM type: YTN; PAM sequence: TTC
aacacctggctcggttacat

SEQ ID NO: 268412 - DNA, 20 bp, Artificial Sequence
  Description of Artificial Sequence: Synthetic oligonucleotide
  Target: ATXN1; (+) strand; PAM type: YTN; PAM sequence: CTG
gctcggttacatcaagtgat

SEQ ID NO: 268413 - DNA, 20 bp, Artificial Sequence
  Description of Artificial Sequence: Synthetic oligonucleotide
  Target: ATXN1; (+) strand; PAM type: YTN; PAM sequence: CTC
ggttacatcaagtgattcat

SEQ ID NO: 268414 - DNA, 20 bp, Artificial Sequence
  Description of Artificial Sequence: Synthetic oligonucleotide
  Target: ATXN1; (+) strand; PAM type: YTN; PAM sequence: TTA
catcaagtgattcatgaatc

SEQ ID NO: 268415 - DNA, 20 bp, Artificial Sequence
  Description of Artificial Sequence: Synthetic oligonucleotide
  Target: ATXN1; (+) strand; PAM type: YTN; PAM sequence: TTC
atgaatcctacaaggcaagc

SEQ ID NO: 268416 - DNA, 20 bp, Artificial Sequence
  Description of Artificial Sequence: Synthetic oligonucleotide
  Target: ATXN1; (+) strand; PAM type: YTN; PAM sequence: CTA
caaggcaagccactacacat

SEQ ID NO: 268417 - DNA, 20 bp, Artificial Sequence
  Description of Artificial Sequence: Synthetic oligonucleotide
  Target: ATXN1; (+) strand; PAM type: YTN; PAM sequence: CTA
cacatattgttcttggttgt

SEQ ID NO: 268418 - DNA, 20 bp, Artificial Sequence
  Description of Artificial Sequence: Synthetic oligonucleotide
  Target: ATXN1; (+) strand; PAM type: YTN; PAM sequence: TTG
ttcttggttgttaacttaca

SEQ ID NO: 268419 - DNA, 20 bp, Artificial Sequence
  Description of Artificial Sequence: Synthetic oligonucleotide
  Target: ATXN1; (+) strand; PAM type: YTN; PAM sequence: TTC
ttggttgttaacttacaaca

SEQ ID NO: 268420 - DNA, 20 bp, Artificial Sequence
  Description of Artificial Sequence: Synthetic oligonucleotide
  Target: ATXN1; (+) strand; PAM type: YTN; PAM sequence: CTT
ggttgttaacttacaacatt

SEQ ID NO: 268421 - DNA, 20 bp, Artificial Sequence
  Description of Artificial Sequence: Synthetic oligonucleotide
  Target: ATXN1; (+) strand; PAM type: YTN; PAM sequence: TTG
gttgttaacttacaacattc

SEQ ID NO: 268422 - DNA, 20 bp, Artificial Sequence
  Description of Artificial Sequence: Synthetic oligonucleotide
  Target: ATXN1; (+) strand; PAM type: YTN; PAM sequence: TTG
ttaacttacaacattcactg

SEQ ID NO: 268423 - DNA, 20 bp, Artificial Sequence
  Description of Artificial Sequence: Synthetic oligonucleotide
  Target: ATXN1; (+) strand; PAM type: YTN; PAM sequence: TTA
acttacaacattcactgcgt

SEQ ID NO: 268424 - DNA, 20 bp, Artificial Sequence
  Description of Artificial Sequence: Synthetic oligonucleotide
  Target: ATXN1; (+) strand; PAM type: YTN; PAM sequence: CTT
acaacattcactgcgtactg

SEQ ID NO: 268425 - DNA, 20 bp, Artificial Sequence
  Description of Artificial Sequence: Synthetic oligonucleotide
  Target: ATXN1; (+) strand; PAM type: YTN; PAM sequence: TTA
caacattcactgcgtactgt

SEQ ID NO: 268426 - DNA, 20 bp, Artificial Sequence
  Description of Artificial Sequence: Synthetic oligonucleotide
  Target: ATXN1; (+) strand; PAM type: YTN; PAM sequence: TTC
actgcgtactgttcacaggt

SEQ ID NO: 268427 - DNA, 20 bp, Artificial Sequence
  Description of Artificial Sequence: Synthetic oligonucleotide
  Target: ATXN1; (+) strand; PAM type: YTN; PAM sequence: CTG
cgtactgttcacaggtagcc

SEQ ID NO: 268428 - DNA, 20 bp, Artificial Sequence
  Description of Artificial Sequence: Synthetic oligonucleotide
  Target: ATXN1; (+) strand; PAM type: YTN; PAM sequence: CTG
ttcacaggtagcctcagcct

SEQ ID NO: 268429 - DNA, 20 bp, Artificial Sequence
  Description of Artificial Sequence: Synthetic oligonucleotide
  Target: ATXN1; (+) strand; PAM type: YTN; PAM sequence: TTC
acaggtagcctcagcctata

SEQ ID NO: 268430 - DNA, 20 bp, Artificial Sequence
  Description of Artificial Sequence: Synthetic oligonucleotide
  Target: ATXN1; (+) strand; PAM type: YTN; PAM sequence: CTC
agcctatacttcaccatgga

SEQ ID NO: 268431 - DNA, 20 bp, Artificial Sequence
  Description of Artificial Sequence: Synthetic oligonucleotide
  Target: ATXN1; (+) strand; PAM type: YTN; PAM sequence: CTA
tacttcaccatggagacttc

SEQ ID NO: 268432 - DNA, 20 bp, Artificial Sequence
  Description of Artificial Sequence: Synthetic oligonucleotide
  Target: ATXN1; (+) strand; PAM type: YTN; PAM sequence: CTT
caccatggagacttcccaca

SEQ ID NO: 268433 - DNA, 20 bp, Artificial Sequence
  Description of Artificial Sequence: Synthetic oligonucleotide
  Target: ATXN1; (+) strand; PAM type: YTN; PAM sequence: TTC
accatggagacttcccacag

SEQ ID NO: 268434 - DNA, 20 bp, Artificial Sequence
  Description of Artificial Sequence: Synthetic oligonucleotide
  Target: ATXN1; (+) strand; PAM type: YTN; PAM sequence: CTT
cccacaggctctggagggct

SEQ ID NO: 268435 - DNA, 20 bp, Artificial Sequence
  Description of Artificial Sequence: Synthetic oligonucleotide
  Target: ATXN1; (+) strand; PAM type: YTN; PAM sequence: TTC
ccacaggctctggagggctc

SEQ ID NO: 268436 - DNA, 20 bp, Artificial Sequence
  Description of Artificial Sequence: Synthetic oligonucleotide
  Target: ATXN1; (+) strand; PAM type: YTN; PAM sequence: CTC
tggagggctcctgagggctc

SEQ ID NO: 268437 - DNA, 20 bp, Artificial Sequence
  Description of Artificial Sequence: Synthetic oligonucleotide
  Target: ATXN1; (+) strand; PAM type: YTN; PAM sequence: CTG
gagggctcctgagggctctt

SEQ ID NO: 268438 - DNA, 20 bp, Artificial Sequence
  Description of Artificial Sequence: Synthetic oligonucleotide
  Target: ATXN1; (+) strand; PAM type: YTN; PAM sequence: CTC
ctgagggctcttgggctcag

SEQ ID NO: 268439 - DNA, 20 bp, Artificial Sequence
  Description of Artificial Sequence: Synthetic oligonucleotide
  Target: ATXN1; (+) strand; PAM type: YTN; PAM sequence: CTG
agggctcttgggctcaggcg

SEQ ID NO: 268440 - DNA, 20 bp, Artificial Sequence
  Description of Artificial Sequence: Synthetic oligonucleotide
  Target: ATXN1; (+) strand; PAM type: YTN; PAM sequence: CTC
ttgggctcaggcgtgttctt

SEQ ID NO: 268441 - DNA, 20 bp, Artificial Sequence
  Description of Artificial Sequence: Synthetic oligonucleotide
  Target: ATXN1; (+) strand; PAM type: YTN; PAM sequence: CTT
gggctcaggcgtgttctttc

SEQ ID NO: 268442 - DNA, 20 bp, Artificial Sequence
  Description of Artificial Sequence: Synthetic oligonucleotide
  Target: ATXN1; (+) strand; PAM type: YTN; PAM sequence: TTG
ggctcaggcgtgttctttct

SEQ ID NO: 268443 - DNA, 20 bp, Artificial Sequence
  Description of Artificial Sequence: Synthetic oligonucleotide
  Target: ATXN1; (+) strand; PAM type: YTN; PAM sequence: CTC
aggcgtgttctttcttcctt

SEQ ID NO: 268444 - DNA, 20 bp, Artificial Sequence
  Description of Artificial Sequence: Synthetic oligonucleotide
  Target: ATXN1; (+) strand; PAM type: YTN; PAM sequence: TTC
tttcttcctttcacagagaa

SEQ ID NO: 268445 - DNA, 20 bp, Artificial Sequence
  Description of Artificial Sequence: Synthetic oligonucleotide
  Target: ATXN1; (+) strand; PAM type: YTN; PAM sequence: CTT
tcttcctttcacagagaagt

SEQ ID NO: 268446 - DNA, 20 bp, Artificial Sequence
  Description of Artificial Sequence: Synthetic oligonucleotide
  Target: ATXN1; (+) strand; PAM type: YTN; PAM sequence: TTT
cttcctttcacagagaagtg

SEQ ID NO: 268447 - DNA, 20 bp, Artificial Sequence
  Description of Artificial Sequence: Synthetic oligonucleotide
  Target: ATXN1; (+) strand; PAM type: YTN; PAM sequence: TTC
ttcctttcacagagaagtga

SEQ ID NO: 268448 - DNA, 20 bp, Artificial Sequence
  Description of Artificial Sequence: Synthetic oligonucleotide
  Target: ATXN1; (+) strand; PAM type: YTN; PAM sequence: CTT
cctttcacagagaagtgaga

SEQ ID NO: 268449 - DNA, 20 bp, Artificial Sequence
  Description of Artificial Sequence: Synthetic oligonucleotide
  Target: ATXN1; (+) strand; PAM type: YTN; PAM sequence: TTC
ctttcacagagaagtgagaa

SEQ ID NO: 268450 - DNA, 20 bp, Artificial Sequence
  Description of Artificial Sequence: Synthetic oligonucleotide
  Target: ATXN1; (+) strand; PAM type: YTN; PAM sequence: CTT
tcacagagaagtgagaaata

SEQ ID NO: 268451 - DNA, 20 bp, Artificial Sequence
  Description of Artificial Sequence: Synthetic oligonucleotide
  Target: ATXN1; (+) strand; PAM type: YTN; PAM sequence: TTT
cacagagaagtgagaaatac

SEQ ID NO: 268452 - DNA, 20 bp, Artificial Sequence
  Description of Artificial Sequence: Synthetic oligonucleotide
  Target: ATXN1; (+) strand; PAM type: YTN; PAM sequence: TTC
acagagaagtgagaaatacc

SEQ ID NO: 268453 - DNA, 20 bp, Artificial Sequence
  Description of Artificial Sequence: Synthetic oligonucleotide
  Target: ATXN1; (+) strand; PAM type: YTN; PAM sequence: CTA
gcatggaaatagaacagaag

SEQ ID NO: 268454 - DNA, 20 bp, Artificial Sequence
  Description of Artificial Sequence: Synthetic oligonucleotide
  Target: ATXN1; (+) strand; PAM type: YTN; PAM sequence: CTT
gttatctgaacaaatacagt

SEQ ID NO: 268455 - DNA, 20 bp, Artificial Sequence
  Description of Artificial Sequence: Synthetic oligonucleotide
  Target: ATXN1; (+) strand; PAM type: YTN; PAM sequence: TTG
ttatctgaacaaatacagtc

SEQ ID NO: 268456 - DNA, 20 bp, Artificial Sequence
  Description of Artificial Sequence: Synthetic oligonucleotide
  Target: ATXN1; (+) strand; PAM type: YTN; PAM sequence: TTA
tctgaacaaatacagtctca

SEQ ID NO: 268457 - DNA, 20 bp, Artificial Sequence
  Description of Artificial Sequence: Synthetic oligonucleotide
  Target: ATXN1; (+) strand; PAM type: YTN; PAM sequence: CTG
aacaaatacagtctcacgac

SEQ ID NO: 268458 - DNA, 20 bp, Artificial Sequence
  Description of Artificial Sequence: Synthetic oligonucleotide
  Target: ATXN1; (+) strand; PAM type: YTN; PAM sequence: CTC
acgaccaattagacgaattg

SEQ ID NO: 268459 - DNA, 20 bp, Artificial Sequence
  Description of Artificial Sequence: Synthetic oligonucleotide
  Target: ATXN1; (+) strand; PAM type: YTN; PAM sequence: TTA
gacgaattgatagttcacca

SEQ ID NO: 268460 - DNA, 20 bp, Artificial Sequence
  Description of Artificial Sequence: Synthetic oligonucleotide
  Target: ATXN1; (+) strand; PAM type: YTN; PAM sequence: TTG
atagttcaccaaagaccatt

SEQ ID NO: 268461 - DNA, 20 bp, Artificial Sequence
  Description of Artificial Sequence: Synthetic oligonucleotide
  Target: ATXN1; (+) strand; PAM type: YTN; PAM sequence: TTC
accaaagaccattttcttaa

SEQ ID NO: 268462 - DNA, 20 bp, Artificial Sequence
  Description of Artificial Sequence: Synthetic oligonucleotide
  Target: ATXN1; (+) strand; PAM type: YTN; PAM sequence: TTT
tcttaaaaaagaagttcaat

SEQ ID NO: 268463 - DNA, 20 bp, Artificial Sequence
  Description of Artificial Sequence: Synthetic oligonucleotide
  Target: ATXN1; (+) strand; PAM type: YTN; PAM sequence: TTT
cttaaaaaagaagttcaatg

SEQ ID NO: 268464 - DNA, 20 bp, Artificial Sequence
  Description of Artificial Sequence: Synthetic oligonucleotide
  Target: ATXN1; (+) strand; PAM type: YTN; PAM sequence: TTC
ttaaaaaagaagttcaatgt

SEQ ID NO: 268465 - DNA, 20 bp, Artificial Sequence
  Description of Artificial Sequence: Synthetic oligonucleotide
  Target: ATXN1; (+) strand; PAM type: YTN; PAM sequence: CTT
aaaaaagaagttcaatgttc

SEQ ID NO: 268466 - DNA, 20 bp, Artificial Sequence
  Description of Artificial Sequence: Synthetic oligonucleotide
  Target: ATXN1; (+) strand; PAM type: YTN; PAM sequence: TTA
aaaaagaagttcaatgttct

SEQ ID NO: 268467 - DNA, 20 bp, Artificial Sequence
  Description of Artificial Sequence: Synthetic oligonucleotide
  Target: ATXN1; (+) strand; PAM type: YTN; PAM sequence: TTC
aatgttcttgctcttttccc

SEQ ID NO: 268468 - DNA, 20 bp, Artificial Sequence
  Description of Artificial Sequence: Synthetic oligonucleotide
  Target: ATXN1; (+) strand; PAM type: YTN; PAM sequence: TTC
ttgctcttttcccaaaaaga

SEQ ID NO: 268469 - DNA, 20 bp, Artificial Sequence
  Description of Artificial Sequence: Synthetic oligonucleotide
  Target: ATXN1; (+) strand; PAM type: YTN; PAM sequence: CTT
gctcttttcccaaaaagaac

SEQ ID NO: 268470 - DNA, 20 bp, Artificial Sequence
  Description of Artificial Sequence: Synthetic oligonucleotide
  Target: ATXN1; (+) strand; PAM type: YTN; PAM sequence: TTG
ctcttttcccaaaaagaaca

SEQ ID NO: 268471 - DNA, 20 bp, Artificial Sequence
  Description of Artificial Sequence: Synthetic oligonucleotide
  Target: ATXN1; (+) strand; PAM type: YTN; PAM sequence: CTC
ttttcccaaaaagaacacaa

SEQ ID NO: 268472 - DNA, 20 bp, Artificial Sequence
  Description of Artificial Sequence: Synthetic oligonucleotide
  Target: ATXN1; (+) strand; PAM type: YTN; PAM sequence: CTT
ttcccaaaaagaacacaaca

SEQ ID NO: 268473 - DNA, 20 bp, Artificial Sequence
  Description of Artificial Sequence: Synthetic oligonucleotide
  Target: ATXN1; (+) strand; PAM type: YTN; PAM sequence: TTT
tcccaaaaagaacacaacat

SEQ ID NO: 268474 - DNA, 20 bp, Artificial Sequence
  Description of Artificial Sequence: Synthetic oligonucleotide
  Target: ATXN1; (+) strand; PAM type: YTN; PAM sequence: TTT
cccaaaaagaacacaacatg

SEQ ID NO: 268475 - DNA, 20 bp, Artificial Sequence
  Description of Artificial Sequence: Synthetic oligonucleotide
  Target: ATXN1; (+) strand; PAM type: YTN; PAM sequence: TTC
ccaaaaagaacacaacatgg

SEQ ID NO: 268476 - DNA, 20 bp, Artificial Sequence
  Description of Artificial Sequence: Synthetic oligonucleotide
  Target: ATXN1; (+) strand; PAM type: YTN; PAM sequence: CTC
tcctcaccccaaagttgaag

SEQ ID NO: 268477 - DNA, 20 bp, Artificial Sequence
  Description of Artificial Sequence: Synthetic oligonucleotide
  Target: ATXN1; (+) strand; PAM type: YTN; PAM sequence: CTC
ctcaccccaaagttgaagcc

SEQ ID NO: 268478 - DNA, 20 bp, Artificial Sequence
  Description of Artificial Sequence: Synthetic oligonucleotide
  Target: ATXN1; (+) strand; PAM type: YTN; PAM sequence: CTC
accccaaagttgaagccatt

SEQ ID NO: 268479 - DNA, 20 bp, Artificial Sequence
  Description of Artificial Sequence: Synthetic oligonucleotide
  Target: ATXN1; (+) strand; PAM type: YTN; PAM sequence: TTG
aagccatttctgggagactt

SEQ ID NO: 268480 - DNA, 20 bp, Artificial Sequence
  Description of Artificial Sequence: Synthetic oligonucleotide
  Target: ATXN1; (+) strand; PAM type: YTN; PAM sequence: TTT
ctgggagacttcagacacaa

SEQ ID NO: 268481 - DNA, 20 bp, Artificial Sequence
  Description of Artificial Sequence: Synthetic oligonucleotide
  Target: ATXN1; (+) strand; PAM type: YTN; PAM sequence: TTC
tgggagacttcagacacaat

SEQ ID NO: 268482 - DNA, 20 bp, Artificial Sequence
  Description of Artificial Sequence: Synthetic oligonucleotide
  Target: ATXN1; (+) strand; PAM type: YTN; PAM sequence: CTG
ggagacttcagacacaatct

SEQ ID NO: 268483 - DNA, 20 bp, Artificial Sequence
  Description of Artificial Sequence: Synthetic oligonucleotide
  Target: ATXN1; (+) strand; PAM type: YTN; PAM sequence: CTT
cagacacaatcttagctgag

SEQ ID NO: 268484 - DNA, 20 bp, Artificial Sequence
  Description of Artificial Sequence: Synthetic oligonucleotide
  Target: ATXN1; (+) strand; PAM type: YTN; PAM sequence: TTC
agacacaatcttagctgaga

SEQ ID NO: 268485 - DNA, 20 bp, Artificial Sequence
  Description of Artificial Sequence: Synthetic oligonucleotide
  Target: ATXN1; (+) strand; PAM type: YTN; PAM sequence: CTT
agctgagatgcaaacttgca

SEQ ID NO: 268486 - DNA, 20 bp, Artificial Sequence
  Description of Artificial Sequence: Synthetic oligonucleotide
  Target: ATXN1; (+) strand; PAM type: YTN; PAM sequence: TTA
gctgagatgcaaacttgcaa

SEQ ID NO: 268487 - DNA, 20 bp, Artificial Sequence
  Description of Artificial Sequence: Synthetic oligonucleotide
  Target: ATXN1; (+) strand; PAM type: YTN; PAM sequence: CTG
agatgcaaacttgcaaaagc

SEQ ID NO: 268488 - DNA, 20 bp, Artificial Sequence
  Description of Artificial Sequence: Synthetic oligonucleotide
  Target: ATXN1; (+) strand; PAM type: YTN; PAM sequence: CTT
gcaaaagcctcaaaacaggc

SEQ ID NO: 268489 - DNA, 20 bp, Artificial Sequence
  Description of Artificial Sequence: Synthetic oligonucleotide
  Target: ATXN1; (+) strand; PAM type: YTN; PAM sequence: TTG
caaaagcctcaaaacaggcc

SEQ ID NO: 268490 - DNA, 20 bp, Artificial Sequence
  Description of Artificial Sequence: Synthetic oligonucleotide
  Target: ATXN1; (+) strand; PAM type: YTN; PAM sequence: CTC
aaaacaggccacttggcttt

SEQ ID NO: 268491 - DNA, 20 bp, Artificial Sequence
  Description of Artificial Sequence: Synthetic oligonucleotide
  Target: ATXN1; (+) strand; PAM type: YTN; PAM sequence: CTT
ggctttactcttctgcaaaa

SEQ ID NO: 268492 - DNA, 20 bp, Artificial Sequence
  Description of Artificial Sequence: Synthetic oligonucleotide
  Target: ATXN1; (+) strand; PAM type: YTN; PAM sequence: TTG
gctttactcttctgcaaaag

SEQ ID NO: 268493 - DNA, 20 bp, Artificial Sequence
  Description of Artificial Sequence: Synthetic oligonucleotide
  Target: ATXN1; (+) strand; PAM type: YTN; PAM sequence: CTT
tactcttctgcaaaaggagg

SEQ ID NO: 268494 - DNA, 20 bp, Artificial Sequence
  Description of Artificial Sequence: Synthetic oligonucleotide
  Target: ATXN1; (+) strand; PAM type: YTN; PAM sequence: TTT
actcttctgcaaaaggaggc

SEQ ID NO: 268495 - DNA, 20 bp, Artificial Sequence
  Description of Artificial Sequence: Synthetic oligonucleotide
  Target: ATXN1; (+) strand; PAM type: YTN; PAM sequence: TTA
ctcttctgcaaaaggaggca

SEQ ID NO: 268496 - DNA, 20 bp, Artificial Sequence
  Description of Artificial Sequence: Synthetic oligonucleotide
  Target: ATXN1; (+) strand; PAM type: YTN; PAM sequence: CTC
ttctgcaaaaggaggcaagg

SEQ ID NO: 268497 - DNA, 20 bp, Artificial Sequence
  Description of Artificial Sequence: Synthetic oligonucleotide
  Target: ATXN1; (+) strand; PAM type: YTN; PAM sequence: CTT
ctgcaaaaggaggcaaggac

SEQ ID NO: 268498 - DNA, 20 bp, Artificial Sequence
  Description of Artificial Sequence: Synthetic oligonucleotide
  Target: ATXN1; (+) strand; PAM type: YTN; PAM sequence: TTC
tgcaaaaggaggcaaggact

SEQ ID NO: 268499 - DNA, 20 bp, Artificial Sequence
  Description of Artificial Sequence: Synthetic oligonucleotide
  Target: ATXN1; (+) strand; PAM type: YTN; PAM sequence: CTG
caaaaggaggcaaggactag

SEQ ID NO: 268500 - DNA, 20 bp, Artificial Sequence
  Description of Artificial Sequence: Synthetic oligonucleotide
  Target: ATXN1; (+) strand; PAM type: YTN; PAM sequence: CTA
gcaccttctgccactgtcat

SEQ ID NO: 268501 - DNA, 20 bp, Artificial Sequence
  Description of Artificial Sequence: Synthetic oligonucleotide
  Target: ATXN1; (+) strand; PAM type: YTN; PAM sequence: CTT
ctgccactgtcatatcttac

SEQ ID NO: 268502 - DNA, 20 bp, Artificial Sequence
  Description of Artificial Sequence: Synthetic oligonucleotide
  Target: ATXN1; (+) strand; PAM type: YTN; PAM sequence: TTC
tgccactgtcatatcttact

SEQ ID NO: 268503 - DNA, 20 bp, Artificial Sequence
  Description of Artificial Sequence: Synthetic oligonucleotide
  Target: ATXN1; (+) strand; PAM type: YTN; PAM sequence: CTG
ccactgtcatatcttactgg

SEQ ID NO: 268504 - DNA, 20 bp, Artificial Sequence
  Description of Artificial Sequence: Synthetic oligonucleotide
  Target: ATXN1; (+) strand; PAM type: YTN; PAM sequence: CTG
tcatatcttactgggtcatg

SEQ ID NO: 268505 - DNA, 20 bp, Artificial Sequence
  Description of Artificial Sequence: Synthetic oligonucleotide
  Target: ATXN1; (+) strand; PAM type: YTN; PAM sequence: CTT
actgggtcatggagaagatc

SEQ ID NO: 268506 - DNA, 20 bp, Artificial Sequence
  Description of Artificial Sequence: Synthetic oligonucleotide
  Target: ATXN1; (+) strand; PAM type: YTN; PAM sequence: TTA
ctgggtcatggagaagatca

SEQ ID NO: 268507 - DNA, 20 bp, Artificial Sequence
  Description of Artificial Sequence: Synthetic oligonucleotide
  Target: ATXN1; (+) strand; PAM type: YTN; PAM sequence: CTG
ggtcatggagaagatcaaga

SEQ ID NO: 268508 - DNA, 20 bp, Artificial Sequence
  Description of Artificial Sequence: Synthetic oligonucleotide
  Target: ATXN1; (+) strand; PAM type: YTN; PAM sequence: TTC
ttgcaaagcacacacagttc

SEQ ID NO: 268509 - DNA, 20 bp, Artificial Sequence
  Description of Artificial Sequence: Synthetic oligonucleotide
  Target: ATXN1; (+) strand; PAM type: YTN; PAM sequence: CTT
gcaaagcacacacagttccc

SEQ ID NO: 268510 - DNA, 20 bp, Artificial Sequence
  Description of Artificial Sequence: Synthetic oligonucleotide
  Target: ATXN1; (+) strand; PAM type: YTN; PAM sequence: TTG
caaagcacacacagttcccg

SEQ ID NO: 268511 - DNA, 20 bp, Artificial Sequence
  Description of Artificial Sequence: Synthetic oligonucleotide
  Target: ATXN1; (+) strand; PAM type: YTN; PAM sequence: TTC
ccgagaagaaatccactatg

SEQ ID NO: 268512 - DNA, 20 bp, Artificial Sequence
  Description of Artificial Sequence: Synthetic oligonucleotide
  Target: ATXN1; (+) strand; PAM type: YTN; PAM sequence: CTA
tgttaatgcaaagcgttgtt

SEQ ID NO: 268513 - DNA, 20 bp, Artificial Sequence
  Description of Artificial Sequence: Synthetic oligonucleotide
  Target: ATXN1; (+) strand; PAM type: YTN; PAM sequence: TTA
atgcaaagcgttgttggtgg

SEQ ID NO: 268514 - DNA, 20 bp, Artificial Sequence
  Description of Artificial Sequence: Synthetic oligonucleotide
  Target: ATXN1; (+) strand; PAM type: YTN; PAM sequence: TTG
ttggtggtcataagcctgtt

SEQ ID NO: 268515 - DNA, 20 bp, Artificial Sequence
  Description of Artificial Sequence: Synthetic oligonucleotide
  Target: ATXN1; (+) strand; PAM type: YTN; PAM sequence: TTG
gtggtcataagcctgttcct

SEQ ID NO: 268516 - DNA, 20 bp, Artificial Sequence
  Description of Artificial Sequence: Synthetic oligonucleotide
  Target: ATXN1; (+) strand; PAM type: YTN; PAM sequence: CTG
ttcctgagctctggagccag

SEQ ID NO: 268517 - DNA, 20 bp, Artificial Sequence
  Description of Artificial Sequence: Synthetic oligonucleotide
  Target: ATXN1; (+) strand; PAM type: YTN; PAM sequence: TTC
ctgagctctggagccagaat

SEQ ID NO: 268518 - DNA, 20 bp, Artificial Sequence
  Description of Artificial Sequence: Synthetic oligonucleotide
  Target: ATXN1; (+) strand; PAM type: YTN; PAM sequence: CTG
agctctggagccagaataca

SEQ ID NO: 268519 - DNA, 20 bp, Artificial Sequence
  Description of Artificial Sequence: Synthetic oligonucleotide
  Target: ATXN1; (+) strand; PAM type: YTN; PAM sequence: CTC
tggagccagaatacaaaagc

SEQ ID NO: 268520 - DNA, 20 bp, Artificial Sequence
  Description of Artificial Sequence: Synthetic oligonucleotide
  Target: ATXN1; (+) strand; PAM type: YTN; PAM sequence: CTG
gagccagaatacaaaagcca

SEQ ID NO: 268521 - DNA, 20 bp, Artificial Sequence
  Description of Artificial Sequence: Synthetic oligonucleotide
  Target: ATXN1; (+) strand; PAM type: YTN; PAM sequence: CTG
gtaaggcaccaatcatcaac

SEQ ID NO: 268522 - DNA, 20 bp, Artificial Sequence
  Description of Artificial Sequence: Synthetic oligonucleotide
  Target: ATXN1; (+) strand; PAM type: YTN; PAM sequence: CTA
tcccgggagcatccaaacgt

SEQ ID NO: 268523 - DNA, 20 bp, Artificial Sequence
  Description of Artificial Sequence: Synthetic oligonucleotide
  Target: ATXN1; (+) strand; PAM type: YTN; PAM sequence: CTG
catgccctactgtgctgagt

SEQ ID NO: 268524 - DNA, 20 bp, Artificial Sequence
  Description of Artificial Sequence: Synthetic oligonucleotide
  Target: ATXN1; (+) strand; PAM type: YTN; PAM sequence: CTA
ctgtgctgagtttcaggaaa

SEQ ID NO: 268525 - DNA, 20 bp, Artificial Sequence
  Description of Artificial Sequence: Synthetic oligonucleotide
  Target: ATXN1; (+) strand; PAM type: YTN; PAM sequence: CTG
tgctgagtttcaggaaagaa

SEQ ID NO: 268526 - DNA, 20 bp, Artificial Sequence
  Description of Artificial Sequence: Synthetic oligonucleotide
  Target: ATXN1; (+) strand; PAM type: YTN; PAM sequence: CTG
agtttcaggaaagaatagga

SEQ ID NO: 268527 - DNA, 20 bp, Artificial Sequence
  Description of Artificial Sequence: Synthetic oligonucleotide
  Target: ATXN1; (+) strand; PAM type: YTN; PAM sequence: TTT
caggaaagaataggaacaga

SEQ ID NO: 268528 - DNA, 20 bp, Artificial Sequence
  Description of Artificial Sequence: Synthetic oligonucleotide
  Target: ATXN1; (+) strand; PAM type: YTN; PAM sequence: TTC
aggaaagaataggaacagaa

SEQ ID NO: 268529 - DNA, 20 bp, Artificial Sequence
  Description of Artificial Sequence: Synthetic oligonucleotide
  Target: ATXN1; (+) strand; PAM type: YTN; PAM sequence: CTG
gaatctccgggaaaaagaaa

SEQ ID NO: 268530 - DNA, 20 bp, Artificial Sequence
  Description of Artificial Sequence: Synthetic oligonucleotide
  Target: ATXN1; (+) strand; PAM type: YTN; PAM sequence: CTC
cgggaaaaagaaagtgaagg

SEQ ID NO: 268531 - DNA, 20 bp, Artificial Sequence
  Description of Artificial Sequence: Synthetic oligonucleotide
  Target: ATXN1; (+) strand; PAM type: YTN; PAM sequence: CTA
ggagaaagagtgtaaggtgg

SEQ ID NO: 268532 - DNA, 20 bp, Artificial Sequence
  Description of Artificial Sequence: Synthetic oligonucleotide
  Target: ATXN1; (+) strand; PAM type: YTN; PAM sequence: TTA
tttggtacacggctccctca

SEQ ID NO: 268533 - DNA, 20 bp, Artificial Sequence
  Description of Artificial Sequence: Synthetic oligonucleotide
  Target: ATXN1; (+) strand; PAM type: YTN; PAM sequence: TTT
ggtacacggctccctcagat

SEQ ID NO: 268534 - DNA, 20 bp, Artificial Sequence
  Description of Artificial Sequence: Synthetic oligonucleotide
  Target: ATXN1; (+) strand; PAM type: YTN; PAM sequence: TTG
gtacacggctccctcagatt

SEQ ID NO: 268535 - DNA, 20 bp, Artificial Sequence
  Description of Artificial Sequence: Synthetic oligonucleotide
  Target: ATXN1; (+) strand; PAM type: YTN; PAM sequence: CTC
cctcagattgctggtttgca

SEQ ID NO: 268536 - DNA, 20 bp, Artificial Sequence
  Description of Artificial Sequence: Synthetic oligonucleotide
  Target: ATXN1; (+) strand; PAM type: YTN; PAM sequence: CTC
agattgctggtttgcagcgt

SEQ ID NO: 268537 - DNA, 20 bp, Artificial Sequence
  Description of Artificial Sequence: Synthetic oligonucleotide
  Target: ATXN1; (+) strand; PAM type: YTN; PAM sequence: TTG
ctggtttgcagcgtttcgtg

SEQ ID NO: 268538 - DNA, 20 bp, Artificial Sequence
  Description of Artificial Sequence: Synthetic oligonucleotide
  Target: ATXN1; (+) strand; PAM type: YTN; PAM sequence: CTG
gtttgcagcgtttcgtgcac

SEQ ID NO: 268539 - DNA, 20 bp, Artificial Sequence
  Description of Artificial Sequence: Synthetic oligonucleotide
  Target: ATXN1; (+) strand; PAM type: YTN; PAM sequence: TTT
gcagcgtttcgtgcactgaa

SEQ ID NO: 268540 - DNA, 20 bp, Artificial Sequence
  Description of Artificial Sequence: Synthetic oligonucleotide
  Target: ATXN1; (+) strand; PAM type: YTN; PAM sequence: TTG
cagcgtttcgtgcactgaat

SEQ ID NO: 268541 - DNA, 20 bp, Artificial Sequence
  Description of Artificial Sequence: Synthetic oligonucleotide
  Target: ATXN1; (+) strand; PAM type: YTN; PAM sequence: TTT
cgtgcactgaatgtttgcga

SEQ ID NO: 268542 - DNA, 20 bp, Artificial Sequence
  Description of Artificial Sequence: Synthetic oligonucleotide
  Target: ATXN1; (+) strand; PAM type: YTN; PAM sequence: TTC
gtgcactgaatgtttgcgac

SEQ ID NO: 268543 - DNA, 20 bp, Artificial Sequence
  Description of Artificial Sequence: Synthetic oligonucleotide
  Target: ATXN1; (+) strand; PAM type: YTN; PAM sequence: CTG
aatgtttgcgacactgtgaa

SEQ ID NO: 268544 - DNA, 20 bp, Artificial Sequence
  Description of Artificial Sequence: Synthetic oligonucleotide
  Target: ATXN1; (+) strand; PAM type: YTN; PAM sequence: TTT
gcgacactgtgaaattttcc

SEQ ID NO: 268545 - DNA, 20 bp, Artificial Sequence
  Description of Artificial Sequence: Synthetic oligonucleotide
  Target: ATXN1; (+) strand; PAM type: YTN; PAM sequence: TTG
cgacactgtgaaattttcca

SEQ ID NO: 268546 - DNA, 20 bp, Artificial Sequence
  Description of Artificial Sequence: Synthetic oligonucleotide
  Target: ATXN1; (+) strand; PAM type: YTN; PAM sequence: CTG
tgaaattttccacttggctg

SEQ ID NO: 268547 - DNA, 20 bp, Artificial Sequence
  Description of Artificial Sequence: Synthetic oligonucleotide
  Target: ATXN1; (+) strand; PAM type: YTN; PAM sequence: TTT
tccacttggctgtctgccat

SEQ ID NO: 268548 - DNA, 20 bp, Artificial Sequence
  Description of Artificial Sequence: Synthetic oligonucleotide
  Target: ATXN1; (+) strand; PAM type: YTN; PAM sequence: TTT
ccacttggctgtctgccatt

SEQ ID NO: 268549 - DNA, 20 bp, Artificial Sequence
  Description of Artificial Sequence: Synthetic oligonucleotide
  Target: ATXN1; (+) strand; PAM type: YTN; PAM sequence: TTC
cacttggctgtctgccattt

SEQ ID NO: 268550 - DNA, 20 bp, Artificial Sequence
  Description of Artificial Sequence: Synthetic oligonucleotide
  Target: ATXN1; (+) strand; PAM type: YTN; PAM sequence: CTT
ggctgtctgccatttccgcc

SEQ ID NO: 268551 - DNA, 20 bp, Artificial Sequence
  Description of Artificial Sequence: Synthetic oligonucleotide
  Target: ATXN1; (+) strand; PAM type: YTN; PAM sequence: TTG
gctgtctgccatttccgccc

SEQ ID NO: 268552 - DNA, 20 bp, Artificial Sequence
  Description of Artificial Sequence: Synthetic oligonucleotide
  Target: ATXN1; (+) strand; PAM type: YTN; PAM sequence: CTG
tctgccatttccgcccaccg

SEQ ID NO: 268553 - DNA, 20 bp, Artificial Sequence
  Description of Artificial Sequence: Synthetic oligonucleotide
  Target: ATXN1; (+) strand; PAM type: YTN; PAM sequence: CTG
ccatttccgcccaccgaaga

SEQ ID NO: 268554 - DNA, 20 bp, Artificial Sequence
  Description of Artificial Sequence: Synthetic oligonucleotide
  Target: ATXN1; (+) strand; PAM type: YTN; PAM sequence: TTT
ccgcccaccgaagacaacac

SEQ ID NO: 268555 - DNA, 20 bp, Artificial Sequence
  Description of Artificial Sequence: Synthetic oligonucleotide
  Target: ATXN1; (+) strand; PAM type: YTN; PAM sequence: TTC
cgcccaccgaagacaacact

SEQ ID NO: 268556 - DNA, 20 bp, Artificial Sequence
  Description of Artificial Sequence: Synthetic oligonucleotide
  Target: ATXN1; (+) strand; PAM type: YTN; PAM sequence: CTT
acacccaccagagtggcaca

SEQ ID NO: 268557 - DNA, 20 bp, Artificial Sequence
  Description of Artificial Sequence: Synthetic oligonucleotide
  Target: ATXN1; (+) strand; PAM type: YTN; PAM sequence: TTA
cacccaccagagtggcacag

SEQ ID NO: 268558 - DNA, 20 bp, Artificial Sequence
  Description of Artificial Sequence: Synthetic oligonucleotide
  Target: ATXN1; (+) strand; PAM type: YTN; PAM sequence: CTG
ctggaaaaggattggataac

SEQ ID NO: 268559 - DNA, 20 bp, Artificial Sequence
  Description of Artificial Sequence: Synthetic oligonucleotide
  Target: ATXN1; (+) strand; PAM type: YTN; PAM sequence: CTG
gaaaaggattggataacttt

SEQ ID NO: 268560 - DNA, 20 bp, Artificial Sequence
  Description of Artificial Sequence: Synthetic oligonucleotide
  Target: ATXN1; (+) strand; PAM type: YTN; PAM sequence: TTG
gataactttttgtttatttg

SEQ ID NO: 268561 - DNA, 20 bp, Artificial Sequence
  Description of Artificial Sequence: Synthetic oligonucleotide
  Target: ATXN1; (+) strand; PAM type: YTN; PAM sequence: CTT
tttgtttatttgctgttgct

SEQ ID NO: 268562 - DNA, 20 bp, Artificial Sequence
  Description of Artificial Sequence: Synthetic oligonucleotide
  Target: ATXN1; (+) strand; PAM type: YTN; PAM sequence: TTT
ttgtttatttgctgttgctt

SEQ ID NO: 268563 - DNA, 20 bp, Artificial Sequence
  Description of Artificial Sequence: Synthetic oligonucleotide
  Target: ATXN1; (+) strand; PAM type: YTN; PAM sequence: TTT
tgtttatttgctgttgcttt

SEQ ID NO: 268564 - DNA, 20 bp, Artificial Sequence
  Description of Artificial Sequence: Synthetic oligonucleotide
  Target: ATXN1; (+) strand; PAM type: YTN; PAM sequence: TTT
gtttatttgctgttgctttt

SEQ ID NO: 268565 - DNA, 20 bp, Artificial Sequence
  Description of Artificial Sequence: Synthetic oligonucleotide
  Target: ATXN1; (+) strand; PAM type: YTN; PAM sequence: TTG
tttatttgctgttgctttta

SEQ ID NO: 268566 - DNA, 20 bp, Artificial Sequence
  Description of Artificial Sequence: Synthetic oligonucleotide
  Target: ATXN1; (+) strand; PAM type: YTN; PAM sequence: TTT
atttgctgttgcttttaatg

SEQ ID NO: 268567 - DNA, 20 bp, Artificial Sequence
  Description of Artificial Sequence: Synthetic oligonucleotide
  Target: ATXN1; (+) strand; PAM type: YTN; PAM sequence: TTA
tttgctgttgcttttaatga

SEQ ID NO: 268568 - DNA, 20 bp, Artificial Sequence
  Description of Artificial Sequence: Synthetic oligonucleotide
  Target: ATXN1; (+) strand; PAM type: YTN; PAM sequence: TTT
gctgttgcttttaatgaaaa

SEQ ID NO: 268569 - DNA, 20 bp, Artificial Sequence
  Description of Artificial Sequence: Synthetic oligonucleotide
  Target: ATXN1; (+) strand; PAM type: YTN; PAM sequence: TTG
ctgttgcttttaatgaaaag

SEQ ID NO: 268570 - DNA, 20 bp, Artificial Sequence
  Description of Artificial Sequence: Synthetic oligonucleotide
  Target: ATXN1; (+) strand; PAM type: YTN; PAM sequence: CTG
ttgcttttaatgaaaagact

SEQ ID NO: 268571 - DNA, 20 bp, Artificial Sequence
  Description of Artificial Sequence: Synthetic oligonucleotide
  Target: ATXN1; (+) strand; PAM type: YTN; PAM sequence: TTG
cttttaatgaaaagacttat

SEQ ID NO: 268572 - DNA, 20 bp, Artificial Sequence
  Description of Artificial Sequence: Synthetic oligonucleotide
  Target: ATXN1; (+) strand; PAM type: YTN; PAM sequence: CTT
ttaatgaaaagacttattca

SEQ ID NO: 268573 - DNA, 20 bp, Artificial Sequence
  Description of Artificial Sequence: Synthetic oligonucleotide
  Target: ATXN1; (+) strand; PAM type: YTN; PAM sequence: TTT
taatgaaaagacttattcat

SEQ ID NO: 268574 - DNA, 20 bp, Artificial Sequence
  Description of Artificial Sequence: Synthetic oligonucleotide
  Target: ATXN1; (+) strand; PAM type: YTN; PAM sequence: TTT
aatgaaaagacttattcata

SEQ ID NO: 268575 - DNA, 20 bp, Artificial Sequence
  Description of Artificial Sequence: Synthetic oligonucleotide
  Target: ATXN1; (+) strand; PAM type: YTN; PAM sequence: TTA
atgaaaagacttattcatat

SEQ ID NO: 268576 - DNA, 20 bp, Artificial Sequence
  Description of Artificial Sequence: Synthetic oligonucleotide
  Target: ATXN1; (+) strand; PAM type: YTN; PAM sequence: CTT
attcatatcctgatcattaa

SEQ ID NO: 268577 - DNA, 20 bp, Artificial Sequence
  Description of Artificial Sequence: Synthetic oligonucleotide
  Target: ATXN1; (+) strand; PAM type: YTN; PAM sequence: TTA
ttcatatcctgatcattaat

SEQ ID NO: 268578 - DNA, 20 bp, Artificial Sequence
  Description of Artificial Sequence: Synthetic oligonucleotide
  Target: ATXN1; (+) strand; PAM type: YTN; PAM sequence: TTC
atatcctgatcattaatatt

SEQ ID NO: 268579 - DNA, 20 bp, Artificial Sequence
  Description of Artificial Sequence: Synthetic oligonucleotide
  Target: ATXN1; (+) strand; PAM type: YTN; PAM sequence: CTG
atcattaatattttccacac

SEQ ID NO: 268580 - DNA, 20 bp, Artificial Sequence
  Description of Artificial Sequence: Synthetic oligonucleotide
  Target: ATXN1; (+) strand; PAM type: YTN; PAM sequence: TTA
atattttccacacctggatt

SEQ ID NO: 268581 - DNA, 20 bp, Artificial Sequence
  Description of Artificial Sequence: Synthetic oligonucleotide
  Target: ATXN1; (+) strand; PAM type: YTN; PAM sequence: TTT
tccacacctggatttcttga

SEQ ID NO: 268582 - DNA, 20 bp, Artificial Sequence
  Description of Artificial Sequence: Synthetic oligonucleotide
  Target: ATXN1; (+) strand; PAM type: YTN; PAM sequence: TTT
ccacacctggatttcttgat

SEQ ID NO: 268583 - DNA, 20 bp, Artificial Sequence
  Description of Artificial Sequence: Synthetic oligonucleotide
  Target: ATXN1; (+) strand; PAM type: YTN; PAM sequence: TTC
cacacctggatttcttgatt

SEQ ID NO: 268584 - DNA, 20 bp, Artificial Sequence
  Description of Artificial Sequence: Synthetic oligonucleotide
  Target: ATXN1; (+) strand; PAM type: YTN; PAM sequence: CTG
gatttcttgatttttttccc

SEQ ID NO: 268585 - DNA, 20 bp, Artificial Sequence
  Description of Artificial Sequence: Synthetic oligonucleotide
  Target: ATXN1; (+) strand; PAM type: YTN; PAM sequence: TTT
cttgatttttttcccccttt

SEQ ID NO: 268586 - DNA, 20 bp, Artificial Sequence
  Description of Artificial Sequence: Synthetic oligonucleotide
  Target: ATXN1; (+) strand; PAM type: YTN; PAM sequence: TTC
ttgatttttttccccctttc

SEQ ID NO: 268587 - DNA, 20 bp, Artificial Sequence
  Description of Artificial Sequence: Synthetic oligonucleotide
  Target: ATXN1; (+) strand; PAM type: YTN; PAM sequence: CTT
gatttttttccccctttcaa

SEQ ID NO: 268588 - DNA, 20 bp, Artificial Sequence
  Description of Artificial Sequence: Synthetic oligonucleotide
  Target: ATXN1; (+) strand; PAM type: YTN; PAM sequence: TTG
atttttttccccctttcaag

SEQ ID NO: 268589 - DNA, 20 bp, Artificial Sequence
  Description of Artificial Sequence: Synthetic oligonucleotide
  Target: ATXN1; (+) strand; PAM type: YTN; PAM sequence: TTT
ttttccccctttcaaggctg

SEQ ID NO: 268590 - DNA, 20 bp, Artificial Sequence
  Description of Artificial Sequence: Synthetic oligonucleotide
  Target: ATXN1; (+) strand; PAM type: YTN; PAM sequence: TTT
tttccccctttcaaggctga

SEQ ID NO: 268591 - DNA, 20 bp, Artificial Sequence
  Description of Artificial Sequence: Synthetic oligonucleotide
  Target: ATXN1; (+) strand; PAM type: YTN; PAM sequence: TTT
ttccccctttcaaggctgac

SEQ ID NO: 268592 - DNA, 20 bp, Artificial Sequence
  Description of Artificial Sequence: Synthetic oligonucleotide
  Target: ATXN1; (+) strand; PAM type: YTN; PAM sequence: TTT
tccccctttcaaggctgacc

SEQ ID NO: 268593 - DNA, 20 bp, Artificial Sequence
  Description of Artificial Sequence: Synthetic oligonucleotide
  Target: ATXN1; (+) strand; PAM type: YTN; PAM sequence: TTT
ccccctttcaaggctgaccc

SEQ ID NO: 268594 - DNA, 20 bp, Artificial Sequence
  Description of Artificial Sequence: Synthetic oligonucleotide
  Target: ATXN1; (+) strand; PAM type: YTN; PAM sequence: TTC
cccctttcaaggctgaccca

SEQ ID NO: 268595 - DNA, 20 bp, Artificial Sequence
  Description of Artificial Sequence: Synthetic oligonucleotide
  Target: ATXN1; (+) strand; PAM type: YTN; PAM sequence: CTT
tcaaggctgacccaggaaca

SEQ ID NO: 268596 - DNA, 20 bp, Artificial Sequence
  Description of Artificial Sequence: Synthetic oligonucleotide
  Target: ATXN1; (+) strand; PAM type: YTN; PAM sequence: TTT
caaggctgacccaggaacag

SEQ ID NO: 268597 - DNA, 20 bp, Artificial Sequence
  Description of Artificial Sequence: Synthetic oligonucleotide
  Target: ATXN1; (+) strand; PAM type: YTN; PAM sequence: TTC
aaggctgacccaggaacagc

SEQ ID NO: 268598 - DNA, 20 bp, Artificial Sequence
  Description of Artificial Sequence: Synthetic oligonucleotide
  Target: ATXN1; (+) strand; PAM type: YTN; PAM sequence: CTG
acccaggaacagcttctcct

SEQ ID NO: 268599 - DNA, 20 bp, Artificial Sequence
  Description of Artificial Sequence: Synthetic oligonucleotide
  Target: ATXN1; (+) strand; PAM type: YTN; PAM sequence: CTT
ctcctggaacgatactatca

SEQ ID NO: 268600 - DNA, 20 bp, Artificial Sequence
  Description of Artificial Sequence: Synthetic oligonucleotide
  Target: ATXN1; (+) strand; PAM type: YTN; PAM sequence: TTC
tcctggaacgatactatcaa

SEQ ID NO: 268601 - DNA, 20 bp, Artificial Sequence
  Description of Artificial Sequence: Synthetic oligonucleotide
  Target: ATXN1; (+) strand; PAM type: YTN; PAM sequence: CTC
ctggaacgatactatcaact

SEQ ID NO: 268602 - DNA, 20 bp, Artificial Sequence
  Description of Artificial Sequence: Synthetic oligonucleotide
  Target: ATXN1; (+) strand; PAM type: YTN; PAM sequence: CTG
gaacgatactatcaacttat

SEQ ID NO: 268603 - DNA, 20 bp, Artificial Sequence
  Description of Artificial Sequence: Synthetic oligonucleotide
  Target: ATXN1; (+) strand; PAM type: YTN; PAM sequence: CTA
tcaacttatttcgccttgta

SEQ ID NO: 268604 - DNA, 20 bp, Artificial Sequence
  Description of Artificial Sequence: Synthetic oligonucleotide
  Target: ATXN1; (+) strand; PAM type: YTN; PAM sequence: CTT
atttcgccttgtatactttt

SEQ ID NO: 268605 - DNA, 20 bp, Artificial Sequence
  Description of Artificial Sequence: Synthetic oligonucleotide
  Target: ATXN1; (+) strand; PAM type: YTN; PAM sequence: TTA
tttcgccttgtatacttttg

SEQ ID NO: 268606 - DNA, 20 bp, Artificial Sequence
  Description of Artificial Sequence: Synthetic oligonucleotide
  Target: ATXN1; (+) strand; PAM type: YTN; PAM sequence: TTT
cgccttgtatacttttgaga

SEQ ID NO: 268607 - DNA, 20 bp, Artificial Sequence
  Description of Artificial Sequence: Synthetic oligonucleotide
  Target: ATXN1; (+) strand; PAM type: YTN; PAM sequence: TTC
gccttgtatacttttgagaa

SEQ ID NO: 268608 - DNA, 20 bp, Artificial Sequence
  Description of Artificial Sequence: Synthetic oligonucleotide
  Target: ATXN1; (+) strand; PAM type: YTN; PAM sequence: CTT
gtatacttttgagaagcaca

SEQ ID NO: 268609 - DNA, 20 bp, Artificial Sequence
  Description of Artificial Sequence: Synthetic oligonucleotide
  Target: ATXN1; (+) strand; PAM type: YTN; PAM sequence: TTG
tatacttttgagaagcacac

SEQ ID NO: 268610 - DNA, 20 bp, Artificial Sequence
  Description of Artificial Sequence: Synthetic oligonucleotide
  Target: ATXN1; (+) strand; PAM type: YTN; PAM sequence: CTT
ttgagaagcacacttgaggc

SEQ ID NO: 268611 - DNA, 20 bp, Artificial Sequence
  Description of Artificial Sequence: Synthetic oligonucleotide
  Target: ATXN1; (+) strand; PAM type: YTN; PAM sequence: TTT
tgagaagcacacttgaggca

SEQ ID NO: 268612 - DNA, 20 bp, Artificial Sequence
  Description of Artificial Sequence: Synthetic oligonucleotide
  Target: ATXN1; (+) strand; PAM type: YTN; PAM sequence: TTT
gagaagcacacttgaggcaa

SEQ ID NO: 268613 - DNA, 20 bp, Artificial Sequence
  Description of Artificial Sequence: Synthetic oligonucleotide
  Target: ATXN1; (+) strand; PAM type: YTN; PAM sequence: TTG
agaagcacacttgaggcaaa

SEQ ID NO: 268614 - DNA, 20 bp, Artificial Sequence
  Description of Artificial Sequence: Synthetic oligonucleotide
  Target: ATXN1; (+) strand; PAM type: YTN; PAM sequence: CTT
gaggcaaaggaacttgtatt

SEQ ID NO: 268615 - DNA, 20 bp, Artificial Sequence
  Description of Artificial Sequence: Synthetic oligonucleotide
  Target: ATXN1; (+) strand; PAM type: YTN; PAM sequence: TTG
aggcaaaggaacttgtatta

SEQ ID NO: 268616 - DNA, 20 bp, Artificial Sequence
  Description of Artificial Sequence: Synthetic oligonucleotide
  Target: ATXN1; (+) strand; PAM type: YTN; PAM sequence: CTT
gtattagcagctttgaggat

SEQ ID NO: 268617 - DNA, 20 bp, Artificial Sequence
  Description of Artificial Sequence: Synthetic oligonucleotide
  Target: ATXN1; (+) strand; PAM type: YTN; PAM sequence: TTG
tattagcagctttgaggatg

SEQ ID NO: 268618 - DNA, 20 bp, Artificial Sequence
  Description of Artificial Sequence: Synthetic oligonucleotide
  Target: ATXN1; (+) strand; PAM type: YTN; PAM sequence: TTA
gcagctttgaggatgacaag

SEQ ID NO: 268619 - DNA, 20 bp, Artificial Sequence
  Description of Artificial Sequence: Synthetic oligonucleotide
  Target: ATXN1; (+) strand; PAM type: YTN; PAM sequence: CTT
tgaggatgacaagaaacaga

SEQ ID NO: 268620 - DNA, 20 bp, Artificial Sequence
  Description of Artificial Sequence: Synthetic oligonucleotide
  Target: ATXN1; (+) strand; PAM type: YTN; PAM sequence: TTT
gaggatgacaagaaacagaa

SEQ ID NO: 268621 - DNA, 20 bp, Artificial Sequence
  Description of Artificial Sequence: Synthetic oligonucleotide
  Target: ATXN1; (+) strand; PAM type: YTN; PAM sequence: TTG
aggatgacaagaaacagaat

SEQ ID NO: 268622 - DNA, 20 bp, Artificial Sequence
  Description of Artificial Sequence: Synthetic oligonucleotide
  Target: ATXN1; (+) strand; PAM type: YTN; PAM sequence: TTT
aagtgctacactagaatctt

SEQ ID NO: 268623 - DNA, 20 bp, Artificial Sequence
  Description of Artificial Sequence: Synthetic oligonucleotide
  Target: ATXN1; (+) strand; PAM type: YTN; PAM sequence: TTA
agtgctacactagaatcttg

SEQ ID NO: 268624 - DNA, 20 bp, Artificial Sequence
  Description of Artificial Sequence: Synthetic oligonucleotide
  Target: ATXN1; (+) strand; PAM type: YTN; PAM sequence: CTA
cactagaatcttgttgcttc

SEQ ID NO: 268625 - DNA, 20 bp, Artificial Sequence
  Description of Artificial Sequence: Synthetic oligonucleotide
  Target: ATXN1; (+) strand; PAM type: YTN; PAM sequence: CTA
gaatcttgttgcttcccaaa

SEQ ID NO: 268626 - DNA, 20 bp, Artificial Sequence
  Description of Artificial Sequence: Synthetic oligonucleotide
  Target: ATXN1; (+) strand; PAM type: YTN; PAM sequence: CTT
gttgcttcccaaatacatca

SEQ ID NO: 268627 - DNA, 20 bp, Artificial Sequence
  Description of Artificial Sequence: Synthetic oligonucleotide
  Target: ATXN1; (+) strand; PAM type: YTN; PAM sequence: TTG
ttgcttcccaaatacatcat

SEQ ID NO: 268628 - DNA, 20 bp, Artificial Sequence
  Description of Artificial Sequence: Synthetic oligonucleotide
  Target: ATXN1; (+) strand; PAM type: YTN; PAM sequence: TTG
cttcccaaatacatcatcga

SEQ ID NO: 268629 - DNA, 20 bp, Artificial Sequence
  Description of Artificial Sequence: Synthetic oligonucleotide
  Target: ATXN1; (+) strand; PAM type: YTN; PAM sequence: CTT
cccaaatacatcatcgacaa

SEQ ID NO: 268630 - DNA, 20 bp, Artificial Sequence
  Description of Artificial Sequence: Synthetic oligonucleotide
  Target: ATXN1; (+) strand; PAM type: YTN; PAM sequence: TTC
ccaaatacatcatcgacaaa

SEQ ID NO: 268631 - DNA, 20 bp, Artificial Sequence
  Description of Artificial Sequence: Synthetic oligonucleotide
  Target: ATXN1; (+) strand; PAM type: YTN; PAM sequence: TTT
ttcctttcaaatcatgagca

SEQ ID NO: 268632 - DNA, 20 bp, Artificial Sequence
  Description of Artificial Sequence: Synthetic oligonucleotide
  Target: ATXN1; (+) strand; PAM type: YTN; PAM sequence: TTT
tcctttcaaatcatgagcat

SEQ ID NO: 268633 - DNA, 20 bp, Artificial Sequence
  Description of Artificial Sequence: Synthetic oligonucleotide
  Target: ATXN1; (+) strand; PAM type: YTN; PAM sequence: TTT
cctttcaaatcatgagcatg

SEQ ID NO: 268634 - DNA, 20 bp, Artificial Sequence
  Description of Artificial Sequence: Synthetic oligonucleotide
  Target: ATXN1; (+) strand; PAM type: YTN; PAM sequence: TTC
ctttcaaatcatgagcatgc

SEQ ID NO: 268635 - DNA, 20 bp, Artificial Sequence
  Description of Artificial Sequence: Synthetic oligonucleotide
  Target: ATXN1; (+) strand; PAM type: YTN; PAM sequence: CTT
tcaaatcatgagcatgcaca

SEQ ID NO: 268636 - DNA, 20 bp, Artificial Sequence
  Description of Artificial Sequence: Synthetic oligonucleotide
  Target: ATXN1; (+) strand; PAM type: YTN; PAM sequence: TTT
caaatcatgagcatgcacag

SEQ ID NO: 268637 - DNA, 20 bp, Artificial Sequence
  Description of Artificial Sequence: Synthetic oligonucleotide
  Target: ATXN1; (+) strand; PAM type: YTN; PAM sequence: TTC
aaatcatgagcatgcacaga

SEQ ID NO: 268638 - DNA, 20 bp, Artificial Sequence
  Description of Artificial Sequence: Synthetic oligonucleotide
  Target: ATXN1; (+) strand; PAM type: YTN; PAM sequence: TTG
tagtattagcattgtgggtg

SEQ ID NO: 268639 - DNA, 20 bp, Artificial Sequence
  Description of Artificial Sequence: Synthetic oligonucleotide
  Target: ATXN1; (+) strand; PAM type: YTN; PAM sequence: TTA
gcattgtgggtgtcattaat

SEQ ID NO: 268640 - DNA, 20 bp, Artificial Sequence
  Description of Artificial Sequence: Synthetic oligonucleotide
  Target: ATXN1; (+) strand; PAM type: YTN; PAM sequence: TTG
tgggtgtcattaatagcatt

SEQ ID NO: 268641 - DNA, 20 bp, Artificial Sequence
  Description of Artificial Sequence: Synthetic oligonucleotide
  Target: ATXN1; (+) strand; PAM type: YTN; PAM sequence: TTA
atagcatttctgaggaaaaa

SEQ ID NO: 268642 - DNA, 20 bp, Artificial Sequence
  Description of Artificial Sequence: Synthetic oligonucleotide
  Target: ATXN1; (+) strand; PAM type: YTN; PAM sequence: TTT
ctgaggaaaaaaaacaaaaa

SEQ ID NO: 268643 - DNA, 20 bp, Artificial Sequence
  Description of Artificial Sequence: Synthetic oligonucleotide
  Target: ATXN1; (+) strand; PAM type: YTN; PAM sequence: TTC
tgaggaaaaaaaacaaaaaa

SEQ ID NO: 268644 - DNA, 20 bp, Artificial Sequence
  Description of Artificial Sequence: Synthetic oligonucleotide
  Target: ATXN1; (+) strand; PAM type: YTN; PAM sequence: CTG
aggaaaaaaaacaaaaaaga

SEQ ID NO: 268645 - DNA, 20 bp, Artificial Sequence
  Description of Artificial Sequence: Synthetic oligonucleotide
  Target: ATXN1; (+) strand; PAM type: YTN; PAM sequence: CTT
tatctctaaaaaaaggcaag

SEQ ID NO: 268646 - DNA, 20 bp, Artificial Sequence
  Description of Artificial Sequence: Synthetic oligonucleotide
  Target: ATXN1; (+) strand; PAM type: YTN; PAM sequence: TTT
atctctaaaaaaaggcaaga

SEQ ID NO: 268647 - DNA, 20 bp, Artificial Sequence
  Description of Artificial Sequence: Synthetic oligonucleotide
  Target: ATXN1; (+) strand; PAM type: YTN; PAM sequence: TTA
tctctaaaaaaaggcaagaa

SEQ ID NO: 268648 - DNA, 20 bp, Artificial Sequence
  Description of Artificial Sequence: Synthetic oligonucleotide
  Target: ATXN1; (+) strand; PAM type: YTN; PAM sequence: CTC
taaaaaaaggcaagaatgaa

SEQ ID NO: 268649 - DNA, 20 bp, Artificial Sequence
  Description of Artificial Sequence: Synthetic oligonucleotide
  Target: ATXN1; (+) strand; PAM type: YTN; PAM sequence: CTA
aaaaaaggcaagaatgaata

SEQ ID NO: 268650 - DNA, 20 bp, Artificial Sequence
  Description of Artificial Sequence: Synthetic oligonucleotide
  Target: ATXN1; (+) strand; PAM type: YTN; PAM sequence: CTT
agatttggaattggtaacac

SEQ ID NO: 268651 - DNA, 20 bp, Artificial Sequence
  Description of Artificial Sequence: Synthetic oligonucleotide
  Target: ATXN1; (+) strand; PAM type: YTN; PAM sequence: TTA
gatttggaattggtaacaca

SEQ ID NO: 268652 - DNA, 20 bp, Artificial Sequence
  Description of Artificial Sequence: Synthetic oligonucleotide
  Target: ATXN1; (+) strand; PAM type: YTN; PAM sequence: TTT
ggaattggtaacacactgac

SEQ ID NO: 268653 - DNA, 20 bp, Artificial Sequence
  Description of Artificial Sequence: Synthetic oligonucleotide
  Target: ATXN1; (+) strand; PAM type: YTN; PAM sequence: TTG
gaattggtaacacactgaca

SEQ ID NO: 268654 - DNA, 20 bp, Artificial Sequence
  Description of Artificial Sequence: Synthetic oligonucleotide
  Target: ATXN1; (+) strand; PAM type: YTN; PAM sequence: TTG
gtaacacactgacaagtata

SEQ ID NO: 268655 - DNA, 20 bp, Artificial Sequence
  Description of Artificial Sequence: Synthetic oligonucleotide
  Target: ATXN1; (+) strand; PAM type: YTN; PAM sequence: CTG
acaagtatatctcaaaataa

SEQ ID NO: 268656 - DNA, 20 bp, Artificial Sequence
  Description of Artificial Sequence: Synthetic oligonucleotide
  Target: ATXN1; (+) strand; PAM type: YTN; PAM sequence: CTC
aaaataaagaactaataaaa

SEQ ID NO: 268657 - DNA, 20 bp, Artificial Sequence
  Description of Artificial Sequence: Synthetic oligonucleotide
  Target: ATXN1; (+) strand; PAM type: YTN; PAM sequence: CTA
ataaaaaatggagagacaaa

SEQ ID NO: 268658 - DNA, 20 bp, Artificial Sequence
  Description of Artificial Sequence: Synthetic oligonucleotide
  Target: ATXN1; (+) strand; PAM type: YTN; PAM sequence: TTG
ggacagaagagagaaaggag

SEQ ID NO: 268659 - DNA, 20 bp, Artificial Sequence
  Description of Artificial Sequence: Synthetic oligonucleotide
  Target: ATXN1; (+) strand; PAM type: YTN; PAM sequence: CTG
ctactcacataattaaccat

SEQ ID NO: 268660 - DNA, 20 bp, Artificial Sequence
  Description of Artificial Sequence: Synthetic oligonucleotide
  Target: ATXN1; (+) strand; PAM type: YTN; PAM sequence: CTA
ctcacataattaaccatcac

SEQ ID NO: 268661 - DNA, 20 bp, Artificial Sequence
  Description of Artificial Sequence: Synthetic oligonucleotide
  Target: ATXN1; (+) strand; PAM type: YTN; PAM sequence: CTC
acataattaaccatcacttt

SEQ ID NO: 268662 - DNA, 20 bp, Artificial Sequence
  Description of Artificial Sequence: Synthetic oligonucleotide
  Target: ATXN1; (+) strand; PAM type: YTN; PAM sequence: TTA
accatcactttcataatgaa

SEQ ID NO: 268663 - DNA, 20 bp, Artificial Sequence
  Description of Artificial Sequence: Synthetic oligonucleotide
  Target: ATXN1; (+) strand; PAM type: YTN; PAM sequence: CTT
tcataatgaatacagtttac

SEQ ID NO: 268664 - DNA, 20 bp, Artificial Sequence
  Description of Artificial Sequence: Synthetic oligonucleotide
  Target: ATXN1; (+) strand; PAM type: YTN; PAM sequence: TTT
cataatgaatacagtttacc

SEQ ID NO: 268665 - DNA, 20 bp, Artificial Sequence
  Description of Artificial Sequence: Synthetic oligonucleotide
  Target: ATXN1; (+) strand; PAM type: YTN; PAM sequence: TTC
ataatgaatacagtttacca

SEQ ID NO: 268666 - DNA, 20 bp, Artificial Sequence
  Description of Artificial Sequence: Synthetic oligonucleotide
  Target: ATXN1; (+) strand; PAM type: YTN; PAM sequence: TTT
accaagtgctttctcattaa

SEQ ID NO: 268667 - DNA, 20 bp, Artificial Sequence
  Description of Artificial Sequence: Synthetic oligonucleotide
  Target: ATXN1; (+) strand; PAM type: YTN; PAM sequence: TTA
ccaagtgctttctcattaat

SEQ ID NO: 268668 - DNA, 20 bp, Artificial Sequence
  Description of Artificial Sequence: Synthetic oligonucleotide
  Target: ATXN1; (+) strand; PAM type: YTN; PAM sequence: CTT
tctcattaattaaatcattc

SEQ ID NO: 268669 - DNA, 20 bp, Artificial Sequence
  Description of Artificial Sequence: Synthetic oligonucleotide
  Target: ATXN1; (+) strand; PAM type: YTN; PAM sequence: TTT
ctcattaattaaatcattcg

SEQ ID NO: 268670 - DNA, 20 bp, Artificial Sequence
  Description of Artificial Sequence: Synthetic oligonucleotide
  Target: ATXN1; (+) strand; PAM type: YTN; PAM sequence: TTC
tcattaattaaatcattcgc

SEQ ID NO: 268671 - DNA, 20 bp, Artificial Sequence
  Description of Artificial Sequence: Synthetic oligonucleotide
  Target: ATXN1; (+) strand; PAM type: YTN; PAM sequence: CTC
attaattaaatcattcgctt

SEQ ID NO: 268672 - DNA, 20 bp, Artificial Sequence
  Description of Artificial Sequence: Synthetic oligonucleotide
  Target: ATXN1; (+) strand; PAM type: YTN; PAM sequence: TTA
attaaatcattcgcttgata

SEQ ID NO: 268673 - DNA, 20 bp, Artificial Sequence
  Description of Artificial Sequence: Synthetic oligonucleotide
  Target: ATXN1; (+) strand; PAM type: YTN; PAM sequence: TTA
aatcattcgcttgatacaat

SEQ ID NO: 268674 - DNA, 20 bp, Artificial Sequence
  Description of Artificial Sequence: Synthetic oligonucleotide
  Target: ATXN1; (+) strand; PAM type: YTN; PAM sequence: TTC
gcttgatacaattttacttg

SEQ ID NO: 268675 - DNA, 20 bp, Artificial Sequence
  Description of Artificial Sequence: Synthetic oligonucleotide
  Target: ATXN1; (+) strand; PAM type: YTN; PAM sequence: CTT
gatacaattttacttggtac

SEQ ID NO: 268676 - DNA, 20 bp, Artificial Sequence
  Description of Artificial Sequence: Synthetic oligonucleotide
  Target: ATXN1; (+) strand; PAM type: YTN; PAM sequence: TTG
atacaattttacttggtact

SEQ ID NO: 268677 - DNA, 20 bp, Artificial Sequence
  Description of Artificial Sequence: Synthetic oligonucleotide
  Target: ATXN1; (+) strand; PAM type: YTN; PAM sequence: TTT
tacttggtacttgctaaatc

SEQ ID NO: 268678 - DNA, 20 bp, Artificial Sequence
  Description of Artificial Sequence: Synthetic oligonucleotide
  Target: ATXN1; (+) strand; PAM type: YTN; PAM sequence: TTT
acttggtacttgctaaatcc

SEQ ID NO: 268679 - DNA, 20 bp, Artificial Sequence
  Description of Artificial Sequence: Synthetic oligonucleotide
  Target: ATXN1; (+) strand; PAM type: YTN; PAM sequence: TTA
cttggtacttgctaaatcca

SEQ ID NO: 268680 - DNA, 20 bp, Artificial Sequence
  Description of Artificial Sequence: Synthetic oligonucleotide
  Target: ATXN1; (+) strand; PAM type: YTN; PAM sequence: CTT
ggtacttgctaaatccacca

SEQ ID NO: 268681 - DNA, 20 bp, Artificial Sequence
  Description of Artificial Sequence: Synthetic oligonucleotide
  Target: ATXN1; (+) strand; PAM type: YTN; PAM sequence: TTG
gtacttgctaaatccaccag

SEQ ID NO: 268682 - DNA, 20 bp, Artificial Sequence
  Description of Artificial Sequence: Synthetic oligonucleotide
  Target: ATXN1; (+) strand; PAM type: YTN; PAM sequence: CTT
gctaaatccaccaggctctg

SEQ ID NO: 268683 - DNA, 20 bp, Artificial Sequence
  Description of Artificial Sequence: Synthetic oligonucleotide
  Target: ATXN1; (+) strand; PAM type: YTN; PAM sequence: TTG
ctaaatccaccaggctctgt

SEQ ID NO: 268684 - DNA, 20 bp, Artificial Sequence
  Description of Artificial Sequence: Synthetic oligonucleotide
  Target: ATXN1; (+) strand; PAM type: YTN; PAM sequence: CTA
aatccaccaggctctgtgtt

SEQ ID NO: 268685 - DNA, 20 bp, Artificial Sequence
  Description of Artificial Sequence: Synthetic oligonucleotide
  Target: ATXN1; (+) strand; PAM type: YTN; PAM sequence: CTC
tgtgttcaactggggaatac

SEQ ID NO: 268686 - DNA, 20 bp, Artificial Sequence
  Description of Artificial Sequence: Synthetic oligonucleotide
  Target: ATXN1; (+) strand; PAM type: YTN; PAM sequence: CTG
tgttcaactggggaatacat

SEQ ID NO: 268687 - DNA, 20 bp, Artificial Sequence
  Description of Artificial Sequence: Synthetic oligonucleotide
  Target: ATXN1; (+) strand; PAM type: YTN; PAM sequence: TTC
aactggggaatacatggtaa

SEQ ID NO: 268688 - DNA, 20 bp, Artificial Sequence
  Description of Artificial Sequence: Synthetic oligonucleotide
  Target: ATXN1; (+) strand; PAM type: YTN; PAM sequence: CTG
gggaatacatggtaaacaaa

SEQ ID NO: 268689 - DNA, 20 bp, Artificial Sequence
  Description of Artificial Sequence: Synthetic oligonucleotide
  Target: ATXN1; (+) strand; PAM type: YTN; PAM sequence: CTG
cacccaaggagctcactgcc

SEQ ID NO: 268690 - DNA, 20 bp, Artificial Sequence
  Description of Artificial Sequence: Synthetic oligonucleotide
  Target: ATXN1; (+) strand; PAM type: YTN; PAM sequence: CTC
actgcctcaagagggacaga

SEQ ID NO: 268691 - DNA, 20 bp, Artificial Sequence
  Description of Artificial Sequence: Synthetic oligonucleotide
  Target: ATXN1; (+) strand; PAM type: YTN; PAM sequence: CTG
cctcaagagggacagaatta

SEQ ID NO: 268692 - DNA, 20 bp, Artificial Sequence
  Description of Artificial Sequence: Synthetic oligonucleotide
  Target: ATXN1; (+) strand; PAM type: YTN; PAM sequence: CTC
aagagggacagaattaaata

SEQ ID NO: 268693 - DNA, 20 bp, Artificial Sequence
  Description of Artificial Sequence: Synthetic oligonucleotide
  Target: ATXN1; (+) strand; PAM type: YTN; PAM sequence: TTA
aataattatatgagttttag

SEQ ID NO: 268694 - DNA, 20 bp, Artificial Sequence
  Description of Artificial Sequence: Synthetic oligonucleotide
  Target: ATXN1; (+) strand; PAM type: YTN; PAM sequence: TTA
tatgagttttaggagatgca

SEQ ID NO: 268695 - DNA, 20 bp, Artificial Sequence
  Description of Artificial Sequence: Synthetic oligonucleotide
  Target: ATXN1; (+) strand; PAM type: YTN; PAM sequence: TTT
taggagatgcataaaatttg

SEQ ID NO: 268696 - DNA, 20 bp, Artificial Sequence
  Description of Artificial Sequence: Synthetic oligonucleotide
  Target: ATXN1; (+) strand; PAM type: YTN; PAM sequence: TTT
aggagatgcataaaatttga

SEQ ID NO: 268697 - DNA, 20 bp, Artificial Sequence
  Description of Artificial Sequence: Synthetic oligonucleotide
  Target: ATXN1; (+) strand; PAM type: YTN; PAM sequence: TTA
ggagatgcataaaatttgaa

SEQ ID NO: 268698 - DNA, 20 bp, Artificial Sequence
  Description of Artificial Sequence: Synthetic oligonucleotide
  Target: ATXN1; (+) strand; PAM type: YTN; PAM sequence: TTT
gaaaactggataggcaatat

SEQ ID NO: 268699 - DNA, 20 bp, Artificial Sequence
  Description of Artificial Sequence: Synthetic oligonucleotide
  Target: ATXN1; (+) strand; PAM type: YTN; PAM sequence: TTG
aaaactggataggcaatatg

SEQ ID NO: 268700 - DNA, 20 bp, Artificial Sequence
  Description of Artificial Sequence: Synthetic oligonucleotide
  Target: ATXN1; (+) strand; PAM type: YTN; PAM sequence: CTG
gataggcaatatgaaggaaa

SEQ ID NO: 268701 - DNA, 20 bp, Artificial Sequence
  Description of Artificial Sequence: Synthetic oligonucleotide
  Target: ATXN1; (+) strand; PAM type: YTN; PAM sequence: TTG
tgatttgtagtcatgatggg

SEQ ID NO: 268702 - DNA, 20 bp, Artificial Sequence
  Description of Artificial Sequence: Synthetic oligonucleotide
  Target: ATXN1; (+) strand; PAM type: YTN; PAM sequence: TTT
gtagtcatgatgggggtacc

SEQ ID NO: 268703 - DNA, 20 bp, Artificial Sequence
  Description of Artificial Sequence: Synthetic oligonucleotide
  Target: ATXN1; (+) strand; PAM type: YTN; PAM sequence: TTG
tagtcatgatgggggtacct

SEQ ID NO: 268704 - DNA, 20 bp, Artificial Sequence
  Description of Artificial Sequence: Synthetic oligonucleotide
  Target: ATXN1; (+) strand; PAM type: YTN; PAM sequence: CTC
acttagaaggagggtctcag

SEQ ID NO: 268705 - DNA, 20 bp, Artificial Sequence
  Description of Artificial Sequence: Synthetic oligonucleotide
  Target: ATXN1; (+) strand; PAM type: YTN; PAM sequence: CTT
agaaggagggtctcaggaag

SEQ ID NO: 268706 - DNA, 20 bp, Artificial Sequence
  Description of Artificial Sequence: Synthetic oligonucleotide
  Target: ATXN1; (+) strand; PAM type: YTN; PAM sequence: TTA
gaaggagggtctcaggaagg

SEQ ID NO: 268707 - DNA, 20 bp, Artificial Sequence
  Description of Artificial Sequence: Synthetic oligonucleotide
  Target: ATXN1; (+) strand; PAM type: YTN; PAM sequence: CTC
aggaaggcttctcttacaaa

SEQ ID NO: 268708 - DNA, 20 bp, Artificial Sequence
  Description of Artificial Sequence: Synthetic oligonucleotide
  Target: ATXN1; (+) strand; PAM type: YTN; PAM sequence: CTT
ctcttacaaaactaacattc

SEQ ID NO: 268709 - DNA, 20 bp, Artificial Sequence
  Description of Artificial Sequence: Synthetic oligonucleotide
  Target: ATXN1; (+) strand; PAM type: YTN; PAM sequence: TTC
tcttacaaaactaacattcg

SEQ ID NO: 268710 - DNA, 20 bp, Artificial Sequence
  Description of Artificial Sequence: Synthetic oligonucleotide
  Target: ATXN1; (+) strand; PAM type: YTN; PAM sequence: CTC
ttacaaaactaacattcgaa

SEQ ID NO: 268711 - DNA, 20 bp, Artificial Sequence
  Description of Artificial Sequence: Synthetic oligonucleotide
  Target: ATXN1; (+) strand; PAM type: YTN; PAM sequence: CTT
acaaaactaacattcgaaca

SEQ ID NO: 268712 - DNA, 20 bp, Artificial Sequence
  Description of Artificial Sequence: Synthetic oligonucleotide
  Target: ATXN1; (+) strand; PAM type: YTN; PAM sequence: TTA
caaaactaacattcgaacag

SEQ ID NO: 268713 - DNA, 20 bp, Artificial Sequence
  Description of Artificial Sequence: Synthetic oligonucleotide
  Target: ATXN1; (+) strand; PAM type: YTN; PAM sequence: CTA
acattcgaacaggaaagtca

SEQ ID NO: 268714 - DNA, 20 bp, Artificial Sequence
  Description of Artificial Sequence: Synthetic oligonucleotide
  Target: ATXN1; (+) strand; PAM type: YTN; PAM sequence: TTC
gaacaggaaagtcaaaaatg

SEQ ID NO: 268715 - DNA, 20 bp, Artificial Sequence
  Description of Artificial Sequence: Synthetic oligonucleotide
  Target: ATXN1; (+) strand; PAM type: YTN; PAM sequence: TTA
gccaggcatcaggtttccag

SEQ ID NO: 268716 - DNA, 20 bp, Artificial Sequence
  Description of Artificial Sequence: Synthetic oligonucleotide
  Target: ATXN1; (+) strand; PAM type: YTN; PAM sequence: TTT
ccaggtagaggaaacagtct

SEQ ID NO: 268717 - DNA, 20 bp, Artificial Sequence
  Description of Artificial Sequence: Synthetic oligonucleotide
  Target: ATXN1; (+) strand; PAM type: YTN; PAM sequence: TTC
caggtagaggaaacagtctg

SEQ ID NO: 268718 - DNA, 20 bp, Artificial Sequence
  Description of Artificial Sequence: Synthetic oligonucleotide
  Target: ATXN1; (+) strand; PAM type: YTN; PAM sequence: CTG
tattatacgaactgatctag

SEQ ID NO: 268719 - DNA, 20 bp, Artificial Sequence
  Description of Artificial Sequence: Synthetic oligonucleotide
  Target: ATXN1; (+) strand; PAM type: YTN; PAM sequence: TTA
tacgaactgatctagtgatg

SEQ ID NO: 268720 - DNA, 20 bp, Artificial Sequence
  Description of Artificial Sequence: Synthetic oligonucleotide
  Target: ATXN1; (+) strand; PAM type: YTN; PAM sequence: CTG
atctagtgatgtacaactgt

SEQ ID NO: 268721 - DNA, 20 bp, Artificial Sequence
  Description of Artificial Sequence: Synthetic oligonucleotide
  Target: ATXN1; (+) strand; PAM type: YTN; PAM sequence: CTA
gtgatgtacaactgtgttct

SEQ ID NO: 268722 - DNA, 20 bp, Artificial Sequence
  Description of Artificial Sequence: Synthetic oligonucleotide
  Target: ATXN1; (+) strand; PAM type: YTN; PAM sequence: CTG
tgttctgttatttctctctt

SEQ ID NO: 268723 - DNA, 20 bp, Artificial Sequence
  Description of Artificial Sequence: Synthetic oligonucleotide
  Target: ATXN1; (+) strand; PAM type: YTN; PAM sequence: TTC
tgttatttctctctttttta

SEQ ID NO: 268724 - DNA, 20 bp, Artificial Sequence
  Description of Artificial Sequence: Synthetic oligonucleotide
  Target: ATXN1; (+) strand; PAM type: YTN; PAM sequence: CTG
ttatttctctcttttttatt

SEQ ID NO: 268725 - DNA, 20 bp, Artificial Sequence
  Description of Artificial Sequence: Synthetic oligonucleotide
  Target: ATXN1; (+) strand; PAM type: YTN; PAM sequence: TTA
tttctctcttttttattttg

SEQ ID NO: 268726 - DNA, 20 bp, Artificial Sequence
  Description of Artificial Sequence: Synthetic oligonucleotide
  Target: ATXN1; (+) strand; PAM type: YTN; PAM sequence: TTT
ctctcttttttattttgcca

SEQ ID NO: 268727 - DNA, 20 bp, Artificial Sequence
  Description of Artificial Sequence: Synthetic oligonucleotide
  Target: ATXN1; (+) strand; PAM type: YTN; PAM sequence: TTC
tctcttttttattttgccat

SEQ ID NO: 268728 - DNA, 20 bp, Artificial Sequence
  Description of Artificial Sequence: Synthetic oligonucleotide
  Target: ATXN1; (+) strand; PAM type: YTN; PAM sequence: CTC
tcttttttattttgccattt

SEQ ID NO: 268729 - DNA, 20 bp, Artificial Sequence
  Description of Artificial Sequence: Synthetic oligonucleotide
  Target: ATXN1; (+) strand; PAM type: YTN; PAM sequence: CTC
ttttttattttgccatttca

SEQ ID NO: 268730 - DNA, 20 bp, Artificial Sequence
  Description of Artificial Sequence: Synthetic oligonucleotide
  Target: ATXN1; (+) strand; PAM type: YTN; PAM sequence: CTT
ttttattttgccatttcaac

SEQ ID NO: 268731 - DNA, 20 bp, Artificial Sequence
  Description of Artificial Sequence: Synthetic oligonucleotide
  Target: ATXN1; (+) strand; PAM type: YTN; PAM sequence: TTT
tttattttgccatttcaact

SEQ ID NO: 268732 - DNA, 20 bp, Artificial Sequence
  Description of Artificial Sequence: Synthetic oligonucleotide
  Target: ATXN1; (+) strand; PAM type: YTN; PAM sequence: TTT
ttattttgccatttcaactg

SEQ ID NO: 268733 - DNA, 20 bp, Artificial Sequence
  Description of Artificial Sequence: Synthetic oligonucleotide
  Target: ATXN1; (+) strand; PAM type: YTN; PAM sequence: TTT
tattttgccatttcaactga

SEQ ID NO: 268734 - DNA, 20 bp, Artificial Sequence
  Description of Artificial Sequence: Synthetic oligonucleotide
  Target: ATXN1; (+) strand; PAM type: YTN; PAM sequence: TTT
attttgccatttcaactgag

SEQ ID NO: 268735 - DNA, 20 bp, Artificial Sequence
  Description of Artificial Sequence: Synthetic oligonucleotide
  Target: ATXN1; (+) strand; PAM type: YTN; PAM sequence: TTA
ttttgccatttcaactgagt

SEQ ID NO: 268736 - DNA, 20 bp, Artificial Sequence
  Description of Artificial Sequence: Synthetic oligonucleotide
  Target: ATXN1; (+) strand; PAM type: YTN; PAM sequence: TTT
tgccatttcaactgagtctc

SEQ ID NO: 268737 - DNA, 20 bp, Artificial Sequence
  Description of Artificial Sequence: Synthetic oligonucleotide
  Target: ATXN1; (+) strand; PAM type: YTN; PAM sequence: TTT
gccatttcaactgagtctcc

SEQ ID NO: 268738 - DNA, 20 bp, Artificial Sequence
  Description of Artificial Sequence: Synthetic oligonucleotide
  Target: ATXN1; (+) strand; PAM type: YTN; PAM sequence: TTG
ccatttcaactgagtctcct

SEQ ID NO: 268739 - DNA, 20 bp, Artificial Sequence
  Description of Artificial Sequence: Synthetic oligonucleotide
  Target: ATXN1; (+) strand; PAM type: YTN; PAM sequence: TTT
caactgagtctccttgaaaa

SEQ ID NO: 268740 - DNA, 20 bp, Artificial Sequence
  Description of Artificial Sequence: Synthetic oligonucleotide
  Target: ATXN1; (+) strand; PAM type: YTN; PAM sequence: TTC
aactgagtctccttgaaaaa

SEQ ID NO: 268741 - DNA, 20 bp, Artificial Sequence
  Description of Artificial Sequence: Synthetic oligonucleotide
  Target: ATXN1; (+) strand; PAM type: YTN; PAM sequence: CTG
agtctccttgaaaaagaaat

SEQ ID NO: 268742 - DNA, 20 bp, Artificial Sequence
  Description of Artificial Sequence: Synthetic oligonucleotide
  Target: ATXN1; (+) strand; PAM type: YTN; PAM sequence: CTC
cttgaaaaagaaatgagtga

SEQ ID NO: 268743 - DNA, 20 bp, Artificial Sequence
  Description of Artificial Sequence: Synthetic oligonucleotide
  Target: ATXN1; (+) strand; PAM type: YTN; PAM sequence: CTT
gaaaaagaaatgagtgacac

SEQ ID NO: 268744 - DNA, 20 bp, Artificial Sequence
  Description of Artificial Sequence: Synthetic oligonucleotide
  Target: ATXN1; (+) strand; PAM type: YTN; PAM sequence: TTG
aaaaagaaatgagtgacaca

SEQ ID NO: 268745 - DNA, 20 bp, Artificial Sequence
  Description of Artificial Sequence: Synthetic oligonucleotide
  Target: ATXN1; (+) strand; PAM type: YTN; PAM sequence: CTG
ttctccataccttgaaataa

SEQ ID NO: 268746 - DNA, 20 bp, Artificial Sequence
  Description of Artificial Sequence: Synthetic oligonucleotide
  Target: ATXN1; (+) strand; PAM type: YTN; PAM sequence: TTC
tccataccttgaaataagag

SEQ ID NO: 268747 - DNA, 20 bp, Artificial Sequence
  Description of Artificial Sequence: Synthetic oligonucleotide
  Target: ATXN1; (+) strand; PAM type: YTN; PAM sequence: CTC
cataccttgaaataagagat

SEQ ID NO: 268748 - DNA, 20 bp, Artificial Sequence
  Description of Artificial Sequence: Synthetic oligonucleotide
  Target: ATXN1; (+) strand; PAM type: YTN; PAM sequence: CTT
gaaataagagatgattcatc

SEQ ID NO: 268749 - DNA, 20 bp, Artificial Sequence
  Description of Artificial Sequence: Synthetic oligonucleotide
  Target: ATXN1; (+) strand; PAM type: YTN; PAM sequence: TTG
aaataagagatgattcatct

SEQ ID NO: 268750 - DNA, 20 bp, Artificial Sequence
  Description of Artificial Sequence: Synthetic oligonucleotide
  Target: ATXN1; (+) strand; PAM type: YTN; PAM sequence: TTC
atctttctgactgctaggcc

SEQ ID NO: 268751 - DNA, 20 bp, Artificial Sequence
  Description of Artificial Sequence: Synthetic oligonucleotide
  Target: ATXN1; (+) strand; PAM type: YTN; PAM sequence: CTT
tctgactgctaggccatcag

SEQ ID NO: 268752 - DNA, 20 bp, Artificial Sequence
  Description of Artificial Sequence: Synthetic oligonucleotide
  Target: ATXN1; (+) strand; PAM type: YTN; PAM sequence: TTT
ctgactgctaggccatcaga

SEQ ID NO: 268753 - DNA, 20 bp, Artificial Sequence
  Description of Artificial Sequence: Synthetic oligonucleotide
  Target: ATXN1; (+) strand; PAM type: YTN; PAM sequence: TTC
tgactgctaggccatcagag

SEQ ID NO: 268754 - DNA, 20 bp, Artificial Sequence
  Description of Artificial Sequence: Synthetic oligonucleotide
  Target: ATXN1; (+) strand; PAM type: YTN; PAM sequence: CTG
actgctaggccatcagagca

SEQ ID NO: 268755 - DNA, 20 bp, Artificial Sequence
  Description of Artificial Sequence: Synthetic oligonucleotide
  Target: ATXN1; (+) strand; PAM type: YTN; PAM sequence: CTG
ctaggccatcagagcaacac

SEQ ID NO: 268756 - DNA, 20 bp, Artificial Sequence
  Description of Artificial Sequence: Synthetic oligonucleotide
  Target: ATXN1; (+) strand; PAM type: YTN; PAM sequence: CTA
ggccatcagagcaacacaca

SEQ ID NO: 268757 - DNA, 20 bp, Artificial Sequence
  Description of Artificial Sequence: Synthetic oligonucleotide
  Target: ATXN1; (+) strand; PAM type: YTN; PAM sequence: CTT
ctctgtgattaatttcggtg

SEQ ID NO: 268758 - DNA, 20 bp, Artificial Sequence
  Description of Artificial Sequence: Synthetic oligonucleotide
  Target: ATXN1; (+) strand; PAM type: YTN; PAM sequence: TTC
tctgtgattaatttcggtga

SEQ ID NO: 268759 - DNA, 20 bp, Artificial Sequence
  Description of Artificial Sequence: Synthetic oligonucleotide
  Target: ATXN1; (+) strand; PAM type: YTN; PAM sequence: CTC
tgtgattaatttcggtgaga

SEQ ID NO: 268760 - DNA, 20 bp, Artificial Sequence
  Description of Artificial Sequence: Synthetic oligonucleotide
  Target: ATXN1; (+) strand; PAM type: YTN; PAM sequence: CTG
tgattaatttcggtgagagg

SEQ ID NO: 268761 - DNA, 20 bp, Artificial Sequence
  Description of Artificial Sequence: Synthetic oligonucleotide
  Target: ATXN1; (+) strand; PAM type: YTN; PAM sequence: TTA
atttcggtgagaggaacacc

SEQ ID NO: 268762 - DNA, 20 bp, Artificial Sequence
  Description of Artificial Sequence: Synthetic oligonucleotide
  Target: ATXN1; (+) strand; PAM type: YTN; PAM sequence: TTT
cggtgagaggaacacccctg

SEQ ID NO: 268763 - DNA, 20 bp, Artificial Sequence
  Description of Artificial Sequence: Synthetic oligonucleotide
  Target: ATXN1; (+) strand; PAM type: YTN; PAM sequence: TTC
ggtgagaggaacacccctga

SEQ ID NO: 268764 - DNA, 20 bp, Artificial Sequence
  Description of Artificial Sequence: Synthetic oligonucleotide
  Target: ATXN1; (+) strand; PAM type: YTN; PAM sequence: CTG
atgcaggtattattcttgat

SEQ ID NO: 268765 - DNA, 20 bp, Artificial Sequence
  Description of Artificial Sequence: Synthetic oligonucleotide
  Target: ATXN1; (+) strand; PAM type: YTN; PAM sequence: TTA
ttcttgatgtgacagcaaat

SEQ ID NO: 268766 - DNA, 20 bp, Artificial Sequence
  Description of Artificial Sequence: Synthetic oligonucleotide
  Target: ATXN1; (+) strand; PAM type: YTN; PAM sequence: TTC
ttgatgtgacagcaaataat

SEQ ID NO: 268767 - DNA, 20 bp, Artificial Sequence
  Description of Artificial Sequence: Synthetic oligonucleotide
  Target: ATXN1; (+) strand; PAM type: YTN; PAM sequence: CTT
gatgtgacagcaaataatga

SEQ ID NO: 268768 - DNA, 20 bp, Artificial Sequence
  Description of Artificial Sequence: Synthetic oligonucleotide
  Target: ATXN1; (+) strand; PAM type: YTN; PAM sequence: TTG
atgtgacagcaaataatgac

SEQ ID NO: 268769 - DNA, 20 bp, Artificial Sequence
  Description of Artificial Sequence: Synthetic oligonucleotide
  Target: ATXN1; (+) strand; PAM type: YTN; PAM sequence: CTG
ctctctaatgcaccccaagt

SEQ ID NO: 268770 - DNA, 20 bp, Artificial Sequence
  Description of Artificial Sequence: Synthetic oligonucleotide
  Target: ATXN1; (+) strand; PAM type: YTN; PAM sequence: CTC
tctaatgcaccccaagtcac

SEQ ID NO: 268771 - DNA, 20 bp, Artificial Sequence
  Description of Artificial Sequence: Synthetic oligonucleotide
  Target: ATXN1; (+) strand; PAM type: YTN; PAM sequence: CTC
taatgcaccccaagtcactc

SEQ ID NO: 268772 - DNA, 20 bp, Artificial Sequence
  Description of Artificial Sequence: Synthetic oligonucleotide
  Target: ATXN1; (+) strand; PAM type: YTN; PAM sequence: CTA
atgcaccccaagtcactccg

SEQ ID NO: 268773 - DNA, 20 bp, Artificial Sequence
  Description of Artificial Sequence: Synthetic oligonucleotide
  Target: ATXN1; (+) strand; PAM type: YTN; PAM sequence: CTC
cgttatcacagtgaagtaaa

SEQ ID NO: 268774 - DNA, 20 bp, Artificial Sequence
  Description of Artificial Sequence: Synthetic oligonucleotide
  Target: ATXN1; (+) strand; PAM type: YTN; PAM sequence: TTA
tcacagtgaagtaaaaggaa

SEQ ID NO: 268775 - DNA, 20 bp, Artificial Sequence
  Description of Artificial Sequence: Synthetic oligonucleotide
  Target: ATXN1; (+) strand; PAM type: YTN; PAM sequence: CTC
tcttgttgacacctgcatgc

SEQ ID NO: 268776 - DNA, 20 bp, Artificial Sequence
  Description of Artificial Sequence: Synthetic oligonucleotide
  Target: ATXN1; (+) strand; PAM type: YTN; PAM sequence: CTC
ttgttgacacctgcatgcca

SEQ ID NO: 268777 - DNA, 20 bp, Artificial Sequence
  Description of Artificial Sequence: Synthetic oligonucleotide
  Target: ATXN1; (+) strand; PAM type: YTN; PAM sequence: CTT
gttgacacctgcatgccaca

SEQ ID NO: 268778 - DNA, 20 bp, Artificial Sequence
  Description of Artificial Sequence: Synthetic oligonucleotide
  Target: ATXN1; (+) strand; PAM type: YTN; PAM sequence: TTG
ttgacacctgcatgccacag

SEQ ID NO: 268779 - DNA, 20 bp, Artificial Sequence
  Description of Artificial Sequence: Synthetic oligonucleotide
  Target: ATXN1; (+) strand; PAM type: YTN; PAM sequence: TTG
acacctgcatgccacagctg

SEQ ID NO: 268780 - DNA, 20 bp, Artificial Sequence
  Description of Artificial Sequence: Synthetic oligonucleotide
  Target: ATXN1; (+) strand; PAM type: YTN; PAM sequence: CTG
catgccacagctgaagttaa

SEQ ID NO: 268781 - DNA, 20 bp, Artificial Sequence
  Description of Artificial Sequence: Synthetic oligonucleotide
  Target: ATXN1; (+) strand; PAM type: YTN; PAM sequence: CTG
aagttaagaaaaccctcccc

SEQ ID NO: 268782 - DNA, 20 bp, Artificial Sequence
  Description of Artificial Sequence: Synthetic oligonucleotide
  Target: ATXN1; (+) strand; PAM type: YTN; PAM sequence: TTA
agaaaaccctcccccaaaaa

SEQ ID NO: 268783 - DNA, 20 bp, Artificial Sequence
  Description of Artificial Sequence: Synthetic oligonucleotide
  Target: ATXN1; (+) strand; PAM type: YTN; PAM sequence: CTC
ccccaaaaaggactgaaaac

SEQ ID NO: 268784 - DNA, 20 bp, Artificial Sequence
  Description of Artificial Sequence: Synthetic oligonucleotide
  Target: ATXN1; (+) strand; PAM type: YTN; PAM sequence: CTG
aaaacagatcacattacttg

SEQ ID NO: 268785 - DNA, 20 bp, Artificial Sequence
  Description of Artificial Sequence: Synthetic oligonucleotide
  Target: ATXN1; (+) strand; PAM type: YTN; PAM sequence: TTA
cttgtagacttctgaaaaac

SEQ ID NO: 268786 - DNA, 20 bp, Artificial Sequence
  Description of Artificial Sequence: Synthetic oligonucleotide
  Target: ATXN1; (+) strand; PAM type: YTN; PAM sequence: CTT
gtagacttctgaaaaacatc

SEQ ID NO: 268787 - DNA, 20 bp, Artificial Sequence
  Description of Artificial Sequence: Synthetic oligonucleotide
  Target: ATXN1; (+) strand; PAM type: YTN; PAM sequence: TTG
tagacttctgaaaaacatct

SEQ ID NO: 268788 - DNA, 20 bp, Artificial Sequence
  Description of Artificial Sequence: Synthetic oligonucleotide
  Target: ATXN1; (+) strand; PAM type: YTN; PAM sequence: CTT
ctgaaaaacatctttaggac

SEQ ID NO: 268789 - DNA, 20 bp, Artificial Sequence
  Description of Artificial Sequence: Synthetic oligonucleotide
  Target: ATXN1; (+) strand; PAM type: YTN; PAM sequence: TTC
tgaaaaacatctttaggacc

SEQ ID NO: 268790 - DNA, 20 bp, Artificial Sequence
  Description of Artificial Sequence: Synthetic oligonucleotide
  Target: ATXN1; (+) strand; PAM type: YTN; PAM sequence: CTG
aaaaacatctttaggacctt

SEQ ID NO: 268791 - DNA, 20 bp, Artificial Sequence
  Description of Artificial Sequence: Synthetic oligonucleotide
  Target: ATXN1; (+) strand; PAM type: YTN; PAM sequence: CTT
taggaccttggatcaggtac

SEQ ID NO: 268792 - DNA, 20 bp, Artificial Sequence
  Description of Artificial Sequence: Synthetic oligonucleotide
  Target: ATXN1; (+) strand; PAM type: YTN; PAM sequence: TTT
aggaccttggatcaggtacc

SEQ ID NO: 268793 - DNA, 20 bp, Artificial Sequence
  Description of Artificial Sequence: Synthetic oligonucleotide
  Target: ATXN1; (+) strand; PAM type: YTN; PAM sequence: TTA
ggaccttggatcaggtacca

SEQ ID NO: 268794 - DNA, 20 bp, Artificial Sequence
  Description of Artificial Sequence: Synthetic oligonucleotide
  Target: ATXN1; (+) strand; PAM type: YTN; PAM sequence: CTT
ggatcaggtaccagatttct

SEQ ID NO: 268795 - DNA, 20 bp, Artificial Sequence
  Description of Artificial Sequence: Synthetic oligonucleotide
  Target: ATXN1; (+) strand; PAM type: YTN; PAM sequence: TTG
gatcaggtaccagatttctg

SEQ ID NO: 268796 - DNA, 20 bp, Artificial Sequence
  Description of Artificial Sequence: Synthetic oligonucleotide
  Target: ATXN1; (+) strand; PAM type: YTN; PAM sequence: TTT
ctggcttccccttgatgatt

SEQ ID NO: 268797 - DNA, 20 bp, Artificial Sequence
  Description of Artificial Sequence: Synthetic oligonucleotide
  Target: ATXN1; (+) strand; PAM type: YTN; PAM sequence: TTC
tggcttccccttgatgatta

SEQ ID NO: 268798 - DNA, 20 bp, Artificial Sequence
  Description of Artificial Sequence: Synthetic oligonucleotide
  Target: ATXN1; (+) strand; PAM type: YTN; PAM sequence: CTG
gcttccccttgatgattacg

SEQ ID NO: 268799 - DNA, 20 bp, Artificial Sequence
  Description of Artificial Sequence: Synthetic oligonucleotide
  Target: ATXN1; (+) strand; PAM type: YTN; PAM sequence: CTT
ccccttgatgattacggtat

SEQ ID NO: 268800 - DNA, 20 bp, Artificial Sequence
  Description of Artificial Sequence: Synthetic oligonucleotide
  Target: ATXN1; (+) strand; PAM type: YTN; PAM sequence: TTC
cccttgatgattacggtatt

SEQ ID NO: 268801 - DNA, 20 bp, Artificial Sequence
  Description of Artificial Sequence: Synthetic oligonucleotide
  Target: ATXN1; (+) strand; PAM type: YTN; PAM sequence: CTT
gatgattacggtatttttac

SEQ ID NO: 268802 - DNA, 20 bp, Artificial Sequence
  Description of Artificial Sequence: Synthetic oligonucleotide
  Target: ATXN1; (+) strand; PAM type: YTN; PAM sequence: TTG
atgattacggtatttttact

SEQ ID NO: 268803 - DNA, 20 bp, Artificial Sequence
  Description of Artificial Sequence: Synthetic oligonucleotide
  Target: ATXN1; (+) strand; PAM type: YTN; PAM sequence: TTA
cggtatttttactatttctc

SEQ ID NO: 268804 - DNA, 20 bp, Artificial Sequence
  Description of Artificial Sequence: Synthetic oligonucleotide
  Target: ATXN1; (+) strand; PAM type: YTN; PAM sequence: TTT
ttactatttctctcttggac

SEQ ID NO: 268805 - DNA, 20 bp, Artificial Sequence
  Description of Artificial Sequence: Synthetic oligonucleotide
  Target: ATXN1; (+) strand; PAM type: YTN; PAM sequence: TTT
tactatttctctcttggact

SEQ ID NO: 268806 - DNA, 20 bp, Artificial Sequence
  Description of Artificial Sequence: Synthetic oligonucleotide
  Target: ATXN1; (+) strand; PAM type: YTN; PAM sequence: TTT
actatttctctcttggactt

SEQ ID NO: 268807 - DNA, 20 bp, Artificial Sequence
  Description of Artificial Sequence: Synthetic oligonucleotide
  Target: ATXN1; (+) strand; PAM type: YTN; PAM sequence: TTA
ctatttctctcttggactta

SEQ ID NO: 268808 - DNA, 20 bp, Artificial Sequence
  Description of Artificial Sequence: Synthetic oligonucleotide
  Target: ATXN1; (+) strand; PAM type: YTN; PAM sequence: CTA
tttctctcttggacttaaac

SEQ ID NO: 268809 - DNA, 20 bp, Artificial Sequence
  Description of Artificial Sequence: Synthetic oligonucleotide
  Target: ATXN1; (+) strand; PAM type: YTN; PAM sequence: TTT
ctctcttggacttaaacagc

SEQ ID NO: 268810 - DNA, 20 bp, Artificial Sequence
  Description of Artificial Sequence: Synthetic oligonucleotide
  Target: ATXN1; (+) strand; PAM type: YTN; PAM sequence: TTC
tctcttggacttaaacagct

SEQ ID NO: 268811 - DNA, 20 bp, Artificial Sequence
  Description of Artificial Sequence: Synthetic oligonucleotide
  Target: ATXN1; (+) strand; PAM type: YTN; PAM sequence: CTC
tcttggacttaaacagcttt

SEQ ID NO: 268812 - DNA, 20 bp, Artificial Sequence
  Description of Artificial Sequence: Synthetic oligonucleotide
  Target: ATXN1; (+) strand; PAM type: YTN; PAM sequence: CTC
ttggacttaaacagctttta

SEQ ID NO: 268813 - DNA, 20 bp, Artificial Sequence
  Description of Artificial Sequence: Synthetic oligonucleotide
  Target: ATXN1; (+) strand; PAM type: YTN; PAM sequence: CTT
ggacttaaacagcttttatg

SEQ ID NO: 268814 - DNA, 20 bp, Artificial Sequence
  Description of Artificial Sequence: Synthetic oligonucleotide
  Target: ATXN1; (+) strand; PAM type: YTN; PAM sequence: TTG
gacttaaacagcttttatgc

SEQ ID NO: 268815 - DNA, 20 bp, Artificial Sequence
  Description of Artificial Sequence: Synthetic oligonucleotide
  Target: ATXN1; (+) strand; PAM type: YTN; PAM sequence: CTT
aaacagcttttatgcccacc

SEQ ID NO: 268816 - DNA, 20 bp, Artificial Sequence
  Description of Artificial Sequence: Synthetic oligonucleotide
  Target: ATXN1; (+) strand; PAM type: YTN; PAM sequence: TTA
aacagcttttatgcccaccg

SEQ ID NO: 268817 - DNA, 20 bp, Artificial Sequence
  Description of Artificial Sequence: Synthetic oligonucleotide
  Target: ATXN1; (+) strand; PAM type: YTN; PAM sequence: CTT
ttatgcccaccgttaacagt

SEQ ID NO: 268818 - DNA, 20 bp, Artificial Sequence
  Description of Artificial Sequence: Synthetic oligonucleotide
  Target: ATXN1; (+) strand; PAM type: YTN; PAM sequence: TTT
tatgcccaccgttaacagtg

SEQ ID NO: 268819 - DNA, 20 bp, Artificial Sequence
  Description of Artificial Sequence: Synthetic oligonucleotide
  Target: ATXN1; (+) strand; PAM type: YTN; PAM sequence: TTT
atgcccaccgttaacagtgt

SEQ ID NO: 268820 - DNA, 20 bp, Artificial Sequence
  Description of Artificial Sequence: Synthetic oligonucleotide
  Target: ATXN1; (+) strand; PAM type: YTN; PAM sequence: TTA
tgcccaccgttaacagtgtt

SEQ ID NO: 268821 - DNA, 20 bp, Artificial Sequence
  Description of Artificial Sequence: Synthetic oligonucleotide
  Target: ATXN1; (+) strand; PAM type: YTN; PAM sequence: TTA
acagtgttccgtcaaccttc

SEQ ID NO: 268822 - DNA, 20 bp, Artificial Sequence
  Description of Artificial Sequence: Synthetic oligonucleotide
  Target: ATXN1; (+) strand; PAM type: YTN; PAM sequence: TTC
cgtcaaccttctctcttggt

SEQ ID NO: 268823 - DNA, 20 bp, Artificial Sequence
  Description of Artificial Sequence: Synthetic oligonucleotide
  Target: ATXN1; (+) strand; PAM type: YTN; PAM sequence: CTT
ctctcttggttcttggttca

SEQ ID NO: 268824 - DNA, 20 bp, Artificial Sequence
  Description of Artificial Sequence: Synthetic oligonucleotide
  Target: ATXN1; (+) strand; PAM type: YTN; PAM sequence: TTC
tctcttggttcttggttcag

SEQ ID NO: 268825 - DNA, 20 bp, Artificial Sequence
  Description of Artificial Sequence: Synthetic oligonucleotide
  Target: ATXN1; (+) strand; PAM type: YTN; PAM sequence: CTC
tcttggttcttggttcagtg

SEQ ID NO: 268826 - DNA, 20 bp, Artificial Sequence
  Description of Artificial Sequence: Synthetic oligonucleotide
  Target: ATXN1; (+) strand; PAM type: YTN; PAM sequence: CTC
ttggttcttggttcagtggt

SEQ ID NO: 268827 - DNA, 20 bp, Artificial Sequence
  Description of Artificial Sequence: Synthetic oligonucleotide
  Target: ATXN1; (+) strand; PAM type: YTN; PAM sequence: CTT
ggttcttggttcagtggtct

SEQ ID NO: 268828 - DNA, 20 bp, Artificial Sequence
  Description of Artificial Sequence: Synthetic oligonucleotide
  Target: ATXN1; (+) strand; PAM type: YTN; PAM sequence: TTG
gttcttggttcagtggtctg

SEQ ID NO: 268829 - DNA, 20 bp, Artificial Sequence
  Description of Artificial Sequence: Synthetic oligonucleotide
  Target: ATXN1; (+) strand; PAM type: YTN; PAM sequence: TTC
ttggttcagtggtctgttta

SEQ ID NO: 268830 - DNA, 20 bp, Artificial Sequence
  Description of Artificial Sequence: Synthetic oligonucleotide
  Target: ATXN1; (+) strand; PAM type: YTN; PAM sequence: CTT
ggttcagtggtctgtttact

SEQ ID NO: 268831 - DNA, 20 bp, Artificial Sequence
  Description of Artificial Sequence: Synthetic oligonucleotide
  Target: ATXN1; (+) strand; PAM type: YTN; PAM sequence: TTG
gttcagtggtctgtttactt

SEQ ID NO: 268832 - DNA, 20 bp, Artificial Sequence
  Description of Artificial Sequence: Synthetic oligonucleotide
  Target: ATXN1; (+) strand; PAM type: YTN; PAM sequence: TTC
agtggtctgtttacttaccc

SEQ ID NO: 268833 - DNA, 20 bp, Artificial Sequence
  Description of Artificial Sequence: Synthetic oligonucleotide
  Target: ATXN1; (+) strand; PAM type: YTN; PAM sequence: CTG
tttacttacccacatgagcc

SEQ ID NO: 268834 - DNA, 20 bp, Artificial Sequence
  Description of Artificial Sequence: Synthetic oligonucleotide
  Target: ATXN1; (+) strand; PAM type: YTN; PAM sequence: TTT
acttacccacatgagccgca

SEQ ID NO: 268835 - DNA, 20 bp, Artificial Sequence
  Description of Artificial Sequence: Synthetic oligonucleotide
  Target: ATXN1; (+) strand; PAM type: YTN; PAM sequence: TTA
cttacccacatgagccgcaa

SEQ ID NO: 268836 - DNA, 20 bp, Artificial Sequence
  Description of Artificial Sequence: Synthetic oligonucleotide
  Target: ATXN1; (+) strand; PAM type: YTN; PAM sequence: CTT
acccacatgagccgcaagca

SEQ ID NO: 268837 - DNA, 20 bp, Artificial Sequence
  Description of Artificial Sequence: Synthetic oligonucleotide
  Target: ATXN1; (+) strand; PAM type: YTN; PAM sequence: TTA
cccacatgagccgcaagcaa

SEQ ID NO: 268838 - DNA, 20 bp, Artificial Sequence
  Description of Artificial Sequence: Synthetic oligonucleotide
  Target: ATXN1; (+) strand; PAM type: YTN; PAM sequence: TTA
aaagcagtggaaatgtcatg

SEQ ID NO: 268839 - DNA, 20 bp, Artificial Sequence
  Description of Artificial Sequence: Synthetic oligonucleotide
  Target: ATXN1; (+) strand; PAM type: YTN; PAM sequence: TTC
atctgaagtgttttcttctt

SEQ ID NO: 268840 - DNA, 20 bp, Artificial Sequence
  Description of Artificial Sequence: Synthetic oligonucleotide
  Target: ATXN1; (+) strand; PAM type: YTN; PAM sequence: CTG
aagtgttttcttcttcccta

SEQ ID NO: 268841 - DNA, 20 bp, Artificial Sequence
  Description of Artificial Sequence: Synthetic oligonucleotide
  Target: ATXN1; (+) strand; PAM type: YTN; PAM sequence: TTT
tcttcttccctatcatccca

SEQ ID NO: 268842 - DNA, 20 bp, Artificial Sequence
  Description of Artificial Sequence: Synthetic oligonucleotide
  Target: ATXN1; (+) strand; PAM type: YTN; PAM sequence: TTT
cttcttccctatcatcccac

SEQ ID NO: 268843 - DNA, 20 bp, Artificial Sequence
  Description of Artificial Sequence: Synthetic oligonucleotide
  Target: ATXN1; (+) strand; PAM type: YTN; PAM sequence: TTC
ttcttccctatcatcccaca

SEQ ID NO: 268844 - DNA, 20 bp, Artificial Sequence
  Description of Artificial Sequence: Synthetic oligonucleotide
  Target: ATXN1; (+) strand; PAM type: YTN; PAM sequence: CTT
cttccctatcatcccacatc

SEQ ID NO: 268845 - DNA, 20 bp, Artificial Sequence
  Description of Artificial Sequence: Synthetic oligonucleotide
  Target: ATXN1; (+) strand; PAM type: YTN; PAM sequence: TTC
ttccctatcatcccacatct

SEQ ID NO: 268846 - DNA, 20 bp, Artificial Sequence
  Description of Artificial Sequence: Synthetic oligonucleotide
  Target: ATXN1; (+) strand; PAM type: YTN; PAM sequence: CTT
ccctatcatcccacatctgg

SEQ ID NO: 268847 - DNA, 20 bp, Artificial Sequence
  Description of Artificial Sequence: Synthetic oligonucleotide
  Target: ATXN1; (+) strand; PAM type: YTN; PAM sequence: TTC
cctatcatcccacatctggc

SEQ ID NO: 268848 - DNA, 20 bp, Artificial Sequence
  Description of Artificial Sequence: Synthetic oligonucleotide
  Target: ATXN1; (+) strand; PAM type: YTN; PAM sequence: CTA
tcatcccacatctggctcaa

SEQ ID NO: 268849 - DNA, 20 bp, Artificial Sequence
  Description of Artificial Sequence: Synthetic oligonucleotide
  Target: ATXN1; (+) strand; PAM type: YTN; PAM sequence: CTG
gctcaacttaattcttccac

SEQ ID NO: 268850 - DNA, 20 bp, Artificial Sequence
  Description of Artificial Sequence: Synthetic oligonucleotide
  Target: ATXN1; (+) strand; PAM type: YTN; PAM sequence: CTC
aacttaattcttccactaag

SEQ ID NO: 268851 - DNA, 20 bp, Artificial Sequence
  Description of Artificial Sequence: Synthetic oligonucleotide
  Target: ATXN1; (+) strand; PAM type: YTN; PAM sequence: CTT
aattcttccactaaggaaaa

SEQ ID NO: 268852 - DNA, 20 bp, Artificial Sequence
  Description of Artificial Sequence: Synthetic oligonucleotide
  Target: ATXN1; (+) strand; PAM type: YTN; PAM sequence: TTA
attcttccactaaggaaaat

SEQ ID NO: 268853 - DNA, 20 bp, Artificial Sequence
  Description of Artificial Sequence: Synthetic oligonucleotide
  Target: ATXN1; (+) strand; PAM type: YTN; PAM sequence: TTC
ttccactaaggaaaatcagt

SEQ ID NO: 268854 - DNA, 20 bp, Artificial Sequence
  Description of Artificial Sequence: Synthetic oligonucleotide
  Target: ATXN1; (+) strand; PAM type: YTN; PAM sequence: CTT
ccactaaggaaaatcagtag

SEQ ID NO: 268855 - DNA, 20 bp, Artificial Sequence
  Description of Artificial Sequence: Synthetic oligonucleotide
  Target: ATXN1; (+) strand; PAM type: YTN; PAM sequence: TTC
cactaaggaaaatcagtagt

SEQ ID NO: 268856 - DNA, 20 bp, Artificial Sequence
  Description of Artificial Sequence: Synthetic oligonucleotide
  Target: ATXN1; (+) strand; PAM type: YTN; PAM sequence: CTA
aggaaaatcagtagtttgct

SEQ ID NO: 268857 - DNA, 20 bp, Artificial Sequence
  Description of Artificial Sequence: Synthetic oligonucleotide
  Target: ATXN1; (+) strand; PAM type: YTN; PAM sequence: TTT
gctttcttcatcctacaaca

SEQ ID NO: 268858 - DNA, 20 bp, Artificial Sequence
  Description of Artificial Sequence: Synthetic oligonucleotide
  Target: ATXN1; (+) strand; PAM type: YTN; PAM sequence: TTG
ctttcttcatcctacaacat

SEQ ID NO: 268859 - DNA, 20 bp, Artificial Sequence
  Description of Artificial Sequence: Synthetic oligonucleotide
  Target: ATXN1; (+) strand; PAM type: YTN; PAM sequence: CTT
tcttcatcctacaacattaa

SEQ ID NO: 268860 - DNA, 20 bp, Artificial Sequence
  Description of Artificial Sequence: Synthetic oligonucleotide
  Target: ATXN1; (+) strand; PAM type: YTN; PAM sequence: TTT
cttcatcctacaacattaaa

SEQ ID NO: 268861 - DNA, 20 bp, Artificial Sequence
  Description of Artificial Sequence: Synthetic oligonucleotide
  Target: ATXN1; (+) strand; PAM type: YTN; PAM sequence: TTC
ttcatcctacaacattaaag

SEQ ID NO: 268862 - DNA, 20 bp, Artificial Sequence
  Description of Artificial Sequence: Synthetic oligonucleotide
  Target: ATXN1; (+) strand; PAM type: YTN; PAM sequence: CTT
catcctacaacattaaagca

SEQ ID NO: 268863 - DNA, 20 bp, Artificial Sequence
  Description of Artificial Sequence: Synthetic oligonucleotide
  Target: ATXN1; (+) strand; PAM type: YTN; PAM sequence: TTC
atcctacaacattaaagcat

SEQ ID NO: 268864 - DNA, 20 bp, Artificial Sequence
  Description of Artificial Sequence: Synthetic oligonucleotide
  Target: ATXN1; (+) strand; PAM type: YTN; PAM sequence: CTA
caacattaaagcatcatcca

SEQ ID NO: 268865 - DNA, 20 bp, Artificial Sequence
  Description of Artificial Sequence: Synthetic oligonucleotide
  Target: ATXN1; (+) strand; PAM type: YTN; PAM sequence: TTA
aagcatcatccaacaggctc

SEQ ID NO: 268866 - DNA, 20 bp, Artificial Sequence
  Description of Artificial Sequence: Synthetic oligonucleotide
  Target: ATXN1; (+) strand; PAM type: YTN; PAM sequence: CTC
attcatgttctccccatgaa

SEQ ID NO: 268867 - DNA, 20 bp, Artificial Sequence
  Description of Artificial Sequence: Synthetic oligonucleotide
  Target: ATXN1; (+) strand; PAM type: YTN; PAM sequence: TTC
atgttctccccatgaatgga

SEQ ID NO: 268868 - DNA, 20 bp, Artificial Sequence
  Description of Artificial Sequence: Synthetic oligonucleotide
  Target: ATXN1; (+) strand; PAM type: YTN; PAM sequence: TTC
tccccatgaatggagtaagt

SEQ ID NO: 268869 - DNA, 20 bp, Artificial Sequence
  Description of Artificial Sequence: Synthetic oligonucleotide
  Target: ATXN1; (+) strand; PAM type: YTN; PAM sequence: CTC
cccatgaatggagtaagtct

SEQ ID NO: 268870 - DNA, 20 bp, Artificial Sequence
  Description of Artificial Sequence: Synthetic oligonucleotide
  Target: ATXN1; (+) strand; PAM type: YTN; PAM sequence: CTG
aaagcctgtctgaaacaaat

SEQ ID NO: 268871 - DNA, 20 bp, Artificial Sequence
  Description of Artificial Sequence: Synthetic oligonucleotide
  Target: ATXN1; (+) strand; PAM type: YTN; PAM sequence: CTG
tctgaaacaaatatgccaaa

SEQ ID NO: 268872 - DNA, 20 bp, Artificial Sequence
  Description of Artificial Sequence: Synthetic oligonucleotide
  Target: ATXN1; (+) strand; PAM type: YTN; PAM sequence: CTG
aaacaaatatgccaaacttc

SEQ ID NO: 268873 - DNA, 20 bp, Artificial Sequence
  Description of Artificial Sequence: Synthetic oligonucleotide
  Target: ATXN1; (+) strand; PAM type: YTN; PAM sequence: CTT
ctatttgagtctctttccat

SEQ ID NO: 268874 - DNA, 20 bp, Artificial Sequence
  Description of Artificial Sequence: Synthetic oligonucleotide
  Target: ATXN1; (+) strand; PAM type: YTN; PAM sequence: TTC
tatttgagtctctttccatt

SEQ ID NO: 268875 - DNA, 20 bp, Artificial Sequence
  Description of Artificial Sequence: Synthetic oligonucleotide
  Target: ATXN1; (+) strand; PAM type: YTN; PAM sequence: CTA
tttgagtctctttccattta

SEQ ID NO: 268876 - DNA, 20 bp, Artificial Sequence
  Description of Artificial Sequence: Synthetic oligonucleotide
  Target: ATXN1; (+) strand; PAM type: YTN; PAM sequence: TTT
gagtctctttccatttaaaa

SEQ ID NO: 268877 - DNA, 20 bp, Artificial Sequence
  Description of Artificial Sequence: Synthetic oligonucleotide
  Target: ATXN1; (+) strand; PAM type: YTN; PAM sequence: TTG
agtctctttccatttaaaat

SEQ ID NO: 268878 - DNA, 20 bp, Artificial Sequence
  Description of Artificial Sequence: Synthetic oligonucleotide
  Target: ATXN1; (+) strand; PAM type: YTN; PAM sequence: CTC
tttccatttaaaatgtccaa

SEQ ID NO: 268879 - DNA, 20 bp, Artificial Sequence
  Description of Artificial Sequence: Synthetic oligonucleotide
  Target: ATXN1; (+) strand; PAM type: YTN; PAM sequence: CTT
tccatttaaaatgtccaaga

SEQ ID NO: 268880 - DNA, 20 bp, Artificial Sequence
  Description of Artificial Sequence: Synthetic oligonucleotide
  Target: ATXN1; (+) strand; PAM type: YTN; PAM sequence: TTT
ccatttaaaatgtccaagat

SEQ ID NO: 268881 - DNA, 20 bp, Artificial Sequence
  Description of Artificial Sequence: Synthetic oligonucleotide
  Target: ATXN1; (+) strand; PAM type: YTN; PAM sequence: TTC
catttaaaatgtccaagata

SEQ ID NO: 268882 - DNA, 20 bp, Artificial Sequence
  Description of Artificial Sequence: Synthetic oligonucleotide
  Target: ATXN1; (+) strand; PAM type: YTN; PAM sequence: TTT
aaaatgtccaagataaaatg

SEQ ID NO: 268883 - DNA, 20 bp, Artificial Sequence
  Description of Artificial Sequence: Synthetic oligonucleotide
  Target: ATXN1; (+) strand; PAM type: YTN; PAM sequence: TTA
aaatgtccaagataaaatgt

SEQ ID NO: 268884 - DNA, 20 bp, Artificial Sequence
  Description of Artificial Sequence: Synthetic oligonucleotide
  Target: ATXN1; (+) strand; PAM type: YTN; PAM sequence: TTT
atcctacaagcttcttatac

SEQ ID NO: 268885 - DNA, 20 bp, Artificial Sequence
  Description of Artificial Sequence: Synthetic oligonucleotide
  Target: ATXN1; (+) strand; PAM type: YTN; PAM sequence: TTA
tcctacaagcttcttataca

SEQ ID NO: 268886 - DNA, 20 bp, Artificial Sequence
  Description of Artificial Sequence: Synthetic oligonucleotide
  Target: ATXN1; (+) strand; PAM type: YTN; PAM sequence: CTA
caagcttcttatacaaacaa

SEQ ID NO: 268887 - DNA, 20 bp, Artificial Sequence
  Description of Artificial Sequence: Synthetic oligonucleotide
  Target: ATXN1; (+) strand; PAM type: YTN; PAM sequence: CTT
cttatacaaacaaaaatatt

SEQ ID NO: 268888 - DNA, 20 bp, Artificial Sequence
  Description of Artificial Sequence: Synthetic oligonucleotide
  Target: ATXN1; (+) strand; PAM type: YTN; PAM sequence: TTC
ttatacaaacaaaaatatta

SEQ ID NO: 268889 - DNA, 20 bp, Artificial Sequence
  Description of Artificial Sequence: Synthetic oligonucleotide
  Target: ATXN1; (+) strand; PAM type: YTN; PAM sequence: CTT
atacaaacaaaaatattaac

SEQ ID NO: 268890 - DNA, 20 bp, Artificial Sequence
  Description of Artificial Sequence: Synthetic oligonucleotide
  Target: ATXN1; (+) strand; PAM type: YTN; PAM sequence: TTA
tacaaacaaaaatattaaca

SEQ ID NO: 268891 - DNA, 20 bp, Artificial Sequence
  Description of Artificial Sequence: Synthetic oligonucleotide
  Target: ATXN1; (+) strand; PAM type: YTN; PAM sequence: TTA
acaatattccacattcaaag

SEQ ID NO: 268892 - DNA, 20 bp, Artificial Sequence
  Description of Artificial Sequence: Synthetic oligonucleotide
  Target: ATXN1; (+) strand; PAM type: YTN; PAM sequence: TTC
cacattcaaagtctcagagt

SEQ ID NO: 268893 - DNA, 20 bp, Artificial Sequence
  Description of Artificial Sequence: Synthetic oligonucleotide
  Target: ATXN1; (+) strand; PAM type: YTN; PAM sequence: TTC
aaagtctcagagtataaacc

SEQ ID NO: 268894 - DNA, 20 bp, Artificial Sequence
  Description of Artificial Sequence: Synthetic oligonucleotide
  Target: ATXN1; (+) strand; PAM type: YTN; PAM sequence: CTC
agagtataaaccttcacttt

SEQ ID NO: 268895 - DNA, 20 bp, Artificial Sequence
  Description of Artificial Sequence: Synthetic oligonucleotide
  Target: ATXN1; (+) strand; PAM type: YTN; PAM sequence: CTT
cactttgacctggcaacttt

SEQ ID NO: 268896 - DNA, 20 bp, Artificial Sequence
  Description of Artificial Sequence: Synthetic oligonucleotide
  Target: ATXN1; (+) strand; PAM type: YTN; PAM sequence: TTC
actttgacctggcaactttg

SEQ ID NO: 268897 - DNA, 20 bp, Artificial Sequence
  Description of Artificial Sequence: Synthetic oligonucleotide
  Target: ATXN1; (+) strand; PAM type: YTN; PAM sequence: CTT
tgacctggcaactttgacac

SEQ ID NO: 268898 - DNA, 20 bp, Artificial Sequence
  Description of Artificial Sequence: Synthetic oligonucleotide
  Target: ATXN1; (+) strand; PAM type: YTN; PAM sequence: TTT
gacctggcaactttgacaca

SEQ ID NO: 268899 - DNA, 20 bp, Artificial Sequence
  Description of Artificial Sequence: Synthetic oligonucleotide
  Target: ATXN1; (+) strand; PAM type: YTN; PAM sequence: TTG
acctggcaactttgacacac

SEQ ID NO: 268900 - DNA, 20 bp, Artificial Sequence
  Description of Artificial Sequence: Synthetic oligonucleotide
  Target: ATXN1; (+) strand; PAM type: YTN; PAM sequence: CTG
gcaactttgacacactcaga

SEQ ID NO: 268901 - DNA, 20 bp, Artificial Sequence
  Description of Artificial Sequence: Synthetic oligonucleotide
  Target: ATXN1; (+) strand; PAM type: YTN; PAM sequence: CTT
tgacacactcagaaaggaga

SEQ ID NO: 268902 - DNA, 20 bp, Artificial Sequence
  Description of Artificial Sequence: Synthetic oligonucleotide
  Target: ATXN1; (+) strand; PAM type: YTN; PAM sequence: TTT
gacacactcagaaaggagag

SEQ ID NO: 268903 - DNA, 20 bp, Artificial Sequence
  Description of Artificial Sequence: Synthetic oligonucleotide
  Target: ATXN1; (+) strand; PAM type: YTN; PAM sequence: TTG
acacactcagaaaggagaga

SEQ ID NO: 268904 - DNA, 20 bp, Artificial Sequence
  Description of Artificial Sequence: Synthetic oligonucleotide
  Target: ATXN1; (+) strand; PAM type: YTN; PAM sequence: CTC
agaaaggagagagagaacaa

SEQ ID NO: 268905 - DNA, 20 bp, Artificial Sequence
  Description of Artificial Sequence: Synthetic oligonucleotide
  Target: ATXN1; (+) strand; PAM type: YTN; PAM sequence: CTT
cctgaagccaaggtgtccaa

SEQ ID NO: 268906 - DNA, 20 bp, Artificial Sequence
  Description of Artificial Sequence: Synthetic oligonucleotide
  Target: ATXN1; (+) strand; PAM type: YTN; PAM sequence: TTC
ctgaagccaaggtgtccaat

SEQ ID NO: 268907 - DNA, 20 bp, Artificial Sequence
  Description of Artificial Sequence: Synthetic oligonucleotide
  Target: ATXN1; (+) strand; PAM type: YTN; PAM sequence: CTG
aagccaaggtgtccaatatc

SEQ ID NO: 268908 - DNA, 20 bp, Artificial Sequence
  Description of Artificial Sequence: Synthetic oligonucleotide
  Target: ATXN1; (+) strand; PAM type: YTN; PAM sequence: CTT
gccatcggacctgggaaatt

SEQ ID NO: 268909 - DNA, 20 bp, Artificial Sequence
  Description of Artificial Sequence: Synthetic oligonucleotide
  Target: ATXN1; (+) strand; PAM type: YTN; PAM sequence: TTG
ccatcggacctgggaaatta

SEQ ID NO: 268910 - DNA, 20 bp, Artificial Sequence
  Description of Artificial Sequence: Synthetic oligonucleotide
  Target: ATXN1; (+) strand; PAM type: YTN; PAM sequence: CTG
ggaaattacgccaggctgtc

SEQ ID NO: 268911 - DNA, 20 bp, Artificial Sequence
  Description of Artificial Sequence: Synthetic oligonucleotide
  Target: ATXN1; (+) strand; PAM type: YTN; PAM sequence: TTA
cgccaggctgtcagtttcat

SEQ ID NO: 268912 - DNA, 20 bp, Artificial Sequence
  Description of Artificial Sequence: Synthetic oligonucleotide
  Target: ATXN1; (+) strand; PAM type: YTN; PAM sequence: CTG
tcagtttcatcctctgccta

SEQ ID NO: 268913 - DNA, 20 bp, Artificial Sequence
  Description of Artificial Sequence: Synthetic oligonucleotide
  Target: ATXN1; (+) strand; PAM type: YTN; PAM sequence: TTT
catcctctgcctagaggaga

SEQ ID NO: 268914 - DNA, 20 bp, Artificial Sequence
  Description of Artificial Sequence: Synthetic oligonucleotide
  Target: ATXN1; (+) strand; PAM type: YTN; PAM sequence: TTC
atcctctgcctagaggagaa

SEQ ID NO: 268915 - DNA, 20 bp, Artificial Sequence
  Description of Artificial Sequence: Synthetic oligonucleotide
  Target: ATXN1; (+) strand; PAM type: YTN; PAM sequence: CTC
tgcctagaggagaaaatgac

SEQ ID NO: 268916 - DNA, 20 bp, Artificial Sequence
  Description of Artificial Sequence: Synthetic oligonucleotide
  Target: ATXN1; (+) strand; PAM type: YTN; PAM sequence: CTG
cctagaggagaaaatgacac

SEQ ID NO: 268917 - DNA, 20 bp, Artificial Sequence
  Description of Artificial Sequence: Synthetic oligonucleotide
  Target: ATXN1; (+) strand; PAM type: YTN; PAM sequence: CTA
gaggagaaaatgacacaatg

SEQ ID NO: 268918 - DNA, 20 bp, Artificial Sequence
  Description of Artificial Sequence: Synthetic oligonucleotide
  Target: ATXN1; (+) strand; PAM type: YTN; PAM sequence: TTT
ctccttcccctgactgccca

SEQ ID NO: 268919 - DNA, 20 bp, Artificial Sequence
  Description of Artificial Sequence: Synthetic oligonucleotide
  Target: ATXN1; (+) strand; PAM type: YTN; PAM sequence: TTC
tccttcccctgactgcccac

SEQ ID NO: 268920 - DNA, 20 bp, Artificial Sequence
  Description of Artificial Sequence: Synthetic oligonucleotide
  Target: ATXN1; (+) strand; PAM type: YTN; PAM sequence: CTC
cttcccctgactgcccacag

SEQ ID NO: 268921 - DNA, 20 bp, Artificial Sequence
  Description of Artificial Sequence: Synthetic oligonucleotide
  Target: ATXN1; (+) strand; PAM type: YTN; PAM sequence: CTT
cccctgactgcccacagcac

SEQ ID NO: 268922 - DNA, 20 bp, Artificial Sequence
  Description of Artificial Sequence: Synthetic oligonucleotide
  Target: ATXN1; (+) strand; PAM type: YTN; PAM sequence: TTC
ccctgactgcccacagcact

SEQ ID NO: 268923 - DNA, 20 bp, Artificial Sequence
  Description of Artificial Sequence: Synthetic oligonucleotide
  Target: ATXN1; (+) strand; PAM type: YTN; PAM sequence: CTG
actgcccacagcacttacag

SEQ ID NO: 268924 - DNA, 20 bp, Artificial Sequence
  Description of Artificial Sequence: Synthetic oligonucleotide
  Target: ATXN1; (+) strand; PAM type: YTN; PAM sequence: CTG
cccacagcacttacagtctc

SEQ ID NO: 268925 - DNA, 20 bp, Artificial Sequence
  Description of Artificial Sequence: Synthetic oligonucleotide
  Target: ATXN1; (+) strand; PAM type: YTN; PAM sequence: CTT
acagtctctaccacacattc

SEQ ID NO: 268926 - DNA, 20 bp, Artificial Sequence
  Description of Artificial Sequence: Synthetic oligonucleotide
  Target: ATXN1; (+) strand; PAM type: YTN; PAM sequence: TTA
cagtctctaccacacattct

SEQ ID NO: 268927 - DNA, 20 bp, Artificial Sequence
  Description of Artificial Sequence: Synthetic oligonucleotide
  Target: ATXN1; (+) strand; PAM type: YTN; PAM sequence: CTC
taccacacattctgacccaa

SEQ ID NO: 268928 - DNA, 20 bp, Artificial Sequence
  Description of Artificial Sequence: Synthetic oligonucleotide
  Target: ATXN1; (+) strand; PAM type: YTN; PAM sequence: CTA
ccacacattctgacccaagg

SEQ ID NO: 268929 - DNA, 20 bp, Artificial Sequence
  Description of Artificial Sequence: Synthetic oligonucleotide
  Target: ATXN1; (+) strand; PAM type: YTN; PAM sequence: TTC
tgacccaaggtccttttcag

SEQ ID NO: 268930 - DNA, 20 bp, Artificial Sequence
  Description of Artificial Sequence: Synthetic oligonucleotide
  Target: ATXN1; (+) strand; PAM type: YTN; PAM sequence: CTG
acccaaggtccttttcagtt

SEQ ID NO: 268931 - DNA, 20 bp, Artificial Sequence
  Description of Artificial Sequence: Synthetic oligonucleotide
  Target: ATXN1; (+) strand; PAM type: YTN; PAM sequence: CTT
ttcagttcagcactttgtta

SEQ ID NO: 268932 - DNA, 20 bp, Artificial Sequence
  Description of Artificial Sequence: Synthetic oligonucleotide
  Target: ATXN1; (+) strand; PAM type: YTN; PAM sequence: TTT
tcagttcagcactttgttat

SEQ ID NO: 268933 - DNA, 20 bp, Artificial Sequence
  Description of Artificial Sequence: Synthetic oligonucleotide
  Target: ATXN1; (+) strand; PAM type: YTN; PAM sequence: TTT
cagttcagcactttgttata

SEQ ID NO: 268934 - DNA, 20 bp, Artificial Sequence
  Description of Artificial Sequence: Synthetic oligonucleotide
  Target: ATXN1; (+) strand; PAM type: YTN; PAM sequence: TTC
agttcagcactttgttatac

SEQ ID NO: 268935 - DNA, 20 bp, Artificial Sequence
  Description of Artificial Sequence: Synthetic oligonucleotide
  Target: ATXN1; (+) strand; PAM type: YTN; PAM sequence: TTC
agcactttgttatactgtct

SEQ ID NO: 268936 - DNA, 20 bp, Artificial Sequence
  Description of Artificial Sequence: Synthetic oligonucleotide
  Target: ATXN1; (+) strand; PAM type: YTN; PAM sequence: CTT
tgttatactgtctttttata

SEQ ID NO: 268937 - DNA, 20 bp, Artificial Sequence
  Description of Artificial Sequence: Synthetic oligonucleotide
  Target: ATXN1; (+) strand; PAM type: YTN; PAM sequence: TTT
gttatactgtctttttatac

SEQ ID NO: 268938 - DNA, 20 bp, Artificial Sequence
  Description of Artificial Sequence: Synthetic oligonucleotide
  Target: ATXN1; (+) strand; PAM type: YTN; PAM sequence: TTG
ttatactgtctttttatact

SEQ ID NO: 268939 - DNA, 20 bp, Artificial Sequence
  Description of Artificial Sequence: Synthetic oligonucleotide
  Target: ATXN1; (+) strand; PAM type: YTN; PAM sequence: TTA
tactgtctttttatactcca

SEQ ID NO: 268940 - DNA, 20 bp, Artificial Sequence
  Description of Artificial Sequence: Synthetic oligonucleotide
  Target: ATXN1; (+) strand; PAM type: YTN; PAM sequence: CTG
tctttttatactccactgga

SEQ ID NO: 268941 - DNA, 20 bp, Artificial Sequence
  Description of Artificial Sequence: Synthetic oligonucleotide
  Target: ATXN1; (+) strand; PAM type: YTN; PAM sequence: CTT
tttatactccactggattta

SEQ ID NO: 268942 - DNA, 20 bp, Artificial Sequence
  Description of Artificial Sequence: Synthetic oligonucleotide
  Target: ATXN1; (+) strand; PAM type: YTN; PAM sequence: TTT
ttatactccactggatttat

SEQ ID NO: 268943 - DNA, 20 bp, Artificial Sequence
  Description of Artificial Sequence: Synthetic oligonucleotide
  Target: ATXN1; (+) strand; PAM type: YTN; PAM sequence: TTT
tatactccactggatttatt

SEQ ID NO: 268944 - DNA, 20 bp, Artificial Sequence
  Description of Artificial Sequence: Synthetic oligonucleotide
  Target: ATXN1; (+) strand; PAM type: YTN; PAM sequence: TTT
atactccactggatttattt

SEQ ID NO: 268945 - DNA, 20 bp, Artificial Sequence
  Description of Artificial Sequence: Synthetic oligonucleotide
  Target: ATXN1; (+) strand; PAM type: YTN; PAM sequence: TTA
tactccactggatttattta

SEQ ID NO: 268946 - DNA, 20 bp, Artificial Sequence
  Description of Artificial Sequence: Synthetic oligonucleotide
  Target: ATXN1; (+) strand; PAM type: YTN; PAM sequence: CTC
cactggatttatttaagtct

SEQ ID NO: 268947 - DNA, 20 bp, Artificial Sequence
  Description of Artificial Sequence: Synthetic oligonucleotide
  Target: ATXN1; (+) strand; PAM type: YTN; PAM sequence: CTG
gatttatttaagtcttgaag

SEQ ID NO: 268948 - DNA, 20 bp, Artificial Sequence
  Description of Artificial Sequence: Synthetic oligonucleotide
  Target: ATXN1; (+) strand; PAM type: YTN; PAM sequence: TTT
atttaagtcttgaaggctca

SEQ ID NO: 268949 - DNA, 20 bp, Artificial Sequence
  Description of Artificial Sequence: Synthetic oligonucleotide
  Target: ATXN1; (+) strand; PAM type: YTN; PAM sequence: TTA
tttaagtcttgaaggctcaa

SEQ ID NO: 268950 - DNA, 20 bp, Artificial Sequence
  Description of Artificial Sequence: Synthetic oligonucleotide
  Target: ATXN1; (+) strand; PAM type: YTN; PAM sequence: TTT
aagtcttgaaggctcaaaaa

SEQ ID NO: 268951 - DNA, 20 bp, Artificial Sequence
  Description of Artificial Sequence: Synthetic oligonucleotide
  Target: ATXN1; (+) strand; PAM type: YTN; PAM sequence: TTA
agtcttgaaggctcaaaaag

SEQ ID NO: 268952 - DNA, 20 bp, Artificial Sequence
  Description of Artificial Sequence: Synthetic oligonucleotide
  Target: ATXN1; (+) strand; PAM type: YTN; PAM sequence: CTT
gaaggctcaaaaagtttcta

SEQ ID NO: 268953 - DNA, 20 bp, Artificial Sequence
  Description of Artificial Sequence: Synthetic oligonucleotide
  Target: ATXN1; (+) strand; PAM type: YTN; PAM sequence: TTG
aaggctcaaaaagtttctaa

SEQ ID NO: 268954 - DNA, 20 bp, Artificial Sequence
  Description of Artificial Sequence: Synthetic oligonucleotide
  Target: ATXN1; (+) strand; PAM type: YTN; PAM sequence: CTC
aaaaagtttctaagctctct

SEQ ID NO: 268955 - DNA, 20 bp, Artificial Sequence
  Description of Artificial Sequence: Synthetic oligonucleotide
  Target: ATXN1; (+) strand; PAM type: YTN; PAM sequence: TTT
ctaagctctctgatgaaaga

SEQ ID NO: 268956 - DNA, 20 bp, Artificial Sequence
  Description of Artificial Sequence: Synthetic oligonucleotide
  Target: ATXN1; (+) strand; PAM type: YTN; PAM sequence: TTC
taagctctctgatgaaagaa

SEQ ID NO: 268957 - DNA, 20 bp, Artificial Sequence
  Description of Artificial Sequence: Synthetic oligonucleotide
  Target: ATXN1; (+) strand; PAM type: YTN; PAM sequence: CTA
agctctctgatgaaagaaac

SEQ ID NO: 268958 - DNA, 20 bp, Artificial Sequence
  Description of Artificial Sequence: Synthetic oligonucleotide
  Target: ATXN1; (+) strand; PAM type: YTN; PAM sequence: CTC
tctgatgaaagaaaccttgc

SEQ ID NO: 268959 - DNA, 20 bp, Artificial Sequence
  Description of Artificial Sequence: Synthetic oligonucleotide
  Target: ATXN1; (+) strand; PAM type: YTN; PAM sequence: CTC
tgatgaaagaaaccttgcca

SEQ ID NO: 268960 - DNA, 20 bp, Artificial Sequence
  Description of Artificial Sequence: Synthetic oligonucleotide
  Target: ATXN1; (+) strand; PAM type: YTN; PAM sequence: CTG
atgaaagaaaccttgccatg

SEQ ID NO: 268961 - DNA, 20 bp, Artificial Sequence
  Description of Artificial Sequence: Synthetic oligonucleotide
  Target: ATXN1; (+) strand; PAM type: YTN; PAM sequence: CTT
gccatgcccttcttttgcaa

SEQ ID NO: 268962 - DNA, 20 bp, Artificial Sequence
  Description of Artificial Sequence: Synthetic oligonucleotide
  Target: ATXN1; (+) strand; PAM type: YTN; PAM sequence: TTG
ccatgcccttcttttgcaac

SEQ ID NO: 268963 - DNA, 20 bp, Artificial Sequence
  Description of Artificial Sequence: Synthetic oligonucleotide
  Target: ATXN1; (+) strand; PAM type: YTN; PAM sequence: CTT
cttttgcaacctcctaacag

SEQ ID NO: 268964 - DNA, 20 bp, Artificial Sequence
  Description of Artificial Sequence: Synthetic oligonucleotide
  Target: ATXN1; (+) strand; PAM type: YTN; PAM sequence: TTC
ttttgcaacctcctaacagc

SEQ ID NO: 268965 - DNA, 20 bp, Artificial Sequence
  Description of Artificial Sequence: Synthetic oligonucleotide
  Target: ATXN1; (+) strand; PAM type: YTN; PAM sequence: CTT
ttgcaacctcctaacagcat

SEQ ID NO: 268966 - DNA, 20 bp, Artificial Sequence
  Description of Artificial Sequence: Synthetic oligonucleotide
  Target: ATXN1; (+) strand; PAM type: YTN; PAM sequence: TTT
tgcaacctcctaacagcatc

SEQ ID NO: 268967 - DNA, 20 bp, Artificial Sequence
  Description of Artificial Sequence: Synthetic oligonucleotide
  Target: ATXN1; (+) strand; PAM type: YTN; PAM sequence: TTT
gcaacctcctaacagcatct

SEQ ID NO: 268968 - DNA, 20 bp, Artificial Sequence
  Description of Artificial Sequence: Synthetic oligonucleotide
  Target: ATXN1; (+) strand; PAM type: YTN; PAM sequence: TTG
caacctcctaacagcatcta

SEQ ID NO: 268969 - DNA, 20 bp, Artificial Sequence
  Description of Artificial Sequence: Synthetic oligonucleotide
  Target: ATXN1; (+) strand; PAM type: YTN; PAM sequence: CTC
ctaacagcatctagtggaag

SEQ ID NO: 268970 - DNA, 20 bp, Artificial Sequence
  Description of Artificial Sequence: Synthetic oligonucleotide
  Target: ATXN1; (+) strand; PAM type: YTN; PAM sequence: CTA
acagcatctagtggaagagc

SEQ ID NO: 268971 - DNA, 20 bp, Artificial Sequence
  Description of Artificial Sequence: Synthetic oligonucleotide
  Target: ATXN1; (+) strand; PAM type: YTN; PAM sequence: CTA
gtggaagagcctggatttaa

SEQ ID NO: 268972 - DNA, 20 bp, Artificial Sequence
  Description of Artificial Sequence: Synthetic oligonucleotide
  Target: ATXN1; (+) strand; PAM type: YTN; PAM sequence: CTG
gatttaacttaaatgatcca

SEQ ID NO: 268973 - DNA, 20 bp, Artificial Sequence
  Description of Artificial Sequence: Synthetic oligonucleotide
  Target: ATXN1; (+) strand; PAM type: YTN; PAM sequence: TTT
aacttaaatgatccatatcc

SEQ ID NO: 268974 - DNA, 20 bp, Artificial Sequence
  Description of Artificial Sequence: Synthetic oligonucleotide
  Target: ATXN1; (+) strand; PAM type: YTN; PAM sequence: TTA
acttaaatgatccatatcca

SEQ ID NO: 268975 - DNA, 20 bp, Artificial Sequence
  Description of Artificial Sequence: Synthetic oligonucleotide
  Target: ATXN1; (+) strand; PAM type: YTN; PAM sequence: CTT
aaatgatccatatccaaaac

SEQ ID NO: 268976 - DNA, 20 bp, Artificial Sequence
  Description of Artificial Sequence: Synthetic oligonucleotide
  Target: ATXN1; (+) strand; PAM type: YTN; PAM sequence: TTA
aatgatccatatccaaaacc

SEQ ID NO: 268977 - DNA, 20 bp, Artificial Sequence
  Description of Artificial Sequence: Synthetic oligonucleotide
  Target: ATXN1; (+) strand; PAM type: YTN; PAM sequence: CTG
ttctaggacttaacccttac

SEQ ID NO: 268978 - DNA, 20 bp, Artificial Sequence
  Description of Artificial Sequence: Synthetic oligonucleotide
  Target: ATXN1; (+) strand; PAM type: YTN; PAM sequence: TTC
taggacttaacccttactcc

SEQ ID NO: 268979 - DNA, 20 bp, Artificial Sequence
  Description of Artificial Sequence: Synthetic oligonucleotide
  Target: ATXN1; (+) strand; PAM type: YTN; PAM sequence: CTA
ggacttaacccttactccaa

SEQ ID NO: 268980 - DNA, 20 bp, Artificial Sequence
  Description of Artificial Sequence: Synthetic oligonucleotide
  Target: ATXN1; (+) strand; PAM type: YTN; PAM sequence: CTT
aacccttactccaaaagaat

SEQ ID NO: 268981 - DNA, 20 bp, Artificial Sequence
  Description of Artificial Sequence: Synthetic oligonucleotide
  Target: ATXN1; (+) strand; PAM type: YTN; PAM sequence: TTA
acccttactccaaaagaatc

SEQ ID NO: 268982 - DNA, 20 bp, Artificial Sequence
  Description of Artificial Sequence: Synthetic oligonucleotide
  Target: ATXN1; (+) strand; PAM type: YTN; PAM sequence: CTT
actccaaaagaatcaccagt

SEQ ID NO: 268983 - DNA, 20 bp, Artificial Sequence
  Description of Artificial Sequence: Synthetic oligonucleotide
  Target: ATXN1; (+) strand; PAM type: YTN; PAM sequence: TTA
ctccaaaagaatcaccagtc

SEQ ID NO: 268984 - DNA, 20 bp, Artificial Sequence
  Description of Artificial Sequence: Synthetic oligonucleotide
  Target: ATXN1; (+) strand; PAM type: YTN; PAM sequence: CTC
caaaagaatcaccagtctac

SEQ ID NO: 268985 - DNA, 20 bp, Artificial Sequence
  Description of Artificial Sequence: Synthetic oligonucleotide
  Target: ATXN1; (+) strand; PAM type: YTN; PAM sequence: CTA
cagctatgctttaagcccat

SEQ ID NO: 268986 - DNA, 20 bp, Artificial Sequence
  Description of Artificial Sequence: Synthetic oligonucleotide
  Target: ATXN1; (+) strand; PAM type: YTN; PAM sequence: CTA
tgctttaagcccatttcacc

SEQ ID NO: 268987 - DNA, 20 bp, Artificial Sequence
  Description of Artificial Sequence: Synthetic oligonucleotide
  Target: ATXN1; (+) strand; PAM type: YTN; PAM sequence: CTT
taagcccatttcacctttct

SEQ ID NO: 268988 - DNA, 20 bp, Artificial Sequence
  Description of Artificial Sequence: Synthetic oligonucleotide
  Target: ATXN1; (+) strand; PAM type: YTN; PAM sequence: TTT
aagcccatttcacctttctc

SEQ ID NO: 268989 - DNA, 20 bp, Artificial Sequence
  Description of Artificial Sequence: Synthetic oligonucleotide
  Target: ATXN1; (+) strand; PAM type: YTN; PAM sequence: TTA
agcccatttcacctttctct

SEQ ID NO: 268990 - DNA, 20 bp, Artificial Sequence
  Description of Artificial Sequence: Synthetic oligonucleotide
  Target: ATXN1; (+) strand; PAM type: YTN; PAM sequence: TTT
cacctttctctgtcttccag

SEQ ID NO: 268991 - DNA, 20 bp, Artificial Sequence
  Description of Artificial Sequence: Synthetic oligonucleotide
  Target: ATXN1; (+) strand; PAM type: YTN; PAM sequence: TTC
acctttctctgtcttccagg

SEQ ID NO: 268992 - DNA, 20 bp, Artificial Sequence
  Description of Artificial Sequence: Synthetic oligonucleotide
  Target: ATXN1; (+) strand; PAM type: YTN; PAM sequence: CTT
tctctgtcttccagggactt

SEQ ID NO: 268993 - DNA, 20 bp, Artificial Sequence
  Description of Artificial Sequence: Synthetic oligonucleotide
  Target: ATXN1; (+) strand; PAM type: YTN; PAM sequence: TTT
ctctgtcttccagggacttg

SEQ ID NO: 268994 - DNA, 20 bp, Artificial Sequence
  Description of Artificial Sequence: Synthetic oligonucleotide
  Target: ATXN1; (+) strand; PAM type: YTN; PAM sequence: TTC
tctgtcttccagggacttga

SEQ ID NO: 268995 - DNA, 20 bp, Artificial Sequence
  Description of Artificial Sequence: Synthetic oligonucleotide
  Target: ATXN1; (+) strand; PAM type: YTN; PAM sequence: CTC
tgtcttccagggacttgaaa

SEQ ID NO: 268996 - DNA, 20 bp, Artificial Sequence
  Description of Artificial Sequence: Synthetic oligonucleotide
  Target: ATXN1; (+) strand; PAM type: YTN; PAM sequence: CTG
tcttccagggacttgaaagt

SEQ ID NO: 268997 - DNA, 20 bp, Artificial Sequence
  Description of Artificial Sequence: Synthetic oligonucleotide
  Target: ATXN1; (+) strand; PAM type: YTN; PAM sequence: CTT
ccagggacttgaaagtctga

SEQ ID NO: 268998 - DNA, 20 bp, Artificial Sequence
  Description of Artificial Sequence: Synthetic oligonucleotide
  Target: ATXN1; (+) strand; PAM type: YTN; PAM sequence: TTC
cagggacttgaaagtctgat

SEQ ID NO: 268999 - DNA, 20 bp, Artificial Sequence
  Description of Artificial Sequence: Synthetic oligonucleotide
  Target: ATXN1; (+) strand; PAM type: YTN; PAM sequence: CTT
gaaagtctgatgatgcctat

SEQ ID NO: 269000 - DNA, 20 bp, Artificial Sequence
  Description of Artificial Sequence: Synthetic oligonucleotide
  Target: ATXN1; (+) strand; PAM type: YTN; PAM sequence: TTG
aaagtctgatgatgcctatc

SEQ ID NO: 269001 - DNA, 20 bp, Artificial Sequence
  Description of Artificial Sequence: Synthetic oligonucleotide
  Target: ATXN1; (+) strand; PAM type: YTN; PAM sequence: CTG
atgatgcctatcatcatcat

SEQ ID NO: 269002 - DNA, 20 bp, Artificial Sequence
  Description of Artificial Sequence: Synthetic oligonucleotide
  Target: ATXN1; (+) strand; PAM type: YTN; PAM sequence: CTA
tcatcatcatgtgtcagccc

SEQ ID NO: 269003 - DNA, 20 bp, Artificial Sequence
  Description of Artificial Sequence: Synthetic oligonucleotide
  Target: ATXN1; (+) strand; PAM type: YTN; PAM sequence: CTC
cacaaactcaaaaaaaatta

SEQ ID NO: 269004 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaattaaattacaac

SEQ ID NO: 269005 - DNA, 20 bp, Artificial Sequence
  Description of Artificial Sequence: Synthetic oligonucleotide
  Target: ATXN1; (+) strand; PAM type: YTN; PAM sequence: TTA
aattacaacttagcctttct

SEQ ID NO: 269006 - DNA, 20 bp, Artificial Sequence
  Description of Artificial Sequence: Synthetic oligonucleotide
  Target: ATXN1; (+) strand; PAM type: YTN; PAM sequence: TTA
caacttagcctttctattct

SEQ ID NO: 269007 - DNA, 20 bp, Artificial Sequence
  Description of Artificial Sequence: Synthetic oligonucleotide
  Target: ATXN1; (+) strand; PAM type: YTN; PAM sequence: CTT
agcctttctattctgttctt

SEQ ID NO: 269008 - DNA, 20 bp, Artificial Sequence
  Description of Artificial Sequence: Synthetic oligonucleotide
  Target: ATXN1; (+) strand; PAM type: YTN; PAM sequence: TTA
gcctttctattctgttcttc

SEQ ID NO: 269009 - DNA, 20 bp, Artificial Sequence
  Description of Artificial Sequence: Synthetic oligonucleotide
  Target: ATXN1; (+) strand; PAM type: YTN; PAM sequence: CTT
tctattctgttcttccaatc

SEQ ID NO: 269010 - DNA, 20 bp, Artificial Sequence
  Description of Artificial Sequence: Synthetic oligonucleotide
  Target: ATXN1; (+) strand; PAM type: YTN; PAM sequence: TTT
ctattctgttcttccaatcc

SEQ ID NO: 269011 - DNA, 20 bp, Artificial Sequence
  Description of Artificial Sequence: Synthetic oligonucleotide
  Target: ATXN1; (+) strand; PAM type: YTN; PAM sequence: TTC
tattctgttcttccaatcca

SEQ ID NO: 269012 - DNA, 20 bp, Artificial Sequence
  Description of Artificial Sequence: Synthetic oligonucleotide
  Target: ATXN1; (+) strand; PAM type: YTN; PAM sequence: CTA
ttctgttcttccaatccatt

SEQ ID NO: 269013 - DNA, 20 bp, Artificial Sequence
  Description of Artificial Sequence: Synthetic oligonucleotide
  Target: ATXN1; (+) strand; PAM type: YTN; PAM sequence: TTC
tgttcttccaatccattaca

SEQ ID NO: 269014 - DNA, 20 bp, Artificial Sequence
  Description of Artificial Sequence: Synthetic oligonucleotide
  Target: ATXN1; (+) strand; PAM type: YTN; PAM sequence: CTG
ttcttccaatccattacatc

SEQ ID NO: 269015 - DNA, 20 bp, Artificial Sequence
  Description of Artificial Sequence: Synthetic oligonucleotide
  Target: ATXN1; (+) strand; PAM type: YTN; PAM sequence: TTC
ttccaatccattacatctta

SEQ ID NO: 269016 - DNA, 20 bp, Artificial Sequence
  Description of Artificial Sequence: Synthetic oligonucleotide
  Target: ATXN1; (+) strand; PAM type: YTN; PAM sequence: CTT
ccaatccattacatcttaag

SEQ ID NO: 269017 - DNA, 20 bp, Artificial Sequence
  Description of Artificial Sequence: Synthetic oligonucleotide
  Target: ATXN1; (+) strand; PAM type: YTN; PAM sequence: TTC
caatccattacatcttaagt

SEQ ID NO: 269018 - DNA, 20 bp, Artificial Sequence
  Description of Artificial Sequence: Synthetic oligonucleotide
  Target: ATXN1; (+) strand; PAM type: YTN; PAM sequence: TTA
catcttaagtcattagtgga

SEQ ID NO: 269019 - DNA, 20 bp, Artificial Sequence
  Description of Artificial Sequence: Synthetic oligonucleotide
  Target: ATXN1; (+) strand; PAM type: YTN; PAM sequence: CTT
aagtcattagtggaatttga

SEQ ID NO: 269020 - DNA, 20 bp, Artificial Sequence
  Description of Artificial Sequence: Synthetic oligonucleotide
  Target: ATXN1; (+) strand; PAM type: YTN; PAM sequence: TTA
agtcattagtggaatttgaa

SEQ ID NO: 269021 - DNA, 20 bp, Artificial Sequence
  Description of Artificial Sequence: Synthetic oligonucleotide
  Target: ATXN1; (+) strand; PAM type: YTN; PAM sequence: TTA
gtggaatttgaacagttgtc

SEQ ID NO: 269022 - DNA, 20 bp, Artificial Sequence
  Description of Artificial Sequence: Synthetic oligonucleotide
  Target: ATXN1; (+) strand; PAM type: YTN; PAM sequence: TTT
gaacagttgtcatctccttt

SEQ ID NO: 269023 - DNA, 20 bp, Artificial Sequence
  Description of Artificial Sequence: Synthetic oligonucleotide
  Target: ATXN1; (+) strand; PAM type: YTN; PAM sequence: TTG
aacagttgtcatctcctttc

SEQ ID NO: 269024 - DNA, 20 bp, Artificial Sequence
  Description of Artificial Sequence: Synthetic oligonucleotide
  Target: ATXN1; (+) strand; PAM type: YTN; PAM sequence: TTG
tcatctcctttcaagattta

SEQ ID NO: 269025 - DNA, 20 bp, Artificial Sequence
  Description of Artificial Sequence: Synthetic oligonucleotide
  Target: ATXN1; (+) strand; PAM type: YTN; PAM sequence: CTC
ctttcaagatttacaaactc

SEQ ID NO: 269026 - DNA, 20 bp, Artificial Sequence
  Description of Artificial Sequence: Synthetic oligonucleotide
  Target: ATXN1; (+) strand; PAM type: YTN; PAM sequence: CTT
tcaagatttacaaactcccc

SEQ ID NO: 269027 - DNA, 20 bp, Artificial Sequence
  Description of Artificial Sequence: Synthetic oligonucleotide
  Target: ATXN1; (+) strand; PAM type: YTN; PAM sequence: TTT
caagatttacaaactccccc

SEQ ID NO: 269028 - DNA, 20 bp, Artificial Sequence
  Description of Artificial Sequence: Synthetic oligonucleotide
  Target: ATXN1; (+) strand; PAM type: YTN; PAM sequence: TTC
aagatttacaaactccccca

SEQ ID NO: 269029 - DNA, 20 bp, Artificial Sequence
  Description of Artificial Sequence: Synthetic oligonucleotide
  Target: ATXN1; (+) strand; PAM type: YTN; PAM sequence: TTT
acaaactcccccatttcctc

SEQ ID NO: 269030 - DNA, 20 bp, Artificial Sequence
  Description of Artificial Sequence: Synthetic oligonucleotide
  Target: ATXN1; (+) strand; PAM type: YTN; PAM sequence: TTA
caaactcccccatttcctca

SEQ ID NO: 269031 - DNA, 20 bp, Artificial Sequence
  Description of Artificial Sequence: Synthetic oligonucleotide
  Target: ATXN1; (+) strand; PAM type: YTN; PAM sequence: CTC
ccccatttcctcatcaccag

SEQ ID NO: 269032 - DNA, 20 bp, Artificial Sequence
  Description of Artificial Sequence: Synthetic oligonucleotide
  Target: ATXN1; (+) strand; PAM type: YTN; PAM sequence: TTT
cctcatcaccagcagcttac

SEQ ID NO: 269033 - DNA, 20 bp, Artificial Sequence
  Description of Artificial Sequence: Synthetic oligonucleotide
  Target: ATXN1; (+) strand; PAM type: YTN; PAM sequence: TTC
ctcatcaccagcagcttaca

SEQ ID NO: 269034 - DNA, 20 bp, Artificial Sequence
  Description of Artificial Sequence: Synthetic oligonucleotide
  Target: ATXN1; (+) strand; PAM type: YTN; PAM sequence: CTC
atcaccagcagcttacatca

SEQ ID NO: 269035 - DNA, 20 bp, Artificial Sequence
  Description of Artificial Sequence: Synthetic oligonucleotide
  Target: ATXN1; (+) strand; PAM type: YTN; PAM sequence: CTT
acatcactagctctcatagc

SEQ ID NO: 269036 - DNA, 20 bp, Artificial Sequence
  Description of Artificial Sequence: Synthetic oligonucleotide
  Target: ATXN1; (+) strand; PAM type: YTN; PAM sequence: TTA
catcactagctctcatagct

SEQ ID NO: 269037 - DNA, 20 bp, Artificial Sequence
  Description of Artificial Sequence: Synthetic oligonucleotide
  Target: ATXN1; (+) strand; PAM type: YTN; PAM sequence: CTA
gctctcatagcttctcaaag

SEQ ID NO: 269038 - DNA, 20 bp, Artificial Sequence
  Description of Artificial Sequence: Synthetic oligonucleotide
  Target: ATXN1; (+) strand; PAM type: YTN; PAM sequence: CTC
tcatagcttctcaaagccac

SEQ ID NO: 269039 - DNA, 20 bp, Artificial Sequence
  Description of Artificial Sequence: Synthetic oligonucleotide
  Target: ATXN1; (+) strand; PAM type: YTN; PAM sequence: CTC
atagcttctcaaagccacta

SEQ ID NO: 269040 - DNA, 20 bp, Artificial Sequence
  Description of Artificial Sequence: Synthetic oligonucleotide
  Target: ATXN1; (+) strand; PAM type: YTN; PAM sequence: CTT
ctcaaagccactattaagga

SEQ ID NO: 269041 - DNA, 20 bp, Artificial Sequence
  Description of Artificial Sequence: Synthetic oligonucleotide
  Target: ATXN1; (+) strand; PAM type: YTN; PAM sequence: TTC
tcaaagccactattaaggaa

SEQ ID NO: 269042 - DNA, 20 bp, Artificial Sequence
  Description of Artificial Sequence: Synthetic oligonucleotide
  Target: ATXN1; (+) strand; PAM type: YTN; PAM sequence: CTC
aaagccactattaaggaaac

SEQ ID NO: 269043 - DNA, 20 bp, Artificial Sequence
  Description of Artificial Sequence: Synthetic oligonucleotide
  Target: ATXN1; (+) strand; PAM type: YTN; PAM sequence: CTA
ttaaggaaaccttcatggca

SEQ ID NO: 269044 - DNA, 20 bp, Artificial Sequence
  Description of Artificial Sequence: Synthetic oligonucleotide
  Target: ATXN1; (+) strand; PAM type: YTN; PAM sequence: TTA
aggaaaccttcatggcatgt

SEQ ID NO: 269045 - DNA, 20 bp, Artificial Sequence
  Description of Artificial Sequence: Synthetic oligonucleotide
  Target: ATXN1; (+) strand; PAM type: YTN; PAM sequence: CTT
catggcatgtggaggggaga

SEQ ID NO: 269046 - DNA, 20 bp, Artificial Sequence
  Description of Artificial Sequence: Synthetic oligonucleotide
  Target: ATXN1; (+) strand; PAM type: YTN; PAM sequence: TTC
atggcatgtggaggggagat

SEQ ID NO: 269047 - DNA, 20 bp, Artificial Sequence
  Description of Artificial Sequence: Synthetic oligonucleotide
  Target: ATXN1; (+) strand; PAM type: YTN; PAM sequence: CTC
tgaggcagtgatattcaaac

SEQ ID NO: 269048 - DNA, 20 bp, Artificial Sequence
  Description of Artificial Sequence: Synthetic oligonucleotide
  Target: ATXN1; (+) strand; PAM type: YTN; PAM sequence: CTG
aggcagtgatattcaaactt

SEQ ID NO: 269049 - DNA, 20 bp, Artificial Sequence
  Description of Artificial Sequence: Synthetic oligonucleotide
  Target: ATXN1; (+) strand; PAM type: YTN; PAM sequence: TTC
aaacttgaagcagcatcaga

SEQ ID NO: 269050 - DNA, 20 bp, Artificial Sequence
  Description of Artificial Sequence: Synthetic oligonucleotide
  Target: ATXN1; (+) strand; PAM type: YTN; PAM sequence: CTT
gaagcagcatcagaaatggc

SEQ ID NO: 269051 - DNA, 20 bp, Artificial Sequence
  Description of Artificial Sequence: Synthetic oligonucleotide
  Target: ATXN1; (+) strand; PAM type: YTN; PAM sequence: TTG
aagcagcatcagaaatggct

SEQ ID NO: 269052 - DNA, 20 bp, Artificial Sequence
  Description of Artificial Sequence: Synthetic oligonucleotide
  Target: ATXN1; (+) strand; PAM type: YTN; PAM sequence: CTG
gagaaggccaggtgcagtgg

SEQ ID NO: 269053 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccagcact

SEQ ID NO: 269054 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 269055 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggcaggaag

SEQ ID NO: 269056 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcaggaagg

SEQ ID NO: 269057 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggaaggt

SEQ ID NO: 269058 - DNA, 20 bp, Artificial Sequence
  Description of Artificial Sequence: Synthetic oligonucleotide
  Target: ATXN1; (+) strand; PAM type: YTN; PAM sequence: CTG
aggcaggaaggtggcttgag

SEQ ID NO: 269059 - DNA, 20 bp, Artificial Sequence
  Description of Artificial Sequence: Synthetic oligonucleotide
  Target: ATXN1; (+) strand; PAM type: YTN; PAM sequence: CTT
gagctcaggagttcaaggct

SEQ ID NO: 269060 - DNA, 20 bp, Artificial Sequence
  Description of Artificial Sequence: Synthetic oligonucleotide
  Target: ATXN1; (+) strand; PAM type: YTN; PAM sequence: TTG
agctcaggagttcaaggctg

SEQ ID NO: 269061 - DNA, 20 bp, Artificial Sequence
  Description of Artificial Sequence: Synthetic oligonucleotide
  Target: ATXN1; (+) strand; PAM type: YTN; PAM sequence: CTC
aggagttcaaggctgcaatg

SEQ ID NO: 269062 - DNA, 20 bp, Artificial Sequence
  Description of Artificial Sequence: Synthetic oligonucleotide
  Target: ATXN1; (+) strand; PAM type: YTN; PAM sequence: TTC
aaggctgcaatgcactatga

SEQ ID NO: 269063 - DNA, 20 bp, Artificial Sequence
  Description of Artificial Sequence: Synthetic oligonucleotide
  Target: ATXN1; (+) strand; PAM type: YTN; PAM sequence: CTG
caatgcactatgatcacgcc

SEQ ID NO: 269064 - DNA, 20 bp, Artificial Sequence
  Description of Artificial Sequence: Synthetic oligonucleotide
  Target: ATXN1; (+) strand; PAM type: YTN; PAM sequence: CTA
tgatcacgccactgtacccc

SEQ ID NO: 269065 - DNA, 20 bp, Artificial Sequence
  Description of Artificial Sequence: Synthetic oligonucleotide
  Target: ATXN1; (+) strand; PAM type: YTN; PAM sequence: CTG
taccccagcctgggcgaaag

SEQ ID NO: 269066 - DNA, 20 bp, Artificial Sequence
  Description of Artificial Sequence: Synthetic oligonucleotide
  Target: ATXN1; (+) strand; PAM type: YTN; PAM sequence: CTG
ggcgaaagaacaagactccg

SEQ ID NO: 269067 - DNA, 20 bp, Artificial Sequence
  Description of Artificial Sequence: Synthetic oligonucleotide
  Target: ATXN1; (+) strand; PAM type: YTN; PAM sequence: CTC
cgactcaaaaaaaggaaaga

SEQ ID NO: 269068 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaggaaagaaacgaa

SEQ ID NO: 269069 - DNA, 20 bp, Artificial Sequence
  Description of Artificial Sequence: Synthetic oligonucleotide
  Target: ATXN1; (+) strand; PAM type: YTN; PAM sequence: CTA
gagggtcttgttaaatcaga

SEQ ID NO: 269070 - DNA, 20 bp, Artificial Sequence
  Description of Artificial Sequence: Synthetic oligonucleotide
  Target: ATXN1; (+) strand; PAM type: YTN; PAM sequence: CTT
gttaaatcagagaatgctaa

SEQ ID NO: 269071 - DNA, 20 bp, Artificial Sequence
  Description of Artificial Sequence: Synthetic oligonucleotide
  Target: ATXN1; (+) strand; PAM type: YTN; PAM sequence: TTG
ttaaatcagagaatgctaag

SEQ ID NO: 269072 - DNA, 20 bp, Artificial Sequence
  Description of Artificial Sequence: Synthetic oligonucleotide
  Target: ATXN1; (+) strand; PAM type: YTN; PAM sequence: TTA
aatcagagaatgctaagacc

SEQ ID NO: 269073 - DNA, 20 bp, Artificial Sequence
  Description of Artificial Sequence: Synthetic oligonucleotide
  Target: ATXN1; (+) strand; PAM type: YTN; PAM sequence: CTA
agacccatctgtagaatttc

SEQ ID NO: 269074 - DNA, 20 bp, Artificial Sequence
  Description of Artificial Sequence: Synthetic oligonucleotide
  Target: ATXN1; (+) strand; PAM type: YTN; PAM sequence: CTG
tagaatttctgattcagtag

SEQ ID NO: 269075 - DNA, 20 bp, Artificial Sequence
  Description of Artificial Sequence: Synthetic oligonucleotide
  Target: ATXN1; (+) strand; PAM type: YTN; PAM sequence: TTT
ctgattcagtaggcttgggg

SEQ ID NO: 269076 - DNA, 20 bp, Artificial Sequence
  Description of Artificial Sequence: Synthetic oligonucleotide
  Target: ATXN1; (+) strand; PAM type: YTN; PAM sequence: TTC
tgattcagtaggcttggggt

SEQ ID NO: 269077 - DNA, 20 bp, Artificial Sequence
  Description of Artificial Sequence: Synthetic oligonucleotide
  Target: ATXN1; (+) strand; PAM type: YTN; PAM sequence: CTG
attcagtaggcttggggtgg

SEQ ID NO: 269078 - DNA, 20 bp, Artificial Sequence
  Description of Artificial Sequence: Synthetic oligonucleotide
  Target: ATXN1; (+) strand; PAM type: YTN; PAM sequence: TTC
agtaggcttggggtggggtc

SEQ ID NO: 269079 - DNA, 20 bp, Artificial Sequence
  Description of Artificial Sequence: Synthetic oligonucleotide
  Target: ATXN1; (+) strand; PAM type: YTN; PAM sequence: CTT
ggggtggggtcagataattt

SEQ ID NO: 269080 - DNA, 20 bp, Artificial Sequence
  Description of Artificial Sequence: Synthetic oligonucleotide
  Target: ATXN1; (+) strand; PAM type: YTN; PAM sequence: TTG
gggtggggtcagataatttg

SEQ ID NO: 269081 - DNA, 20 bp, Artificial Sequence
  Description of Artificial Sequence: Synthetic oligonucleotide
  Target: ATXN1; (+) strand; PAM type: YTN; PAM sequence: TTT
gtatttctgacaagttccca

SEQ ID NO: 269082 - DNA, 20 bp, Artificial Sequence
  Description of Artificial Sequence: Synthetic oligonucleotide
  Target: ATXN1; (+) strand; PAM type: YTN; PAM sequence: TTG
tatttctgacaagttcccag

SEQ ID NO: 269083 - DNA, 20 bp, Artificial Sequence
  Description of Artificial Sequence: Synthetic oligonucleotide
  Target: ATXN1; (+) strand; PAM type: YTN; PAM sequence: TTT
ctgacaagttcccaggtgat

SEQ ID NO: 269084 - DNA, 20 bp, Artificial Sequence
  Description of Artificial Sequence: Synthetic oligonucleotide
  Target: ATXN1; (+) strand; PAM type: YTN; PAM sequence: TTC
tgacaagttcccaggtgatg

SEQ ID NO: 269085 - DNA, 20 bp, Artificial Sequence
  Description of Artificial Sequence: Synthetic oligonucleotide
  Target: ATXN1; (+) strand; PAM type: YTN; PAM sequence: CTG
acaagttcccaggtgatgct

SEQ ID NO: 269086 - DNA, 20 bp, Artificial Sequence
  Description of Artificial Sequence: Synthetic oligonucleotide
  Target: ATXN1; (+) strand; PAM type: YTN; PAM sequence: TTC
ccaggtgatgctgatactgc

SEQ ID NO: 269087 - DNA, 20 bp, Artificial Sequence
  Description of Artificial Sequence: Synthetic oligonucleotide
  Target: ATXN1; (+) strand; PAM type: YTN; PAM sequence: CTG
atactgctggtccagggacc

SEQ ID NO: 269088 - DNA, 20 bp, Artificial Sequence
  Description of Artificial Sequence: Synthetic oligonucleotide
  Target: ATXN1; (+) strand; PAM type: YTN; PAM sequence: CTG
ctggtccagggaccagactt

SEQ ID NO: 269089 - DNA, 20 bp, Artificial Sequence
  Description of Artificial Sequence: Synthetic oligonucleotide
  Target: ATXN1; (+) strand; PAM type: YTN; PAM sequence: CTG
gtccagggaccagactttga

SEQ ID NO: 269090 - DNA, 20 bp, Artificial Sequence
  Description of Artificial Sequence: Synthetic oligonucleotide
  Target: ATXN1; (+) strand; PAM type: YTN; PAM sequence: CTT
tgagaaccacttctctaagg

SEQ ID NO: 269091 - DNA, 20 bp, Artificial Sequence
  Description of Artificial Sequence: Synthetic oligonucleotide
  Target: ATXN1; (+) strand; PAM type: YTN; PAM sequence: TTT
gagaaccacttctctaaggt

SEQ ID NO: 269092 - DNA, 20 bp, Artificial Sequence
  Description of Artificial Sequence: Synthetic oligonucleotide
  Target: ATXN1; (+) strand; PAM type: YTN; PAM sequence: TTG
agaaccacttctctaaggtt

SEQ ID NO: 269093 - DNA, 20 bp, Artificial Sequence
  Description of Artificial Sequence: Synthetic oligonucleotide
  Target: ATXN1; (+) strand; PAM type: YTN; PAM sequence: CTT
ctctaaggttaaatgtttct

SEQ ID NO: 269094 - DNA, 20 bp, Artificial Sequence
  Description of Artificial Sequence: Synthetic oligonucleotide
  Target: ATXN1; (+) strand; PAM type: YTN; PAM sequence: TTC
tctaaggttaaatgtttctg

SEQ ID NO: 269095 - DNA, 20 bp, Artificial Sequence
  Description of Artificial Sequence: Synthetic oligonucleotide
  Target: ATXN1; (+) strand; PAM type: YTN; PAM sequence: CTC
taaggttaaatgtttctgtc

SEQ ID NO: 269096 - DNA, 20 bp, Artificial Sequence
  Description of Artificial Sequence: Synthetic oligonucleotide
  Target: ATXN1; (+) strand; PAM type: YTN; PAM sequence: CTA
aggttaaatgtttctgtcaa

SEQ ID NO: 269097 - DNA, 20 bp, Artificial Sequence
  Description of Artificial Sequence: Synthetic oligonucleotide
  Target: ATXN1; (+) strand; PAM type: YTN; PAM sequence: TTA
aatgtttctgtcaattacag

SEQ ID NO: 269098 - DNA, 20 bp, Artificial Sequence
  Description of Artificial Sequence: Synthetic oligonucleotide
  Target: ATXN1; (+) strand; PAM type: YTN; PAM sequence: TTT
ctgtcaattacagggccaga

SEQ ID NO: 269099 - DNA, 20 bp, Artificial Sequence
  Description of Artificial Sequence: Synthetic oligonucleotide
  Target: ATXN1; (+) strand; PAM type: YTN; PAM sequence: TTC
tgtcaattacagggccagag

SEQ ID NO: 269100 - DNA, 20 bp, Artificial Sequence
  Description of Artificial Sequence: Synthetic oligonucleotide
  Target: ATXN1; (+) strand; PAM type: YTN; PAM sequence: CTG
tcaattacagggccagagag

SEQ ID NO: 269101 - DNA, 20 bp, Artificial Sequence
  Description of Artificial Sequence: Synthetic oligonucleotide
  Target: ATXN1; (+) strand; PAM type: YTN; PAM sequence: TTA
cagggccagagagatgctga

SEQ ID NO: 269102 - DNA, 20 bp, Artificial Sequence
  Description of Artificial Sequence: Synthetic oligonucleotide
  Target: ATXN1; (+) strand; PAM type: YTN; PAM sequence: CTG
aggatcttttgagtacattt

SEQ ID NO: 269103 - DNA, 20 bp, Artificial Sequence
  Description of Artificial Sequence: Synthetic oligonucleotide
  Target: ATXN1; (+) strand; PAM type: YTN; PAM sequence: CTT
ttgagtacatttaatcacca

SEQ ID NO: 269104 - DNA, 20 bp, Artificial Sequence
  Description of Artificial Sequence: Synthetic oligonucleotide
  Target: ATXN1; (+) strand; PAM type: YTN; PAM sequence: TTT
tgagtacatttaatcaccat

SEQ ID NO: 269105 - DNA, 20 bp, Artificial Sequence
  Description of Artificial Sequence: Synthetic oligonucleotide
  Target: ATXN1; (+) strand; PAM type: YTN; PAM sequence: TTT
gagtacatttaatcaccatt

SEQ ID NO: 269106 - DNA, 20 bp, Artificial Sequence
  Description of Artificial Sequence: Synthetic oligonucleotide
  Target: ATXN1; (+) strand; PAM type: YTN; PAM sequence: TTG
agtacatttaatcaccattt

SEQ ID NO: 269107 - DNA, 20 bp, Artificial Sequence
  Description of Artificial Sequence: Synthetic oligonucleotide
  Target: ATXN1; (+) strand; PAM type: YTN; PAM sequence: TTT
aatcaccatttgatagctac

SEQ ID NO: 269108 - DNA, 20 bp, Artificial Sequence
  Description of Artificial Sequence: Synthetic oligonucleotide
  Target: ATXN1; (+) strand; PAM type: YTN; PAM sequence: TTA
atcaccatttgatagctaca

SEQ ID NO: 269109 - DNA, 20 bp, Artificial Sequence
  Description of Artificial Sequence: Synthetic oligonucleotide
  Target: ATXN1; (+) strand; PAM type: YTN; PAM sequence: TTT
gatagctacattgaaagcaa

SEQ ID NO: 269110 - DNA, 20 bp, Artificial Sequence
  Description of Artificial Sequence: Synthetic oligonucleotide
  Target: ATXN1; (+) strand; PAM type: YTN; PAM sequence: TTG
atagctacattgaaagcaat

SEQ ID NO: 269111 - DNA, 20 bp, Artificial Sequence
  Description of Artificial Sequence: Synthetic oligonucleotide
  Target: ATXN1; (+) strand; PAM type: YTN; PAM sequence: CTA
cattgaaagcaatgatacct

SEQ ID NO: 269112 - DNA, 20 bp, Artificial Sequence
  Description of Artificial Sequence: Synthetic oligonucleotide
  Target: ATXN1; (+) strand; PAM type: YTN; PAM sequence: TTG
aaagcaatgatacctgtcta

SEQ ID NO: 269113 - DNA, 20 bp, Artificial Sequence
  Description of Artificial Sequence: Synthetic oligonucleotide
  Target: ATXN1; (+) strand; PAM type: YTN; PAM sequence: CTG
tctatttcaaagaagcgaca

SEQ ID NO: 269114 - DNA, 20 bp, Artificial Sequence
  Description of Artificial Sequence: Synthetic oligonucleotide
  Target: ATXN1; (+) strand; PAM type: YTN; PAM sequence: CTA
tttcaaagaagcgacaaatg

SEQ ID NO: 269115 - DNA, 20 bp, Artificial Sequence
  Description of Artificial Sequence: Synthetic oligonucleotide
  Target: ATXN1; (+) strand; PAM type: YTN; PAM sequence: TTT
caaagaagcgacaaatgacc

SEQ ID NO: 269116 - DNA, 20 bp, Artificial Sequence
  Description of Artificial Sequence: Synthetic oligonucleotide
  Target: ATXN1; (+) strand; PAM type: YTN; PAM sequence: TTC
aaagaagcgacaaatgacca

SEQ ID NO: 269117 - DNA, 20 bp, Artificial Sequence
  Description of Artificial Sequence: Synthetic oligonucleotide
  Target: ATXN1; (+) strand; PAM type: YTN; PAM sequence: CTT
cacacactatattacccagg

SEQ ID NO: 269118 - DNA, 20 bp, Artificial Sequence
  Description of Artificial Sequence: Synthetic oligonucleotide
  Target: ATXN1; (+) strand; PAM type: YTN; PAM sequence: TTC
acacactatattacccaggt

SEQ ID NO: 269119 - DNA, 20 bp, Artificial Sequence
  Description of Artificial Sequence: Synthetic oligonucleotide
  Target: ATXN1; (+) strand; PAM type: YTN; PAM sequence: CTA
tattacccaggttattacac

SEQ ID NO: 269120 - DNA, 20 bp, Artificial Sequence
  Description of Artificial Sequence: Synthetic oligonucleotide
  Target: ATXN1; (+) strand; PAM type: YTN; PAM sequence: TTA
cccaggttattacactgtgt

SEQ ID NO: 269121 - DNA, 20 bp, Artificial Sequence
  Description of Artificial Sequence: Synthetic oligonucleotide
  Target: ATXN1; (+) strand; PAM type: YTN; PAM sequence: TTA
ttacactgtgtgtggcctct

SEQ ID NO: 269122 - DNA, 20 bp, Artificial Sequence
  Description of Artificial Sequence: Synthetic oligonucleotide
  Target: ATXN1; (+) strand; PAM type: YTN; PAM sequence: TTA
cactgtgtgtggcctctcta

SEQ ID NO: 269123 - DNA, 20 bp, Artificial Sequence
  Description of Artificial Sequence: Synthetic oligonucleotide
  Target: ATXN1; (+) strand; PAM type: YTN; PAM sequence: CTG
tgtgtggcctctctacttgg

SEQ ID NO: 269124 - DNA, 20 bp, Artificial Sequence
  Description of Artificial Sequence: Synthetic oligonucleotide
  Target: ATXN1; (+) strand; PAM type: YTN; PAM sequence: CTC
tctacttggagtctgaatcc

SEQ ID NO: 269125 - DNA, 20 bp, Artificial Sequence
  Description of Artificial Sequence: Synthetic oligonucleotide
  Target: ATXN1; (+) strand; PAM type: YTN; PAM sequence: CTC
tacttggagtctgaatccat

SEQ ID NO: 269126 - DNA, 20 bp, Artificial Sequence
  Description of Artificial Sequence: Synthetic oligonucleotide
  Target: ATXN1; (+) strand; PAM type: YTN; PAM sequence: CTA
cttggagtctgaatccattc

SEQ ID NO: 269127 - DNA, 20 bp, Artificial Sequence
  Description of Artificial Sequence: Synthetic oligonucleotide
  Target: ATXN1; (+) strand; PAM type: YTN; PAM sequence: CTT
ggagtctgaatccattctcc

SEQ ID NO: 269128 - DNA, 20 bp, Artificial Sequence
  Description of Artificial Sequence: Synthetic oligonucleotide
  Target: ATXN1; (+) strand; PAM type: YTN; PAM sequence: TTG
gagtctgaatccattctcct

SEQ ID NO: 269129 - DNA, 20 bp, Artificial Sequence
  Description of Artificial Sequence: Synthetic oligonucleotide
  Target: ATXN1; (+) strand; PAM type: YTN; PAM sequence: CTG
aatccattctcctcctactg

SEQ ID NO: 269130 - DNA, 20 bp, Artificial Sequence
  Description of Artificial Sequence: Synthetic oligonucleotide
  Target: ATXN1; (+) strand; PAM type: YTN; PAM sequence: TTC
tcctcctactggttccagat

SEQ ID NO: 269131 - DNA, 20 bp, Artificial Sequence
  Description of Artificial Sequence: Synthetic oligonucleotide
  Target: ATXN1; (+) strand; PAM type: YTN; PAM sequence: CTC
ctcctactggttccagatcc

SEQ ID NO: 269132 - DNA, 20 bp, Artificial Sequence
  Description of Artificial Sequence: Synthetic oligonucleotide
  Target: ATXN1; (+) strand; PAM type: YTN; PAM sequence: CTC
ctactggttccagatcctgc

SEQ ID NO: 269133 - DNA, 20 bp, Artificial Sequence
  Description of Artificial Sequence: Synthetic oligonucleotide
  Target: ATXN1; (+) strand; PAM type: YTN; PAM sequence: CTA
ctggttccagatcctgctgg

SEQ ID NO: 269134 - DNA, 20 bp, Artificial Sequence
  Description of Artificial Sequence: Synthetic oligonucleotide
  Target: ATXN1; (+) strand; PAM type: YTN; PAM sequence: CTG
gttccagatcctgctggggt

SEQ ID NO: 269135 - DNA, 20 bp, Artificial Sequence
  Description of Artificial Sequence: Synthetic oligonucleotide
  Target: ATXN1; (+) strand; PAM type: YTN; PAM sequence: TTC
cagatcctgctggggtcaac

SEQ ID NO: 269136 - DNA, 20 bp, Artificial Sequence
  Description of Artificial Sequence: Synthetic oligonucleotide
  Target: ATXN1; (+) strand; PAM type: YTN; PAM sequence: CTG
ctggggtcaactctgctccc

SEQ ID NO: 269137 - DNA, 20 bp, Artificial Sequence
  Description of Artificial Sequence: Synthetic oligonucleotide
  Target: ATXN1; (+) strand; PAM type: YTN; PAM sequence: CTG
gggtcaactctgctcccaac

SEQ ID NO: 269138 - DNA, 20 bp, Artificial Sequence
  Description of Artificial Sequence: Synthetic oligonucleotide
  Target: ATXN1; (+) strand; PAM type: YTN; PAM sequence: CTC
tgctcccaacttcccttcag

SEQ ID NO: 269139 - DNA, 20 bp, Artificial Sequence
  Description of Artificial Sequence: Synthetic oligonucleotide
  Target: ATXN1; (+) strand; PAM type: YTN; PAM sequence: CTG
ctcccaacttcccttcagtc

SEQ ID NO: 269140 - DNA, 20 bp, Artificial Sequence
  Description of Artificial Sequence: Synthetic oligonucleotide
  Target: ATXN1; (+) strand; PAM type: YTN; PAM sequence: CTC
ccaacttcccttcagtcttt

SEQ ID NO: 269141 - DNA, 20 bp, Artificial Sequence
  Description of Artificial Sequence: Synthetic oligonucleotide
  Target: ATXN1; (+) strand; PAM type: YTN; PAM sequence: CTT
cccttcagtctttttcctct

SEQ ID NO: 269142 - DNA, 20 bp, Artificial Sequence
  Description of Artificial Sequence: Synthetic oligonucleotide
  Target: ATXN1; (+) strand; PAM type: YTN; PAM sequence: TTC
ccttcagtctttttcctctc

SEQ ID NO: 269143 - DNA, 20 bp, Artificial Sequence
  Description of Artificial Sequence: Synthetic oligonucleotide
  Target: ATXN1; (+) strand; PAM type: YTN; PAM sequence: CTT
cagtctttttcctctctact

SEQ ID NO: 269144 - DNA, 20 bp, Artificial Sequence
  Description of Artificial Sequence: Synthetic oligonucleotide
  Target: ATXN1; (+) strand; PAM type: YTN; PAM sequence: TTC
agtctttttcctctctactg

SEQ ID NO: 269145 - DNA, 20 bp, Artificial Sequence
  Description of Artificial Sequence: Synthetic oligonucleotide
  Target: ATXN1; (+) strand; PAM type: YTN; PAM sequence: CTT
tttcctctctactggaaatt

SEQ ID NO: 269146 - DNA, 20 bp, Artificial Sequence
  Description of Artificial Sequence: Synthetic oligonucleotide
  Target: ATXN1; (+) strand; PAM type: YTN; PAM sequence: TTT
ttcctctctactggaaattt

SEQ ID NO: 269147 - DNA, 20 bp, Artificial Sequence
  Description of Artificial Sequence: Synthetic oligonucleotide
  Target: ATXN1; (+) strand; PAM type: YTN; PAM sequence: TTT
tcctctctactggaaatttc

SEQ ID NO: 269148 - DNA, 20 bp, Artificial Sequence
  Description of Artificial Sequence: Synthetic oligonucleotide
  Target: ATXN1; (+) strand; PAM type: YTN; PAM sequence: TTT
cctctctactggaaatttct

SEQ ID NO: 269149 - DNA, 20 bp, Artificial Sequence
  Description of Artificial Sequence: Synthetic oligonucleotide
  Target: ATXN1; (+) strand; PAM type: YTN; PAM sequence: TTC
ctctctactggaaatttctc

SEQ ID NO: 269150 - DNA, 20 bp, Artificial Sequence
  Description of Artificial Sequence: Synthetic oligonucleotide
  Target: ATXN1; (+) strand; PAM type: YTN; PAM sequence: CTC
tctactggaaatttctcaca

SEQ ID NO: 269151 - DNA, 20 bp, Artificial Sequence
  Description of Artificial Sequence: Synthetic oligonucleotide
  Target: ATXN1; (+) strand; PAM type: YTN; PAM sequence: CTC
tactggaaatttctcacact

SEQ ID NO: 269152 - DNA, 20 bp, Artificial Sequence
  Description of Artificial Sequence: Synthetic oligonucleotide
  Target: ATXN1; (+) strand; PAM type: YTN; PAM sequence: CTA
ctggaaatttctcacactcc

SEQ ID NO: 269153 - DNA, 20 bp, Artificial Sequence
  Description of Artificial Sequence: Synthetic oligonucleotide
  Target: ATXN1; (+) strand; PAM type: YTN; PAM sequence: CTG
gaaatttctcacactccaag

SEQ ID NO: 269154 - DNA, 20 bp, Artificial Sequence
  Description of Artificial Sequence: Synthetic oligonucleotide
  Target: ATXN1; (+) strand; PAM type: YTN; PAM sequence: TTT
ctcacactccaagcatactc

SEQ ID NO: 269155 - DNA, 20 bp, Artificial Sequence
  Description of Artificial Sequence: Synthetic oligonucleotide
  Target: ATXN1; (+) strand; PAM type: YTN; PAM sequence: TTC
tcacactccaagcatactca

SEQ ID NO: 269156 - DNA, 20 bp, Artificial Sequence
  Description of Artificial Sequence: Synthetic oligonucleotide
  Target: ATXN1; (+) strand; PAM type: YTN; PAM sequence: CTC
acactccaagcatactcagt

SEQ ID NO: 269157 - DNA, 20 bp, Artificial Sequence
  Description of Artificial Sequence: Synthetic oligonucleotide
  Target: ATXN1; (+) strand; PAM type: YTN; PAM sequence: CTC
caagcatactcagtcactgc

SEQ ID NO: 269158 - DNA, 20 bp, Artificial Sequence
  Description of Artificial Sequence: Synthetic oligonucleotide
  Target: ATXN1; (+) strand; PAM type: YTN; PAM sequence: CTC
agtcactgctattcctaaaa

SEQ ID NO: 269159 - DNA, 20 bp, Artificial Sequence
  Description of Artificial Sequence: Synthetic oligonucleotide
  Target: ATXN1; (+) strand; PAM type: YTN; PAM sequence: CTG
ctattcctaaaagaatttat

SEQ ID NO: 269160 - DNA, 20 bp, Artificial Sequence
  Description of Artificial Sequence: Synthetic oligonucleotide
  Target: ATXN1; (+) strand; PAM type: YTN; PAM sequence: CTA
ttcctaaaagaatttatcca

SEQ ID NO: 269161 - DNA, 20 bp, Artificial Sequence
  Description of Artificial Sequence: Synthetic oligonucleotide
  Target: ATXN1; (+) strand; PAM type: YTN; PAM sequence: TTC
ctaaaagaatttatccatac

SEQ ID NO: 269162 - DNA, 20 bp, Artificial Sequence
  Description of Artificial Sequence: Synthetic oligonucleotide
  Target: ATXN1; (+) strand; PAM type: YTN; PAM sequence: CTA
aaagaatttatccataccct

SEQ ID NO: 269163 - DNA, 20 bp, Artificial Sequence
  Description of Artificial Sequence: Synthetic oligonucleotide
  Target: ATXN1; (+) strand; PAM type: YTN; PAM sequence: TTT
atccataccctaatacagtc

SEQ ID NO: 269164 - DNA, 20 bp, Artificial Sequence
  Description of Artificial Sequence: Synthetic oligonucleotide
  Target: ATXN1; (+) strand; PAM type: YTN; PAM sequence: TTA
tccataccctaatacagtcc

SEQ ID NO: 269165 - DNA, 20 bp, Artificial Sequence
  Description of Artificial Sequence: Synthetic oligonucleotide
  Target: ATXN1; (+) strand; PAM type: YTN; PAM sequence: CTA
atacagtcccaaatggctgt

SEQ ID NO: 269166 - DNA, 20 bp, Artificial Sequence
  Description of Artificial Sequence: Synthetic oligonucleotide
  Target: ATXN1; (+) strand; PAM type: YTN; PAM sequence: CTG
tcctctctcttctgtttacc

SEQ ID NO: 269167 - DNA, 20 bp, Artificial Sequence
  Description of Artificial Sequence: Synthetic oligonucleotide
  Target: ATXN1; (+) strand; PAM type: YTN; PAM sequence: CTC
tctcttctgtttaccaacaa

SEQ ID NO: 269168 - DNA, 20 bp, Artificial Sequence
  Description of Artificial Sequence: Synthetic oligonucleotide
  Target: ATXN1; (+) strand; PAM type: YTN; PAM sequence: CTC
tcttctgtttaccaacaaac

SEQ ID NO: 269169 - DNA, 20 bp, Artificial Sequence
  Description of Artificial Sequence: Synthetic oligonucleotide
  Target: ATXN1; (+) strand; PAM type: YTN; PAM sequence: CTC
ttctgtttaccaacaaacag

SEQ ID NO: 269170 - DNA, 20 bp, Artificial Sequence
  Description of Artificial Sequence: Synthetic oligonucleotide
  Target: ATXN1; (+) strand; PAM type: YTN; PAM sequence: CTT
ctgtttaccaacaaacagtt

SEQ ID NO: 269171 - DNA, 20 bp, Artificial Sequence
  Description of Artificial Sequence: Synthetic oligonucleotide
  Target: ATXN1; (+) strand; PAM type: YTN; PAM sequence: TTC
tgtttaccaacaaacagttg

SEQ ID NO: 269172 - DNA, 20 bp, Artificial Sequence
  Description of Artificial Sequence: Synthetic oligonucleotide
  Target: ATXN1; (+) strand; PAM type: YTN; PAM sequence: CTG
tttaccaacaaacagttgta

SEQ ID NO: 269173 - DNA, 20 bp, Artificial Sequence
  Description of Artificial Sequence: Synthetic oligonucleotide
  Target: ATXN1; (+) strand; PAM type: YTN; PAM sequence: TTT
accaacaaacagttgtacta

SEQ ID NO: 269174 - DNA, 20 bp, Artificial Sequence
  Description of Artificial Sequence: Synthetic oligonucleotide
  Target: ATXN1; (+) strand; PAM type: YTN; PAM sequence: TTA
ccaacaaacagttgtactat

SEQ ID NO: 269175 - DNA, 20 bp, Artificial Sequence
  Description of Artificial Sequence: Synthetic oligonucleotide
  Target: ATXN1; (+) strand; PAM type: YTN; PAM sequence: TTG
tactatacattcaatgccag

SEQ ID NO: 269176 - DNA, 20 bp, Artificial Sequence
  Description of Artificial Sequence: Synthetic oligonucleotide
  Target: ATXN1; (+) strand; PAM type: YTN; PAM sequence: CTA
tacattcaatgccagtattt

SEQ ID NO: 269177 - DNA, 20 bp, Artificial Sequence
  Description of Artificial Sequence: Synthetic oligonucleotide
  Target: ATXN1; (+) strand; PAM type: YTN; PAM sequence: TTC
aatgccagtatttcaccgcc

SEQ ID NO: 269178 - DNA, 20 bp, Artificial Sequence
  Description of Artificial Sequence: Synthetic oligonucleotide
  Target: ATXN1; (+) strand; PAM type: YTN; PAM sequence: TTT
caccgcctacatcttaaaac

SEQ ID NO: 269179 - DNA, 20 bp, Artificial Sequence
  Description of Artificial Sequence: Synthetic oligonucleotide
  Target: ATXN1; (+) strand; PAM type: YTN; PAM sequence: TTC
accgcctacatcttaaaact

SEQ ID NO: 269180 - DNA, 20 bp, Artificial Sequence
  Description of Artificial Sequence: Synthetic oligonucleotide
  Target: ATXN1; (+) strand; PAM type: YTN; PAM sequence: CTA
catcttaaaactctggagct

SEQ ID NO: 269181 - DNA, 20 bp, Artificial Sequence
  Description of Artificial Sequence: Synthetic oligonucleotide
  Target: ATXN1; (+) strand; PAM type: YTN; PAM sequence: CTT
aaaactctggagcttgattt

SEQ ID NO: 269182 - DNA, 20 bp, Artificial Sequence
  Description of Artificial Sequence: Synthetic oligonucleotide
  Target: ATXN1; (+) strand; PAM type: YTN; PAM sequence: TTA
aaactctggagcttgatttc

SEQ ID NO: 269183 - DNA, 20 bp, Artificial Sequence
  Description of Artificial Sequence: Synthetic oligonucleotide
  Target: ATXN1; (+) strand; PAM type: YTN; PAM sequence: CTC
tggagcttgatttccaccac

SEQ ID NO: 269184 - DNA, 20 bp, Artificial Sequence
  Description of Artificial Sequence: Synthetic oligonucleotide
  Target: ATXN1; (+) strand; PAM type: YTN; PAM sequence: CTG
gagcttgatttccaccactt

SEQ ID NO: 269185 - DNA, 20 bp, Artificial Sequence
  Description of Artificial Sequence: Synthetic oligonucleotide
  Target: ATXN1; (+) strand; PAM type: YTN; PAM sequence: CTT
gatttccaccacttttctct

SEQ ID NO: 269186 - DNA, 20 bp, Artificial Sequence
  Description of Artificial Sequence: Synthetic oligonucleotide
  Target: ATXN1; (+) strand; PAM type: YTN; PAM sequence: TTG
atttccaccacttttctctg

SEQ ID NO: 269187 - DNA, 20 bp, Artificial Sequence
  Description of Artificial Sequence: Synthetic oligonucleotide
  Target: ATXN1; (+) strand; PAM type: YTN; PAM sequence: TTT
ccaccacttttctctgtgtt

SEQ ID NO: 269188 - DNA, 20 bp, Artificial Sequence
  Description of Artificial Sequence: Synthetic oligonucleotide
  Target: ATXN1; (+) strand; PAM type: YTN; PAM sequence: TTC
caccacttttctctgtgtta

SEQ ID NO: 269189 - DNA, 20 bp, Artificial Sequence
  Description of Artificial Sequence: Synthetic oligonucleotide
  Target: ATXN1; (+) strand; PAM type: YTN; PAM sequence: CTT
ttctctgtgttagtaacctt

SEQ ID NO: 269190 - DNA, 20 bp, Artificial Sequence
  Description of Artificial Sequence: Synthetic oligonucleotide
  Target: ATXN1; (+) strand; PAM type: YTN; PAM sequence: TTT
tctctgtgttagtaaccttc

SEQ ID NO: 269191 - DNA, 20 bp, Artificial Sequence
  Description of Artificial Sequence: Synthetic oligonucleotide
  Target: ATXN1; (+) strand; PAM type: YTN; PAM sequence: TTT
ctctgtgttagtaaccttcc

SEQ ID NO: 269192 - DNA, 20 bp, Artificial Sequence
  Description of Artificial Sequence: Synthetic oligonucleotide
  Target: ATXN1; (+) strand; PAM type: YTN; PAM sequence: TTC
tctgtgttagtaaccttcct

SEQ ID NO: 269193 - DNA, 20 bp, Artificial Sequence
  Description of Artificial Sequence: Synthetic oligonucleotide
  Target: ATXN1; (+) strand; PAM type: YTN; PAM sequence: CTC
tgtgttagtaaccttccttc

SEQ ID NO: 269194 - DNA, 20 bp, Artificial Sequence
  Description of Artificial Sequence: Synthetic oligonucleotide
  Target: ATXN1; (+) strand; PAM type: YTN; PAM sequence: CTG
tgttagtaaccttccttctc

SEQ ID NO: 269195 - DNA, 20 bp, Artificial Sequence
  Description of Artificial Sequence: Synthetic oligonucleotide
  Target: ATXN1; (+) strand; PAM type: YTN; PAM sequence: TTA
gtaaccttccttctcctcca

SEQ ID NO: 269196 - DNA, 20 bp, Artificial Sequence
  Description of Artificial Sequence: Synthetic oligonucleotide
  Target: ATXN1; (+) strand; PAM type: YTN; PAM sequence: CTT
ccttctcctccaaaggtcaa

SEQ ID NO: 269197 - DNA, 20 bp, Artificial Sequence
  Description of Artificial Sequence: Synthetic oligonucleotide
  Target: ATXN1; (+) strand; PAM type: YTN; PAM sequence: TTC
cttctcctccaaaggtcaag

SEQ ID NO: 269198 - DNA, 20 bp, Artificial Sequence
  Description of Artificial Sequence: Synthetic oligonucleotide
  Target: ATXN1; (+) strand; PAM type: YTN; PAM sequence: CTT
ctcctccaaaggtcaagaat

SEQ ID NO: 269199 - DNA, 20 bp, Artificial Sequence
  Description of Artificial Sequence: Synthetic oligonucleotide
  Target: ATXN1; (+) strand; PAM type: YTN; PAM sequence: TTC
tcctccaaaggtcaagaatg

SEQ ID NO: 269200 - DNA, 20 bp, Artificial Sequence
  Description of Artificial Sequence: Synthetic oligonucleotide
  Target: ATXN1; (+) strand; PAM type: YTN; PAM sequence: CTC
ctccaaaggtcaagaatggt

SEQ ID NO: 269201 - DNA, 20 bp, Artificial Sequence
  Description of Artificial Sequence: Synthetic oligonucleotide
  Target: ATXN1; (+) strand; PAM type: YTN; PAM sequence: CTC
caaaggtcaagaatggtttc

SEQ ID NO: 269202 - DNA, 20 bp, Artificial Sequence
  Description of Artificial Sequence: Synthetic oligonucleotide
  Target: ATXN1; (+) strand; PAM type: YTN; PAM sequence: TTT
cctgccttctaaatgcagtg

SEQ ID NO: 269203 - DNA, 20 bp, Artificial Sequence
  Description of Artificial Sequence: Synthetic oligonucleotide
  Target: ATXN1; (+) strand; PAM type: YTN; PAM sequence: TTC
ctgccttctaaatgcagtga

SEQ ID NO: 269204 - DNA, 20 bp, Artificial Sequence
  Description of Artificial Sequence: Synthetic oligonucleotide
  Target: ATXN1; (+) strand; PAM type: YTN; PAM sequence: CTG
ccttctaaatgcagtgacct

SEQ ID NO: 269205 - DNA, 20 bp, Artificial Sequence
  Description of Artificial Sequence: Synthetic oligonucleotide
  Target: ATXN1; (+) strand; PAM type: YTN; PAM sequence: CTT
ctaaatgcagtgacctttgc

SEQ ID NO: 269206 - DNA, 20 bp, Artificial Sequence
  Description of Artificial Sequence: Synthetic oligonucleotide
  Target: ATXN1; (+) strand; PAM type: YTN; PAM sequence: TTC
taaatgcagtgacctttgct

SEQ ID NO: 269207 - DNA, 20 bp, Artificial Sequence
  Description of Artificial Sequence: Synthetic oligonucleotide
  Target: ATXN1; (+) strand; PAM type: YTN; PAM sequence: CTA
aatgcagtgacctttgctga

SEQ ID NO: 269208 - DNA, 20 bp, Artificial Sequence
  Description of Artificial Sequence: Synthetic oligonucleotide
  Target: ATXN1; (+) strand; PAM type: YTN; PAM sequence: CTT
tgctgagtcctcctcttaac

SEQ ID NO: 269209 - DNA, 20 bp, Artificial Sequence
  Description of Artificial Sequence: Synthetic oligonucleotide
  Target: ATXN1; (+) strand; PAM type: YTN; PAM sequence: TTT
gctgagtcctcctcttaact

SEQ ID NO: 269210 - DNA, 20 bp, Artificial Sequence
  Description of Artificial Sequence: Synthetic oligonucleotide
  Target: ATXN1; (+) strand; PAM type: YTN; PAM sequence: TTG
ctgagtcctcctcttaactt

SEQ ID NO: 269211 - DNA, 20 bp, Artificial Sequence
  Description of Artificial Sequence: Synthetic oligonucleotide
  Target: ATXN1; (+) strand; PAM type: YTN; PAM sequence: CTG
agtcctcctcttaacttctc

SEQ ID NO: 269212 - DNA, 20 bp, Artificial Sequence
  Description of Artificial Sequence: Synthetic oligonucleotide
  Target: ATXN1; (+) strand; PAM type: YTN; PAM sequence: CTC
ctcttaacttctctaacaat

SEQ ID NO: 269213 - DNA, 20 bp, Artificial Sequence
  Description of Artificial Sequence: Synthetic oligonucleotide
  Target: ATXN1; (+) strand; PAM type: YTN; PAM sequence: CTC
ttaacttctctaacaatgtc

SEQ ID NO: 269214 - DNA, 20 bp, Artificial Sequence
  Description of Artificial Sequence: Synthetic oligonucleotide
  Target: ATXN1; (+) strand; PAM type: YTN; PAM sequence: CTT
aacttctctaacaatgtctg

SEQ ID NO: 269215 - DNA, 20 bp, Artificial Sequence
  Description of Artificial Sequence: Synthetic oligonucleotide
  Target: ATXN1; (+) strand; PAM type: YTN; PAM sequence: TTA
acttctctaacaatgtctga

SEQ ID NO: 269216 - DNA, 20 bp, Artificial Sequence
  Description of Artificial Sequence: Synthetic oligonucleotide
  Target: ATXN1; (+) strand; PAM type: YTN; PAM sequence: CTT
ctctaacaatgtctgataca

SEQ ID NO: 269217 - DNA, 20 bp, Artificial Sequence
  Description of Artificial Sequence: Synthetic oligonucleotide
  Target: ATXN1; (+) strand; PAM type: YTN; PAM sequence: TTC
tctaacaatgtctgatacag

SEQ ID NO: 269218 - DNA, 20 bp, Artificial Sequence
  Description of Artificial Sequence: Synthetic oligonucleotide
  Target: ATXN1; (+) strand; PAM type: YTN; PAM sequence: CTC
taacaatgtctgatacagtt

SEQ ID NO: 269219 - DNA, 20 bp, Artificial Sequence
  Description of Artificial Sequence: Synthetic oligonucleotide
  Target: ATXN1; (+) strand; PAM type: YTN; PAM sequence: CTA
acaatgtctgatacagttca

SEQ ID NO: 269220 - DNA, 20 bp, Artificial Sequence
  Description of Artificial Sequence: Synthetic oligonucleotide
  Target: ATXN1; (+) strand; PAM type: YTN; PAM sequence: CTG
atacagttcactagtaatag

SEQ ID NO: 269221 - DNA, 20 bp, Artificial Sequence
  Description of Artificial Sequence: Synthetic oligonucleotide
  Target: ATXN1; (+) strand; PAM type: YTN; PAM sequence: TTC
actagtaatagttccttcca

SEQ ID NO: 269222 - DNA, 20 bp, Artificial Sequence
  Description of Artificial Sequence: Synthetic oligonucleotide
  Target: ATXN1; (+) strand; PAM type: YTN; PAM sequence: CTA
gtaatagttccttccatttt

SEQ ID NO: 269223 - DNA, 20 bp, Artificial Sequence
  Description of Artificial Sequence: Synthetic oligonucleotide
  Target: ATXN1; (+) strand; PAM type: YTN; PAM sequence: TTC
cttccattttcttttccttt

SEQ ID NO: 269224 - DNA, 20 bp, Artificial Sequence
  Description of Artificial Sequence: Synthetic oligonucleotide
  Target: ATXN1; (+) strand; PAM type: YTN; PAM sequence: CTT
ccattttcttttccttttat

SEQ ID NO: 269225 - DNA, 20 bp, Artificial Sequence
  Description of Artificial Sequence: Synthetic oligonucleotide
  Target: ATXN1; (+) strand; PAM type: YTN; PAM sequence: TTC
cattttcttttccttttatt

SEQ ID NO: 269226 - DNA, 20 bp, Artificial Sequence
  Description of Artificial Sequence: Synthetic oligonucleotide
  Target: ATXN1; (+) strand; PAM type: YTN; PAM sequence: TTT
tcttttccttttatttagta

SEQ ID NO: 269227 - DNA, 20 bp, Artificial Sequence
  Description of Artificial Sequence: Synthetic oligonucleotide
  Target: ATXN1; (+) strand; PAM type: YTN; PAM sequence: TTT
cttttccttttatttagtag

SEQ ID NO: 269228 - DNA, 20 bp, Artificial Sequence
  Description of Artificial Sequence: Synthetic oligonucleotide
  Target: ATXN1; (+) strand; PAM type: YTN; PAM sequence: TTC
ttttccttttatttagtaga

SEQ ID NO: 269229 - DNA, 20 bp, Artificial Sequence
  Description of Artificial Sequence: Synthetic oligonucleotide
  Target: ATXN1; (+) strand; PAM type: YTN; PAM sequence: CTT
ttccttttatttagtagact

SEQ ID NO: 269230 - DNA, 20 bp, Artificial Sequence
  Description of Artificial Sequence: Synthetic oligonucleotide
  Target: ATXN1; (+) strand; PAM type: YTN; PAM sequence: TTT
tccttttatttagtagacta

SEQ ID NO: 269231 - DNA, 20 bp, Artificial Sequence
  Description of Artificial Sequence: Synthetic oligonucleotide
  Target: ATXN1; (+) strand; PAM type: YTN; PAM sequence: TTT
ccttttatttagtagactag

SEQ ID NO: 269232 - DNA, 20 bp, Artificial Sequence
  Description of Artificial Sequence: Synthetic oligonucleotide
  Target: ATXN1; (+) strand; PAM type: YTN; PAM sequence: TTC
cttttatttagtagactagc

SEQ ID NO: 269233 - DNA, 20 bp, Artificial Sequence
  Description of Artificial Sequence: Synthetic oligonucleotide
  Target: ATXN1; (+) strand; PAM type: YTN; PAM sequence: CTT
ttatttagtagactagcatt

SEQ ID NO: 269234 - DNA, 20 bp, Artificial Sequence
  Description of Artificial Sequence: Synthetic oligonucleotide
  Target: ATXN1; (+) strand; PAM type: YTN; PAM sequence: TTT
tatttagtagactagcattt

SEQ ID NO: 269235 - DNA, 20 bp, Artificial Sequence
  Description of Artificial Sequence: Synthetic oligonucleotide
  Target: ATXN1; (+) strand; PAM type: YTN; PAM sequence: TTT
atttagtagactagcatttt

SEQ ID NO: 269236 - DNA, 20 bp, Artificial Sequence
  Description of Artificial Sequence: Synthetic oligonucleotide
  Target: ATXN1; (+) strand; PAM type: YTN; PAM sequence: TTA
tttagtagactagcattttt

SEQ ID NO: 269237 - DNA, 20 bp, Artificial Sequence
  Description of Artificial Sequence: Synthetic oligonucleotide
  Target: ATXN1; (+) strand; PAM type: YTN; PAM sequence: TTT
agtagactagcatttttgcc

SEQ ID NO: 269238 - DNA, 20 bp, Artificial Sequence
  Description of Artificial Sequence: Synthetic oligonucleotide
  Target: ATXN1; (+) strand; PAM type: YTN; PAM sequence: TTA
gtagactagcatttttgcct

SEQ ID NO: 269239 - DNA, 20 bp, Artificial Sequence
  Description of Artificial Sequence: Synthetic oligonucleotide
  Target: ATXN1; (+) strand; PAM type: YTN; PAM sequence: CTA
gcatttttgcctgaacagca

SEQ ID NO: 269240 - DNA, 20 bp, Artificial Sequence
  Description of Artificial Sequence: Synthetic oligonucleotide
  Target: ATXN1; (+) strand; PAM type: YTN; PAM sequence: TTT
ttgcctgaacagcatctttt

SEQ ID NO: 269241 - DNA, 20 bp, Artificial Sequence
  Description of Artificial Sequence: Synthetic oligonucleotide
  Target: ATXN1; (+) strand; PAM type: YTN; PAM sequence: TTT
tgcctgaacagcatcttttc

SEQ ID NO: 269242 - DNA, 20 bp, Artificial Sequence
  Description of Artificial Sequence: Synthetic oligonucleotide
  Target: ATXN1; (+) strand; PAM type: YTN; PAM sequence: TTT
gcctgaacagcatcttttct

SEQ ID NO: 269243 - DNA, 20 bp, Artificial Sequence
  Description of Artificial Sequence: Synthetic oligonucleotide
  Target: ATXN1; (+) strand; PAM type: YTN; PAM sequence: TTG
cctgaacagcatcttttctg

SEQ ID NO: 269244 - DNA, 20 bp, Artificial Sequence
  Description of Artificial Sequence: Synthetic oligonucleotide
  Target: ATXN1; (+) strand; PAM type: YTN; PAM sequence: CTG
aacagcatcttttctggaat

SEQ ID NO: 269245 - DNA, 20 bp, Artificial Sequence
  Description of Artificial Sequence: Synthetic oligonucleotide
  Target: ATXN1; (+) strand; PAM type: YTN; PAM sequence: CTT
ttctggaatgatctctcccc

SEQ ID NO: 269246 - DNA, 20 bp, Artificial Sequence
  Description of Artificial Sequence: Synthetic oligonucleotide
  Target: ATXN1; (+) strand; PAM type: YTN; PAM sequence: TTT
tctggaatgatctctcccct

SEQ ID NO: 269247 - DNA, 20 bp, Artificial Sequence
  Description of Artificial Sequence: Synthetic oligonucleotide
  Target: ATXN1; (+) strand; PAM type: YTN; PAM sequence: TTT
ctggaatgatctctcccctt

SEQ ID NO: 269248 - DNA, 20 bp, Artificial Sequence
  Description of Artificial Sequence: Synthetic oligonucleotide
  Target: ATXN1; (+) strand; PAM type: YTN; PAM sequence: TTC
tggaatgatctctccccttg

SEQ ID NO: 269249 - DNA, 20 bp, Artificial Sequence
  Description of Artificial Sequence: Synthetic oligonucleotide
  Target: ATXN1; (+) strand; PAM type: YTN; PAM sequence: CTG
gaatgatctctccccttggc

SEQ ID NO: 269250 - DNA, 20 bp, Artificial Sequence
  Description of Artificial Sequence: Synthetic oligonucleotide
  Target: ATXN1; (+) strand; PAM type: YTN; PAM sequence: CTC
tccccttggctgttatctgg

SEQ ID NO: 269251 - DNA, 20 bp, Artificial Sequence
  Description of Artificial Sequence: Synthetic oligonucleotide
  Target: ATXN1; (+) strand; PAM type: YTN; PAM sequence: CTC
cccttggctgttatctgggc

SEQ ID NO: 269252 - DNA, 20 bp, Artificial Sequence
  Description of Artificial Sequence: Synthetic oligonucleotide
  Target: ATXN1; (+) strand; PAM type: YTN; PAM sequence: CTT
ggctgttatctgggctggga

SEQ ID NO: 269253 - DNA, 20 bp, Artificial Sequence
  Description of Artificial Sequence: Synthetic oligonucleotide
  Target: ATXN1; (+) strand; PAM type: YTN; PAM sequence: TTG
gctgttatctgggctgggat

SEQ ID NO: 269254 - DNA, 20 bp, Artificial Sequence
  Description of Artificial Sequence: Synthetic oligonucleotide
  Target: ATXN1; (+) strand; PAM type: YTN; PAM sequence: CTG
ttatctgggctgggatgact

SEQ ID NO: 269255 - DNA, 20 bp, Artificial Sequence
  Description of Artificial Sequence: Synthetic oligonucleotide
  Target: ATXN1; (+) strand; PAM type: YTN; PAM sequence: TTA
tctgggctgggatgacttca

SEQ ID NO: 269256 - DNA, 20 bp, Artificial Sequence
  Description of Artificial Sequence: Synthetic oligonucleotide
  Target: ATXN1; (+) strand; PAM type: YTN; PAM sequence: CTG
ggctgggatgacttcacaca

SEQ ID NO: 269257 - DNA, 20 bp, Artificial Sequence
  Description of Artificial Sequence: Synthetic oligonucleotide
  Target: ATXN1; (+) strand; PAM type: YTN; PAM sequence: CTG
ggatgacttcacacattggc

SEQ ID NO: 269258 - DNA, 20 bp, Artificial Sequence
  Description of Artificial Sequence: Synthetic oligonucleotide
  Target: ATXN1; (+) strand; PAM type: YTN; PAM sequence: CTT
cacacattggcctggaagat

SEQ ID NO: 269259 - DNA, 20 bp, Artificial Sequence
  Description of Artificial Sequence: Synthetic oligonucleotide
  Target: ATXN1; (+) strand; PAM type: YTN; PAM sequence: TTC
acacattggcctggaagatg

SEQ ID NO: 269260 - DNA, 20 bp, Artificial Sequence
  Description of Artificial Sequence: Synthetic oligonucleotide
  Target: ATXN1; (+) strand; PAM type: YTN; PAM sequence: TTG
gcctggaagatggacatatg

SEQ ID NO: 269261 - DNA, 20 bp, Artificial Sequence
  Description of Artificial Sequence: Synthetic oligonucleotide
  Target: ATXN1; (+) strand; PAM type: YTN; PAM sequence: CTG
gaagatggacatatgaccca

SEQ ID NO: 269262 - DNA, 20 bp, Artificial Sequence
  Description of Artificial Sequence: Synthetic oligonucleotide
  Target: ATXN1; (+) strand; PAM type: YTN; PAM sequence: CTG
ggcaatcgtaatacaacaac

SEQ ID NO: 269263 - DNA, 20 bp, Artificial Sequence
  Description of Artificial Sequence: Synthetic oligonucleotide
  Target: ATXN1; (+) strand; PAM type: YTN; PAM sequence: CTC
cagccacagtgactggccta

SEQ ID NO: 269264 - DNA, 20 bp, Artificial Sequence
  Description of Artificial Sequence: Synthetic oligonucleotide
  Target: ATXN1; (+) strand; PAM type: YTN; PAM sequence: CTG
gcctaggggtaggcatgtac

SEQ ID NO: 269265 - DNA, 20 bp, Artificial Sequence
  Description of Artificial Sequence: Synthetic oligonucleotide
  Target: ATXN1; (+) strand; PAM type: YTN; PAM sequence: CTA
ggggtaggcatgtacccaag

SEQ ID NO: 269266 - DNA, 20 bp, Artificial Sequence
  Description of Artificial Sequence: Synthetic oligonucleotide
  Target: ATXN1; (+) strand; PAM type: YTN; PAM sequence: CTC
tctcagactacctggaacta

SEQ ID NO: 269267 - DNA, 20 bp, Artificial Sequence
  Description of Artificial Sequence: Synthetic oligonucleotide
  Target: ATXN1; (+) strand; PAM type: YTN; PAM sequence: CTC
tcagactacctggaactaag

SEQ ID NO: 269268 - DNA, 20 bp, Artificial Sequence
  Description of Artificial Sequence: Synthetic oligonucleotide
  Target: ATXN1; (+) strand; PAM type: YTN; PAM sequence: CTC
agactacctggaactaagag

SEQ ID NO: 269269 - DNA, 20 bp, Artificial Sequence
  Description of Artificial Sequence: Synthetic oligonucleotide
  Target: ATXN1; (+) strand; PAM type: YTN; PAM sequence: CTA
cctggaactaagaggagcaa

SEQ ID NO: 269270 - DNA, 20 bp, Artificial Sequence
  Description of Artificial Sequence: Synthetic oligonucleotide
  Target: ATXN1; (+) strand; PAM type: YTN; PAM sequence: CTG
gaactaagaggagcaacaca

SEQ ID NO: 269271 - DNA, 20 bp, Artificial Sequence
  Description of Artificial Sequence: Synthetic oligonucleotide
  Target: ATXN1; (+) strand; PAM type: YTN; PAM sequence: CTA
agaggagcaacacactcttt

SEQ ID NO: 269272 - DNA, 20 bp, Artificial Sequence
  Description of Artificial Sequence: Synthetic oligonucleotide
  Target: ATXN1; (+) strand; PAM type: YTN; PAM sequence: CTC
tttcctagtgagaccacggg

SEQ ID NO: 269273 - DNA, 20 bp, Artificial Sequence
  Description of Artificial Sequence: Synthetic oligonucleotide
  Target: ATXN1; (+) strand; PAM type: YTN; PAM sequence: CTT
tcctagtgagaccacgggag

SEQ ID NO: 269274 - DNA, 20 bp, Artificial Sequence
  Description of Artificial Sequence: Synthetic oligonucleotide
  Target: ATXN1; (+) strand; PAM type: YTN; PAM sequence: TTT
cctagtgagaccacgggagc

SEQ ID NO: 269275 - DNA, 20 bp, Artificial Sequence
  Description of Artificial Sequence: Synthetic oligonucleotide
  Target: ATXN1; (+) strand; PAM type: YTN; PAM sequence: TTC
ctagtgagaccacgggagca

SEQ ID NO: 269276 - DNA, 20 bp, Artificial Sequence
  Description of Artificial Sequence: Synthetic oligonucleotide
  Target: ATXN1; (+) strand; PAM type: YTN; PAM sequence: CTA
gtgagaccacgggagcatga

SEQ ID NO: 269277 - DNA, 20 bp, Artificial Sequence
  Description of Artificial Sequence: Synthetic oligonucleotide
  Target: ATXN1; (+) strand; PAM type: YTN; PAM sequence: CTA
ctaacagctggtttctttag

SEQ ID NO: 269278 - DNA, 20 bp, Artificial Sequence
  Description of Artificial Sequence: Synthetic oligonucleotide
  Target: ATXN1; (+) strand; PAM type: YTN; PAM sequence: CTA
acagctggtttctttagcca

SEQ ID NO: 269279 - DNA, 20 bp, Artificial Sequence
  Description of Artificial Sequence: Synthetic oligonucleotide
  Target: ATXN1; (+) strand; PAM type: YTN; PAM sequence: CTG
gtttctttagccacctctta

SEQ ID NO: 269280 - DNA, 20 bp, Artificial Sequence
  Description of Artificial Sequence: Synthetic oligonucleotide
  Target: ATXN1; (+) strand; PAM type: YTN; PAM sequence: TTT
ctttagccacctcttacaga

SEQ ID NO: 269281 - DNA, 20 bp, Artificial Sequence
  Description of Artificial Sequence: Synthetic oligonucleotide
  Target: ATXN1; (+) strand; PAM type: YTN; PAM sequence: TTC
tttagccacctcttacagaa

SEQ ID NO: 269282 - DNA, 20 bp, Artificial Sequence
  Description of Artificial Sequence: Synthetic oligonucleotide
  Target: ATXN1; (+) strand; PAM type: YTN; PAM sequence: CTT
tagccacctcttacagaaag

SEQ ID NO: 269283 - DNA, 20 bp, Artificial Sequence
  Description of Artificial Sequence: Synthetic oligonucleotide
  Target: ATXN1; (+) strand; PAM type: YTN; PAM sequence: TTT
agccacctcttacagaaagc

SEQ ID NO: 269284 - DNA, 20 bp, Artificial Sequence
  Description of Artificial Sequence: Synthetic oligonucleotide
  Target: ATXN1; (+) strand; PAM type: YTN; PAM sequence: TTA
gccacctcttacagaaagcc

SEQ ID NO: 269285 - DNA, 20 bp, Artificial Sequence
  Description of Artificial Sequence: Synthetic oligonucleotide
  Target: ATXN1; (+) strand; PAM type: YTN; PAM sequence: CTC
ttacagaaagcccactggag

SEQ ID NO: 269286 - DNA, 20 bp, Artificial Sequence
  Description of Artificial Sequence: Synthetic oligonucleotide
  Target: ATXN1; (+) strand; PAM type: YTN; PAM sequence: CTT
acagaaagcccactggagaa

SEQ ID NO: 269287 - DNA, 20 bp, Artificial Sequence
  Description of Artificial Sequence: Synthetic oligonucleotide
  Target: ATXN1; (+) strand; PAM type: YTN; PAM sequence: TTA
cagaaagcccactggagaag

SEQ ID NO: 269288 - DNA, 20 bp, Artificial Sequence
  Description of Artificial Sequence: Synthetic oligonucleotide
  Target: ATXN1; (+) strand; PAM type: YTN; PAM sequence: CTG
gagaaggaagcttcccagta

SEQ ID NO: 269289 - DNA, 20 bp, Artificial Sequence
  Description of Artificial Sequence: Synthetic oligonucleotide
  Target: ATXN1; (+) strand; PAM type: YTN; PAM sequence: CTT
cccagtacagagaaaagctg

SEQ ID NO: 269290 - DNA, 20 bp, Artificial Sequence
  Description of Artificial Sequence: Synthetic oligonucleotide
  Target: ATXN1; (+) strand; PAM type: YTN; PAM sequence: TTC
ccagtacagagaaaagctga

SEQ ID NO: 269291 - DNA, 20 bp, Artificial Sequence
  Description of Artificial Sequence: Synthetic oligonucleotide
  Target: ATXN1; (+) strand; PAM type: YTN; PAM sequence: CTG
aaagacagaaaatctgagtc

SEQ ID NO: 269292 - DNA, 20 bp, Artificial Sequence
  Description of Artificial Sequence: Synthetic oligonucleotide
  Target: ATXN1; (+) strand; PAM type: YTN; PAM sequence: CTG
agtcctgatgacagtaaagt

SEQ ID NO: 269293 - DNA, 20 bp, Artificial Sequence
  Description of Artificial Sequence: Synthetic oligonucleotide
  Target: ATXN1; (+) strand; PAM type: YTN; PAM sequence: CTG
atgacagtaaagtcccttgg

SEQ ID NO: 269294 - DNA, 20 bp, Artificial Sequence
  Description of Artificial Sequence: Synthetic oligonucleotide
  Target: ATXN1; (+) strand; PAM type: YTN; PAM sequence: CTT
ggatttagccatgccagaag

SEQ ID NO: 269295 - DNA, 20 bp, Artificial Sequence
  Description of Artificial Sequence: Synthetic oligonucleotide
  Target: ATXN1; (+) strand; PAM type: YTN; PAM sequence: TTG
gatttagccatgccagaagt

SEQ ID NO: 269296 - DNA, 20 bp, Artificial Sequence
  Description of Artificial Sequence: Synthetic oligonucleotide
  Target: ATXN1; (+) strand; PAM type: YTN; PAM sequence: TTT
agccatgccagaagttagac

SEQ ID NO: 269297 - DNA, 20 bp, Artificial Sequence
  Description of Artificial Sequence: Synthetic oligonucleotide
  Target: ATXN1; (+) strand; PAM type: YTN; PAM sequence: TTA
gccatgccagaagttagacg

SEQ ID NO: 269298 - DNA, 20 bp, Artificial Sequence
  Description of Artificial Sequence: Synthetic oligonucleotide
  Target: ATXN1; (+) strand; PAM type: YTN; PAM sequence: TTA
gacggatccctggatttttt

SEQ ID NO: 269299 - DNA, 20 bp, Artificial Sequence
  Description of Artificial Sequence: Synthetic oligonucleotide
  Target: ATXN1; (+) strand; PAM type: YTN; PAM sequence: CTG
gatttttttttttttttttt

SEQ ID NO: 269300 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 269301 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 269302 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 269303 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 269304 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 269305 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 269306 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 269307 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 269308 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagacg

SEQ ID NO: 269309 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacga

SEQ ID NO: 269310 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacgaa

SEQ ID NO: 269311 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacgaag

SEQ ID NO: 269312 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacgaagt

SEQ ID NO: 269313 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacgaagtc

SEQ ID NO: 269314 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacgaagtct

SEQ ID NO: 269315 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacgaagtctt

SEQ ID NO: 269316 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacgaagtcttg

SEQ ID NO: 269317 - DNA, 20 bp, Artificial Sequence
  Description of Artificial Sequence: Synthetic oligonucleotide
  Target: ATXN1; (+) strand; PAM type: YTN; PAM sequence: TTT
tttttgagacgaagtcttgc

SEQ ID NO: 269318 - DNA, 20 bp, Artificial Sequence
  Description of Artificial Sequence: Synthetic oligonucleotide
  Target: ATXN1; (+) strand; PAM type: YTN; PAM sequence: TTT
ttttgagacgaagtcttgct

SEQ ID NO: 269319 - DNA, 20 bp, Artificial Sequence
  Description of Artificial Sequence: Synthetic oligonucleotide
  Target: ATXN1; (+) strand; PAM type: YTN; PAM sequence: TTT
tttgagacgaagtcttgctc

SEQ ID NO: 269320 - DNA, 20 bp, Artificial Sequence
  Description of Artificial Sequence: Synthetic oligonucleotide
  Target: ATXN1; (+) strand; PAM type: YTN; PAM sequence: TTT
ttgagacgaagtcttgctcc

SEQ ID NO: 269321 - DNA, 20 bp, Artificial Sequence
  Description of Artificial Sequence: Synthetic oligonucleotide
  Target: ATXN1; (+) strand; PAM type: YTN; PAM sequence: TTT
tgagacgaagtcttgctcca

SEQ ID NO: 269322 - DNA, 20 bp, Artificial Sequence
  Description of Artificial Sequence: Synthetic oligonucleotide
  Target: ATXN1; (+) strand; PAM type: YTN; PAM sequence: TTT
gagacgaagtcttgctccat

SEQ ID NO: 269323 - DNA, 20 bp, Artificial Sequence
  Description of Artificial Sequence: Synthetic oligonucleotide
  Target: ATXN1; (+) strand; PAM type: YTN; PAM sequence: TTG
agacgaagtcttgctccatc

SEQ ID NO: 269324 - DNA, 20 bp, Artificial Sequence
  Description of Artificial Sequence: Synthetic oligonucleotide
  Target: ATXN1; (+) strand; PAM type: YTN; PAM sequence: CTT
gctccatcacccagacagag

SEQ ID NO: 269325 - DNA, 20 bp, Artificial Sequence
  Description of Artificial Sequence: Synthetic oligonucleotide
  Target: ATXN1; (+) strand; PAM type: YTN; PAM sequence: TTG
ctccatcacccagacagagc

SEQ ID NO: 269326 - DNA, 20 bp, Artificial Sequence
  Description of Artificial Sequence: Synthetic oligonucleotide
  Target: ATXN1; (+) strand; PAM type: YTN; PAM sequence: CTC
catcacccagacagagcagt

SEQ ID NO: 269327 - DNA, 20 bp, Artificial Sequence
  Description of Artificial Sequence: Synthetic oligonucleotide
  Target: ATXN1; (+) strand; PAM type: YTN; PAM sequence: CTC
actcactgcaacctctgact

SEQ ID NO: 269328 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgactccga

SEQ ID NO: 269329 - DNA, 20 bp, Artificial Sequence
  Description of Artificial Sequence: Synthetic oligonucleotide
  Target: ATXN1; (+) strand; PAM type: YTN; PAM sequence: CTG
caacctctgactccgagttc

SEQ ID NO: 269330 - DNA, 20 bp, Artificial Sequence
  Description of Artificial Sequence: Synthetic oligonucleotide
  Target: ATXN1; (+) strand; PAM type: YTN; PAM sequence: CTC
tgactccgagttcaagcaat

SEQ ID NO: 269331 - DNA, 20 bp, Artificial Sequence
  Description of Artificial Sequence: Synthetic oligonucleotide
  Target: ATXN1; (+) strand; PAM type: YTN; PAM sequence: CTG
actccgagttcaagcaatac

SEQ ID NO: 269332 - DNA, 20 bp, Artificial Sequence
  Description of Artificial Sequence: Synthetic oligonucleotide
  Target: ATXN1; (+) strand; PAM type: YTN; PAM sequence: CTC
cgagttcaagcaatactcct

SEQ ID NO: 269333 - DNA, 20 bp, Artificial Sequence
  Description of Artificial Sequence: Synthetic oligonucleotide
  Target: ATXN1; (+) strand; PAM type: YTN; PAM sequence: TTC
aagcaatactcctgactcag

SEQ ID NO: 269334 - DNA, 20 bp, Artificial Sequence
  Description of Artificial Sequence: Synthetic oligonucleotide
  Target: ATXN1; (+) strand; PAM type: YTN; PAM sequence: CTC
ctgactcagcctcccgagta

SEQ ID NO: 269335 - DNA, 20 bp, Artificial Sequence
  Description of Artificial Sequence: Synthetic oligonucleotide
  Target: ATXN1; (+) strand; PAM type: YTN; PAM sequence: CTG
actcagcctcccgagtagct

SEQ ID NO: 269336 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtagctggga

SEQ ID NO: 269337 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctgggattatag

SEQ ID NO: 269338 - DNA, 20 bp, Artificial Sequence
  Description of Artificial Sequence: Synthetic oligonucleotide
  Target: ATXN1; (+) strand; PAM type: YTN; PAM sequence: CTG
ggattataggcatatgccac

SEQ ID NO: 269339 - DNA, 20 bp, Artificial Sequence
  Description of Artificial Sequence: Synthetic oligonucleotide
  Target: ATXN1; (+) strand; PAM type: YTN; PAM sequence: TTA
taggcatatgccaccacacc

SEQ ID NO: 269340 - DNA, 20 bp, Artificial Sequence
  Description of Artificial Sequence: Synthetic oligonucleotide
  Target: ATXN1; (+) strand; PAM type: YTN; PAM sequence: CTG
gctaattattattattatta

SEQ ID NO: 269341 - DNA, 20 bp, Artificial Sequence
  Description of Artificial Sequence: Synthetic oligonucleotide
  Target: ATXN1; (+) strand; PAM type: YTN; PAM sequence: CTA
attattattattattattat

SEQ ID NO: 269342 - DNA, 20 bp, Artificial Sequence
  Description of Artificial Sequence: Synthetic oligonucleotide
  Target: ATXN1; (+) strand; PAM type: YTN; PAM sequence: TTA
ttattattattattattttt

SEQ ID NO: 269343 - DNA, 20 bp, Artificial Sequence
  Description of Artificial Sequence: Synthetic oligonucleotide
  Target: ATXN1; (+) strand; PAM type: YTN; PAM sequence: TTA
ttattattattatttttttt

SEQ ID NO: 269344 - DNA, 20 bp, Artificial Sequence
  Description of Artificial Sequence: Synthetic oligonucleotide
  Target: ATXN1; (+) strand; PAM type: YTN; PAM sequence: TTA
ttattattattttttttttt

SEQ ID NO: 269345 - DNA, 20 bp, Artificial Sequence
  Description of Artificial Sequence: Synthetic oligonucleotide
  Target: ATXN1; (+) strand; PAM type: YTN; PAM sequence: TTA
ttattatttttttttttttt

SEQ ID NO: 269346 - DNA, 20 bp, Artificial Sequence
  Description of Artificial Sequence: Synthetic oligonucleotide
  Target: ATXN1; (+) strand; PAM type: YTN; PAM sequence: TTA
ttattttttttttttttttt

SEQ ID NO: 269347 - DNA, 20 bp, Artificial Sequence
  Description of Artificial Sequence: Synthetic oligonucleotide
  Target: ATXN1; (+) strand; PAM type: YTN; PAM sequence: TTA
tttttttttttttttttttt

SEQ ID NO: 269348 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 269349 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 269350 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 269351 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 269352 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgat

SEQ ID NO: 269353 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgata

SEQ ID NO: 269354 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgatac

SEQ ID NO: 269355 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgataca

SEQ ID NO: 269356 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgatacaa

SEQ ID NO: 269357 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgatacaag

SEQ ID NO: 269358 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgatacaagg

SEQ ID NO: 269359 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgatacaaggt

SEQ ID NO: 269360 - DNA, 20 bp, Artificial Sequence
  Description of Artificial Sequence: Synthetic oligonucleotide
  Target: ATXN1; (+) strand; PAM type: YTN; PAM sequence: TTT
tttttttttgatacaaggtt

SEQ ID NO: 269361 - DNA, 20 bp, Artificial Sequence
  Description of Artificial Sequence: Synthetic oligonucleotide
  Target: ATXN1; (+) strand; PAM type: YTN; PAM sequence: TTT
ttttttttgatacaaggttt

SEQ ID NO: 269362 - DNA, 20 bp, Artificial Sequence
  Description of Artificial Sequence: Synthetic oligonucleotide
  Target: ATXN1; (+) strand; PAM type: YTN; PAM sequence: TTT
tttttttgatacaaggtttc

SEQ ID NO: 269363 - DNA, 20 bp, Artificial Sequence
  Description of Artificial Sequence: Synthetic oligonucleotide
  Target: ATXN1; (+) strand; PAM type: YTN; PAM sequence: TTT
ttttttgatacaaggtttcg

SEQ ID NO: 269364 - DNA, 20 bp, Artificial Sequence
  Description of Artificial Sequence: Synthetic oligonucleotide
  Target: ATXN1; (+) strand; PAM type: YTN; PAM sequence: TTT
tttttgatacaaggtttcgc

SEQ ID NO: 269365 - DNA, 20 bp, Artificial Sequence
  Description of Artificial Sequence: Synthetic oligonucleotide
  Target: ATXN1; (+) strand; PAM type: YTN; PAM sequence: TTT
ttttgatacaaggtttcgct

SEQ ID NO: 269366 - DNA, 20 bp, Artificial Sequence
  Description of Artificial Sequence: Synthetic oligonucleotide
  Target: ATXN1; (+) strand; PAM type: YTN; PAM sequence: TTT
tttgatacaaggtttcgctc

SEQ ID NO: 269367 - DNA, 20 bp, Artificial Sequence
  Description of Artificial Sequence: Synthetic oligonucleotide
  Target: ATXN1; (+) strand; PAM type: YTN; PAM sequence: TTT
ttgatacaaggtttcgctct

SEQ ID NO: 269368 - DNA, 20 bp, Artificial Sequence
  Description of Artificial Sequence: Synthetic oligonucleotide
  Target: ATXN1; (+) strand; PAM type: YTN; PAM sequence: TTT
tgatacaaggtttcgctctt

SEQ ID NO: 269369 - DNA, 20 bp, Artificial Sequence
  Description of Artificial Sequence: Synthetic oligonucleotide
  Target: ATXN1; (+) strand; PAM type: YTN; PAM sequence: TTT
gatacaaggtttcgctcttg

SEQ ID NO: 269370 - DNA, 20 bp, Artificial Sequence
  Description of Artificial Sequence: Synthetic oligonucleotide
  Target: ATXN1; (+) strand; PAM type: YTN; PAM sequence: TTG
atacaaggtttcgctcttgt

SEQ ID NO: 269371 - DNA, 20 bp, Artificial Sequence
  Description of Artificial Sequence: Synthetic oligonucleotide
  Target: ATXN1; (+) strand; PAM type: YTN; PAM sequence: TTT
cgctcttgttgcccaggctg

SEQ ID NO: 269372 - DNA, 20 bp, Artificial Sequence
  Description of Artificial Sequence: Synthetic oligonucleotide
  Target: ATXN1; (+) strand; PAM type: YTN; PAM sequence: TTC
gctcttgttgcccaggctgg

SEQ ID NO: 269373 - DNA, 20 bp, Artificial Sequence
  Description of Artificial Sequence: Synthetic oligonucleotide
  Target: ATXN1; (+) strand; PAM type: YTN; PAM sequence: CTC
ttgttgcccaggctggagtg

SEQ ID NO: 269374 - DNA, 20 bp, Artificial Sequence
  Description of Artificial Sequence: Synthetic oligonucleotide
  Target: ATXN1; (+) strand; PAM type: YTN; PAM sequence: CTT
gttgcccaggctggagtgca

SEQ ID NO: 269375 - DNA, 20 bp, Artificial Sequence
  Description of Artificial Sequence: Synthetic oligonucleotide
  Target: ATXN1; (+) strand; PAM type: YTN; PAM sequence: TTG
ttgcccaggctggagtgcaa

SEQ ID NO: 269376 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtgcaatgg

SEQ ID NO: 269377 - DNA, 20 bp, Artificial Sequence
  Description of Artificial Sequence: Synthetic oligonucleotide
  Target: ATXN1; (+) strand; PAM type: YTN; PAM sequence: CTG
gagtgcaatggcgcaatctc

SEQ ID NO: 269378 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctctgcc

SEQ ID NO: 269379 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctccca

SEQ ID NO: 269380 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccaggtt

SEQ ID NO: 269381 - DNA, 20 bp, Artificial Sequence
  Description of Artificial Sequence: Synthetic oligonucleotide
  Target: ATXN1; (+) strand; PAM type: YTN; PAM sequence: CTC
tgcctcccaggttcaagcaa

SEQ ID NO: 269382 - DNA, 20 bp, Artificial Sequence
  Description of Artificial Sequence: Synthetic oligonucleotide
  Target: ATXN1; (+) strand; PAM type: YTN; PAM sequence: CTG
cctcccaggttcaagcaatt

SEQ ID NO: 269383 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcaattctcc

SEQ ID NO: 269384 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgtctcag

SEQ ID NO: 269385 - DNA, 20 bp, Artificial Sequence
  Description of Artificial Sequence: Synthetic oligonucleotide
  Target: ATXN1; (+) strand; PAM type: YTN; PAM sequence: TTC
tcctgtctcagcctcctgag

SEQ ID NO: 269386 - DNA, 20 bp, Artificial Sequence
  Description of Artificial Sequence: Synthetic oligonucleotide
  Target: ATXN1; (+) strand; PAM type: YTN; PAM sequence: CTC
ctgtctcagcctcctgagta

SEQ ID NO: 269387 - DNA, 20 bp, Artificial Sequence
  Description of Artificial Sequence: Synthetic oligonucleotide
  Target: ATXN1; (+) strand; PAM type: YTN; PAM sequence: CTG
tctcagcctcctgagtagct

SEQ ID NO: 269388 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 269389 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggactgcag

SEQ ID NO: 269390 - DNA, 20 bp, Artificial Sequence
  Description of Artificial Sequence: Synthetic oligonucleotide
  Target: ATXN1; (+) strand; PAM type: YTN; PAM sequence: CTG
agtagctgggactgcaggca

SEQ ID NO: 269391 - DNA, 20 bp, Artificial Sequence
  Description of Artificial Sequence: Synthetic oligonucleotide
  Target: ATXN1; (+) strand; PAM type: YTN; PAM sequence: CTG
ggactgcaggcaccagccac

SEQ ID NO: 269392 - DNA, 20 bp, Artificial Sequence
  Description of Artificial Sequence: Synthetic oligonucleotide
  Target: ATXN1; (+) strand; PAM type: YTN; PAM sequence: CTG
caggcaccagccactacgcc

SEQ ID NO: 269393 - DNA, 20 bp, Artificial Sequence
  Description of Artificial Sequence: Synthetic oligonucleotide
  Target: ATXN1; (+) strand; PAM type: YTN; PAM sequence: CTA
cgcccggctaatttttggta

SEQ ID NO: 269394 - DNA, 20 bp, Artificial Sequence
  Description of Artificial Sequence: Synthetic oligonucleotide
  Target: ATXN1; (+) strand; PAM type: YTN; PAM sequence: CTA
atttttggtatttttagtag

SEQ ID NO: 269395 - DNA, 20 bp, Artificial Sequence
  Description of Artificial Sequence: Synthetic oligonucleotide
  Target: ATXN1; (+) strand; PAM type: YTN; PAM sequence: TTT
ttggtatttttagtagagac

SEQ ID NO: 269396 - DNA, 20 bp, Artificial Sequence
  Description of Artificial Sequence: Synthetic oligonucleotide
  Target: ATXN1; (+) strand; PAM type: YTN; PAM sequence: TTT
tggtatttttagtagagaca

SEQ ID NO: 269397 - DNA, 20 bp, Artificial Sequence
  Description of Artificial Sequence: Synthetic oligonucleotide
  Target: ATXN1; (+) strand; PAM type: YTN; PAM sequence: TTT
ggtatttttagtagagacag

SEQ ID NO: 269398 - DNA, 20 bp, Artificial Sequence
  Description of Artificial Sequence: Synthetic oligonucleotide
  Target: ATXN1; (+) strand; PAM type: YTN; PAM sequence: TTG
gtatttttagtagagacagg

SEQ ID NO: 269399 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacagggtttca

SEQ ID NO: 269400 - DNA, 20 bp, Artificial Sequence
  Description of Artificial Sequence: Synthetic oligonucleotide
  Target: ATXN1; (+) strand; PAM type: YTN; PAM sequence: TTT
tagtagagacagggtttcac

SEQ ID NO: 269401 - DNA, 20 bp, Artificial Sequence
  Description of Artificial Sequence: Synthetic oligonucleotide
  Target: ATXN1; (+) strand; PAM type: YTN; PAM sequence: TTT
agtagagacagggtttcacc

SEQ ID NO: 269402 - DNA, 20 bp, Artificial Sequence
  Description of Artificial Sequence: Synthetic oligonucleotide
  Target: ATXN1; (+) strand; PAM type: YTN; PAM sequence: TTA
gtagagacagggtttcacca

SEQ ID NO: 269403 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccatgttca

SEQ ID NO: 269404 - DNA, 20 bp, Artificial Sequence
  Description of Artificial Sequence: Synthetic oligonucleotide
  Target: ATXN1; (+) strand; PAM type: YTN; PAM sequence: TTC
accatgttggccatgttcaa

SEQ ID NO: 269405 - DNA, 20 bp, Artificial Sequence
  Description of Artificial Sequence: Synthetic oligonucleotide
  Target: ATXN1; (+) strand; PAM type: YTN; PAM sequence: TTG
gccatgttcaagacaggctg

SEQ ID NO: 269406 - DNA, 20 bp, Artificial Sequence
  Description of Artificial Sequence: Synthetic oligonucleotide
  Target: ATXN1; (+) strand; PAM type: YTN; PAM sequence: TTC
aagacaggctggtcttgaac

SEQ ID NO: 269407 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctggcctca

SEQ ID NO: 269408 - DNA, 20 bp, Artificial Sequence
  Description of Artificial Sequence: Synthetic oligonucleotide
  Target: ATXN1; (+) strand; PAM type: YTN; PAM sequence: CTT
gaactcctggcctcaagtga

SEQ ID NO: 269409 - DNA, 20 bp, Artificial Sequence
  Description of Artificial Sequence: Synthetic oligonucleotide
  Target: ATXN1; (+) strand; PAM type: YTN; PAM sequence: TTG
aactcctggcctcaagtgat

SEQ ID NO: 269410 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagtgatccacc

SEQ ID NO: 269411 - DNA, 20 bp, Artificial Sequence
  Description of Artificial Sequence: Synthetic oligonucleotide
  Target: ATXN1; (+) strand; PAM type: YTN; PAM sequence: CTG
gcctcaagtgatccacctgc

SEQ ID NO: 269412 - DNA, 20 bp, Artificial Sequence
  Description of Artificial Sequence: Synthetic oligonucleotide
  Target: ATXN1; (+) strand; PAM type: YTN; PAM sequence: CTC
aagtgatccacctgcctcag

SEQ ID NO: 269413 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaaagtgcc

SEQ ID NO: 269414 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgccggga

SEQ ID NO: 269415 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgccgggattacag

SEQ ID NO: 269416 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccatggcgcc

SEQ ID NO: 269417 - DNA, 20 bp, Artificial Sequence
  Description of Artificial Sequence: Synthetic oligonucleotide
  Target: ATXN1; (+) strand; PAM type: YTN; PAM sequence: CTG
atccctggaatttttagtta

SEQ ID NO: 269418 - DNA, 20 bp, Artificial Sequence
  Description of Artificial Sequence: Synthetic oligonucleotide
  Target: ATXN1; (+) strand; PAM type: YTN; PAM sequence: CTG
gaatttttagttatattatg

SEQ ID NO: 269419 - DNA, 20 bp, Artificial Sequence
  Description of Artificial Sequence: Synthetic oligonucleotide
  Target: ATXN1; (+) strand; PAM type: YTN; PAM sequence: TTT
ttagttatattatgatagac

SEQ ID NO: 269420 - DNA, 20 bp, Artificial Sequence
  Description of Artificial Sequence: Synthetic oligonucleotide
  Target: ATXN1; (+) strand; PAM type: YTN; PAM sequence: TTT
tagttatattatgatagacc

SEQ ID NO: 269421 - DNA, 20 bp, Artificial Sequence
  Description of Artificial Sequence: Synthetic oligonucleotide
  Target: ATXN1; (+) strand; PAM type: YTN; PAM sequence: TTT
agttatattatgatagacca

SEQ ID NO: 269422 - DNA, 20 bp, Artificial Sequence
  Description of Artificial Sequence: Synthetic oligonucleotide
  Target: ATXN1; (+) strand; PAM type: YTN; PAM sequence: TTA
gttatattatgatagaccaa

SEQ ID NO: 269423 - DNA, 20 bp, Artificial Sequence
  Description of Artificial Sequence: Synthetic oligonucleotide
  Target: ATXN1; (+) strand; PAM type: YTN; PAM sequence: TTA
tattatgatagaccaaattc

SEQ ID NO: 269424 - DNA, 20 bp, Artificial Sequence
  Description of Artificial Sequence: Synthetic oligonucleotide
  Target: ATXN1; (+) strand; PAM type: YTN; PAM sequence: TTA
tgatagaccaaattctaacg

SEQ ID NO: 269425 - DNA, 20 bp, Artificial Sequence
  Description of Artificial Sequence: Synthetic oligonucleotide
  Target: ATXN1; (+) strand; PAM type: YTN; PAM sequence: TTC
taacgtagcccacaagattg

SEQ ID NO: 269426 - DNA, 20 bp, Artificial Sequence
  Description of Artificial Sequence: Synthetic oligonucleotide
  Target: ATXN1; (+) strand; PAM type: YTN; PAM sequence: CTA
acgtagcccacaagattgcc

SEQ ID NO: 269427 - DNA, 20 bp, Artificial Sequence
  Description of Artificial Sequence: Synthetic oligonucleotide
  Target: ATXN1; (+) strand; PAM type: YTN; PAM sequence: TTG
ccatgtcccctgccagacac

SEQ ID NO: 269428 - DNA, 20 bp, Artificial Sequence
  Description of Artificial Sequence: Synthetic oligonucleotide
  Target: ATXN1; (+) strand; PAM type: YTN; PAM sequence: CTG
ccagacacacacctcttccc

SEQ ID NO: 269429 - DNA, 20 bp, Artificial Sequence
  Description of Artificial Sequence: Synthetic oligonucleotide
  Target: ATXN1; (+) strand; PAM type: YTN; PAM sequence: CTC
ttcccagttagtcagtggga

SEQ ID NO: 269430 - DNA, 20 bp, Artificial Sequence
  Description of Artificial Sequence: Synthetic oligonucleotide
  Target: ATXN1; (+) strand; PAM type: YTN; PAM sequence: CTT
cccagttagtcagtgggaca

SEQ ID NO: 269431 - DNA, 20 bp, Artificial Sequence
  Description of Artificial Sequence: Synthetic oligonucleotide
  Target: ATXN1; (+) strand; PAM type: YTN; PAM sequence: TTC
ccagttagtcagtgggacag

SEQ ID NO: 269432 - DNA, 20 bp, Artificial Sequence
  Description of Artificial Sequence: Synthetic oligonucleotide
  Target: ATXN1; (+) strand; PAM type: YTN; PAM sequence: TTA
gtcagtgggacagtaatcaa

SEQ ID NO: 269433 - DNA, 20 bp, Artificial Sequence
  Description of Artificial Sequence: Synthetic oligonucleotide
  Target: ATXN1; (+) strand; PAM type: YTN; PAM sequence: TTC
tgctgttgtgaagggatttt

SEQ ID NO: 269434 - DNA, 20 bp, Artificial Sequence
  Description of Artificial Sequence: Synthetic oligonucleotide
  Target: ATXN1; (+) strand; PAM type: YTN; PAM sequence: CTG
ctgttgtgaagggattttgc

SEQ ID NO: 269435 - DNA, 20 bp, Artificial Sequence
  Description of Artificial Sequence: Synthetic oligonucleotide
  Target: ATXN1; (+) strand; PAM type: YTN; PAM sequence: CTG
ttgtgaagggattttgcaaa

SEQ ID NO: 269436 - DNA, 20 bp, Artificial Sequence
  Description of Artificial Sequence: Synthetic oligonucleotide
  Target: ATXN1; (+) strand; PAM type: YTN; PAM sequence: TTG
tgaagggattttgcaaatat

SEQ ID NO: 269437 - DNA, 20 bp, Artificial Sequence
  Description of Artificial Sequence: Synthetic oligonucleotide
  Target: ATXN1; (+) strand; PAM type: YTN; PAM sequence: TTT
tgcaaatataagtgaggtcc

SEQ ID NO: 269438 - DNA, 20 bp, Artificial Sequence
  Description of Artificial Sequence: Synthetic oligonucleotide
  Target: ATXN1; (+) strand; PAM type: YTN; PAM sequence: TTT
gcaaatataagtgaggtcca

SEQ ID NO: 269439 - DNA, 20 bp, Artificial Sequence
  Description of Artificial Sequence: Synthetic oligonucleotide
  Target: ATXN1; (+) strand; PAM type: YTN; PAM sequence: TTG
caaatataagtgaggtccaa

SEQ ID NO: 269440 - DNA, 20 bp, Artificial Sequence
  Description of Artificial Sequence: Synthetic oligonucleotide
  Target: ATXN1; (+) strand; PAM type: YTN; PAM sequence: CTT
aaaatagagagattatcttg

SEQ ID NO: 269441 - DNA, 20 bp, Artificial Sequence
  Description of Artificial Sequence: Synthetic oligonucleotide
  Target: ATXN1; (+) strand; PAM type: YTN; PAM sequence: TTA
aaatagagagattatcttgg

SEQ ID NO: 269442 - DNA, 20 bp, Artificial Sequence
  Description of Artificial Sequence: Synthetic oligonucleotide
  Target: ATXN1; (+) strand; PAM type: YTN; PAM sequence: TTA
tcttggtgagcctgatctaa

SEQ ID NO: 269443 - DNA, 20 bp, Artificial Sequence
  Description of Artificial Sequence: Synthetic oligonucleotide
  Target: ATXN1; (+) strand; PAM type: YTN; PAM sequence: CTT
ggtgagcctgatctaattaa

SEQ ID NO: 269444 - DNA, 20 bp, Artificial Sequence
  Description of Artificial Sequence: Synthetic oligonucleotide
  Target: ATXN1; (+) strand; PAM type: YTN; PAM sequence: TTG
gtgagcctgatctaattaag

SEQ ID NO: 269445 - DNA, 20 bp, Artificial Sequence
  Description of Artificial Sequence: Synthetic oligonucleotide
  Target: ATXN1; (+) strand; PAM type: YTN; PAM sequence: CTG
atctaattaagagaacccta

SEQ ID NO: 269446 - DNA, 20 bp, Artificial Sequence
  Description of Artificial Sequence: Synthetic oligonucleotide
  Target: ATXN1; (+) strand; PAM type: YTN; PAM sequence: CTA
attaagagaaccctaaaagg

SEQ ID NO: 269447 - DNA, 20 bp, Artificial Sequence
  Description of Artificial Sequence: Synthetic oligonucleotide
  Target: ATXN1; (+) strand; PAM type: YTN; PAM sequence: TTA
agagaaccctaaaagggatg

SEQ ID NO: 269448 - DNA, 20 bp, Artificial Sequence
  Description of Artificial Sequence: Synthetic oligonucleotide
  Target: ATXN1; (+) strand; PAM type: YTN; PAM sequence: CTA
aaagggatggggctttacca

SEQ ID NO: 269449 - DNA, 20 bp, Artificial Sequence
  Description of Artificial Sequence: Synthetic oligonucleotide
  Target: ATXN1; (+) strand; PAM type: YTN; PAM sequence: CTT
taccaggaatgagattcaaa

SEQ ID NO: 269450 - DNA, 20 bp, Artificial Sequence
  Description of Artificial Sequence: Synthetic oligonucleotide
  Target: ATXN1; (+) strand; PAM type: YTN; PAM sequence: TTT
accaggaatgagattcaaag

SEQ ID NO: 269451 - DNA, 20 bp, Artificial Sequence
  Description of Artificial Sequence: Synthetic oligonucleotide
  Target: ATXN1; (+) strand; PAM type: YTN; PAM sequence: TTA
ccaggaatgagattcaaagt

SEQ ID NO: 269452 - DNA, 20 bp, Artificial Sequence
  Description of Artificial Sequence: Synthetic oligonucleotide
  Target: ATXN1; (+) strand; PAM type: YTN; PAM sequence: TTC
aaagtgagagaggacatgtt

SEQ ID NO: 269453 - DNA, 20 bp, Artificial Sequence
  Description of Artificial Sequence: Synthetic oligonucleotide
  Target: ATXN1; (+) strand; PAM type: YTN; PAM sequence: TTG
atggaggaggcaagtcatat

SEQ ID NO: 269454 - DNA, 20 bp, Artificial Sequence
  Description of Artificial Sequence: Synthetic oligonucleotide
  Target: ATXN1; (+) strand; PAM type: YTN; PAM sequence: CTG
aaggtgaatgccaggacctg

SEQ ID NO: 269455 - DNA, 20 bp, Artificial Sequence
  Description of Artificial Sequence: Synthetic oligonucleotide
  Target: ATXN1; (+) strand; PAM type: YTN; PAM sequence: CTG
agagtggcccccagctcaca

SEQ ID NO: 269456 - DNA, 20 bp, Artificial Sequence
  Description of Artificial Sequence: Synthetic oligonucleotide
  Target: ATXN1; (+) strand; PAM type: YTN; PAM sequence: CTC
acagccagcaatggaacggg

SEQ ID NO: 269457 - DNA, 20 bp, Artificial Sequence
  Description of Artificial Sequence: Synthetic oligonucleotide
  Target: ATXN1; (+) strand; PAM type: YTN; PAM sequence: CTT
ggtcctacgaccacaagaaa

SEQ ID NO: 269458 - DNA, 20 bp, Artificial Sequence
  Description of Artificial Sequence: Synthetic oligonucleotide
  Target: ATXN1; (+) strand; PAM type: YTN; PAM sequence: TTG
gtcctacgaccacaagaaac

SEQ ID NO: 269459 - DNA, 20 bp, Artificial Sequence
  Description of Artificial Sequence: Synthetic oligonucleotide
  Target: ATXN1; (+) strand; PAM type: YTN; PAM sequence: CTA
cgaccacaagaaactaaata

SEQ ID NO: 269460 - DNA, 20 bp, Artificial Sequence
  Description of Artificial Sequence: Synthetic oligonucleotide
  Target: ATXN1; (+) strand; PAM type: YTN; PAM sequence: CTA
aatacaaaaaaccatgtgag

SEQ ID NO: 269461 - DNA, 20 bp, Artificial Sequence
  Description of Artificial Sequence: Synthetic oligonucleotide
  Target: ATXN1; (+) strand; PAM type: YTN; PAM sequence: CTT
gaaaaaggaccatgagctcc

SEQ ID NO: 269462 - DNA, 20 bp, Artificial Sequence
  Description of Artificial Sequence: Synthetic oligonucleotide
  Target: ATXN1; (+) strand; PAM type: YTN; PAM sequence: TTG
aaaaaggaccatgagctcca

SEQ ID NO: 269463 - DNA, 20 bp, Artificial Sequence
  Description of Artificial Sequence: Synthetic oligonucleotide
  Target: ATXN1; (+) strand; PAM type: YTN; PAM sequence: CTC
cagataataaggcagccctg

SEQ ID NO: 269464 - DNA, 20 bp, Artificial Sequence
  Description of Artificial Sequence: Synthetic oligonucleotide
  Target: ATXN1; (+) strand; PAM type: YTN; PAM sequence: CTG
ttgacacctcaatttcagtc

SEQ ID NO: 269465 - DNA, 20 bp, Artificial Sequence
  Description of Artificial Sequence: Synthetic oligonucleotide
  Target: ATXN1; (+) strand; PAM type: YTN; PAM sequence: TTG
acacctcaatttcagtctta

SEQ ID NO: 269466 - DNA, 20 bp, Artificial Sequence
  Description of Artificial Sequence: Synthetic oligonucleotide
  Target: ATXN1; (+) strand; PAM type: YTN; PAM sequence: CTC
aatttcagtcttatgaaacc

SEQ ID NO: 269467 - DNA, 20 bp, Artificial Sequence
  Description of Artificial Sequence: Synthetic oligonucleotide
  Target: ATXN1; (+) strand; PAM type: YTN; PAM sequence: TTT
cagtcttatgaaaccctgaa

SEQ ID NO: 269468 - DNA, 20 bp, Artificial Sequence
  Description of Artificial Sequence: Synthetic oligonucleotide
  Target: ATXN1; (+) strand; PAM type: YTN; PAM sequence: TTC
agtcttatgaaaccctgaac

SEQ ID NO: 269469 - DNA, 20 bp, Artificial Sequence
  Description of Artificial Sequence: Synthetic oligonucleotide
  Target: ATXN1; (+) strand; PAM type: YTN; PAM sequence: CTT
atgaaaccctgaacagataa

SEQ ID NO: 269470 - DNA, 20 bp, Artificial Sequence
  Description of Artificial Sequence: Synthetic oligonucleotide
  Target: ATXN1; (+) strand; PAM type: YTN; PAM sequence: TTA
tgaaaccctgaacagataat

SEQ ID NO: 269471 - DNA, 20 bp, Artificial Sequence
  Description of Artificial Sequence: Synthetic oligonucleotide
  Target: ATXN1; (+) strand; PAM type: YTN; PAM sequence: CTG
aacagataattcagctaagc

SEQ ID NO: 269472 - DNA, 20 bp, Artificial Sequence
  Description of Artificial Sequence: Synthetic oligonucleotide
  Target: ATXN1; (+) strand; PAM type: YTN; PAM sequence: TTC
agctaagccatgcctggact

SEQ ID NO: 269473 - DNA, 20 bp, Artificial Sequence
  Description of Artificial Sequence: Synthetic oligonucleotide
  Target: ATXN1; (+) strand; PAM type: YTN; PAM sequence: CTA
agccatgcctggacttcgga

SEQ ID NO: 269474 - DNA, 20 bp, Artificial Sequence
  Description of Artificial Sequence: Synthetic oligonucleotide
  Target: ATXN1; (+) strand; PAM type: YTN; PAM sequence: CTG
gacttcggacctccaacaga

SEQ ID NO: 269475 - DNA, 20 bp, Artificial Sequence
  Description of Artificial Sequence: Synthetic oligonucleotide
  Target: ATXN1; (+) strand; PAM type: YTN; PAM sequence: CTT
cggacctccaacagataatt

SEQ ID NO: 269476 - DNA, 20 bp, Artificial Sequence
  Description of Artificial Sequence: Synthetic oligonucleotide
  Target: ATXN1; (+) strand; PAM type: YTN; PAM sequence: TTC
ggacctccaacagataattc

SEQ ID NO: 269477 - DNA, 20 bp, Artificial Sequence
  Description of Artificial Sequence: Synthetic oligonucleotide
  Target: ATXN1; (+) strand; PAM type: YTN; PAM sequence: CTC
caacagataattcaactaag

SEQ ID NO: 269478 - DNA, 20 bp, Artificial Sequence
  Description of Artificial Sequence: Synthetic oligonucleotide
  Target: ATXN1; (+) strand; PAM type: YTN; PAM sequence: TTC
aactaagccatgcctggact

SEQ ID NO: 269479 - DNA, 20 bp, Artificial Sequence
  Description of Artificial Sequence: Synthetic oligonucleotide
  Target: ATXN1; (+) strand; PAM type: YTN; PAM sequence: CTA
agccatgcctggacttcgca

SEQ ID NO: 269480 - DNA, 20 bp, Artificial Sequence
  Description of Artificial Sequence: Synthetic oligonucleotide
  Target: ATXN1; (+) strand; PAM type: YTN; PAM sequence: CTG
gacttcgcacctccagaaac

SEQ ID NO: 269481 - DNA, 20 bp, Artificial Sequence
  Description of Artificial Sequence: Synthetic oligonucleotide
  Target: ATXN1; (+) strand; PAM type: YTN; PAM sequence: CTT
cgcacctccagaaactgtga

SEQ ID NO: 269482 - DNA, 20 bp, Artificial Sequence
  Description of Artificial Sequence: Synthetic oligonucleotide
  Target: ATXN1; (+) strand; PAM type: YTN; PAM sequence: TTC
gcacctccagaaactgtgag

SEQ ID NO: 269483 - DNA, 20 bp, Artificial Sequence
  Description of Artificial Sequence: Synthetic oligonucleotide
  Target: ATXN1; (+) strand; PAM type: YTN; PAM sequence: CTC
cagaaactgtgagataataa

SEQ ID NO: 269484 - DNA, 20 bp, Artificial Sequence
  Description of Artificial Sequence: Synthetic oligonucleotide
  Target: ATXN1; (+) strand; PAM type: YTN; PAM sequence: CTG
tgagataataaataggtatt

SEQ ID NO: 269485 - DNA, 20 bp, Artificial Sequence
  Description of Artificial Sequence: Synthetic oligonucleotide
  Target: ATXN1; (+) strand; PAM type: YTN; PAM sequence: TTG
ttataggtgggaattgaaca

SEQ ID NO: 269486 - DNA, 20 bp, Artificial Sequence
  Description of Artificial Sequence: Synthetic oligonucleotide
  Target: ATXN1; (+) strand; PAM type: YTN; PAM sequence: TTA
taggtgggaattgaacaatg

SEQ ID NO: 269487 - DNA, 20 bp, Artificial Sequence
  Description of Artificial Sequence: Synthetic oligonucleotide
  Target: ATXN1; (+) strand; PAM type: YTN; PAM sequence: TTG
aacaatgagaacacatggac

SEQ ID NO: 269488 - DNA, 20 bp, Artificial Sequence
  Description of Artificial Sequence: Synthetic oligonucleotide
  Target: ATXN1; (+) strand; PAM type: YTN; PAM sequence: CTC
tggggactgtagtggggtgg

SEQ ID NO: 269489 - DNA, 20 bp, Artificial Sequence
  Description of Artificial Sequence: Synthetic oligonucleotide
  Target: ATXN1; (+) strand; PAM type: YTN; PAM sequence: CTG
gggactgtagtggggtgggg

SEQ ID NO: 269490 - DNA, 20 bp, Artificial Sequence
  Description of Artificial Sequence: Synthetic oligonucleotide
  Target: ATXN1; (+) strand; PAM type: YTN; PAM sequence: CTG
tagtggggtggggggagcgg

SEQ ID NO: 269491 - DNA, 20 bp, Artificial Sequence
  Description of Artificial Sequence: Synthetic oligonucleotide
  Target: ATXN1; (+) strand; PAM type: YTN; PAM sequence: TTA
ggagatatacctaatgctag

SEQ ID NO: 269492 - DNA, 20 bp, Artificial Sequence
  Description of Artificial Sequence: Synthetic oligonucleotide
  Target: ATXN1; (+) strand; PAM type: YTN; PAM sequence: CTA
atgctagatgacgagttaat

SEQ ID NO: 269493 - DNA, 20 bp, Artificial Sequence
  Description of Artificial Sequence: Synthetic oligonucleotide
  Target: ATXN1; (+) strand; PAM type: YTN; PAM sequence: CTA
gatgacgagttaatgggtgc

SEQ ID NO: 269494 - DNA, 20 bp, Artificial Sequence
  Description of Artificial Sequence: Synthetic oligonucleotide
  Target: ATXN1; (+) strand; PAM type: YTN; PAM sequence: TTA
atgggtgcagcacaccagca

SEQ ID NO: 269495 - DNA, 20 bp, Artificial Sequence
  Description of Artificial Sequence: Synthetic oligonucleotide
  Target: ATXN1; (+) strand; PAM type: YTN; PAM sequence: CTA
acctgcacattgtgcacatg

SEQ ID NO: 269496 - DNA, 20 bp, Artificial Sequence
  Description of Artificial Sequence: Synthetic oligonucleotide
  Target: ATXN1; (+) strand; PAM type: YTN; PAM sequence: CTG
cacattgtgcacatgtaccc

SEQ ID NO: 269497 - DNA, 20 bp, Artificial Sequence
  Description of Artificial Sequence: Synthetic oligonucleotide
  Target: ATXN1; (+) strand; PAM type: YTN; PAM sequence: TTG
tgcacatgtaccctaaaacc

SEQ ID NO: 269498 - DNA, 20 bp, Artificial Sequence
  Description of Artificial Sequence: Synthetic oligonucleotide
  Target: ATXN1; (+) strand; PAM type: YTN; PAM sequence: CTA
aaacctaaagtataataata

SEQ ID NO: 269499 - DNA, 20 bp, Artificial Sequence
  Description of Artificial Sequence: Synthetic oligonucleotide
  Target: ATXN1; (+) strand; PAM type: YTN; PAM sequence: CTA
aagtataataataataacat

SEQ ID NO: 269500 - DNA, 20 bp, Artificial Sequence
  Description of Artificial Sequence: Synthetic oligonucleotide
  Target: ATXN1; (+) strand; PAM type: YTN; PAM sequence: TTG
tttaagtcactatatttgta

SEQ ID NO: 269501 - DNA, 20 bp, Artificial Sequence
  Description of Artificial Sequence: Synthetic oligonucleotide
  Target: ATXN1; (+) strand; PAM type: YTN; PAM sequence: TTT
aagtcactatatttgtagtt

SEQ ID NO: 269502 - DNA, 20 bp, Artificial Sequence
  Description of Artificial Sequence: Synthetic oligonucleotide
  Target: ATXN1; (+) strand; PAM type: YTN; PAM sequence: TTA
agtcactatatttgtagttt

SEQ ID NO: 269503 - DNA, 20 bp, Artificial Sequence
  Description of Artificial Sequence: Synthetic oligonucleotide
  Target: ATXN1; (+) strand; PAM type: YTN; PAM sequence: CTA
tatttgtagtttgtcataca

SEQ ID NO: 269504 - DNA, 20 bp, Artificial Sequence
  Description of Artificial Sequence: Synthetic oligonucleotide
  Target: ATXN1; (+) strand; PAM type: YTN; PAM sequence: TTT
gtagtttgtcatacagcaat

SEQ ID NO: 269505 - DNA, 20 bp, Artificial Sequence
  Description of Artificial Sequence: Synthetic oligonucleotide
  Target: ATXN1; (+) strand; PAM type: YTN; PAM sequence: TTG
tagtttgtcatacagcaata

SEQ ID NO: 269506 - DNA, 20 bp, Artificial Sequence
  Description of Artificial Sequence: Synthetic oligonucleotide
  Target: ATXN1; (+) strand; PAM type: YTN; PAM sequence: TTT
gtcatacagcaatagaaaac

SEQ ID NO: 269507 - DNA, 20 bp, Artificial Sequence
  Description of Artificial Sequence: Synthetic oligonucleotide
  Target: ATXN1; (+) strand; PAM type: YTN; PAM sequence: TTG
tcatacagcaatagaaaacc

SEQ ID NO: 269508 - DNA, 20 bp, Artificial Sequence
  Description of Artificial Sequence: Synthetic oligonucleotide
  Target: ATXN1; (+) strand; PAM type: YTN; PAM sequence: TTT
ctttttttttttgcttgaat

SEQ ID NO: 269509 - DNA, 20 bp, Artificial Sequence
  Description of Artificial Sequence: Synthetic oligonucleotide
  Target: ATXN1; (+) strand; PAM type: YTN; PAM sequence: TTC
tttttttttttgcttgaatc

SEQ ID NO: 269510 - DNA, 20 bp, Artificial Sequence
  Description of Artificial Sequence: Synthetic oligonucleotide
  Target: ATXN1; (+) strand; PAM type: YTN; PAM sequence: CTT
tttttttttgcttgaatcac

SEQ ID NO: 269511 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcttgaatcact

SEQ ID NO: 269512 - DNA, 20 bp, Artificial Sequence
  Description of Artificial Sequence: Synthetic oligonucleotide
  Target: ATXN1; (+) strand; PAM type: YTN; PAM sequence: TTT
tttttttgcttgaatcactt

SEQ ID NO: 269513 - DNA, 20 bp, Artificial Sequence
  Description of Artificial Sequence: Synthetic oligonucleotide
  Target: ATXN1; (+) strand; PAM type: YTN; PAM sequence: TTT
ttttttgcttgaatcacttt

SEQ ID NO: 269514 - DNA, 20 bp, Artificial Sequence
  Description of Artificial Sequence: Synthetic oligonucleotide
  Target: ATXN1; (+) strand; PAM type: YTN; PAM sequence: TTT
tttttgcttgaatcactttg

SEQ ID NO: 269515 - DNA, 20 bp, Artificial Sequence
  Description of Artificial Sequence: Synthetic oligonucleotide
  Target: ATXN1; (+) strand; PAM type: YTN; PAM sequence: TTT
ttttgcttgaatcactttga

SEQ ID NO: 269516 - DNA, 20 bp, Artificial Sequence
  Description of Artificial Sequence: Synthetic oligonucleotide
  Target: ATXN1; (+) strand; PAM type: YTN; PAM sequence: TTT
tttgcttgaatcactttgag

SEQ ID NO: 269517 - DNA, 20 bp, Artificial Sequence
  Description of Artificial Sequence: Synthetic oligonucleotide
  Target: ATXN1; (+) strand; PAM type: YTN; PAM sequence: TTT
ttgcttgaatcactttgagt

SEQ ID NO: 269518 - DNA, 20 bp, Artificial Sequence
  Description of Artificial Sequence: Synthetic oligonucleotide
  Target: ATXN1; (+) strand; PAM type: YTN; PAM sequence: TTT
tgcttgaatcactttgagtt

SEQ ID NO: 269519 - DNA, 20 bp, Artificial Sequence
  Description of Artificial Sequence: Synthetic oligonucleotide
  Target: ATXN1; (+) strand; PAM type: YTN; PAM sequence: TTT
gcttgaatcactttgagttt

SEQ ID NO: 269520 - DNA, 20 bp, Artificial Sequence
  Description of Artificial Sequence: Synthetic oligonucleotide
  Target: ATXN1; (+) strand; PAM type: YTN; PAM sequence: TTG
cttgaatcactttgagttta

SEQ ID NO: 269521 - DNA, 20 bp, Artificial Sequence
  Description of Artificial Sequence: Synthetic oligonucleotide
  Target: ATXN1; (+) strand; PAM type: YTN; PAM sequence: CTT
gaatcactttgagtttaatt

SEQ ID NO: 269522 - DNA, 20 bp, Artificial Sequence
  Description of Artificial Sequence: Synthetic oligonucleotide
  Target: ATXN1; (+) strand; PAM type: YTN; PAM sequence: TTG
aatcactttgagtttaattt

SEQ ID NO: 269523 - DNA, 20 bp, Artificial Sequence
  Description of Artificial Sequence: Synthetic oligonucleotide
  Target: ATXN1; (+) strand; PAM type: YTN; PAM sequence: CTT
tgagtttaatttgtctattg

SEQ ID NO: 269524 - DNA, 20 bp, Artificial Sequence
  Description of Artificial Sequence: Synthetic oligonucleotide
  Target: ATXN1; (+) strand; PAM type: YTN; PAM sequence: TTT
gagtttaatttgtctattgt

SEQ ID NO: 269525 - DNA, 20 bp, Artificial Sequence
  Description of Artificial Sequence: Synthetic oligonucleotide
  Target: ATXN1; (+) strand; PAM type: YTN; PAM sequence: TTG
agtttaatttgtctattgta

SEQ ID NO: 269526 - DNA, 20 bp, Artificial Sequence
  Description of Artificial Sequence: Synthetic oligonucleotide
  Target: ATXN1; (+) strand; PAM type: YTN; PAM sequence: TTT
aatttgtctattgtaaccaa

SEQ ID NO: 269527 - DNA, 20 bp, Artificial Sequence
  Description of Artificial Sequence: Synthetic oligonucleotide
  Target: ATXN1; (+) strand; PAM type: YTN; PAM sequence: TTA
atttgtctattgtaaccaaa

SEQ ID NO: 269528 - DNA, 20 bp, Artificial Sequence
  Description of Artificial Sequence: Synthetic oligonucleotide
  Target: ATXN1; (+) strand; PAM type: YTN; PAM sequence: TTT
gtctattgtaaccaaaataa

SEQ ID NO: 269529 - DNA, 20 bp, Artificial Sequence
  Description of Artificial Sequence: Synthetic oligonucleotide
  Target: ATXN1; (+) strand; PAM type: YTN; PAM sequence: TTG
tctattgtaaccaaaataaa

SEQ ID NO: 269530 - DNA, 20 bp, Artificial Sequence
  Description of Artificial Sequence: Synthetic oligonucleotide
  Target: ATXN1; (+) strand; PAM type: YTN; PAM sequence: CTA
ttgtaaccaaaataaacaaa

SEQ ID NO: 269531 - DNA, 20 bp, Artificial Sequence
  Description of Artificial Sequence: Synthetic oligonucleotide
  Target: ATXN1; (+) strand; PAM type: YTN; PAM sequence: TTG
taaccaaaataaacaaatat

SEQ ID NO: 269532 - DNA, 20 bp, Artificial Sequence
  Description of Artificial Sequence: Synthetic oligonucleotide
  Target: ATXN1; (+) strand; PAM type: YTN; PAM sequence: TTC
ttaatttctctgagatggta

SEQ ID NO: 269533 - DNA, 20 bp, Artificial Sequence
  Description of Artificial Sequence: Synthetic oligonucleotide
  Target: ATXN1; (+) strand; PAM type: YTN; PAM sequence: CTT
aatttctctgagatggtact

SEQ ID NO: 269534 - DNA, 20 bp, Artificial Sequence
  Description of Artificial Sequence: Synthetic oligonucleotide
  Target: ATXN1; (+) strand; PAM type: YTN; PAM sequence: TTA
atttctctgagatggtactt

SEQ ID NO: 269535 - DNA, 20 bp, Artificial Sequence
  Description of Artificial Sequence: Synthetic oligonucleotide
  Target: ATXN1; (+) strand; PAM type: YTN; PAM sequence: TTT
ctctgagatggtactttctt

SEQ ID NO: 269536 - DNA, 20 bp, Artificial Sequence
  Description of Artificial Sequence: Synthetic oligonucleotide
  Target: ATXN1; (+) strand; PAM type: YTN; PAM sequence: TTC
tctgagatggtactttcttg

SEQ ID NO: 269537 - DNA, 20 bp, Artificial Sequence
  Description of Artificial Sequence: Synthetic oligonucleotide
  Target: ATXN1; (+) strand; PAM type: YTN; PAM sequence: CTC
tgagatggtactttcttggg

SEQ ID NO: 269538 - DNA, 20 bp, Artificial Sequence
  Description of Artificial Sequence: Synthetic oligonucleotide
  Target: ATXN1; (+) strand; PAM type: YTN; PAM sequence: CTG
agatggtactttcttgggtt

SEQ ID NO: 269539 - DNA, 20 bp, Artificial Sequence
  Description of Artificial Sequence: Synthetic oligonucleotide
  Target: ATXN1; (+) strand; PAM type: YTN; PAM sequence: CTT
tcttgggttccttatattac

SEQ ID NO: 269540 - DNA, 20 bp, Artificial Sequence
  Description of Artificial Sequence: Synthetic oligonucleotide
  Target: ATXN1; (+) strand; PAM type: YTN; PAM sequence: TTT
cttgggttccttatattact

SEQ ID NO: 269541 - DNA, 20 bp, Artificial Sequence
  Description of Artificial Sequence: Synthetic oligonucleotide
  Target: ATXN1; (+) strand; PAM type: YTN; PAM sequence: TTC
ttgggttccttatattactc

SEQ ID NO: 269542 - DNA, 20 bp, Artificial Sequence
  Description of Artificial Sequence: Synthetic oligonucleotide
  Target: ATXN1; (+) strand; PAM type: YTN; PAM sequence: CTT
gggttccttatattactcct

SEQ ID NO: 269543 - DNA, 20 bp, Artificial Sequence
  Description of Artificial Sequence: Synthetic oligonucleotide
  Target: ATXN1; (+) strand; PAM type: YTN; PAM sequence: TTG
ggttccttatattactcctt

SEQ ID NO: 269544 - DNA, 20 bp, Artificial Sequence
  Description of Artificial Sequence: Synthetic oligonucleotide
  Target: ATXN1; (+) strand; PAM type: YTN; PAM sequence: TTC
cttatattactccttatggc

SEQ ID NO: 269545 - DNA, 20 bp, Artificial Sequence
  Description of Artificial Sequence: Synthetic oligonucleotide
  Target: ATXN1; (+) strand; PAM type: YTN; PAM sequence: CTT
atattactccttatggcccc

SEQ ID NO: 269546 - DNA, 20 bp, Artificial Sequence
  Description of Artificial Sequence: Synthetic oligonucleotide
  Target: ATXN1; (+) strand; PAM type: YTN; PAM sequence: TTA
tattactccttatggcccct

SEQ ID NO: 269547 - DNA, 20 bp, Artificial Sequence
  Description of Artificial Sequence: Synthetic oligonucleotide
  Target: ATXN1; (+) strand; PAM type: YTN; PAM sequence: TTA
ctccttatggcccctctgca

SEQ ID NO: 269548 - DNA, 20 bp, Artificial Sequence
  Description of Artificial Sequence: Synthetic oligonucleotide
  Target: ATXN1; (+) strand; PAM type: YTN; PAM sequence: CTC
cttatggcccctctgcagtt

SEQ ID NO: 269549 - DNA, 20 bp, Artificial Sequence
  Description of Artificial Sequence: Synthetic oligonucleotide
  Target: ATXN1; (+) strand; PAM type: YTN; PAM sequence: CTT
atggcccctctgcagttttt

SEQ ID NO: 269550 - DNA, 20 bp, Artificial Sequence
  Description of Artificial Sequence: Synthetic oligonucleotide
  Target: ATXN1; (+) strand; PAM type: YTN; PAM sequence: TTA
tggcccctctgcagtttttt

SEQ ID NO: 269551 - DNA, 20 bp, Artificial Sequence
  Description of Artificial Sequence: Synthetic oligonucleotide
  Target: ATXN1; (+) strand; PAM type: YTN; PAM sequence: CTC
tgcagttttttgctctctct

SEQ ID NO: 269552 - DNA, 20 bp, Artificial Sequence
  Description of Artificial Sequence: Synthetic oligonucleotide
  Target: ATXN1; (+) strand; PAM type: YTN; PAM sequence: CTG
cagttttttgctctctctgt

SEQ ID NO: 269553 - DNA, 20 bp, Artificial Sequence
  Description of Artificial Sequence: Synthetic oligonucleotide
  Target: ATXN1; (+) strand; PAM type: YTN; PAM sequence: TTT
tttgctctctctgttctttc

SEQ ID NO: 269554 - DNA, 20 bp, Artificial Sequence
  Description of Artificial Sequence: Synthetic oligonucleotide
  Target: ATXN1; (+) strand; PAM type: YTN; PAM sequence: TTT
ttgctctctctgttctttct

SEQ ID NO: 269555 - DNA, 20 bp, Artificial Sequence
  Description of Artificial Sequence: Synthetic oligonucleotide
  Target: ATXN1; (+) strand; PAM type: YTN; PAM sequence: TTT
tgctctctctgttctttcta

SEQ ID NO: 269556 - DNA, 20 bp, Artificial Sequence
  Description of Artificial Sequence: Synthetic oligonucleotide
  Target: ATXN1; (+) strand; PAM type: YTN; PAM sequence: TTT
gctctctctgttctttctaa

SEQ ID NO: 269557 - DNA, 20 bp, Artificial Sequence
  Description of Artificial Sequence: Synthetic oligonucleotide
  Target: ATXN1; (+) strand; PAM type: YTN; PAM sequence: TTG
ctctctctgttctttctaac

SEQ ID NO: 269558 - DNA, 20 bp, Artificial Sequence
  Description of Artificial Sequence: Synthetic oligonucleotide
  Target: ATXN1; (+) strand; PAM type: YTN; PAM sequence: CTC
tctctgttctttctaactct

SEQ ID NO: 269559 - DNA, 20 bp, Artificial Sequence
  Description of Artificial Sequence: Synthetic oligonucleotide
  Target: ATXN1; (+) strand; PAM type: YTN; PAM sequence: CTC
tctgttctttctaactctag

SEQ ID NO: 269560 - DNA, 20 bp, Artificial Sequence
  Description of Artificial Sequence: Synthetic oligonucleotide
  Target: ATXN1; (+) strand; PAM type: YTN; PAM sequence: CTC
tgttctttctaactctaggg

SEQ ID NO: 269561 - DNA, 20 bp, Artificial Sequence
  Description of Artificial Sequence: Synthetic oligonucleotide
  Target: ATXN1; (+) strand; PAM type: YTN; PAM sequence: CTG
ttctttctaactctagggga

SEQ ID NO: 269562 - DNA, 20 bp, Artificial Sequence
  Description of Artificial Sequence: Synthetic oligonucleotide
  Target: ATXN1; (+) strand; PAM type: YTN; PAM sequence: TTC
tttctaactctaggggacag

SEQ ID NO: 269563 - DNA, 20 bp, Artificial Sequence
  Description of Artificial Sequence: Synthetic oligonucleotide
  Target: ATXN1; (+) strand; PAM type: YTN; PAM sequence: CTT
tctaactctaggggacagat

SEQ ID NO: 269564 - DNA, 20 bp, Artificial Sequence
  Description of Artificial Sequence: Synthetic oligonucleotide
  Target: ATXN1; (+) strand; PAM type: YTN; PAM sequence: TTT
ctaactctaggggacagatt

SEQ ID NO: 269565 - DNA, 20 bp, Artificial Sequence
  Description of Artificial Sequence: Synthetic oligonucleotide
  Target: ATXN1; (+) strand; PAM type: YTN; PAM sequence: TTC
taactctaggggacagattt

SEQ ID NO: 269566 - DNA, 20 bp, Artificial Sequence
  Description of Artificial Sequence: Synthetic oligonucleotide
  Target: ATXN1; (+) strand; PAM type: YTN; PAM sequence: CTA
actctaggggacagatttcc

SEQ ID NO: 269567 - DNA, 20 bp, Artificial Sequence
  Description of Artificial Sequence: Synthetic oligonucleotide
  Target: ATXN1; (+) strand; PAM type: YTN; PAM sequence: CTC
taggggacagatttcctaag

SEQ ID NO: 269568 - DNA, 20 bp, Artificial Sequence
  Description of Artificial Sequence: Synthetic oligonucleotide
  Target: ATXN1; (+) strand; PAM type: YTN; PAM sequence: CTA
ggggacagatttcctaaggc

SEQ ID NO: 269569 - DNA, 20 bp, Artificial Sequence
  Description of Artificial Sequence: Synthetic oligonucleotide
  Target: ATXN1; (+) strand; PAM type: YTN; PAM sequence: TTT
cctaaggctatctgctcagt

SEQ ID NO: 269570 - DNA, 20 bp, Artificial Sequence
  Description of Artificial Sequence: Synthetic oligonucleotide
  Target: ATXN1; (+) strand; PAM type: YTN; PAM sequence: TTC
ctaaggctatctgctcagtt

SEQ ID NO: 269571 - DNA, 20 bp, Artificial Sequence
  Description of Artificial Sequence: Synthetic oligonucleotide
  Target: ATXN1; (+) strand; PAM type: YTN; PAM sequence: CTA
aggctatctgctcagttcta

SEQ ID NO: 269572 - DNA, 20 bp, Artificial Sequence
  Description of Artificial Sequence: Synthetic oligonucleotide
  Target: ATXN1; (+) strand; PAM type: YTN; PAM sequence: CTA
tctgctcagttctattcact

SEQ ID NO: 269573 - DNA, 20 bp, Artificial Sequence
  Description of Artificial Sequence: Synthetic oligonucleotide
  Target: ATXN1; (+) strand; PAM type: YTN; PAM sequence: CTG
ctcagttctattcactttct

SEQ ID NO: 269574 - DNA, 20 bp, Artificial Sequence
  Description of Artificial Sequence: Synthetic oligonucleotide
  Target: ATXN1; (+) strand; PAM type: YTN; PAM sequence: CTC
agttctattcactttctata

SEQ ID NO: 269575 - DNA, 20 bp, Artificial Sequence
  Description of Artificial Sequence: Synthetic oligonucleotide
  Target: ATXN1; (+) strand; PAM type: YTN; PAM sequence: TTC
tattcactttctataatgat

SEQ ID NO: 269576 - DNA, 20 bp, Artificial Sequence
  Description of Artificial Sequence: Synthetic oligonucleotide
  Target: ATXN1; (+) strand; PAM type: YTN; PAM sequence: CTA
ttcactttctataatgattt

SEQ ID NO: 269577 - DNA, 20 bp, Artificial Sequence
  Description of Artificial Sequence: Synthetic oligonucleotide
  Target: ATXN1; (+) strand; PAM type: YTN; PAM sequence: TTC
actttctataatgatttcct

SEQ ID NO: 269578 - DNA, 20 bp, Artificial Sequence
  Description of Artificial Sequence: Synthetic oligonucleotide
  Target: ATXN1; (+) strand; PAM type: YTN; PAM sequence: CTT
tctataatgatttccttcta

SEQ ID NO: 269579 - DNA, 20 bp, Artificial Sequence
  Description of Artificial Sequence: Synthetic oligonucleotide
  Target: ATXN1; (+) strand; PAM type: YTN; PAM sequence: TTT
ctataatgatttccttctac

SEQ ID NO: 269580 - DNA, 20 bp, Artificial Sequence
  Description of Artificial Sequence: Synthetic oligonucleotide
  Target: ATXN1; (+) strand; PAM type: YTN; PAM sequence: TTC
tataatgatttccttctact

SEQ ID NO: 269581 - DNA, 20 bp, Artificial Sequence
  Description of Artificial Sequence: Synthetic oligonucleotide
  Target: ATXN1; (+) strand; PAM type: YTN; PAM sequence: CTA
taatgatttccttctactgt

SEQ ID NO: 269582 - DNA, 20 bp, Artificial Sequence
  Description of Artificial Sequence: Synthetic oligonucleotide
  Target: ATXN1; (+) strand; PAM type: YTN; PAM sequence: TTT
ccttctactgtttatcgttc

SEQ ID NO: 269583 - DNA, 20 bp, Artificial Sequence
  Description of Artificial Sequence: Synthetic oligonucleotide
  Target: ATXN1; (+) strand; PAM type: YTN; PAM sequence: TTC
cttctactgtttatcgttct

SEQ ID NO: 269584 - DNA, 20 bp, Artificial Sequence
  Description of Artificial Sequence: Synthetic oligonucleotide
  Target: ATXN1; (+) strand; PAM type: YTN; PAM sequence: CTT
ctactgtttatcgttcttaa

SEQ ID NO: 269585 - DNA, 20 bp, Artificial Sequence
  Description of Artificial Sequence: Synthetic oligonucleotide
  Target: ATXN1; (+) strand; PAM type: YTN; PAM sequence: TTC
tactgtttatcgttcttaaa

SEQ ID NO: 269586 - DNA, 20 bp, Artificial Sequence
  Description of Artificial Sequence: Synthetic oligonucleotide
  Target: ATXN1; (+) strand; PAM type: YTN; PAM sequence: CTA
ctgtttatcgttcttaaatc

SEQ ID NO: 269587 - DNA, 20 bp, Artificial Sequence
  Description of Artificial Sequence: Synthetic oligonucleotide
  Target: ATXN1; (+) strand; PAM type: YTN; PAM sequence: CTG
tttatcgttcttaaatctgt

SEQ ID NO: 269588 - DNA, 20 bp, Artificial Sequence
  Description of Artificial Sequence: Synthetic oligonucleotide
  Target: ATXN1; (+) strand; PAM type: YTN; PAM sequence: TTT
atcgttcttaaatctgtatc

SEQ ID NO: 269589 - DNA, 20 bp, Artificial Sequence
  Description of Artificial Sequence: Synthetic oligonucleotide
  Target: ATXN1; (+) strand; PAM type: YTN; PAM sequence: TTA
tcgttcttaaatctgtatcc

SEQ ID NO: 269590 - DNA, 20 bp, Artificial Sequence
  Description of Artificial Sequence: Synthetic oligonucleotide
  Target: ATXN1; (+) strand; PAM type: YTN; PAM sequence: TTC
ttaaatctgtatcctggtcc

SEQ ID NO: 269591 - DNA, 20 bp, Artificial Sequence
  Description of Artificial Sequence: Synthetic oligonucleotide
  Target: ATXN1; (+) strand; PAM type: YTN; PAM sequence: CTT
aaatctgtatcctggtccct

SEQ ID NO: 269592 - DNA, 20 bp, Artificial Sequence
  Description of Artificial Sequence: Synthetic oligonucleotide
  Target: ATXN1; (+) strand; PAM type: YTN; PAM sequence: TTA
aatctgtatcctggtccctg

SEQ ID NO: 269593 - DNA, 20 bp, Artificial Sequence
  Description of Artificial Sequence: Synthetic oligonucleotide
  Target: ATXN1; (+) strand; PAM type: YTN; PAM sequence: CTG
tatcctggtccctggtatct

SEQ ID NO: 269594 - DNA, 20 bp, Artificial Sequence
  Description of Artificial Sequence: Synthetic oligonucleotide
  Target: ATXN1; (+) strand; PAM type: YTN; PAM sequence: CTG
gtccctggtatctcccccta

SEQ ID NO: 269595 - DNA, 20 bp, Artificial Sequence
  Description of Artificial Sequence: Synthetic oligonucleotide
  Target: ATXN1; (+) strand; PAM type: YTN; PAM sequence: CTG
gtatctccccctacaaactc

SEQ ID NO: 269596 - DNA, 20 bp, Artificial Sequence
  Description of Artificial Sequence: Synthetic oligonucleotide
  Target: ATXN1; (+) strand; PAM type: YTN; PAM sequence: CTC
cccctacaaactcctggata

SEQ ID NO: 269597 - DNA, 20 bp, Artificial Sequence
  Description of Artificial Sequence: Synthetic oligonucleotide
  Target: ATXN1; (+) strand; PAM type: YTN; PAM sequence: CTA
caaactcctggatatatgca

SEQ ID NO: 269598 - DNA, 20 bp, Artificial Sequence
  Description of Artificial Sequence: Synthetic oligonucleotide
  Target: ATXN1; (+) strand; PAM type: YTN; PAM sequence: CTC
ctggatatatgcagtggaaa

SEQ ID NO: 269599 - DNA, 20 bp, Artificial Sequence
  Description of Artificial Sequence: Synthetic oligonucleotide
  Target: ATXN1; (+) strand; PAM type: YTN; PAM sequence: CTG
gatatatgcagtggaaacaa

SEQ ID NO: 269600 - DNA, 20 bp, Artificial Sequence
  Description of Artificial Sequence: Synthetic oligonucleotide
  Target: ATXN1; (+) strand; PAM type: YTN; PAM sequence: TTA
tgtttatttcaaactttccc

SEQ ID NO: 269601 - DNA, 20 bp, Artificial Sequence
  Description of Artificial Sequence: Synthetic oligonucleotide
  Target: ATXN1; (+) strand; PAM type: YTN; PAM sequence: TTT
atttcaaactttcccagtcc

SEQ ID NO: 269602 - DNA, 20 bp, Artificial Sequence
  Description of Artificial Sequence: Synthetic oligonucleotide
  Target: ATXN1; (+) strand; PAM type: YTN; PAM sequence: TTA
tttcaaactttcccagtccc

SEQ ID NO: 269603 - DNA, 20 bp, Artificial Sequence
  Description of Artificial Sequence: Synthetic oligonucleotide
  Target: ATXN1; (+) strand; PAM type: YTN; PAM sequence: TTT
caaactttcccagtcccttg

SEQ ID NO: 269604 - DNA, 20 bp, Artificial Sequence
  Description of Artificial Sequence: Synthetic oligonucleotide
  Target: ATXN1; (+) strand; PAM type: YTN; PAM sequence: TTC
aaactttcccagtcccttgc

SEQ ID NO: 269605 - DNA, 20 bp, Artificial Sequence
  Description of Artificial Sequence: Synthetic oligonucleotide
  Target: ATXN1; (+) strand; PAM type: YTN; PAM sequence: CTT
tcccagtcccttgctccaaa

SEQ ID NO: 269606 - DNA, 20 bp, Artificial Sequence
  Description of Artificial Sequence: Synthetic oligonucleotide
  Target: ATXN1; (+) strand; PAM type: YTN; PAM sequence: TTT
cccagtcccttgctccaaac

SEQ ID NO: 269607 - DNA, 20 bp, Artificial Sequence
  Description of Artificial Sequence: Synthetic oligonucleotide
  Target: ATXN1; (+) strand; PAM type: YTN; PAM sequence: TTC
ccagtcccttgctccaaacc

SEQ ID NO: 269608 - DNA, 20 bp, Artificial Sequence
  Description of Artificial Sequence: Synthetic oligonucleotide
  Target: ATXN1; (+) strand; PAM type: YTN; PAM sequence: CTT
gctccaaacccagctcctcc

SEQ ID NO: 269609 - DNA, 20 bp, Artificial Sequence
  Description of Artificial Sequence: Synthetic oligonucleotide
  Target: ATXN1; (+) strand; PAM type: YTN; PAM sequence: TTG
ctccaaacccagctcctcct

SEQ ID NO: 269610 - DNA, 20 bp, Artificial Sequence
  Description of Artificial Sequence: Synthetic oligonucleotide
  Target: ATXN1; (+) strand; PAM type: YTN; PAM sequence: CTC
caaacccagctcctcctctt

SEQ ID NO: 269611 - DNA, 20 bp, Artificial Sequence
  Description of Artificial Sequence: Synthetic oligonucleotide
  Target: ATXN1; (+) strand; PAM type: YTN; PAM sequence: CTC
ctcctctttaatttctgatg

SEQ ID NO: 269612 - DNA, 20 bp, Artificial Sequence
  Description of Artificial Sequence: Synthetic oligonucleotide
  Target: ATXN1; (+) strand; PAM type: YTN; PAM sequence: CTC
ctctttaatttctgatggaa

SEQ ID NO: 269613 - DNA, 20 bp, Artificial Sequence
  Description of Artificial Sequence: Synthetic oligonucleotide
  Target: ATXN1; (+) strand; PAM type: YTN; PAM sequence: CTC
tttaatttctgatggaagct

SEQ ID NO: 269614 - DNA, 20 bp, Artificial Sequence
  Description of Artificial Sequence: Synthetic oligonucleotide
  Target: ATXN1; (+) strand; PAM type: YTN; PAM sequence: CTT
taatttctgatggaagctga

SEQ ID NO: 269615 - DNA, 20 bp, Artificial Sequence
  Description of Artificial Sequence: Synthetic oligonucleotide
  Target: ATXN1; (+) strand; PAM type: YTN; PAM sequence: TTT
aatttctgatggaagctgac

SEQ ID NO: 269616 - DNA, 20 bp, Artificial Sequence
  Description of Artificial Sequence: Synthetic oligonucleotide
  Target: ATXN1; (+) strand; PAM type: YTN; PAM sequence: TTA
atttctgatggaagctgaca

SEQ ID NO: 269617 - DNA, 20 bp, Artificial Sequence
  Description of Artificial Sequence: Synthetic oligonucleotide
  Target: ATXN1; (+) strand; PAM type: YTN; PAM sequence: TTT
ctgatggaagctgacagcat

SEQ ID NO: 269618 - DNA, 20 bp, Artificial Sequence
  Description of Artificial Sequence: Synthetic oligonucleotide
  Target: ATXN1; (+) strand; PAM type: YTN; PAM sequence: TTC
tgatggaagctgacagcatc

SEQ ID NO: 269619 - DNA, 20 bp, Artificial Sequence
  Description of Artificial Sequence: Synthetic oligonucleotide
  Target: ATXN1; (+) strand; PAM type: YTN; PAM sequence: CTG
atggaagctgacagcatcat

SEQ ID NO: 269620 - DNA, 20 bp, Artificial Sequence
  Description of Artificial Sequence: Synthetic oligonucleotide
  Target: ATXN1; (+) strand; PAM type: YTN; PAM sequence: CTG
acagcatcatcatcttctac

SEQ ID NO: 269621 - DNA, 20 bp, Artificial Sequence
  Description of Artificial Sequence: Synthetic oligonucleotide
  Target: ATXN1; (+) strand; PAM type: YTN; PAM sequence: CTT
ctactctttctcccacattc

SEQ ID NO: 269622 - DNA, 20 bp, Artificial Sequence
  Description of Artificial Sequence: Synthetic oligonucleotide
  Target: ATXN1; (+) strand; PAM type: YTN; PAM sequence: TTC
tactctttctcccacattcc

SEQ ID NO: 269623 - DNA, 20 bp, Artificial Sequence
  Description of Artificial Sequence: Synthetic oligonucleotide
  Target: ATXN1; (+) strand; PAM type: YTN; PAM sequence: CTA
ctctttctcccacattccat

SEQ ID NO: 269624 - DNA, 20 bp, Artificial Sequence
  Description of Artificial Sequence: Synthetic oligonucleotide
  Target: ATXN1; (+) strand; PAM type: YTN; PAM sequence: CTC
tttctcccacattccatcgg

SEQ ID NO: 269625 - DNA, 20 bp, Artificial Sequence
  Description of Artificial Sequence: Synthetic oligonucleotide
  Target: ATXN1; (+) strand; PAM type: YTN; PAM sequence: CTT
tctcccacattccatcggtt

SEQ ID NO: 269626 - DNA, 20 bp, Artificial Sequence
  Description of Artificial Sequence: Synthetic oligonucleotide
  Target: ATXN1; (+) strand; PAM type: YTN; PAM sequence: TTT
ctcccacattccatcggttt

SEQ ID NO: 269627 - DNA, 20 bp, Artificial Sequence
  Description of Artificial Sequence: Synthetic oligonucleotide
  Target: ATXN1; (+) strand; PAM type: YTN; PAM sequence: TTC
tcccacattccatcggtttc

SEQ ID NO: 269628 - DNA, 20 bp, Artificial Sequence
  Description of Artificial Sequence: Synthetic oligonucleotide
  Target: ATXN1; (+) strand; PAM type: YTN; PAM sequence: CTC
ccacattccatcggtttcca

SEQ ID NO: 269629 - DNA, 20 bp, Artificial Sequence
  Description of Artificial Sequence: Synthetic oligonucleotide
  Target: ATXN1; (+) strand; PAM type: YTN; PAM sequence: TTC
catcggtttccaagtcctac

SEQ ID NO: 269630 - DNA, 20 bp, Artificial Sequence
  Description of Artificial Sequence: Synthetic oligonucleotide
  Target: ATXN1; (+) strand; PAM type: YTN; PAM sequence: TTT
ccaagtcctaccaattctgc

SEQ ID NO: 269631 - DNA, 20 bp, Artificial Sequence
  Description of Artificial Sequence: Synthetic oligonucleotide
  Target: ATXN1; (+) strand; PAM type: YTN; PAM sequence: TTC
caagtcctaccaattctgca

SEQ ID NO: 269632 - DNA, 20 bp, Artificial Sequence
  Description of Artificial Sequence: Synthetic oligonucleotide
  Target: ATXN1; (+) strand; PAM type: YTN; PAM sequence: CTA
ccaattctgcaccctttcta

SEQ ID NO: 269633 - DNA, 20 bp, Artificial Sequence
  Description of Artificial Sequence: Synthetic oligonucleotide
  Target: ATXN1; (+) strand; PAM type: YTN; PAM sequence: TTC
tgcaccctttctatcttcac

SEQ ID NO: 269634 - DNA, 20 bp, Artificial Sequence
  Description of Artificial Sequence: Synthetic oligonucleotide
  Target: ATXN1; (+) strand; PAM type: YTN; PAM sequence: CTG
caccctttctatcttcaccg

SEQ ID NO: 269635 - DNA, 20 bp, Artificial Sequence
  Description of Artificial Sequence: Synthetic oligonucleotide
  Target: ATXN1; (+) strand; PAM type: YTN; PAM sequence: CTT
tctatcttcaccgccccatg

SEQ ID NO: 269636 - DNA, 20 bp, Artificial Sequence
  Description of Artificial Sequence: Synthetic oligonucleotide
  Target: ATXN1; (+) strand; PAM type: YTN; PAM sequence: TTT
ctatcttcaccgccccatgc

SEQ ID NO: 269637 - DNA, 20 bp, Artificial Sequence
  Description of Artificial Sequence: Synthetic oligonucleotide
  Target: ATXN1; (+) strand; PAM type: YTN; PAM sequence: TTC
tatcttcaccgccccatgct

SEQ ID NO: 269638 - DNA, 20 bp, Artificial Sequence
  Description of Artificial Sequence: Synthetic oligonucleotide
  Target: ATXN1; (+) strand; PAM type: YTN; PAM sequence: CTA
tcttcaccgccccatgctag

SEQ ID NO: 269639 - DNA, 20 bp, Artificial Sequence
  Description of Artificial Sequence: Synthetic oligonucleotide
  Target: ATXN1; (+) strand; PAM type: YTN; PAM sequence: CTT
caccgccccatgctagctca

SEQ ID NO: 269640 - DNA, 20 bp, Artificial Sequence
  Description of Artificial Sequence: Synthetic oligonucleotide
  Target: ATXN1; (+) strand; PAM type: YTN; PAM sequence: TTC
accgccccatgctagctcag

SEQ ID NO: 269641 - DNA, 20 bp, Artificial Sequence
  Description of Artificial Sequence: Synthetic oligonucleotide
  Target: ATXN1; (+) strand; PAM type: YTN; PAM sequence: CTA
gctcagactgaattcctctc

SEQ ID NO: 269642 - DNA, 20 bp, Artificial Sequence
  Description of Artificial Sequence: Synthetic oligonucleotide
  Target: ATXN1; (+) strand; PAM type: YTN; PAM sequence: CTC
agactgaattcctctcacag

SEQ ID NO: 269643 - DNA, 20 bp, Artificial Sequence
  Description of Artificial Sequence: Synthetic oligonucleotide
  Target: ATXN1; (+) strand; PAM type: YTN; PAM sequence: CTG
aattcctctcacagcagcct

SEQ ID NO: 269644 - DNA, 20 bp, Artificial Sequence
  Description of Artificial Sequence: Synthetic oligonucleotide
  Target: ATXN1; (+) strand; PAM type: YTN; PAM sequence: TTC
ctctcacagcagcctgctca

SEQ ID NO: 269645 - DNA, 20 bp, Artificial Sequence
  Description of Artificial Sequence: Synthetic oligonucleotide
  Target: ATXN1; (+) strand; PAM type: YTN; PAM sequence: CTC
tcacagcagcctgctcattg

SEQ ID NO: 269646 - DNA, 20 bp, Artificial Sequence
  Description of Artificial Sequence: Synthetic oligonucleotide
  Target: ATXN1; (+) strand; PAM type: YTN; PAM sequence: CTC
acagcagcctgctcattggt

SEQ ID NO: 269647 - DNA, 20 bp, Artificial Sequence
  Description of Artificial Sequence: Synthetic oligonucleotide
  Target: ATXN1; (+) strand; PAM type: YTN; PAM sequence: CTG
ctcattggtcttcttgtcaa

SEQ ID NO: 269648 - DNA, 20 bp, Artificial Sequence
  Description of Artificial Sequence: Synthetic oligonucleotide
  Target: ATXN1; (+) strand; PAM type: YTN; PAM sequence: CTC
attggtcttcttgtcaatgc

SEQ ID NO: 269649 - DNA, 20 bp, Artificial Sequence
  Description of Artificial Sequence: Synthetic oligonucleotide
  Target: ATXN1; (+) strand; PAM type: YTN; PAM sequence: TTG
gtcttcttgtcaatgctttc

SEQ ID NO: 269650 - DNA, 20 bp, Artificial Sequence
  Description of Artificial Sequence: Synthetic oligonucleotide
  Target: ATXN1; (+) strand; PAM type: YTN; PAM sequence: CTT
cttgtcaatgctttctctct

SEQ ID NO: 269651 - DNA, 20 bp, Artificial Sequence
  Description of Artificial Sequence: Synthetic oligonucleotide
  Target: ATXN1; (+) strand; PAM type: YTN; PAM sequence: TTC
ttgtcaatgctttctctctc

SEQ ID NO: 269652 - DNA, 20 bp, Artificial Sequence
  Description of Artificial Sequence: Synthetic oligonucleotide
  Target: ATXN1; (+) strand; PAM type: YTN; PAM sequence: CTT
gtcaatgctttctctctcta

SEQ ID NO: 269653 - DNA, 20 bp, Artificial Sequence
  Description of Artificial Sequence: Synthetic oligonucleotide
  Target: ATXN1; (+) strand; PAM type: YTN; PAM sequence: TTG
tcaatgctttctctctctaa

SEQ ID NO: 269654 - DNA, 20 bp, Artificial Sequence
  Description of Artificial Sequence: Synthetic oligonucleotide
  Target: ATXN1; (+) strand; PAM type: YTN; PAM sequence: CTT
tctctctctaaaccatttga

SEQ ID NO: 269655 - DNA, 20 bp, Artificial Sequence
  Description of Artificial Sequence: Synthetic oligonucleotide
  Target: ATXN1; (+) strand; PAM type: YTN; PAM sequence: TTT
ctctctctaaaccatttgag

SEQ ID NO: 269656 - DNA, 20 bp, Artificial Sequence
  Description of Artificial Sequence: Synthetic oligonucleotide
  Target: ATXN1; (+) strand; PAM type: YTN; PAM sequence: TTC
tctctctaaaccatttgagt

SEQ ID NO: 269657 - DNA, 20 bp, Artificial Sequence
  Description of Artificial Sequence: Synthetic oligonucleotide
  Target: ATXN1; (+) strand; PAM type: YTN; PAM sequence: CTC
tctctaaaccatttgagtca

SEQ ID NO: 269658 - DNA, 20 bp, Artificial Sequence
  Description of Artificial Sequence: Synthetic oligonucleotide
  Target: ATXN1; (+) strand; PAM type: YTN; PAM sequence: CTC
tctaaaccatttgagtcatc

SEQ ID NO: 269659 - DNA, 20 bp, Artificial Sequence
  Description of Artificial Sequence: Synthetic oligonucleotide
  Target: ATXN1; (+) strand; PAM type: YTN; PAM sequence: CTC
taaaccatttgagtcatccc

SEQ ID NO: 269660 - DNA, 20 bp, Artificial Sequence
  Description of Artificial Sequence: Synthetic oligonucleotide
  Target: ATXN1; (+) strand; PAM type: YTN; PAM sequence: CTA
aaccatttgagtcatccctg

SEQ ID NO: 269661 - DNA, 20 bp, Artificial Sequence
  Description of Artificial Sequence: Synthetic oligonucleotide
  Target: ATXN1; (+) strand; PAM type: YTN; PAM sequence: TTT
gagtcatccctgttggatcg

SEQ ID NO: 269662 - DNA, 20 bp, Artificial Sequence
  Description of Artificial Sequence: Synthetic oligonucleotide
  Target: ATXN1; (+) strand; PAM type: YTN; PAM sequence: TTG
agtcatccctgttggatcga

SEQ ID NO: 269663 - DNA, 20 bp, Artificial Sequence
  Description of Artificial Sequence: Synthetic oligonucleotide
  Target: ATXN1; (+) strand; PAM type: YTN; PAM sequence: CTG
ttggatcgaacttcctaaag

SEQ ID NO: 269664 - DNA, 20 bp, Artificial Sequence
  Description of Artificial Sequence: Synthetic oligonucleotide
  Target: ATXN1; (+) strand; PAM type: YTN; PAM sequence: TTG
gatcgaacttcctaaagtag

SEQ ID NO: 269665 - DNA, 20 bp, Artificial Sequence
  Description of Artificial Sequence: Synthetic oligonucleotide
  Target: ATXN1; (+) strand; PAM type: YTN; PAM sequence: CTT
cctaaagtagatataacaca

SEQ ID NO: 269666 - DNA, 20 bp, Artificial Sequence
  Description of Artificial Sequence: Synthetic oligonucleotide
  Target: ATXN1; (+) strand; PAM type: YTN; PAM sequence: TTC
ctaaagtagatataacacaa

SEQ ID NO: 269667 - DNA, 20 bp, Artificial Sequence
  Description of Artificial Sequence: Synthetic oligonucleotide
  Target: ATXN1; (+) strand; PAM type: YTN; PAM sequence: CTA
aagtagatataacacaactt

SEQ ID NO: 269668 - DNA, 20 bp, Artificial Sequence
  Description of Artificial Sequence: Synthetic oligonucleotide
  Target: ATXN1; (+) strand; PAM type: YTN; PAM sequence: CTT
ccccgtgccatccatacctt

SEQ ID NO: 269669 - DNA, 20 bp, Artificial Sequence
  Description of Artificial Sequence: Synthetic oligonucleotide
  Target: ATXN1; (+) strand; PAM type: YTN; PAM sequence: TTC
cccgtgccatccataccttc

SEQ ID NO: 269670 - DNA, 20 bp, Artificial Sequence
  Description of Artificial Sequence: Synthetic oligonucleotide
  Target: ATXN1; (+) strand; PAM type: YTN; PAM sequence: CTT
cattggttcctacagcttac

SEQ ID NO: 269671 - DNA, 20 bp, Artificial Sequence
  Description of Artificial Sequence: Synthetic oligonucleotide
  Target: ATXN1; (+) strand; PAM type: YTN; PAM sequence: TTC
attggttcctacagcttact

SEQ ID NO: 269672 - DNA, 20 bp, Artificial Sequence
  Description of Artificial Sequence: Synthetic oligonucleotide
  Target: ATXN1; (+) strand; PAM type: YTN; PAM sequence: TTG
gttcctacagcttactgaac

SEQ ID NO: 269673 - DNA, 20 bp, Artificial Sequence
  Description of Artificial Sequence: Synthetic oligonucleotide
  Target: ATXN1; (+) strand; PAM type: YTN; PAM sequence: TTC
ctacagcttactgaacatct

SEQ ID NO: 269674 - DNA, 20 bp, Artificial Sequence
  Description of Artificial Sequence: Synthetic oligonucleotide
  Target: ATXN1; (+) strand; PAM type: YTN; PAM sequence: CTA
cagcttactgaacatcttcg

SEQ ID NO: 269675 - DNA, 20 bp, Artificial Sequence
  Description of Artificial Sequence: Synthetic oligonucleotide
  Target: ATXN1; (+) strand; PAM type: YTN; PAM sequence: CTT
actgaacatcttcgaaattc

SEQ ID NO: 269676 - DNA, 20 bp, Artificial Sequence
  Description of Artificial Sequence: Synthetic oligonucleotide
  Target: ATXN1; (+) strand; PAM type: YTN; PAM sequence: TTA
ctgaacatcttcgaaattct

SEQ ID NO: 269677 - DNA, 20 bp, Artificial Sequence
  Description of Artificial Sequence: Synthetic oligonucleotide
  Target: ATXN1; (+) strand; PAM type: YTN; PAM sequence: CTG
aacatcttcgaaattcttta

SEQ ID NO: 269678 - DNA, 20 bp, Artificial Sequence
  Description of Artificial Sequence: Synthetic oligonucleotide
  Target: ATXN1; (+) strand; PAM type: YTN; PAM sequence: CTT
cgaaattctttatttgatgc

SEQ ID NO: 269679 - DNA, 20 bp, Artificial Sequence
  Description of Artificial Sequence: Synthetic oligonucleotide
  Target: ATXN1; (+) strand; PAM type: YTN; PAM sequence: TTC
gaaattctttatttgatgct

SEQ ID NO: 269680 - DNA, 20 bp, Artificial Sequence
  Description of Artificial Sequence: Synthetic oligonucleotide
  Target: ATXN1; (+) strand; PAM type: YTN; PAM sequence: TTC
tttatttgatgctgaagatc

SEQ ID NO: 269681 - DNA, 20 bp, Artificial Sequence
  Description of Artificial Sequence: Synthetic oligonucleotide
  Target: ATXN1; (+) strand; PAM type: YTN; PAM sequence: CTT
tatttgatgctgaagatctt

SEQ ID NO: 269682 - DNA, 20 bp, Artificial Sequence
  Description of Artificial Sequence: Synthetic oligonucleotide
  Target: ATXN1; (+) strand; PAM type: YTN; PAM sequence: TTT
atttgatgctgaagatcttc

SEQ ID NO: 269683 - DNA, 20 bp, Artificial Sequence
  Description of Artificial Sequence: Synthetic oligonucleotide
  Target: ATXN1; (+) strand; PAM type: YTN; PAM sequence: TTA
tttgatgctgaagatcttca

SEQ ID NO: 269684 - DNA, 20 bp, Artificial Sequence
  Description of Artificial Sequence: Synthetic oligonucleotide
  Target: ATXN1; (+) strand; PAM type: YTN; PAM sequence: TTT
gatgctgaagatcttcacaa

SEQ ID NO: 269685 - DNA, 20 bp, Artificial Sequence
  Description of Artificial Sequence: Synthetic oligonucleotide
  Target: ATXN1; (+) strand; PAM type: YTN; PAM sequence: TTG
atgctgaagatcttcacaat

SEQ ID NO: 269686 - DNA, 20 bp, Artificial Sequence
  Description of Artificial Sequence: Synthetic oligonucleotide
  Target: ATXN1; (+) strand; PAM type: YTN; PAM sequence: CTG
aagatcttcacaatctggcc

SEQ ID NO: 269687 - DNA, 20 bp, Artificial Sequence
  Description of Artificial Sequence: Synthetic oligonucleotide
  Target: ATXN1; (+) strand; PAM type: YTN; PAM sequence: CTT
cacaatctggccccagcatg

SEQ ID NO: 269688 - DNA, 20 bp, Artificial Sequence
  Description of Artificial Sequence: Synthetic oligonucleotide
  Target: ATXN1; (+) strand; PAM type: YTN; PAM sequence: TTC
acaatctggccccagcatgc

SEQ ID NO: 269689 - DNA, 20 bp, Artificial Sequence
  Description of Artificial Sequence: Synthetic oligonucleotide
  Target: ATXN1; (+) strand; PAM type: YTN; PAM sequence: CTG
gccccagcatgcttttccaa

SEQ ID NO: 269690 - DNA, 20 bp, Artificial Sequence
  Description of Artificial Sequence: Synthetic oligonucleotide
  Target: ATXN1; (+) strand; PAM type: YTN; PAM sequence: CTT
ttccaacttcatttctactt

SEQ ID NO: 269691 - DNA, 20 bp, Artificial Sequence
  Description of Artificial Sequence: Synthetic oligonucleotide
  Target: ATXN1; (+) strand; PAM type: YTN; PAM sequence: TTT
tccaacttcatttctacttc

SEQ ID NO: 269692 - DNA, 20 bp, Artificial Sequence
  Description of Artificial Sequence: Synthetic oligonucleotide
  Target: ATXN1; (+) strand; PAM type: YTN; PAM sequence: TTT
ccaacttcatttctacttct

SEQ ID NO: 269693 - DNA, 20 bp, Artificial Sequence
  Description of Artificial Sequence: Synthetic oligonucleotide
  Target: ATXN1; (+) strand; PAM type: YTN; PAM sequence: TTC
caacttcatttctacttctc

SEQ ID NO: 269694 - DNA, 20 bp, Artificial Sequence
  Description of Artificial Sequence: Synthetic oligonucleotide
  Target: ATXN1; (+) strand; PAM type: YTN; PAM sequence: CTT
catttctacttctcccctca

SEQ ID NO: 269695 - DNA, 20 bp, Artificial Sequence
  Description of Artificial Sequence: Synthetic oligonucleotide
  Target: ATXN1; (+) strand; PAM type: YTN; PAM sequence: TTC
atttctacttctcccctcat

SEQ ID NO: 269696 - DNA, 20 bp, Artificial Sequence
  Description of Artificial Sequence: Synthetic oligonucleotide
  Target: ATXN1; (+) strand; PAM type: YTN; PAM sequence: TTT
ctacttctcccctcatgcac

SEQ ID NO: 269697 - DNA, 20 bp, Artificial Sequence
  Description of Artificial Sequence: Synthetic oligonucleotide
  Target: ATXN1; (+) strand; PAM type: YTN; PAM sequence: TTC
tacttctcccctcatgcaca

SEQ ID NO: 269698 - DNA, 20 bp, Artificial Sequence
  Description of Artificial Sequence: Synthetic oligonucleotide
  Target: ATXN1; (+) strand; PAM type: YTN; PAM sequence: CTA
cttctcccctcatgcacact

SEQ ID NO: 269699 - DNA, 20 bp, Artificial Sequence
  Description of Artificial Sequence: Synthetic oligonucleotide
  Target: ATXN1; (+) strand; PAM type: YTN; PAM sequence: CTT
ctcccctcatgcacactgaa

SEQ ID NO: 269700 - DNA, 20 bp, Artificial Sequence
  Description of Artificial Sequence: Synthetic oligonucleotide
  Target: ATXN1; (+) strand; PAM type: YTN; PAM sequence: TTC
tcccctcatgcacactgaag

SEQ ID NO: 269701 - DNA, 20 bp, Artificial Sequence
  Description of Artificial Sequence: Synthetic oligonucleotide
  Target: ATXN1; (+) strand; PAM type: YTN; PAM sequence: CTC
ccctcatgcacactgaagca

SEQ ID NO: 269702 - DNA, 20 bp, Artificial Sequence
  Description of Artificial Sequence: Synthetic oligonucleotide
  Target: ATXN1; (+) strand; PAM type: YTN; PAM sequence: CTC
atgcacactgaagcagccac

SEQ ID NO: 269703 - DNA, 20 bp, Artificial Sequence
  Description of Artificial Sequence: Synthetic oligonucleotide
  Target: ATXN1; (+) strand; PAM type: YTN; PAM sequence: CTG
aagcagccacagtgagcttc

SEQ ID NO: 269704 - DNA, 20 bp, Artificial Sequence
  Description of Artificial Sequence: Synthetic oligonucleotide
  Target: ATXN1; (+) strand; PAM type: YTN; PAM sequence: CTT
ctcacttcctctctgagagc

SEQ ID NO: 269705 - DNA, 20 bp, Artificial Sequence
  Description of Artificial Sequence: Synthetic oligonucleotide
  Target: ATXN1; (+) strand; PAM type: YTN; PAM sequence: TTC
tcacttcctctctgagagcc

SEQ ID NO: 269706 - DNA, 20 bp, Artificial Sequence
  Description of Artificial Sequence: Synthetic oligonucleotide
  Target: ATXN1; (+) strand; PAM type: YTN; PAM sequence: CTC
acttcctctctgagagcccg

SEQ ID NO: 269707 - DNA, 20 bp, Artificial Sequence
  Description of Artificial Sequence: Synthetic oligonucleotide
  Target: ATXN1; (+) strand; PAM type: YTN; PAM sequence: CTT
cctctctgagagcccgcatt

SEQ ID NO: 269708 - DNA, 20 bp, Artificial Sequence
  Description of Artificial Sequence: Synthetic oligonucleotide
  Target: ATXN1; (+) strand; PAM type: YTN; PAM sequence: TTC
ctctctgagagcccgcattt

SEQ ID NO: 269709 - DNA, 20 bp, Artificial Sequence
  Description of Artificial Sequence: Synthetic oligonucleotide
  Target: ATXN1; (+) strand; PAM type: YTN; PAM sequence: CTC
tctgagagcccgcatttcta

SEQ ID NO: 269710 - DNA, 20 bp, Artificial Sequence
  Description of Artificial Sequence: Synthetic oligonucleotide
  Target: ATXN1; (+) strand; PAM type: YTN; PAM sequence: CTC
tgagagcccgcatttctact

SEQ ID NO: 269711 - DNA, 20 bp, Artificial Sequence
  Description of Artificial Sequence: Synthetic oligonucleotide
  Target: ATXN1; (+) strand; PAM type: YTN; PAM sequence: CTG
agagcccgcatttctactcc

SEQ ID NO: 269712 - DNA, 20 bp, Artificial Sequence
  Description of Artificial Sequence: Synthetic oligonucleotide
  Target: ATXN1; (+) strand; PAM type: YTN; PAM sequence: TTT
ctactccacgtgtcaaaatg

SEQ ID NO: 269713 - DNA, 20 bp, Artificial Sequence
  Description of Artificial Sequence: Synthetic oligonucleotide
  Target: ATXN1; (+) strand; PAM type: YTN; PAM sequence: TTC
tactccacgtgtcaaaatgt

SEQ ID NO: 269714 - DNA, 20 bp, Artificial Sequence
  Description of Artificial Sequence: Synthetic oligonucleotide
  Target: ATXN1; (+) strand; PAM type: YTN; PAM sequence: CTA
ctccacgtgtcaaaatgtaa

SEQ ID NO: 269715 - DNA, 20 bp, Artificial Sequence
  Description of Artificial Sequence: Synthetic oligonucleotide
  Target: ATXN1; (+) strand; PAM type: YTN; PAM sequence: CTC
cacgtgtcaaaatgtaagcc

SEQ ID NO: 269716 - DNA, 20 bp, Artificial Sequence
  Description of Artificial Sequence: Synthetic oligonucleotide
  Target: ATXN1; (+) strand; PAM type: YTN; PAM sequence: CTC
ccaagaccagctcaaatccc

SEQ ID NO: 269717 - DNA, 20 bp, Artificial Sequence
  Description of Artificial Sequence: Synthetic oligonucleotide
  Target: ATXN1; (+) strand; PAM type: YTN; PAM sequence: CTC
aaatcccactttttctacaa

SEQ ID NO: 269718 - DNA, 20 bp, Artificial Sequence
  Description of Artificial Sequence: Synthetic oligonucleotide
  Target: ATXN1; (+) strand; PAM type: YTN; PAM sequence: CTT
tttctacaactcttttatcc

SEQ ID NO: 269719 - DNA, 20 bp, Artificial Sequence
  Description of Artificial Sequence: Synthetic oligonucleotide
  Target: ATXN1; (+) strand; PAM type: YTN; PAM sequence: TTT
ttctacaactcttttatcct

SEQ ID NO: 269720 - DNA, 20 bp, Artificial Sequence
  Description of Artificial Sequence: Synthetic oligonucleotide
  Target: ATXN1; (+) strand; PAM type: YTN; PAM sequence: TTT
tctacaactcttttatcctc

SEQ ID NO: 269721 - DNA, 20 bp, Artificial Sequence
  Description of Artificial Sequence: Synthetic oligonucleotide
  Target: ATXN1; (+) strand; PAM type: YTN; PAM sequence: TTT
ctacaactcttttatcctct

SEQ ID NO: 269722 - DNA, 20 bp, Artificial Sequence
  Description of Artificial Sequence: Synthetic oligonucleotide
  Target: ATXN1; (+) strand; PAM type: YTN; PAM sequence: TTC
tacaactcttttatcctctt

SEQ ID NO: 269723 - DNA, 20 bp, Artificial Sequence
  Description of Artificial Sequence: Synthetic oligonucleotide
  Target: ATXN1; (+) strand; PAM type: YTN; PAM sequence: CTA
caactcttttatcctcttat

SEQ ID NO: 269724 - DNA, 20 bp, Artificial Sequence
  Description of Artificial Sequence: Synthetic oligonucleotide
  Target: ATXN1; (+) strand; PAM type: YTN; PAM sequence: CTC
ttttatcctcttattctaca

SEQ ID NO: 269725 - DNA, 20 bp, Artificial Sequence
  Description of Artificial Sequence: Synthetic oligonucleotide
  Target: ATXN1; (+) strand; PAM type: YTN; PAM sequence: CTT
ttatcctcttattctacaac

SEQ ID NO: 269726 - DNA, 20 bp, Artificial Sequence
  Description of Artificial Sequence: Synthetic oligonucleotide
  Target: ATXN1; (+) strand; PAM type: YTN; PAM sequence: TTT
tatcctcttattctacaact

SEQ ID NO: 269727 - DNA, 20 bp, Artificial Sequence
  Description of Artificial Sequence: Synthetic oligonucleotide
  Target: ATXN1; (+) strand; PAM type: YTN; PAM sequence: TTT
atcctcttattctacaactt

SEQ ID NO: 269728 - DNA, 20 bp, Artificial Sequence
  Description of Artificial Sequence: Synthetic oligonucleotide
  Target: ATXN1; (+) strand; PAM type: YTN; PAM sequence: TTA
tcctcttattctacaacttt

SEQ ID NO: 269729 - DNA, 20 bp, Artificial Sequence
  Description of Artificial Sequence: Synthetic oligonucleotide
  Target: ATXN1; (+) strand; PAM type: YTN; PAM sequence: CTC
ttattctacaactttctcaa

SEQ ID NO: 269730 - DNA, 20 bp, Artificial Sequence
  Description of Artificial Sequence: Synthetic oligonucleotide
  Target: ATXN1; (+) strand; PAM type: YTN; PAM sequence: CTT
attctacaactttctcaatc

SEQ ID NO: 269731 - DNA, 20 bp, Artificial Sequence
  Description of Artificial Sequence: Synthetic oligonucleotide
  Target: ATXN1; (+) strand; PAM type: YTN; PAM sequence: TTA
ttctacaactttctcaatca

SEQ ID NO: 269732 - DNA, 20 bp, Artificial Sequence
  Description of Artificial Sequence: Synthetic oligonucleotide
  Target: ATXN1; (+) strand; PAM type: YTN; PAM sequence: TTC
tacaactttctcaatcagaa

SEQ ID NO: 269733 - DNA, 20 bp, Artificial Sequence
  Description of Artificial Sequence: Synthetic oligonucleotide
  Target: ATXN1; (+) strand; PAM type: YTN; PAM sequence: CTA
caactttctcaatcagaagt

SEQ ID NO: 269734 - DNA, 20 bp, Artificial Sequence
  Description of Artificial Sequence: Synthetic oligonucleotide
  Target: ATXN1; (+) strand; PAM type: YTN; PAM sequence: CTT
tctcaatcagaagttttttt

SEQ ID NO: 269735 - DNA, 20 bp, Artificial Sequence
  Description of Artificial Sequence: Synthetic oligonucleotide
  Target: ATXN1; (+) strand; PAM type: YTN; PAM sequence: TTT
ctcaatcagaagtttttttt

SEQ ID NO: 269736 - DNA, 20 bp, Artificial Sequence
  Description of Artificial Sequence: Synthetic oligonucleotide
  Target: ATXN1; (+) strand; PAM type: YTN; PAM sequence: TTC
tcaatcagaagttttttttt

SEQ ID NO: 269737 - DNA, 20 bp, Artificial Sequence
  Description of Artificial Sequence: Synthetic oligonucleotide
  Target: ATXN1; (+) strand; PAM type: YTN; PAM sequence: CTC
aatcagaagttttttttttt

SEQ ID NO: 269738 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttggtt

SEQ ID NO: 269739 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttggttg

SEQ ID NO: 269740 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttggttgt

SEQ ID NO: 269741 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttggttgtt

SEQ ID NO: 269742 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttggttgttt

SEQ ID NO: 269743 - DNA, 20 bp, Artificial Sequence
  Description of Artificial Sequence: Synthetic oligonucleotide
  Target: ATXN1; (+) strand; PAM type: YTN; PAM sequence: TTT
tttttttttttggttgtttt

SEQ ID NO: 269744 - DNA, 20 bp, Artificial Sequence
  Description of Artificial Sequence: Synthetic oligonucleotide
  Target: ATXN1; (+) strand; PAM type: YTN; PAM sequence: TTT
ttttttttttggttgttttg

SEQ ID NO: 269745 - DNA, 20 bp, Artificial Sequence
  Description of Artificial Sequence: Synthetic oligonucleotide
  Target: ATXN1; (+) strand; PAM type: YTN; PAM sequence: TTT
tttttttttggttgttttgt

SEQ ID NO: 269746 - DNA, 20 bp, Artificial Sequence
  Description of Artificial Sequence: Synthetic oligonucleotide
  Target: ATXN1; (+) strand; PAM type: YTN; PAM sequence: TTT
ttttttttggttgttttgtt

SEQ ID NO: 269747 - DNA, 20 bp, Artificial Sequence
  Description of Artificial Sequence: Synthetic oligonucleotide
  Target: ATXN1; (+) strand; PAM type: YTN; PAM sequence: TTT
tttttttggttgttttgttt

SEQ ID NO: 269748 - DNA, 20 bp, Artificial Sequence
  Description of Artificial Sequence: Synthetic oligonucleotide
  Target: ATXN1; (+) strand; PAM type: YTN; PAM sequence: TTT
ttttttggttgttttgtttt

SEQ ID NO: 269749 - DNA, 20 bp, Artificial Sequence
  Description of Artificial Sequence: Synthetic oligonucleotide
  Target: ATXN1; (+) strand; PAM type: YTN; PAM sequence: TTT
tttttggttgttttgttttt

SEQ ID NO: 269750 - DNA, 20 bp, Artificial Sequence
  Description of Artificial Sequence: Synthetic oligonucleotide
  Target: ATXN1; (+) strand; PAM type: YTN; PAM sequence: TTT
ttttggttgttttgtttttg

SEQ ID NO: 269751 - DNA, 20 bp, Artificial Sequence
  Description of Artificial Sequence: Synthetic oligonucleotide
  Target: ATXN1; (+) strand; PAM type: YTN; PAM sequence: TTT
tttggttgttttgtttttgc

SEQ ID NO: 269752 - DNA, 20 bp, Artificial Sequence
  Description of Artificial Sequence: Synthetic oligonucleotide
  Target: ATXN1; (+) strand; PAM type: YTN; PAM sequence: TTT
ttggttgttttgtttttgca

SEQ ID NO: 269753 - DNA, 20 bp, Artificial Sequence
  Description of Artificial Sequence: Synthetic oligonucleotide
  Target: ATXN1; (+) strand; PAM type: YTN; PAM sequence: TTT
tggttgttttgtttttgcat

SEQ ID NO: 269754 - DNA, 20 bp, Artificial Sequence
  Description of Artificial Sequence: Synthetic oligonucleotide
  Target: ATXN1; (+) strand; PAM type: YTN; PAM sequence: TTT
ggttgttttgtttttgcatg

SEQ ID NO: 269755 - DNA, 20 bp, Artificial Sequence
  Description of Artificial Sequence: Synthetic oligonucleotide
  Target: ATXN1; (+) strand; PAM type: YTN; PAM sequence: TTG
gttgttttgtttttgcatgt

SEQ ID NO: 269756 - DNA, 20 bp, Artificial Sequence
  Description of Artificial Sequence: Synthetic oligonucleotide
  Target: ATXN1; (+) strand; PAM type: YTN; PAM sequence: TTG
ttttgtttttgcatgtgaat

SEQ ID NO: 269757 - DNA, 20 bp, Artificial Sequence
  Description of Artificial Sequence: Synthetic oligonucleotide
  Target: ATXN1; (+) strand; PAM type: YTN; PAM sequence: TTT
tgtttttgcatgtgaatgcc

SEQ ID NO: 269758 - DNA, 20 bp, Artificial Sequence
  Description of Artificial Sequence: Synthetic oligonucleotide
  Target: ATXN1; (+) strand; PAM type: YTN; PAM sequence: TTT
gtttttgcatgtgaatgcct

SEQ ID NO: 269759 - DNA, 20 bp, Artificial Sequence
  Description of Artificial Sequence: Synthetic oligonucleotide
  Target: ATXN1; (+) strand; PAM type: YTN; PAM sequence: TTG
tttttgcatgtgaatgccta

SEQ ID NO: 269760 - DNA, 20 bp, Artificial Sequence
  Description of Artificial Sequence: Synthetic oligonucleotide
  Target: ATXN1; (+) strand; PAM type: YTN; PAM sequence: TTT
ttgcatgtgaatgcctatgg

SEQ ID NO: 269761 - DNA, 20 bp, Artificial Sequence
  Description of Artificial Sequence: Synthetic oligonucleotide
  Target: ATXN1; (+) strand; PAM type: YTN; PAM sequence: TTT
tgcatgtgaatgcctatggt

SEQ ID NO: 269762 - DNA, 20 bp, Artificial Sequence
  Description of Artificial Sequence: Synthetic oligonucleotide
  Target: ATXN1; (+) strand; PAM type: YTN; PAM sequence: TTT
gcatgtgaatgcctatggtt

SEQ ID NO: 269763 - DNA, 20 bp, Artificial Sequence
  Description of Artificial Sequence: Synthetic oligonucleotide
  Target: ATXN1; (+) strand; PAM type: YTN; PAM sequence: TTG
catgtgaatgcctatggttt

SEQ ID NO: 269764 - DNA, 20 bp, Artificial Sequence
  Description of Artificial Sequence: Synthetic oligonucleotide
  Target: ATXN1; (+) strand; PAM type: YTN; PAM sequence: CTA
tggttttaaaattcattttc

SEQ ID NO: 269765 - DNA, 20 bp, Artificial Sequence
  Description of Artificial Sequence: Synthetic oligonucleotide
  Target: ATXN1; (+) strand; PAM type: YTN; PAM sequence: TTT
taaaattcattttccttatg

SEQ ID NO: 269766 - DNA, 20 bp, Artificial Sequence
  Description of Artificial Sequence: Synthetic oligonucleotide
  Target: ATXN1; (+) strand; PAM type: YTN; PAM sequence: TTT
aaaattcattttccttatgt

SEQ ID NO: 269767 - DNA, 20 bp, Artificial Sequence
  Description of Artificial Sequence: Synthetic oligonucleotide
  Target: ATXN1; (+) strand; PAM type: YTN; PAM sequence: TTA
aaattcattttccttatgtt

SEQ ID NO: 269768 - DNA, 20 bp, Artificial Sequence
  Description of Artificial Sequence: Synthetic oligonucleotide
  Target: ATXN1; (+) strand; PAM type: YTN; PAM sequence: TTC
attttccttatgttactaac

SEQ ID NO: 269769 - DNA, 20 bp, Artificial Sequence
  Description of Artificial Sequence: Synthetic oligonucleotide
  Target: ATXN1; (+) strand; PAM type: YTN; PAM sequence: TTT
tccttatgttactaaccatt

SEQ ID NO: 269770 - DNA, 20 bp, Artificial Sequence
  Description of Artificial Sequence: Synthetic oligonucleotide
  Target: ATXN1; (+) strand; PAM type: YTN; PAM sequence: TTT
ccttatgttactaaccattt

SEQ ID NO: 269771 - DNA, 20 bp, Artificial Sequence
  Description of Artificial Sequence: Synthetic oligonucleotide
  Target: ATXN1; (+) strand; PAM type: YTN; PAM sequence: TTC
cttatgttactaaccatttt

SEQ ID NO: 269772 - DNA, 20 bp, Artificial Sequence
  Description of Artificial Sequence: Synthetic oligonucleotide
  Target: ATXN1; (+) strand; PAM type: YTN; PAM sequence: CTT
atgttactaaccattttatt

SEQ ID NO: 269773 - DNA, 20 bp, Artificial Sequence
  Description of Artificial Sequence: Synthetic oligonucleotide
  Target: ATXN1; (+) strand; PAM type: YTN; PAM sequence: TTA
tgttactaaccattttattc

SEQ ID NO: 269774 - DNA, 20 bp, Artificial Sequence
  Description of Artificial Sequence: Synthetic oligonucleotide
  Target: ATXN1; (+) strand; PAM type: YTN; PAM sequence: TTA
ctaaccattttattccttat

SEQ ID NO: 269775 - DNA, 20 bp, Artificial Sequence
  Description of Artificial Sequence: Synthetic oligonucleotide
  Target: ATXN1; (+) strand; PAM type: YTN; PAM sequence: CTA
accattttattccttatcct

SEQ ID NO: 269776 - DNA, 20 bp, Artificial Sequence
  Description of Artificial Sequence: Synthetic oligonucleotide
  Target: ATXN1; (+) strand; PAM type: YTN; PAM sequence: TTT
tattccttatcctacaatag

SEQ ID NO: 269777 - DNA, 20 bp, Artificial Sequence
  Description of Artificial Sequence: Synthetic oligonucleotide
  Target: ATXN1; (+) strand; PAM type: YTN; PAM sequence: TTT
attccttatcctacaatagg

SEQ ID NO: 269778 - DNA, 20 bp, Artificial Sequence
  Description of Artificial Sequence: Synthetic oligonucleotide
  Target: ATXN1; (+) strand; PAM type: YTN; PAM sequence: TTA
ttccttatcctacaataggt

SEQ ID NO: 269779 - DNA, 20 bp, Artificial Sequence
  Description of Artificial Sequence: Synthetic oligonucleotide
  Target: ATXN1; (+) strand; PAM type: YTN; PAM sequence: TTC
cttatcctacaataggtgtc

SEQ ID NO: 269780 - DNA, 20 bp, Artificial Sequence
  Description of Artificial Sequence: Synthetic oligonucleotide
  Target: ATXN1; (+) strand; PAM type: YTN; PAM sequence: CTT
atcctacaataggtgtcatc

SEQ ID NO: 269781 - DNA, 20 bp, Artificial Sequence
  Description of Artificial Sequence: Synthetic oligonucleotide
  Target: ATXN1; (+) strand; PAM type: YTN; PAM sequence: TTA
tcctacaataggtgtcatct

SEQ ID NO: 269782 - DNA, 20 bp, Artificial Sequence
  Description of Artificial Sequence: Synthetic oligonucleotide
  Target: ATXN1; (+) strand; PAM type: YTN; PAM sequence: CTA
caataggtgtcatctcccca

SEQ ID NO: 269783 - DNA, 20 bp, Artificial Sequence
  Description of Artificial Sequence: Synthetic oligonucleotide
  Target: ATXN1; (+) strand; PAM type: YTN; PAM sequence: CTC
cccaagtggaatgtggtaac

SEQ ID NO: 269784 - DNA, 20 bp, Artificial Sequence
  Description of Artificial Sequence: Synthetic oligonucleotide
  Target: ATXN1; (+) strand; PAM type: YTN; PAM sequence: CTT
ccgtaaaggtagggtttatg

SEQ ID NO: 269785 - DNA, 20 bp, Artificial Sequence
  Description of Artificial Sequence: Synthetic oligonucleotide
  Target: ATXN1; (+) strand; PAM type: YTN; PAM sequence: TTC
cgtaaaggtagggtttatgt

SEQ ID NO: 269786 - DNA, 20 bp, Artificial Sequence
  Description of Artificial Sequence: Synthetic oligonucleotide
  Target: ATXN1; (+) strand; PAM type: YTN; PAM sequence: TTT
atgtctgtcttctttttgta

SEQ ID NO: 269787 - DNA, 20 bp, Artificial Sequence
  Description of Artificial Sequence: Synthetic oligonucleotide
  Target: ATXN1; (+) strand; PAM type: YTN; PAM sequence: TTA
tgtctgtcttctttttgtaa

SEQ ID NO: 269788 - DNA, 20 bp, Artificial Sequence
  Description of Artificial Sequence: Synthetic oligonucleotide
  Target: ATXN1; (+) strand; PAM type: YTN; PAM sequence: CTG
tcttctttttgtaagcttca

SEQ ID NO: 269789 - DNA, 20 bp, Artificial Sequence
  Description of Artificial Sequence: Synthetic oligonucleotide
  Target: ATXN1; (+) strand; PAM type: YTN; PAM sequence: CTT
ctttttgtaagcttcacggg

SEQ ID NO: 269790 - DNA, 20 bp, Artificial Sequence
  Description of Artificial Sequence: Synthetic oligonucleotide
  Target: ATXN1; (+) strand; PAM type: YTN; PAM sequence: TTC
tttttgtaagcttcacgggg

SEQ ID NO: 269791 - DNA, 20 bp, Artificial Sequence
  Description of Artificial Sequence: Synthetic oligonucleotide
  Target: ATXN1; (+) strand; PAM type: YTN; PAM sequence: CTT
tttgtaagcttcacggggct

SEQ ID NO: 269792 - DNA, 20 bp, Artificial Sequence
  Description of Artificial Sequence: Synthetic oligonucleotide
  Target: ATXN1; (+) strand; PAM type: YTN; PAM sequence: TTT
ttgtaagcttcacggggctt

SEQ ID NO: 269793 - DNA, 20 bp, Artificial Sequence
  Description of Artificial Sequence: Synthetic oligonucleotide
  Target: ATXN1; (+) strand; PAM type: YTN; PAM sequence: TTT
tgtaagcttcacggggcttt

SEQ ID NO: 269794 - DNA, 20 bp, Artificial Sequence
  Description of Artificial Sequence: Synthetic oligonucleotide
  Target: ATXN1; (+) strand; PAM type: YTN; PAM sequence: TTT
gtaagcttcacggggctttc

SEQ ID NO: 269795 - DNA, 20 bp, Artificial Sequence
  Description of Artificial Sequence: Synthetic oligonucleotide
  Target: ATXN1; (+) strand; PAM type: YTN; PAM sequence: TTG
taagcttcacggggctttcg

SEQ ID NO: 269796 - DNA, 20 bp, Artificial Sequence
  Description of Artificial Sequence: Synthetic oligonucleotide
  Target: ATXN1; (+) strand; PAM type: YTN; PAM sequence: CTT
cacggggctttcgcaaatga

SEQ ID NO: 269797 - DNA, 20 bp, Artificial Sequence
  Description of Artificial Sequence: Synthetic oligonucleotide
  Target: ATXN1; (+) strand; PAM type: YTN; PAM sequence: TTC
acggggctttcgcaaatgat

SEQ ID NO: 269798 - DNA, 20 bp, Artificial Sequence
  Description of Artificial Sequence: Synthetic oligonucleotide
  Target: ATXN1; (+) strand; PAM type: YTN; PAM sequence: CTT
tcgcaaatgataactctttg

SEQ ID NO: 269799 - DNA, 20 bp, Artificial Sequence
  Description of Artificial Sequence: Synthetic oligonucleotide
  Target: ATXN1; (+) strand; PAM type: YTN; PAM sequence: TTT
cgcaaatgataactctttga

SEQ ID NO: 269800 - DNA, 20 bp, Artificial Sequence
  Description of Artificial Sequence: Synthetic oligonucleotide
  Target: ATXN1; (+) strand; PAM type: YTN; PAM sequence: TTC
gcaaatgataactctttgat

SEQ ID NO: 269801 - DNA, 20 bp, Artificial Sequence
  Description of Artificial Sequence: Synthetic oligonucleotide
  Target: ATXN1; (+) strand; PAM type: YTN; PAM sequence: CTC
tttgatcaatatttgttgat

SEQ ID NO: 269802 - DNA, 20 bp, Artificial Sequence
  Description of Artificial Sequence: Synthetic oligonucleotide
  Target: ATXN1; (+) strand; PAM type: YTN; PAM sequence: CTT
tgatcaatatttgttgatta

SEQ ID NO: 269803 - DNA, 20 bp, Artificial Sequence
  Description of Artificial Sequence: Synthetic oligonucleotide
  Target: ATXN1; (+) strand; PAM type: YTN; PAM sequence: TTT
gatcaatatttgttgattaa

SEQ ID NO: 269804 - DNA, 20 bp, Artificial Sequence
  Description of Artificial Sequence: Synthetic oligonucleotide
  Target: ATXN1; (+) strand; PAM type: YTN; PAM sequence: TTG
atcaatatttgttgattaac

SEQ ID NO: 269805 - DNA, 20 bp, Artificial Sequence
  Description of Artificial Sequence: Synthetic oligonucleotide
  Target: ATXN1; (+) strand; PAM type: YTN; PAM sequence: TTT
gttgattaactgattgataa

SEQ ID NO: 269806 - DNA, 20 bp, Artificial Sequence
  Description of Artificial Sequence: Synthetic oligonucleotide
  Target: ATXN1; (+) strand; PAM type: YTN; PAM sequence: TTG
ttgattaactgattgataac

SEQ ID NO: 269807 - DNA, 20 bp, Artificial Sequence
  Description of Artificial Sequence: Synthetic oligonucleotide
  Target: ATXN1; (+) strand; PAM type: YTN; PAM sequence: TTG
attaactgattgataacatg

SEQ ID NO: 269808 - DNA, 20 bp, Artificial Sequence
  Description of Artificial Sequence: Synthetic oligonucleotide
  Target: ATXN1; (+) strand; PAM type: YTN; PAM sequence: TTA
actgattgataacatggtat

SEQ ID NO: 269809 - DNA, 20 bp, Artificial Sequence
  Description of Artificial Sequence: Synthetic oligonucleotide
  Target: ATXN1; (+) strand; PAM type: YTN; PAM sequence: CTG
attgataacatggtattata

SEQ ID NO: 269810 - DNA, 20 bp, Artificial Sequence
  Description of Artificial Sequence: Synthetic oligonucleotide
  Target: ATXN1; (+) strand; PAM type: YTN; PAM sequence: TTG
ataacatggtattatattac

SEQ ID NO: 269811 - DNA, 20 bp, Artificial Sequence
  Description of Artificial Sequence: Synthetic oligonucleotide
  Target: ATXN1; (+) strand; PAM type: YTN; PAM sequence: TTA
tattacattatacttgaaga

SEQ ID NO: 269812 - DNA, 20 bp, Artificial Sequence
  Description of Artificial Sequence: Synthetic oligonucleotide
  Target: ATXN1; (+) strand; PAM type: YTN; PAM sequence: TTA
cattatacttgaagacgtta

SEQ ID NO: 269813 - DNA, 20 bp, Artificial Sequence
  Description of Artificial Sequence: Synthetic oligonucleotide
  Target: ATXN1; (+) strand; PAM type: YTN; PAM sequence: TTA
tacttgaagacgttatatgt

SEQ ID NO: 269814 - DNA, 20 bp, Artificial Sequence
  Description of Artificial Sequence: Synthetic oligonucleotide
  Target: ATXN1; (+) strand; PAM type: YTN; PAM sequence: CTT
gaagacgttatatgtctttg

SEQ ID NO: 269815 - DNA, 20 bp, Artificial Sequence
  Description of Artificial Sequence: Synthetic oligonucleotide
  Target: ATXN1; (+) strand; PAM type: YTN; PAM sequence: TTG
aagacgttatatgtctttga

SEQ ID NO: 269816 - DNA, 20 bp, Artificial Sequence
  Description of Artificial Sequence: Synthetic oligonucleotide
  Target: ATXN1; (+) strand; PAM type: YTN; PAM sequence: TTA
tatgtctttgagtctctgtc

SEQ ID NO: 269817 - DNA, 20 bp, Artificial Sequence
  Description of Artificial Sequence: Synthetic oligonucleotide
  Target: ATXN1; (+) strand; PAM type: YTN; PAM sequence: CTT
tgagtctctgtcctccatgg

SEQ ID NO: 269818 - DNA, 20 bp, Artificial Sequence
  Description of Artificial Sequence: Synthetic oligonucleotide
  Target: ATXN1; (+) strand; PAM type: YTN; PAM sequence: TTT
gagtctctgtcctccatgga

SEQ ID NO: 269819 - DNA, 20 bp, Artificial Sequence
  Description of Artificial Sequence: Synthetic oligonucleotide
  Target: ATXN1; (+) strand; PAM type: YTN; PAM sequence: TTG
agtctctgtcctccatggaa

SEQ ID NO: 269820 - DNA, 20 bp, Artificial Sequence
  Description of Artificial Sequence: Synthetic oligonucleotide
  Target: ATXN1; (+) strand; PAM type: YTN; PAM sequence: CTC
tgtcctccatggaagaggac

SEQ ID NO: 269821 - DNA, 20 bp, Artificial Sequence
  Description of Artificial Sequence: Synthetic oligonucleotide
  Target: ATXN1; (+) strand; PAM type: YTN; PAM sequence: CTG
tcctccatggaagaggacag

SEQ ID NO: 269822 - DNA, 20 bp, Artificial Sequence
  Description of Artificial Sequence: Synthetic oligonucleotide
  Target: ATXN1; (+) strand; PAM type: YTN; PAM sequence: CTC
catggaagaggacaggtgtt

SEQ ID NO: 269823 - DNA, 20 bp, Artificial Sequence
  Description of Artificial Sequence: Synthetic oligonucleotide
  Target: ATXN1; (+) strand; PAM type: YTN; PAM sequence: TTC
aaatggaagaacaccctttt

SEQ ID NO: 269824 - DNA, 20 bp, Artificial Sequence
  Description of Artificial Sequence: Synthetic oligonucleotide
  Target: ATXN1; (+) strand; PAM type: YTN; PAM sequence: CTT
ttgggtgacttggagaaaaa

SEQ ID NO: 269825 - DNA, 20 bp, Artificial Sequence
  Description of Artificial Sequence: Synthetic oligonucleotide
  Target: ATXN1; (+) strand; PAM type: YTN; PAM sequence: TTT
tgggtgacttggagaaaaat

SEQ ID NO: 269826 - DNA, 20 bp, Artificial Sequence
  Description of Artificial Sequence: Synthetic oligonucleotide
  Target: ATXN1; (+) strand; PAM type: YTN; PAM sequence: TTT
gggtgacttggagaaaaatc

SEQ ID NO: 269827 - DNA, 20 bp, Artificial Sequence
  Description of Artificial Sequence: Synthetic oligonucleotide
  Target: ATXN1; (+) strand; PAM type: YTN; PAM sequence: TTG
ggtgacttggagaaaaatca

SEQ ID NO: 269828 - DNA, 20 bp, Artificial Sequence
  Description of Artificial Sequence: Synthetic oligonucleotide
  Target: ATXN1; (+) strand; PAM type: YTN; PAM sequence: CTT
ggagaaaaatcatcacataa

SEQ ID NO: 269829 - DNA, 20 bp, Artificial Sequence
  Description of Artificial Sequence: Synthetic oligonucleotide
  Target: ATXN1; (+) strand; PAM type: YTN; PAM sequence: TTG
gagaaaaatcatcacataag

SEQ ID NO: 269830 - DNA, 20 bp, Artificial Sequence
  Description of Artificial Sequence: Synthetic oligonucleotide
  Target: ATXN1; (+) strand; PAM type: YTN; PAM sequence: CTC
taaggaaactgtgcagtccc

SEQ ID NO: 269831 - DNA, 20 bp, Artificial Sequence
  Description of Artificial Sequence: Synthetic oligonucleotide
  Target: ATXN1; (+) strand; PAM type: YTN; PAM sequence: CTA
aggaaactgtgcagtccctc

SEQ ID NO: 269832 - DNA, 20 bp, Artificial Sequence
  Description of Artificial Sequence: Synthetic oligonucleotide
  Target: ATXN1; (+) strand; PAM type: YTN; PAM sequence: CTG
tgcagtccctcaatgaaatg

SEQ ID NO: 269833 - DNA, 20 bp, Artificial Sequence
  Description of Artificial Sequence: Synthetic oligonucleotide
  Target: ATXN1; (+) strand; PAM type: YTN; PAM sequence: CTC
aatgaaatgttccacaacag

SEQ ID NO: 269834 - DNA, 20 bp, Artificial Sequence
  Description of Artificial Sequence: Synthetic oligonucleotide
  Target: ATXN1; (+) strand; PAM type: YTN; PAM sequence: TTC
cacaacagcctctttttcca

SEQ ID NO: 269835 - DNA, 20 bp, Artificial Sequence
  Description of Artificial Sequence: Synthetic oligonucleotide
  Target: ATXN1; (+) strand; PAM type: YTN; PAM sequence: CTC
tttttccaactcagaactaa

SEQ ID NO: 269836 - DNA, 20 bp, Artificial Sequence
  Description of Artificial Sequence: Synthetic oligonucleotide
  Target: ATXN1; (+) strand; PAM type: YTN; PAM sequence: CTT
tttccaactcagaactaaag

SEQ ID NO: 269837 - DNA, 20 bp, Artificial Sequence
  Description of Artificial Sequence: Synthetic oligonucleotide
  Target: ATXN1; (+) strand; PAM type: YTN; PAM sequence: TTT
ttccaactcagaactaaagg

SEQ ID NO: 269838 - DNA, 20 bp, Artificial Sequence
  Description of Artificial Sequence: Synthetic oligonucleotide
  Target: ATXN1; (+) strand; PAM type: YTN; PAM sequence: TTT
tccaactcagaactaaaggt

SEQ ID NO: 269839 - DNA, 20 bp, Artificial Sequence
  Description of Artificial Sequence: Synthetic oligonucleotide
  Target: ATXN1; (+) strand; PAM type: YTN; PAM sequence: TTT
ccaactcagaactaaaggta

SEQ ID NO: 269840 - DNA, 20 bp, Artificial Sequence
  Description of Artificial Sequence: Synthetic oligonucleotide
  Target: ATXN1; (+) strand; PAM type: YTN; PAM sequence: TTC
caactcagaactaaaggtaa

SEQ ID NO: 269841 - DNA, 20 bp, Artificial Sequence
  Description of Artificial Sequence: Synthetic oligonucleotide
  Target: ATXN1; (+) strand; PAM type: YTN; PAM sequence: CTC
agaactaaaggtaactcttt

SEQ ID NO: 269842 - DNA, 20 bp, Artificial Sequence
  Description of Artificial Sequence: Synthetic oligonucleotide
  Target: ATXN1; (+) strand; PAM type: YTN; PAM sequence: CTA
aaggtaactctttgtatttc

SEQ ID NO: 269843 - DNA, 20 bp, Artificial Sequence
  Description of Artificial Sequence: Synthetic oligonucleotide
  Target: ATXN1; (+) strand; PAM type: YTN; PAM sequence: CTC
tttgtatttcctttctgagg

SEQ ID NO: 269844 - DNA, 20 bp, Artificial Sequence
  Description of Artificial Sequence: Synthetic oligonucleotide
  Target: ATXN1; (+) strand; PAM type: YTN; PAM sequence: CTT
tgtatttcctttctgaggaa

SEQ ID NO: 269845 - DNA, 20 bp, Artificial Sequence
  Description of Artificial Sequence: Synthetic oligonucleotide
  Target: ATXN1; (+) strand; PAM type: YTN; PAM sequence: TTT
gtatttcctttctgaggaat

SEQ ID NO: 269846 - DNA, 20 bp, Artificial Sequence
  Description of Artificial Sequence: Synthetic oligonucleotide
  Target: ATXN1; (+) strand; PAM type: YTN; PAM sequence: TTG
tatttcctttctgaggaata

SEQ ID NO: 269847 - DNA, 20 bp, Artificial Sequence
  Description of Artificial Sequence: Synthetic oligonucleotide
  Target: ATXN1; (+) strand; PAM type: YTN; PAM sequence: TTT
cctttctgaggaataaagag

SEQ ID NO: 269848 - DNA, 20 bp, Artificial Sequence
  Description of Artificial Sequence: Synthetic oligonucleotide
  Target: ATXN1; (+) strand; PAM type: YTN; PAM sequence: TTC
ctttctgaggaataaagaga

SEQ ID NO: 269849 - DNA, 20 bp, Artificial Sequence
  Description of Artificial Sequence: Synthetic oligonucleotide
  Target: ATXN1; (+) strand; PAM type: YTN; PAM sequence: CTT
tctgaggaataaagagaagc

SEQ ID NO: 269850 - DNA, 20 bp, Artificial Sequence
  Description of Artificial Sequence: Synthetic oligonucleotide
  Target: ATXN1; (+) strand; PAM type: YTN; PAM sequence: TTT
ctgaggaataaagagaagct

SEQ ID NO: 269851 - DNA, 20 bp, Artificial Sequence
  Description of Artificial Sequence: Synthetic oligonucleotide
  Target: ATXN1; (+) strand; PAM type: YTN; PAM sequence: TTC
tgaggaataaagagaagctg

SEQ ID NO: 269852 - DNA, 20 bp, Artificial Sequence
  Description of Artificial Sequence: Synthetic oligonucleotide
  Target: ATXN1; (+) strand; PAM type: YTN; PAM sequence: CTG
aggaataaagagaagctgcc

SEQ ID NO: 269853 - DNA, 20 bp, Artificial Sequence
  Description of Artificial Sequence: Synthetic oligonucleotide
  Target: ATXN1; (+) strand; PAM type: YTN; PAM sequence: CTG
ccagggctgctggcaattgc

SEQ ID NO: 269854 - DNA, 20 bp, Artificial Sequence
  Description of Artificial Sequence: Synthetic oligonucleotide
  Target: ATXN1; (+) strand; PAM type: YTN; PAM sequence: CTG
ctggcaattgcagagttcag

SEQ ID NO: 269855 - DNA, 20 bp, Artificial Sequence
  Description of Artificial Sequence: Synthetic oligonucleotide
  Target: ATXN1; (+) strand; PAM type: YTN; PAM sequence: CTG
gcaattgcagagttcagaaa

SEQ ID NO: 269856 - DNA, 20 bp, Artificial Sequence
  Description of Artificial Sequence: Synthetic oligonucleotide
  Target: ATXN1; (+) strand; PAM type: YTN; PAM sequence: TTG
cagagttcagaaatgcttcc

SEQ ID NO: 269857 - DNA, 20 bp, Artificial Sequence
  Description of Artificial Sequence: Synthetic oligonucleotide
  Target: ATXN1; (+) strand; PAM type: YTN; PAM sequence: TTC
agaaatgcttcctctgaatg

SEQ ID NO: 269858 - DNA, 20 bp, Artificial Sequence
  Description of Artificial Sequence: Synthetic oligonucleotide
  Target: ATXN1; (+) strand; PAM type: YTN; PAM sequence: CTT
cctctgaatgagcacactca

SEQ ID NO: 269859 - DNA, 20 bp, Artificial Sequence
  Description of Artificial Sequence: Synthetic oligonucleotide
  Target: ATXN1; (+) strand; PAM type: YTN; PAM sequence: TTC
ctctgaatgagcacactcag

SEQ ID NO: 269860 - DNA, 20 bp, Artificial Sequence
  Description of Artificial Sequence: Synthetic oligonucleotide
  Target: ATXN1; (+) strand; PAM type: YTN; PAM sequence: CTC
tgaatgagcacactcagccc

SEQ ID NO: 269861 - DNA, 20 bp, Artificial Sequence
  Description of Artificial Sequence: Synthetic oligonucleotide
  Target: ATXN1; (+) strand; PAM type: YTN; PAM sequence: CTG
aatgagcacactcagcccag

SEQ ID NO: 269862 - DNA, 20 bp, Artificial Sequence
  Description of Artificial Sequence: Synthetic oligonucleotide
  Target: ATXN1; (+) strand; PAM type: YTN; PAM sequence: CTC
agcccagcagggtgcagagc

SEQ ID NO: 269863 - DNA, 20 bp, Artificial Sequence
  Description of Artificial Sequence: Synthetic oligonucleotide
  Target: ATXN1; (+) strand; PAM type: YTN; PAM sequence: CTG
tctccaccctgcccaccaag

SEQ ID NO: 269864 - DNA, 20 bp, Artificial Sequence
  Description of Artificial Sequence: Synthetic oligonucleotide
  Target: ATXN1; (+) strand; PAM type: YTN; PAM sequence: CTC
caccctgcccaccaaggagc

SEQ ID NO: 269865 - DNA, 20 bp, Artificial Sequence
  Description of Artificial Sequence: Synthetic oligonucleotide
  Target: ATXN1; (+) strand; PAM type: YTN; PAM sequence: CTG
cccaccaaggagcttaagtg

SEQ ID NO: 269866 - DNA, 20 bp, Artificial Sequence
  Description of Artificial Sequence: Synthetic oligonucleotide
  Target: ATXN1; (+) strand; PAM type: YTN; PAM sequence: CTT
aagtggcaggcaaactgggc

SEQ ID NO: 269867 - DNA, 20 bp, Artificial Sequence
  Description of Artificial Sequence: Synthetic oligonucleotide
  Target: ATXN1; (+) strand; PAM type: YTN; PAM sequence: TTA
agtggcaggcaaactgggcc

SEQ ID NO: 269868 - DNA, 20 bp, Artificial Sequence
  Description of Artificial Sequence: Synthetic oligonucleotide
  Target: ATXN1; (+) strand; PAM type: YTN; PAM sequence: CTG
ggccaaaaacacccctttcc

SEQ ID NO: 269869 - DNA, 20 bp, Artificial Sequence
  Description of Artificial Sequence: Synthetic oligonucleotide
  Target: ATXN1; (+) strand; PAM type: YTN; PAM sequence: CTT
tcccatggagaggcatctcc

SEQ ID NO: 269870 - DNA, 20 bp, Artificial Sequence
  Description of Artificial Sequence: Synthetic oligonucleotide
  Target: ATXN1; (+) strand; PAM type: YTN; PAM sequence: TTT
cccatggagaggcatctcca

SEQ ID NO: 269871 - DNA, 20 bp, Artificial Sequence
  Description of Artificial Sequence: Synthetic oligonucleotide
  Target: ATXN1; (+) strand; PAM type: YTN; PAM sequence: TTC
ccatggagaggcatctccag

SEQ ID NO: 269872 - DNA, 20 bp, Artificial Sequence
  Description of Artificial Sequence: Synthetic oligonucleotide
  Target: ATXN1; (+) strand; PAM type: YTN; PAM sequence: CTC
cagtgcagggctggactgag

SEQ ID NO: 269873 - DNA, 20 bp, Artificial Sequence
  Description of Artificial Sequence: Synthetic oligonucleotide
  Target: ATXN1; (+) strand; PAM type: YTN; PAM sequence: CTG
gactgagaggcatctccagt

SEQ ID NO: 269874 - DNA, 20 bp, Artificial Sequence
  Description of Artificial Sequence: Synthetic oligonucleotide
  Target: ATXN1; (+) strand; PAM type: YTN; PAM sequence: CTG
agaggcatctccagtgcagg

SEQ ID NO: 269875 - DNA, 20 bp, Artificial Sequence
  Description of Artificial Sequence: Synthetic oligonucleotide
  Target: ATXN1; (+) strand; PAM type: YTN; PAM sequence: CTC
cagtgcagggctggactgag

SEQ ID NO: 269876 - DNA, 20 bp, Artificial Sequence
  Description of Artificial Sequence: Synthetic oligonucleotide
  Target: ATXN1; (+) strand; PAM type: YTN; PAM sequence: CTG
gactgagaggcatctccagt

SEQ ID NO: 269877 - DNA, 20 bp, Artificial Sequence
  Description of Artificial Sequence: Synthetic oligonucleotide
  Target: ATXN1; (+) strand; PAM type: YTN; PAM sequence: CTG
agaggcatctccagtgcagg

SEQ ID NO: 269878 - DNA, 20 bp, Artificial Sequence
  Description of Artificial Sequence: Synthetic oligonucleotide
  Target: ATXN1; (+) strand; PAM type: YTN; PAM sequence: CTC
cagtgcagggctggactgag

SEQ ID NO: 269879 - DNA, 20 bp, Artificial Sequence
  Description of Artificial Sequence: Synthetic oligonucleotide
  Target: ATXN1; (+) strand; PAM type: YTN; PAM sequence: CTG
gactgagagtccagttagac

SEQ ID NO: 269880 - DNA, 20 bp, Artificial Sequence
  Description of Artificial Sequence: Synthetic oligonucleotide
  Target: ATXN1; (+) strand; PAM type: YTN; PAM sequence: CTG
agagtccagttagacctcaa

SEQ ID NO: 269881 - DNA, 20 bp, Artificial Sequence
  Description of Artificial Sequence: Synthetic oligonucleotide
  Target: ATXN1; (+) strand; PAM type: YTN; PAM sequence: TTA
gacctcaagaagagttggag

SEQ ID NO: 269882 - DNA, 20 bp, Artificial Sequence
  Description of Artificial Sequence: Synthetic oligonucleotide
  Target: ATXN1; (+) strand; PAM type: YTN; PAM sequence: CTC
aagaagagttggagggaggt

SEQ ID NO: 269883 - DNA, 20 bp, Artificial Sequence
  Description of Artificial Sequence: Synthetic oligonucleotide
  Target: ATXN1; (+) strand; PAM type: YTN; PAM sequence: TTG
gagggaggtcagcgtgggag

SEQ ID NO: 269884 - DNA, 20 bp, Artificial Sequence
  Description of Artificial Sequence: Synthetic oligonucleotide
  Target: ATXN1; (+) strand; PAM type: YTN; PAM sequence: CTC
aaggtattctgaagaatatg

SEQ ID NO: 269885 - DNA, 20 bp, Artificial Sequence
  Description of Artificial Sequence: Synthetic oligonucleotide
  Target: ATXN1; (+) strand; PAM type: YTN; PAM sequence: TTC
tgaagaatatgatttattca

SEQ ID NO: 269886 - DNA, 20 bp, Artificial Sequence
  Description of Artificial Sequence: Synthetic oligonucleotide
  Target: ATXN1; (+) strand; PAM type: YTN; PAM sequence: CTG
aagaatatgatttattcaca

SEQ ID NO: 269887 - DNA, 20 bp, Artificial Sequence
  Description of Artificial Sequence: Synthetic oligonucleotide
  Target: ATXN1; (+) strand; PAM type: YTN; PAM sequence: TTT
attcacaatatcatgcgttc

SEQ ID NO: 269888 - DNA, 20 bp, Artificial Sequence
  Description of Artificial Sequence: Synthetic oligonucleotide
  Target: ATXN1; (+) strand; PAM type: YTN; PAM sequence: TTA
ttcacaatatcatgcgttcc

SEQ ID NO: 269889 - DNA, 20 bp, Artificial Sequence
  Description of Artificial Sequence: Synthetic oligonucleotide
  Target: ATXN1; (+) strand; PAM type: YTN; PAM sequence: TTC
acaatatcatgcgttccctg

SEQ ID NO: 269890 - DNA, 20 bp, Artificial Sequence
  Description of Artificial Sequence: Synthetic oligonucleotide
  Target: ATXN1; (+) strand; PAM type: YTN; PAM sequence: TTC
cctgttcagtcaacatttga

SEQ ID NO: 269891 - DNA, 20 bp, Artificial Sequence
  Description of Artificial Sequence: Synthetic oligonucleotide
  Target: ATXN1; (+) strand; PAM type: YTN; PAM sequence: CTG
ttcagtcaacatttgatcat

SEQ ID NO: 269892 - DNA, 20 bp, Artificial Sequence
  Description of Artificial Sequence: Synthetic oligonucleotide
  Target: ATXN1; (+) strand; PAM type: YTN; PAM sequence: TTC
agtcaacatttgatcattta

SEQ ID NO: 269893 - DNA, 20 bp, Artificial Sequence
  Description of Artificial Sequence: Synthetic oligonucleotide
  Target: ATXN1; (+) strand; PAM type: YTN; PAM sequence: TTT
gatcatttatgggagttatc

SEQ ID NO: 269894 - DNA, 20 bp, Artificial Sequence
  Description of Artificial Sequence: Synthetic oligonucleotide
  Target: ATXN1; (+) strand; PAM type: YTN; PAM sequence: TTG
atcatttatgggagttatcc

SEQ ID NO: 269895 - DNA, 20 bp, Artificial Sequence
  Description of Artificial Sequence: Synthetic oligonucleotide
  Target: ATXN1; (+) strand; PAM type: YTN; PAM sequence: TTT
atgggagttatccattgtaa

SEQ ID NO: 269896 - DNA, 20 bp, Artificial Sequence
  Description of Artificial Sequence: Synthetic oligonucleotide
  Target: ATXN1; (+) strand; PAM type: YTN; PAM sequence: TTA
tgggagttatccattgtaaa

SEQ ID NO: 269897 - DNA, 20 bp, Artificial Sequence
  Description of Artificial Sequence: Synthetic oligonucleotide
  Target: ATXN1; (+) strand; PAM type: YTN; PAM sequence: TTA
tccattgtaaaatttcttac

SEQ ID NO: 269898 - DNA, 20 bp, Artificial Sequence
  Description of Artificial Sequence: Synthetic oligonucleotide
  Target: ATXN1; (+) strand; PAM type: YTN; PAM sequence: TTG
taaaatttcttacaaactgg

SEQ ID NO: 269899 - DNA, 20 bp, Artificial Sequence
  Description of Artificial Sequence: Synthetic oligonucleotide
  Target: ATXN1; (+) strand; PAM type: YTN; PAM sequence: TTT
cttacaaactggcagtcctt

SEQ ID NO: 269900 - DNA, 20 bp, Artificial Sequence
  Description of Artificial Sequence: Synthetic oligonucleotide
  Target: ATXN1; (+) strand; PAM type: YTN; PAM sequence: TTC
ttacaaactggcagtccttg

SEQ ID NO: 269901 - DNA, 20 bp, Artificial Sequence
  Description of Artificial Sequence: Synthetic oligonucleotide
  Target: ATXN1; (+) strand; PAM type: YTN; PAM sequence: CTT
acaaactggcagtccttgga

SEQ ID NO: 269902 - DNA, 20 bp, Artificial Sequence
  Description of Artificial Sequence: Synthetic oligonucleotide
  Target: ATXN1; (+) strand; PAM type: YTN; PAM sequence: TTA
caaactggcagtccttggat

SEQ ID NO: 269903 - DNA, 20 bp, Artificial Sequence
  Description of Artificial Sequence: Synthetic oligonucleotide
  Target: ATXN1; (+) strand; PAM type: YTN; PAM sequence: CTG
gcagtccttggatacctagc

SEQ ID NO: 269904 - DNA, 20 bp, Artificial Sequence
  Description of Artificial Sequence: Synthetic oligonucleotide
  Target: ATXN1; (+) strand; PAM type: YTN; PAM sequence: CTT
ggatacctagcatgcactca

SEQ ID NO: 269905 - DNA, 20 bp, Artificial Sequence
  Description of Artificial Sequence: Synthetic oligonucleotide
  Target: ATXN1; (+) strand; PAM type: YTN; PAM sequence: TTG
gatacctagcatgcactcag

SEQ ID NO: 269906 - DNA, 20 bp, Artificial Sequence
  Description of Artificial Sequence: Synthetic oligonucleotide
  Target: ATXN1; (+) strand; PAM type: YTN; PAM sequence: CTA
gcatgcactcagaatattct

SEQ ID NO: 269907 - DNA, 20 bp, Artificial Sequence
  Description of Artificial Sequence: Synthetic oligonucleotide
  Target: ATXN1; (+) strand; PAM type: YTN; PAM sequence: CTC
agaatattctctgtgtatat

SEQ ID NO: 269908 - DNA, 20 bp, Artificial Sequence
  Description of Artificial Sequence: Synthetic oligonucleotide
  Target: ATXN1; (+) strand; PAM type: YTN; PAM sequence: TTC
tctgtgtatattaactggtt

SEQ ID NO: 269909 - DNA, 20 bp, Artificial Sequence
  Description of Artificial Sequence: Synthetic oligonucleotide
  Target: ATXN1; (+) strand; PAM type: YTN; PAM sequence: CTC
tgtgtatattaactggtttg

SEQ ID NO: 269910 - DNA, 20 bp, Artificial Sequence
  Description of Artificial Sequence: Synthetic oligonucleotide
  Target: ATXN1; (+) strand; PAM type: YTN; PAM sequence: CTG
tgtatattaactggtttgtg

SEQ ID NO: 269911 - DNA, 20 bp, Artificial Sequence
  Description of Artificial Sequence: Synthetic oligonucleotide
  Target: ATXN1; (+) strand; PAM type: YTN; PAM sequence: TTA
actggtttgtgttcaaggaa

SEQ ID NO: 269912 - DNA, 20 bp, Artificial Sequence
  Description of Artificial Sequence: Synthetic oligonucleotide
  Target: ATXN1; (+) strand; PAM type: YTN; PAM sequence: CTG
gtttgtgttcaaggaataaa

SEQ ID NO: 269913 - DNA, 20 bp, Artificial Sequence
  Description of Artificial Sequence: Synthetic oligonucleotide
  Target: ATXN1; (+) strand; PAM type: YTN; PAM sequence: TTT
gtgttcaaggaataaaatcc

SEQ ID NO: 269914 - DNA, 20 bp, Artificial Sequence
  Description of Artificial Sequence: Synthetic oligonucleotide
  Target: ATXN1; (+) strand; PAM type: YTN; PAM sequence: TTG
tgttcaaggaataaaatcca

SEQ ID NO: 269915 - DNA, 20 bp, Artificial Sequence
  Description of Artificial Sequence: Synthetic oligonucleotide
  Target: ATXN1; (+) strand; PAM type: YTN; PAM sequence: TTC
aaggaataaaatccaaaatt

SEQ ID NO: 269916 - DNA, 20 bp, Artificial Sequence
  Description of Artificial Sequence: Synthetic oligonucleotide
  Target: ATXN1; (+) strand; PAM type: YTN; PAM sequence: TTA
gtaccggcctaaagaacaca

SEQ ID NO: 269917 - DNA, 20 bp, Artificial Sequence
  Description of Artificial Sequence: Synthetic oligonucleotide
  Target: ATXN1; (+) strand; PAM type: YTN; PAM sequence: CTA
aagaacacattatcagagat

SEQ ID NO: 269918 - DNA, 20 bp, Artificial Sequence
  Description of Artificial Sequence: Synthetic oligonucleotide
  Target: ATXN1; (+) strand; PAM type: YTN; PAM sequence: TTA
tcagagataaatatgctgga

SEQ ID NO: 269919 - DNA, 20 bp, Artificial Sequence
  Description of Artificial Sequence: Synthetic oligonucleotide
  Target: ATXN1; (+) strand; PAM type: YTN; PAM sequence: CTG
gaaaaatgtctatcctcaaa

SEQ ID NO: 269920 - DNA, 20 bp, Artificial Sequence
  Description of Artificial Sequence: Synthetic oligonucleotide
  Target: ATXN1; (+) strand; PAM type: YTN; PAM sequence: CTA
tcctcaaaggttttttaaaa

SEQ ID NO: 269921 - DNA, 20 bp, Artificial Sequence
  Description of Artificial Sequence: Synthetic oligonucleotide
  Target: ATXN1; (+) strand; PAM type: YTN; PAM sequence: CTC
aaaggttttttaaaaaaatt

SEQ ID NO: 269922 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaattatatttca

SEQ ID NO: 269923 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaattatatttcat

SEQ ID NO: 269924 - DNA, 20 bp, Artificial Sequence
  Description of Artificial Sequence: Synthetic oligonucleotide
  Target: ATXN1; (+) strand; PAM type: YTN; PAM sequence: TTT
taaaaaaattatatttcatg

SEQ ID NO: 269925 - DNA, 20 bp, Artificial Sequence
  Description of Artificial Sequence: Synthetic oligonucleotide
  Target: ATXN1; (+) strand; PAM type: YTN; PAM sequence: TTT
aaaaaaattatatttcatgt

SEQ ID NO: 269926 - DNA, 20 bp, Artificial Sequence
  Description of Artificial Sequence: Synthetic oligonucleotide
  Target: ATXN1; (+) strand; PAM type: YTN; PAM sequence: TTA
aaaaaattatatttcatgtt

SEQ ID NO: 269927 - DNA, 20 bp, Artificial Sequence
  Description of Artificial Sequence: Synthetic oligonucleotide
  Target: ATXN1; (+) strand; PAM type: YTN; PAM sequence: TTA
tatttcatgttgatccatgt

SEQ ID NO: 269928 - DNA, 20 bp, Artificial Sequence
  Description of Artificial Sequence: Synthetic oligonucleotide
  Target: ATXN1; (+) strand; PAM type: YTN; PAM sequence: TTT
catgttgatccatgtcactg

SEQ ID NO: 269929 - DNA, 20 bp, Artificial Sequence
  Description of Artificial Sequence: Synthetic oligonucleotide
  Target: ATXN1; (+) strand; PAM type: YTN; PAM sequence: TTC
atgttgatccatgtcactgc

SEQ ID NO: 269930 - DNA, 20 bp, Artificial Sequence
  Description of Artificial Sequence: Synthetic oligonucleotide
  Target: ATXN1; (+) strand; PAM type: YTN; PAM sequence: TTG
atccatgtcactgcttctta

SEQ ID NO: 269931 - DNA, 20 bp, Artificial Sequence
  Description of Artificial Sequence: Synthetic oligonucleotide
  Target: ATXN1; (+) strand; PAM type: YTN; PAM sequence: CTG
cttcttatcattagcatggc

SEQ ID NO: 269932 - DNA, 20 bp, Artificial Sequence
  Description of Artificial Sequence: Synthetic oligonucleotide
  Target: ATXN1; (+) strand; PAM type: YTN; PAM sequence: CTT
cttatcattagcatggctta

SEQ ID NO: 269933 - DNA, 20 bp, Artificial Sequence
  Description of Artificial Sequence: Synthetic oligonucleotide
  Target: ATXN1; (+) strand; PAM type: YTN; PAM sequence: TTC
ttatcattagcatggcttat

SEQ ID NO: 269934 - DNA, 20 bp, Artificial Sequence
  Description of Artificial Sequence: Synthetic oligonucleotide
  Target: ATXN1; (+) strand; PAM type: YTN; PAM sequence: CTT
atcattagcatggcttatca

SEQ ID NO: 269935 - DNA, 20 bp, Artificial Sequence
  Description of Artificial Sequence: Synthetic oligonucleotide
  Target: ATXN1; (+) strand; PAM type: YTN; PAM sequence: TTA
tcattagcatggcttatcac

SEQ ID NO: 269936 - DNA, 20 bp, Artificial Sequence
  Description of Artificial Sequence: Synthetic oligonucleotide
  Target: ATXN1; (+) strand; PAM type: YTN; PAM sequence: TTA
gcatggcttatcacataaag

SEQ ID NO: 269937 - DNA, 20 bp, Artificial Sequence
  Description of Artificial Sequence: Synthetic oligonucleotide
  Target: ATXN1; (+) strand; PAM type: YTN; PAM sequence: CTT
atcacataaaggtaaggatt

SEQ ID NO: 269938 - DNA, 20 bp, Artificial Sequence
  Description of Artificial Sequence: Synthetic oligonucleotide
  Target: ATXN1; (+) strand; PAM type: YTN; PAM sequence: TTA
tcacataaaggtaaggattt

SEQ ID NO: 269939 - DNA, 20 bp, Artificial Sequence
  Description of Artificial Sequence: Synthetic oligonucleotide
  Target: ATXN1; (+) strand; PAM type: YTN; PAM sequence: TTT
attcatacagagactgctgc

SEQ ID NO: 269940 - DNA, 20 bp, Artificial Sequence
  Description of Artificial Sequence: Synthetic oligonucleotide
  Target: ATXN1; (+) strand; PAM type: YTN; PAM sequence: TTA
ttcatacagagactgctgct

SEQ ID NO: 269941 - DNA, 20 bp, Artificial Sequence
  Description of Artificial Sequence: Synthetic oligonucleotide
  Target: ATXN1; (+) strand; PAM type: YTN; PAM sequence: TTC
atacagagactgctgctgtg

SEQ ID NO: 269942 - DNA, 20 bp, Artificial Sequence
  Description of Artificial Sequence: Synthetic oligonucleotide
  Target: ATXN1; (+) strand; PAM type: YTN; PAM sequence: CTG
ctgctgtgtgtatttgtatg

SEQ ID NO: 269943 - DNA, 20 bp, Artificial Sequence
  Description of Artificial Sequence: Synthetic oligonucleotide
  Target: ATXN1; (+) strand; PAM type: YTN; PAM sequence: CTG
ctgtgtgtatttgtatgcag

SEQ ID NO: 269944 - DNA, 20 bp, Artificial Sequence
  Description of Artificial Sequence: Synthetic oligonucleotide
  Target: ATXN1; (+) strand; PAM type: YTN; PAM sequence: CTG
tgtgtatttgtatgcaggtt

SEQ ID NO: 269945 - DNA, 20 bp, Artificial Sequence
  Description of Artificial Sequence: Synthetic oligonucleotide
  Target: ATXN1; (+) strand; PAM type: YTN; PAM sequence: TTT
gtatgcaggttacatctcct

SEQ ID NO: 269946 - DNA, 20 bp, Artificial Sequence
  Description of Artificial Sequence: Synthetic oligonucleotide
  Target: ATXN1; (+) strand; PAM type: YTN; PAM sequence: TTG
tatgcaggttacatctcctt

SEQ ID NO: 269947 - DNA, 20 bp, Artificial Sequence
  Description of Artificial Sequence: Synthetic oligonucleotide
  Target: ATXN1; (+) strand; PAM type: YTN; PAM sequence: TTA
catctccttatggacgtagt

SEQ ID NO: 269948 - DNA, 20 bp, Artificial Sequence
  Description of Artificial Sequence: Synthetic oligonucleotide
  Target: ATXN1; (+) strand; PAM type: YTN; PAM sequence: CTC
cttatggacgtagtgcaaag

SEQ ID NO: 269949 - DNA, 20 bp, Artificial Sequence
  Description of Artificial Sequence: Synthetic oligonucleotide
  Target: ATXN1; (+) strand; PAM type: YTN; PAM sequence: CTT
atggacgtagtgcaaagttt

SEQ ID NO: 269950 - DNA, 20 bp, Artificial Sequence
  Description of Artificial Sequence: Synthetic oligonucleotide
  Target: ATXN1; (+) strand; PAM type: YTN; PAM sequence: TTA
tggacgtagtgcaaagtttg

SEQ ID NO: 269951 - DNA, 20 bp, Artificial Sequence
  Description of Artificial Sequence: Synthetic oligonucleotide
  Target: ATXN1; (+) strand; PAM type: YTN; PAM sequence: TTT
gctatgaaatataattatac

SEQ ID NO: 269952 - DNA, 20 bp, Artificial Sequence
  Description of Artificial Sequence: Synthetic oligonucleotide
  Target: ATXN1; (+) strand; PAM type: YTN; PAM sequence: TTG
ctatgaaatataattataca

SEQ ID NO: 269953 - DNA, 20 bp, Artificial Sequence
  Description of Artificial Sequence: Synthetic oligonucleotide
  Target: ATXN1; (+) strand; PAM type: YTN; PAM sequence: CTA
tgaaatataattatacattg

SEQ ID NO: 269954 - DNA, 20 bp, Artificial Sequence
  Description of Artificial Sequence: Synthetic oligonucleotide
  Target: ATXN1; (+) strand; PAM type: YTN; PAM sequence: TTA
tacattggagaaaagtatgt

SEQ ID NO: 269955 - DNA, 20 bp, Artificial Sequence
  Description of Artificial Sequence: Synthetic oligonucleotide
  Target: ATXN1; (+) strand; PAM type: YTN; PAM sequence: TTG
gagaaaagtatgtctgcata

SEQ ID NO: 269956 - DNA, 20 bp, Artificial Sequence
  Description of Artificial Sequence: Synthetic oligonucleotide
  Target: ATXN1; (+) strand; PAM type: YTN; PAM sequence: CTG
catatcaagaataaaatgaa

SEQ ID NO: 269957 - DNA, 20 bp, Artificial Sequence
  Description of Artificial Sequence: Synthetic oligonucleotide
  Target: ATXN1; (+) strand; PAM type: YTN; PAM sequence: TTG
aacatatagatgataaatac

SEQ ID NO: 269958 - DNA, 20 bp, Artificial Sequence
  Description of Artificial Sequence: Synthetic oligonucleotide
  Target: ATXN1; (+) strand; PAM type: YTN; PAM sequence: CTG
tgctgagcagctgtagaacg

SEQ ID NO: 269959 - DNA, 20 bp, Artificial Sequence
  Description of Artificial Sequence: Synthetic oligonucleotide
  Target: ATXN1; (+) strand; PAM type: YTN; PAM sequence: CTG
agcagctgtagaacgacgtc

SEQ ID NO: 269960 - DNA, 20 bp, Artificial Sequence
  Description of Artificial Sequence: Synthetic oligonucleotide
  Target: ATXN1; (+) strand; PAM type: YTN; PAM sequence: CTG
tagaacgacgtctcaggaaa

SEQ ID NO: 269961 - DNA, 20 bp, Artificial Sequence
  Description of Artificial Sequence: Synthetic oligonucleotide
  Target: ATXN1; (+) strand; PAM type: YTN; PAM sequence: CTC
aggaaattagtattttaaag

SEQ ID NO: 269962 - DNA, 20 bp, Artificial Sequence
  Description of Artificial Sequence: Synthetic oligonucleotide
  Target: ATXN1; (+) strand; PAM type: YTN; PAM sequence: TTA
gtattttaaagacaagatgt

SEQ ID NO: 269963 - DNA, 20 bp, Artificial Sequence
  Description of Artificial Sequence: Synthetic oligonucleotide
  Target: ATXN1; (+) strand; PAM type: YTN; PAM sequence: TTT
taaagacaagatgtcatgtg

SEQ ID NO: 269964 - DNA, 20 bp, Artificial Sequence
  Description of Artificial Sequence: Synthetic oligonucleotide
  Target: ATXN1; (+) strand; PAM type: YTN; PAM sequence: TTT
aaagacaagatgtcatgtgc

SEQ ID NO: 269965 - DNA, 20 bp, Artificial Sequence
  Description of Artificial Sequence: Synthetic oligonucleotide
  Target: ATXN1; (+) strand; PAM type: YTN; PAM sequence: TTA
aagacaagatgtcatgtgct

SEQ ID NO: 269966 - DNA, 20 bp, Artificial Sequence
  Description of Artificial Sequence: Synthetic oligonucleotide
  Target: ATXN1; (+) strand; PAM type: YTN; PAM sequence: CTC
ctattgacaacttattcctg

SEQ ID NO: 269967 - DNA, 20 bp, Artificial Sequence
  Description of Artificial Sequence: Synthetic oligonucleotide
  Target: ATXN1; (+) strand; PAM type: YTN; PAM sequence: CTA
ttgacaacttattcctggcc

SEQ ID NO: 269968 - DNA, 20 bp, Artificial Sequence
  Description of Artificial Sequence: Synthetic oligonucleotide
  Target: ATXN1; (+) strand; PAM type: YTN; PAM sequence: TTG
acaacttattcctggcctta

SEQ ID NO: 269969 - DNA, 20 bp, Artificial Sequence
  Description of Artificial Sequence: Synthetic oligonucleotide
  Target: ATXN1; (+) strand; PAM type: YTN; PAM sequence: CTT
attcctggccttatttgttc

SEQ ID NO: 269970 - DNA, 20 bp, Artificial Sequence
  Description of Artificial Sequence: Synthetic oligonucleotide
  Target: ATXN1; (+) strand; PAM type: YTN; PAM sequence: TTA
ttcctggccttatttgttca

SEQ ID NO: 269971 - DNA, 20 bp, Artificial Sequence
  Description of Artificial Sequence: Synthetic oligonucleotide
  Target: ATXN1; (+) strand; PAM type: YTN; PAM sequence: TTC
ctggccttatttgttcaaca

SEQ ID NO: 269972 - DNA, 20 bp, Artificial Sequence
  Description of Artificial Sequence: Synthetic oligonucleotide
  Target: ATXN1; (+) strand; PAM type: YTN; PAM sequence: CTG
gccttatttgttcaacacgc

SEQ ID NO: 269973 - DNA, 20 bp, Artificial Sequence
  Description of Artificial Sequence: Synthetic oligonucleotide
  Target: ATXN1; (+) strand; PAM type: YTN; PAM sequence: CTT
atttgttcaacacgcaggtc

SEQ ID NO: 269974 - DNA, 20 bp, Artificial Sequence
  Description of Artificial Sequence: Synthetic oligonucleotide
  Target: ATXN1; (+) strand; PAM type: YTN; PAM sequence: TTA
tttgttcaacacgcaggtcc

SEQ ID NO: 269975 - DNA, 20 bp, Artificial Sequence
  Description of Artificial Sequence: Synthetic oligonucleotide
  Target: ATXN1; (+) strand; PAM type: YTN; PAM sequence: TTT
gttcaacacgcaggtccttc

SEQ ID NO: 269976 - DNA, 20 bp, Artificial Sequence
  Description of Artificial Sequence: Synthetic oligonucleotide
  Target: ATXN1; (+) strand; PAM type: YTN; PAM sequence: TTG
ttcaacacgcaggtccttca

SEQ ID NO: 269977 - DNA, 20 bp, Artificial Sequence
  Description of Artificial Sequence: Synthetic oligonucleotide
  Target: ATXN1; (+) strand; PAM type: YTN; PAM sequence: TTC
aacacgcaggtccttcaggt

SEQ ID NO: 269978 - DNA, 20 bp, Artificial Sequence
  Description of Artificial Sequence: Synthetic oligonucleotide
  Target: ATXN1; (+) strand; PAM type: YTN; PAM sequence: CTT
caggtattgctgtagcacaa

SEQ ID NO: 269979 - DNA, 20 bp, Artificial Sequence
  Description of Artificial Sequence: Synthetic oligonucleotide
  Target: ATXN1; (+) strand; PAM type: YTN; PAM sequence: TTC
aggtattgctgtagcacaac

SEQ ID NO: 269980 - DNA, 20 bp, Artificial Sequence
  Description of Artificial Sequence: Synthetic oligonucleotide
  Target: ATXN1; (+) strand; PAM type: YTN; PAM sequence: TTG
ctgtagcacaacagaaagaa

SEQ ID NO: 269981 - DNA, 20 bp, Artificial Sequence
  Description of Artificial Sequence: Synthetic oligonucleotide
  Target: ATXN1; (+) strand; PAM type: YTN; PAM sequence: CTG
tagcacaacagaaagaacag

SEQ ID NO: 269982 - DNA, 20 bp, Artificial Sequence
  Description of Artificial Sequence: Synthetic oligonucleotide
  Target: ATXN1; (+) strand; PAM type: YTN; PAM sequence: CTG
ggtctagaagcccagagact

SEQ ID NO: 269983 - DNA, 20 bp, Artificial Sequence
  Description of Artificial Sequence: Synthetic oligonucleotide
  Target: ATXN1; (+) strand; PAM type: YTN; PAM sequence: CTA
gaagcccagagactccacat

SEQ ID NO: 269984 - DNA, 20 bp, Artificial Sequence
  Description of Artificial Sequence: Synthetic oligonucleotide
  Target: ATXN1; (+) strand; PAM type: YTN; PAM sequence: CTC
cacatcccgagttacacatc

SEQ ID NO: 269985 - DNA, 20 bp, Artificial Sequence
  Description of Artificial Sequence: Synthetic oligonucleotide
  Target: ATXN1; (+) strand; PAM type: YTN; PAM sequence: TTA
cacatcccctttctggttgc

SEQ ID NO: 269986 - DNA, 20 bp, Artificial Sequence
  Description of Artificial Sequence: Synthetic oligonucleotide
  Target: ATXN1; (+) strand; PAM type: YTN; PAM sequence: CTT
tctggttgccatgagtcatc

SEQ ID NO: 269987 - DNA, 20 bp, Artificial Sequence
  Description of Artificial Sequence: Synthetic oligonucleotide
  Target: ATXN1; (+) strand; PAM type: YTN; PAM sequence: TTT
ctggttgccatgagtcatca

SEQ ID NO: 269988 - DNA, 20 bp, Artificial Sequence
  Description of Artificial Sequence: Synthetic oligonucleotide
  Target: ATXN1; (+) strand; PAM type: YTN; PAM sequence: TTC
tggttgccatgagtcatcac

SEQ ID NO: 269989 - DNA, 20 bp, Artificial Sequence
  Description of Artificial Sequence: Synthetic oligonucleotide
  Target: ATXN1; (+) strand; PAM type: YTN; PAM sequence: CTG
gttgccatgagtcatcacgc

SEQ ID NO: 269990 - DNA, 20 bp, Artificial Sequence
  Description of Artificial Sequence: Synthetic oligonucleotide
  Target: ATXN1; (+) strand; PAM type: YTN; PAM sequence: TTG
ccatgagtcatcacgcacct

SEQ ID NO: 269991 - DNA, 20 bp, Artificial Sequence
  Description of Artificial Sequence: Synthetic oligonucleotide
  Target: ATXN1; (+) strand; PAM type: YTN; PAM sequence: CTT
ctgcccagaggagagtttta

SEQ ID NO: 269992 - DNA, 20 bp, Artificial Sequence
  Description of Artificial Sequence: Synthetic oligonucleotide
  Target: ATXN1; (+) strand; PAM type: YTN; PAM sequence: TTC
tgcccagaggagagttttat

SEQ ID NO: 269993 - DNA, 20 bp, Artificial Sequence
  Description of Artificial Sequence: Synthetic oligonucleotide
  Target: ATXN1; (+) strand; PAM type: YTN; PAM sequence: CTG
cccagaggagagttttattc

SEQ ID NO: 269994 - DNA, 20 bp, Artificial Sequence
  Description of Artificial Sequence: Synthetic oligonucleotide
  Target: ATXN1; (+) strand; PAM type: YTN; PAM sequence: TTT
tattcatgcctgcttgaaaa

SEQ ID NO: 269995 - DNA, 20 bp, Artificial Sequence
  Description of Artificial Sequence: Synthetic oligonucleotide
  Target: ATXN1; (+) strand; PAM type: YTN; PAM sequence: TTT
attcatgcctgcttgaaaag

SEQ ID NO: 269996 - DNA, 20 bp, Artificial Sequence
  Description of Artificial Sequence: Synthetic oligonucleotide
  Target: ATXN1; (+) strand; PAM type: YTN; PAM sequence: TTA
ttcatgcctgcttgaaaagg

SEQ ID NO: 269997 - DNA, 20 bp, Artificial Sequence
  Description of Artificial Sequence: Synthetic oligonucleotide
  Target: ATXN1; (+) strand; PAM type: YTN; PAM sequence: TTC
atgcctgcttgaaaaggtca

SEQ ID NO: 269998 - DNA, 20 bp, Artificial Sequence
  Description of Artificial Sequence: Synthetic oligonucleotide
  Target: ATXN1; (+) strand; PAM type: YTN; PAM sequence: CTG
cttgaaaaggtcagtgttta

SEQ ID NO: 269999 - DNA, 20 bp, Artificial Sequence
  Description of Artificial Sequence: Synthetic oligonucleotide
  Target: ATXN1; (+) strand; PAM type: YTN; PAM sequence: CTT
gaaaaggtcagtgtttaggt

SEQ ID NO: 270000 - DNA, 20 bp, Artificial Sequence
  Description of Artificial Sequence: Synthetic oligonucleotide
  Target: ATXN1; (+) strand; PAM type: YTN; PAM sequence: TTG
aaaaggtcagtgtttaggtg

SEQ ID NO: 270001 - DNA, 20 bp, Artificial Sequence
  Description of Artificial Sequence: Synthetic oligonucleotide
  Target: ATXN1; (+) strand; PAM type: YTN; PAM sequence: TTT
aggtgttgcagaagtgcttg

SEQ ID NO: 270002 - DNA, 20 bp, Artificial Sequence
  Description of Artificial Sequence: Synthetic oligonucleotide
  Target: ATXN1; (+) strand; PAM type: YTN; PAM sequence: TTA
ggtgttgcagaagtgcttgg

SEQ ID NO: 270003 - DNA, 20 bp, Artificial Sequence
  Description of Artificial Sequence: Synthetic oligonucleotide
  Target: ATXN1; (+) strand; PAM type: YTN; PAM sequence: TTG
cagaagtgcttggtgaaaat

SEQ ID NO: 270004 - DNA, 20 bp, Artificial Sequence
  Description of Artificial Sequence: Synthetic oligonucleotide
  Target: ATXN1; (+) strand; PAM type: YTN; PAM sequence: CTT
ggtgaaaatggggaaggctg

SEQ ID NO: 270005 - DNA, 20 bp, Artificial Sequence
  Description of Artificial Sequence: Synthetic oligonucleotide
  Target: ATXN1; (+) strand; PAM type: YTN; PAM sequence: TTG
gtgaaaatggggaaggctga

SEQ ID NO: 270006 - DNA, 20 bp, Artificial Sequence
  Description of Artificial Sequence: Synthetic oligonucleotide
  Target: ATXN1; (+) strand; PAM type: YTN; PAM sequence: CTG
aaacacagcctgtgcctcat

SEQ ID NO: 270007 - DNA, 20 bp, Artificial Sequence
  Description of Artificial Sequence: Synthetic oligonucleotide
  Target: ATXN1; (+) strand; PAM type: YTN; PAM sequence: CTG
tgcctcatgctttgataatt

SEQ ID NO: 270008 - DNA, 20 bp, Artificial Sequence
  Description of Artificial Sequence: Synthetic oligonucleotide
  Target: ATXN1; (+) strand; PAM type: YTN; PAM sequence: CTC
atgctttgataatttctgaa

SEQ ID NO: 270009 - DNA, 20 bp, Artificial Sequence
  Description of Artificial Sequence: Synthetic oligonucleotide
  Target: ATXN1; (+) strand; PAM type: YTN; PAM sequence: CTT
tgataatttctgaagcattt

SEQ ID NO: 270010 - DNA, 20 bp, Artificial Sequence
  Description of Artificial Sequence: Synthetic oligonucleotide
  Target: ATXN1; (+) strand; PAM type: YTN; PAM sequence: TTT
gataatttctgaagcattta

SEQ ID NO: 270011 - DNA, 20 bp, Artificial Sequence
  Description of Artificial Sequence: Synthetic oligonucleotide
  Target: ATXN1; (+) strand; PAM type: YTN; PAM sequence: TTG
ataatttctgaagcatttat

SEQ ID NO: 270012 - DNA, 20 bp, Artificial Sequence
  Description of Artificial Sequence: Synthetic oligonucleotide
  Target: ATXN1; (+) strand; PAM type: YTN; PAM sequence: TTT
ctgaagcatttataaatcat

SEQ ID NO: 270013 - DNA, 20 bp, Artificial Sequence
  Description of Artificial Sequence: Synthetic oligonucleotide
  Target: ATXN1; (+) strand; PAM type: YTN; PAM sequence: TTC
tgaagcatttataaatcatg

SEQ ID NO: 270014 - DNA, 20 bp, Artificial Sequence
  Description of Artificial Sequence: Synthetic oligonucleotide
  Target: ATXN1; (+) strand; PAM type: YTN; PAM sequence: CTG
aagcatttataaatcatgag

SEQ ID NO: 270015 - DNA, 20 bp, Artificial Sequence
  Description of Artificial Sequence: Synthetic oligonucleotide
  Target: ATXN1; (+) strand; PAM type: YTN; PAM sequence: TTT
ataaatcatgagcagctaag

SEQ ID NO: 270016 - DNA, 20 bp, Artificial Sequence
  Description of Artificial Sequence: Synthetic oligonucleotide
  Target: ATXN1; (+) strand; PAM type: YTN; PAM sequence: TTA
taaatcatgagcagctaagg

SEQ ID NO: 270017 - DNA, 20 bp, Artificial Sequence
  Description of Artificial Sequence: Synthetic oligonucleotide
  Target: ATXN1; (+) strand; PAM type: YTN; PAM sequence: CTA
aggtctgcaagatgctaatg

SEQ ID NO: 270018 - DNA, 20 bp, Artificial Sequence
  Description of Artificial Sequence: Synthetic oligonucleotide
  Target: ATXN1; (+) strand; PAM type: YTN; PAM sequence: CTG
caagatgctaatgtgtgcag

SEQ ID NO: 270019 - DNA, 20 bp, Artificial Sequence
  Description of Artificial Sequence: Synthetic oligonucleotide
  Target: ATXN1; (+) strand; PAM type: YTN; PAM sequence: CTA
atgtgtgcagtccagtcctc

SEQ ID NO: 270020 - DNA, 20 bp, Artificial Sequence
  Description of Artificial Sequence: Synthetic oligonucleotide
  Target: ATXN1; (+) strand; PAM type: YTN; PAM sequence: CTC
tgactttaagtctgtttcag

SEQ ID NO: 270021 - DNA, 20 bp, Artificial Sequence
  Description of Artificial Sequence: Synthetic oligonucleotide
  Target: ATXN1; (+) strand; PAM type: YTN; PAM sequence: CTG
actttaagtctgtttcagtt

SEQ ID NO: 270022 - DNA, 20 bp, Artificial Sequence
  Description of Artificial Sequence: Synthetic oligonucleotide
  Target: ATXN1; (+) strand; PAM type: YTN; PAM sequence: CTT
taagtctgtttcagttcctg

SEQ ID NO: 270023 - DNA, 20 bp, Artificial Sequence
  Description of Artificial Sequence: Synthetic oligonucleotide
  Target: ATXN1; (+) strand; PAM type: YTN; PAM sequence: TTT
aagtctgtttcagttcctgc

SEQ ID NO: 270024 - DNA, 20 bp, Artificial Sequence
  Description of Artificial Sequence: Synthetic oligonucleotide
  Target: ATXN1; (+) strand; PAM type: YTN; PAM sequence: TTA
agtctgtttcagttcctgct

SEQ ID NO: 270025 - DNA, 20 bp, Artificial Sequence
  Description of Artificial Sequence: Synthetic oligonucleotide
  Target: ATXN1; (+) strand; PAM type: YTN; PAM sequence: CTG
tttcagttcctgctctattt

SEQ ID NO: 270026 - DNA, 20 bp, Artificial Sequence
  Description of Artificial Sequence: Synthetic oligonucleotide
  Target: ATXN1; (+) strand; PAM type: YTN; PAM sequence: TTT
cagttcctgctctatttgct

SEQ ID NO: 270027 - DNA, 20 bp, Artificial Sequence
  Description of Artificial Sequence: Synthetic oligonucleotide
  Target: ATXN1; (+) strand; PAM type: YTN; PAM sequence: TTC
agttcctgctctatttgctc

SEQ ID NO: 270028 - DNA, 20 bp, Artificial Sequence
  Description of Artificial Sequence: Synthetic oligonucleotide
  Target: ATXN1; (+) strand; PAM type: YTN; PAM sequence: TTC
ctgctctatttgctcctttt

SEQ ID NO: 270029 - DNA, 20 bp, Artificial Sequence
  Description of Artificial Sequence: Synthetic oligonucleotide
  Target: ATXN1; (+) strand; PAM type: YTN; PAM sequence: CTG
ctctatttgctcctttttaa

SEQ ID NO: 270030 - DNA, 20 bp, Artificial Sequence
  Description of Artificial Sequence: Synthetic oligonucleotide
  Target: ATXN1; (+) strand; PAM type: YTN; PAM sequence: CTC
tatttgctcctttttaataa

SEQ ID NO: 270031 - DNA, 20 bp, Artificial Sequence
  Description of Artificial Sequence: Synthetic oligonucleotide
  Target: ATXN1; (+) strand; PAM type: YTN; PAM sequence: CTA
tttgctcctttttaataaca

SEQ ID NO: 270032 - DNA, 20 bp, Artificial Sequence
  Description of Artificial Sequence: Synthetic oligonucleotide
  Target: ATXN1; (+) strand; PAM type: YTN; PAM sequence: TTT
gctcctttttaataacacaa

SEQ ID NO: 270033 - DNA, 20 bp, Artificial Sequence
  Description of Artificial Sequence: Synthetic oligonucleotide
  Target: ATXN1; (+) strand; PAM type: YTN; PAM sequence: TTG
ctcctttttaataacacaat

SEQ ID NO: 270034 - DNA, 20 bp, Artificial Sequence
  Description of Artificial Sequence: Synthetic oligonucleotide
  Target: ATXN1; (+) strand; PAM type: YTN; PAM sequence: CTC
ctttttaataacacaattag

SEQ ID NO: 270035 - DNA, 20 bp, Artificial Sequence
  Description of Artificial Sequence: Synthetic oligonucleotide
  Target: ATXN1; (+) strand; PAM type: YTN; PAM sequence: CTT
tttaataacacaattagtaa

SEQ ID NO: 270036 - DNA, 20 bp, Artificial Sequence
  Description of Artificial Sequence: Synthetic oligonucleotide
  Target: ATXN1; (+) strand; PAM type: YTN; PAM sequence: TTT
ttaataacacaattagtaaa

SEQ ID NO: 270037 - DNA, 20 bp, Artificial Sequence
  Description of Artificial Sequence: Synthetic oligonucleotide
  Target: ATXN1; (+) strand; PAM type: YTN; PAM sequence: TTT
taataacacaattagtaaaa

SEQ ID NO: 270038 - DNA, 20 bp, Artificial Sequence
  Description of Artificial Sequence: Synthetic oligonucleotide
  Target: ATXN1; (+) strand; PAM type: YTN; PAM sequence: TTT
aataacacaattagtaaaaa

SEQ ID NO: 270039 - DNA, 20 bp, Artificial Sequence
  Description of Artificial Sequence: Synthetic oligonucleotide
  Target: ATXN1; (+) strand; PAM type: YTN; PAM sequence: TTA
ataacacaattagtaaaaat

SEQ ID NO: 270040 - DNA, 20 bp, Artificial Sequence
  Description of Artificial Sequence: Synthetic oligonucleotide
  Target: ATXN1; (+) strand; PAM type: YTN; PAM sequence: TTA
gtaaaaatcctaaaaaagaa

SEQ ID NO: 270041 - DNA, 20 bp, Artificial Sequence
  Description of Artificial Sequence: Synthetic oligonucleotide
  Target: ATXN1; (+) strand; PAM type: YTN; PAM sequence: CTA
aaaaagaaatagctaaatat

SEQ ID NO: 270042 - DNA, 20 bp, Artificial Sequence
  Description of Artificial Sequence: Synthetic oligonucleotide
  Target: ATXN1; (+) strand; PAM type: YTN; PAM sequence: CTA
aatattttcctctcattctc

SEQ ID NO: 270043 - DNA, 20 bp, Artificial Sequence
  Description of Artificial Sequence: Synthetic oligonucleotide
  Target: ATXN1; (+) strand; PAM type: YTN; PAM sequence: TTT
tcctctcattctctttttgc

SEQ ID NO: 270044 - DNA, 20 bp, Artificial Sequence
  Description of Artificial Sequence: Synthetic oligonucleotide
  Target: ATXN1; (+) strand; PAM type: YTN; PAM sequence: TTT
cctctcattctctttttgcc

SEQ ID NO: 270045 - DNA, 20 bp, Artificial Sequence
  Description of Artificial Sequence: Synthetic oligonucleotide
  Target: ATXN1; (+) strand; PAM type: YTN; PAM sequence: TTC
ctctcattctctttttgcca

SEQ ID NO: 270046 - DNA, 20 bp, Artificial Sequence
  Description of Artificial Sequence: Synthetic oligonucleotide
  Target: ATXN1; (+) strand; PAM type: YTN; PAM sequence: CTC
tcattctctttttgccataa

SEQ ID NO: 270047 - DNA, 20 bp, Artificial Sequence
  Description of Artificial Sequence: Synthetic oligonucleotide
  Target: ATXN1; (+) strand; PAM type: YTN; PAM sequence: CTC
attctctttttgccataata

SEQ ID NO: 270048 - DNA, 20 bp, Artificial Sequence
  Description of Artificial Sequence: Synthetic oligonucleotide
  Target: ATXN1; (+) strand; PAM type: YTN; PAM sequence: TTC
tctttttgccataatattga

SEQ ID NO: 270049 - DNA, 20 bp, Artificial Sequence
  Description of Artificial Sequence: Synthetic oligonucleotide
  Target: ATXN1; (+) strand; PAM type: YTN; PAM sequence: CTC
tttttgccataatattgaga

SEQ ID NO: 270050 - DNA, 20 bp, Artificial Sequence
  Description of Artificial Sequence: Synthetic oligonucleotide
  Target: ATXN1; (+) strand; PAM type: YTN; PAM sequence: CTT
tttgccataatattgagagt

SEQ ID NO: 270051 - DNA, 20 bp, Artificial Sequence
  Description of Artificial Sequence: Synthetic oligonucleotide
  Target: ATXN1; (+) strand; PAM type: YTN; PAM sequence: TTT
ttgccataatattgagagtt

SEQ ID NO: 270052 - DNA, 20 bp, Artificial Sequence
  Description of Artificial Sequence: Synthetic oligonucleotide
  Target: ATXN1; (+) strand; PAM type: YTN; PAM sequence: TTT
tgccataatattgagagtta

SEQ ID NO: 270053 - DNA, 20 bp, Artificial Sequence
  Description of Artificial Sequence: Synthetic oligonucleotide
  Target: ATXN1; (+) strand; PAM type: YTN; PAM sequence: TTT
gccataatattgagagttat

SEQ ID NO: 270054 - DNA, 20 bp, Artificial Sequence
  Description of Artificial Sequence: Synthetic oligonucleotide
  Target: ATXN1; (+) strand; PAM type: YTN; PAM sequence: TTG
ccataatattgagagttata

SEQ ID NO: 270055 - DNA, 20 bp, Artificial Sequence
  Description of Artificial Sequence: Synthetic oligonucleotide
  Target: ATXN1; (+) strand; PAM type: YTN; PAM sequence: TTG
agagttatatgatagtatct

SEQ ID NO: 270056 - DNA, 20 bp, Artificial Sequence
  Description of Artificial Sequence: Synthetic oligonucleotide
  Target: ATXN1; (+) strand; PAM type: YTN; PAM sequence: TTA
tatgatagtatcttcaacta

SEQ ID NO: 270057 - DNA, 20 bp, Artificial Sequence
  Description of Artificial Sequence: Synthetic oligonucleotide
  Target: ATXN1; (+) strand; PAM type: YTN; PAM sequence: CTT
caactattttatttggcctg

SEQ ID NO: 270058 - DNA, 20 bp, Artificial Sequence
  Description of Artificial Sequence: Synthetic oligonucleotide
  Target: ATXN1; (+) strand; PAM type: YTN; PAM sequence: TTC
aactattttatttggcctga

SEQ ID NO: 270059 - DNA, 20 bp, Artificial Sequence
  Description of Artificial Sequence: Synthetic oligonucleotide
  Target: ATXN1; (+) strand; PAM type: YTN; PAM sequence: CTA
ttttatttggcctgacttca

SEQ ID NO: 270060 - DNA, 20 bp, Artificial Sequence
  Description of Artificial Sequence: Synthetic oligonucleotide
  Target: ATXN1; (+) strand; PAM type: YTN; PAM sequence: TTT
tatttggcctgacttcacaa

SEQ ID NO: 270061 - DNA, 20 bp, Artificial Sequence
  Description of Artificial Sequence: Synthetic oligonucleotide
  Target: ATXN1; (+) strand; PAM type: YTN; PAM sequence: TTT
atttggcctgacttcacaaa

SEQ ID NO: 270062 - DNA, 20 bp, Artificial Sequence
  Description of Artificial Sequence: Synthetic oligonucleotide
  Target: ATXN1; (+) strand; PAM type: YTN; PAM sequence: TTA
tttggcctgacttcacaaag

SEQ ID NO: 270063 - DNA, 20 bp, Artificial Sequence
  Description of Artificial Sequence: Synthetic oligonucleotide
  Target: ATXN1; (+) strand; PAM type: YTN; PAM sequence: TTT
ggcctgacttcacaaagtac

SEQ ID NO: 270064 - DNA, 20 bp, Artificial Sequence
  Description of Artificial Sequence: Synthetic oligonucleotide
  Target: ATXN1; (+) strand; PAM type: YTN; PAM sequence: TTG
gcctgacttcacaaagtacc

SEQ ID NO: 270065 - DNA, 20 bp, Artificial Sequence
  Description of Artificial Sequence: Synthetic oligonucleotide
  Target: ATXN1; (+) strand; PAM type: YTN; PAM sequence: CTG
acttcacaaagtaccaaacg

SEQ ID NO: 270066 - DNA, 20 bp, Artificial Sequence
  Description of Artificial Sequence: Synthetic oligonucleotide
  Target: ATXN1; (+) strand; PAM type: YTN; PAM sequence: CTT
cacaaagtaccaaacgggga

SEQ ID NO: 270067 - DNA, 20 bp, Artificial Sequence
  Description of Artificial Sequence: Synthetic oligonucleotide
  Target: ATXN1; (+) strand; PAM type: YTN; PAM sequence: TTC
acaaagtaccaaacggggag

SEQ ID NO: 270068 - DNA, 20 bp, Artificial Sequence
  Description of Artificial Sequence: Synthetic oligonucleotide
  Target: ATXN1; (+) strand; PAM type: YTN; PAM sequence: CTC
ccaacctctgtccttttgaa

SEQ ID NO: 270069 - DNA, 20 bp, Artificial Sequence
  Description of Artificial Sequence: Synthetic oligonucleotide
  Target: ATXN1; (+) strand; PAM type: YTN; PAM sequence: CTC
tgtccttttgaacagacaca

SEQ ID NO: 270070 - DNA, 20 bp, Artificial Sequence
  Description of Artificial Sequence: Synthetic oligonucleotide
  Target: ATXN1; (+) strand; PAM type: YTN; PAM sequence: CTG
tccttttgaacagacacaag

SEQ ID NO: 270071 - DNA, 20 bp, Artificial Sequence
  Description of Artificial Sequence: Synthetic oligonucleotide
  Target: ATXN1; (+) strand; PAM type: YTN; PAM sequence: CTT
ttgaacagacacaagtaaca

SEQ ID NO: 270072 - DNA, 20 bp, Artificial Sequence
  Description of Artificial Sequence: Synthetic oligonucleotide
  Target: ATXN1; (+) strand; PAM type: YTN; PAM sequence: TTT
tgaacagacacaagtaacag

SEQ ID NO: 270073 - DNA, 20 bp, Artificial Sequence
  Description of Artificial Sequence: Synthetic oligonucleotide
  Target: ATXN1; (+) strand; PAM type: YTN; PAM sequence: TTT
gaacagacacaagtaacaga

SEQ ID NO: 270074 - DNA, 20 bp, Artificial Sequence
  Description of Artificial Sequence: Synthetic oligonucleotide
  Target: ATXN1; (+) strand; PAM type: YTN; PAM sequence: TTG
aacagacacaagtaacagaa

SEQ ID NO: 270075 - DNA, 20 bp, Artificial Sequence
  Description of Artificial Sequence: Synthetic oligonucleotide
  Target: ATXN1; (+) strand; PAM type: YTN; PAM sequence: TTT
accaaaagtattaaaaacac

SEQ ID NO: 270076 - DNA, 20 bp, Artificial Sequence
  Description of Artificial Sequence: Synthetic oligonucleotide
  Target: ATXN1; (+) strand; PAM type: YTN; PAM sequence: TTA
ccaaaagtattaaaaacacg

SEQ ID NO: 270077 - DNA, 20 bp, Artificial Sequence
  Description of Artificial Sequence: Synthetic oligonucleotide
  Target: ATXN1; (+) strand; PAM type: YTN; PAM sequence: TTA
aaaacacgaccttggaagca

SEQ ID NO: 270078 - DNA, 20 bp, Artificial Sequence
  Description of Artificial Sequence: Synthetic oligonucleotide
  Target: ATXN1; (+) strand; PAM type: YTN; PAM sequence: CTT
ggaagcatcctatcaaagcc

SEQ ID NO: 270079 - DNA, 20 bp, Artificial Sequence
  Description of Artificial Sequence: Synthetic oligonucleotide
  Target: ATXN1; (+) strand; PAM type: YTN; PAM sequence: TTG
gaagcatcctatcaaagcca

SEQ ID NO: 270080 - DNA, 20 bp, Artificial Sequence
  Description of Artificial Sequence: Synthetic oligonucleotide
  Target: ATXN1; (+) strand; PAM type: YTN; PAM sequence: CTA
tcaaagccacaacttccttt

SEQ ID NO: 270081 - DNA, 20 bp, Artificial Sequence
  Description of Artificial Sequence: Synthetic oligonucleotide
  Target: ATXN1; (+) strand; PAM type: YTN; PAM sequence: CTT
ccttttctttttatgaacta

SEQ ID NO: 270082 - DNA, 20 bp, Artificial Sequence
  Description of Artificial Sequence: Synthetic oligonucleotide
  Target: ATXN1; (+) strand; PAM type: YTN; PAM sequence: TTC
cttttctttttatgaactac

SEQ ID NO: 270083 - DNA, 20 bp, Artificial Sequence
  Description of Artificial Sequence: Synthetic oligonucleotide
  Target: ATXN1; (+) strand; PAM type: YTN; PAM sequence: CTT
ttctttttatgaactactac

SEQ ID NO: 270084 - DNA, 20 bp, Artificial Sequence
  Description of Artificial Sequence: Synthetic oligonucleotide
  Target: ATXN1; (+) strand; PAM type: YTN; PAM sequence: TTT
tctttttatgaactactacc

SEQ ID NO: 270085 - DNA, 20 bp, Artificial Sequence
  Description of Artificial Sequence: Synthetic oligonucleotide
  Target: ATXN1; (+) strand; PAM type: YTN; PAM sequence: TTT
ctttttatgaactactacca

SEQ ID NO: 270086 - DNA, 20 bp, Artificial Sequence
  Description of Artificial Sequence: Synthetic oligonucleotide
  Target: ATXN1; (+) strand; PAM type: YTN; PAM sequence: TTC
tttttatgaactactaccat

SEQ ID NO: 270087 - DNA, 20 bp, Artificial Sequence
  Description of Artificial Sequence: Synthetic oligonucleotide
  Target: ATXN1; (+) strand; PAM type: YTN; PAM sequence: CTT
tttatgaactactaccatgc

SEQ ID NO: 270088 - DNA, 20 bp, Artificial Sequence
  Description of Artificial Sequence: Synthetic oligonucleotide
  Target: ATXN1; (+) strand; PAM type: YTN; PAM sequence: TTT
ttatgaactactaccatgca

SEQ ID NO: 270089 - DNA, 20 bp, Artificial Sequence
  Description of Artificial Sequence: Synthetic oligonucleotide
  Target: ATXN1; (+) strand; PAM type: YTN; PAM sequence: TTT
tatgaactactaccatgcaa

SEQ ID NO: 270090 - DNA, 20 bp, Artificial Sequence
  Description of Artificial Sequence: Synthetic oligonucleotide
  Target: ATXN1; (+) strand; PAM type: YTN; PAM sequence: TTT
atgaactactaccatgcaaa

SEQ ID NO: 270091 - DNA, 20 bp, Artificial Sequence
  Description of Artificial Sequence: Synthetic oligonucleotide
  Target: ATXN1; (+) strand; PAM type: YTN; PAM sequence: TTA
tgaactactaccatgcaaaa

SEQ ID NO: 270092 - DNA, 20 bp, Artificial Sequence
  Description of Artificial Sequence: Synthetic oligonucleotide
  Target: ATXN1; (+) strand; PAM type: YTN; PAM sequence: CTA
ctaccatgcaaaattgcatg

SEQ ID NO: 270093 - DNA, 20 bp, Artificial Sequence
  Description of Artificial Sequence: Synthetic oligonucleotide
  Target: ATXN1; (+) strand; PAM type: YTN; PAM sequence: CTA
ccatgcaaaattgcatggct

SEQ ID NO: 270094 - DNA, 20 bp, Artificial Sequence
  Description of Artificial Sequence: Synthetic oligonucleotide
  Target: ATXN1; (+) strand; PAM type: YTN; PAM sequence: TTG
catggctacagctgggacat

SEQ ID NO: 270095 - DNA, 20 bp, Artificial Sequence
  Description of Artificial Sequence: Synthetic oligonucleotide
  Target: ATXN1; (+) strand; PAM type: YTN; PAM sequence: CTA
cagctgggacatcaaatcat

SEQ ID NO: 270096 - DNA, 20 bp, Artificial Sequence
  Description of Artificial Sequence: Synthetic oligonucleotide
  Target: ATXN1; (+) strand; PAM type: YTN; PAM sequence: CTG
ggacatcaaatcatgcttta

SEQ ID NO: 270097 - DNA, 20 bp, Artificial Sequence
  Description of Artificial Sequence: Synthetic oligonucleotide
  Target: ATXN1; (+) strand; PAM type: YTN; PAM sequence: CTT
taaaaaattagtattggggc

SEQ ID NO: 270098 - DNA, 20 bp, Artificial Sequence
  Description of Artificial Sequence: Synthetic oligonucleotide
  Target: ATXN1; (+) strand; PAM type: YTN; PAM sequence: TTT
aaaaaattagtattggggct

SEQ ID NO: 270099 - DNA, 20 bp, Artificial Sequence
  Description of Artificial Sequence: Synthetic oligonucleotide
  Target: ATXN1; (+) strand; PAM type: YTN; PAM sequence: TTA
aaaaattagtattggggcta

SEQ ID NO: 270100 - DNA, 20 bp, Artificial Sequence
  Description of Artificial Sequence: Synthetic oligonucleotide
  Target: ATXN1; (+) strand; PAM type: YTN; PAM sequence: TTA
gtattggggctaggcgtggt

SEQ ID NO: 270101 - DNA, 20 bp, Artificial Sequence
  Description of Artificial Sequence: Synthetic oligonucleotide
  Target: ATXN1; (+) strand; PAM type: YTN; PAM sequence: TTG
gggctaggcgtggtggctta

SEQ ID NO: 270102 - DNA, 20 bp, Artificial Sequence
  Description of Artificial Sequence: Synthetic oligonucleotide
  Target: ATXN1; (+) strand; PAM type: YTN; PAM sequence: CTA
ggcgtggtggcttacgccta

SEQ ID NO: 270103 - DNA, 20 bp, Artificial Sequence
  Description of Artificial Sequence: Synthetic oligonucleotide
  Target: ATXN1; (+) strand; PAM type: YTN; PAM sequence: CTT
acgcctataatccctgtact

SEQ ID NO: 270104 - DNA, 20 bp, Artificial Sequence
  Description of Artificial Sequence: Synthetic oligonucleotide
  Target: ATXN1; (+) strand; PAM type: YTN; PAM sequence: TTA
cgcctataatccctgtactt

SEQ ID NO: 270105 - DNA, 20 bp, Artificial Sequence
  Description of Artificial Sequence: Synthetic oligonucleotide
  Target: ATXN1; (+) strand; PAM type: YTN; PAM sequence: CTA
taatccctgtactttgggag

SEQ ID NO: 270106 - DNA, 20 bp, Artificial Sequence
  Description of Artificial Sequence: Synthetic oligonucleotide
  Target: ATXN1; (+) strand; PAM type: YTN; PAM sequence: CTG
tactttgggaggccaaggca

SEQ ID NO: 270107 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggtgg

SEQ ID NO: 270108 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggtgga

SEQ ID NO: 270109 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggtggat

SEQ ID NO: 270110 - DNA, 20 bp, Artificial Sequence
  Description of Artificial Sequence: Synthetic oligonucleotide
  Target: ATXN1; (+) strand; PAM type: YTN; PAM sequence: TTT
gaggtcaggagttcaagacc

SEQ ID NO: 270111 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacca

SEQ ID NO: 270112 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacat

SEQ ID NO: 270113 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccctg

SEQ ID NO: 270114 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 270115 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatga

SEQ ID NO: 270116 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaatgagc

SEQ ID NO: 270117 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaatgagccag

SEQ ID NO: 270118 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcacgag

SEQ ID NO: 270119 - DNA, 20 bp, Artificial Sequence
  Description of Artificial Sequence: Synthetic oligonucleotide
  Target: ATXN1; (+) strand; PAM type: YTN; PAM sequence: CTA
ctcacgaggctgaggcagga

SEQ ID NO: 270120 - DNA, 20 bp, Artificial Sequence
  Description of Artificial Sequence: Synthetic oligonucleotide
  Target: ATXN1; (+) strand; PAM type: YTN; PAM sequence: CTC
acgaggctgaggcaggagaa

SEQ ID NO: 270121 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 270122 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaagcggaggtt

SEQ ID NO: 270123 - DNA, 20 bp, Artificial Sequence
  Description of Artificial Sequence: Synthetic oligonucleotide
  Target: ATXN1; (+) strand; PAM type: YTN; PAM sequence: TTG
aacccaggaagcggaggttg

SEQ ID NO: 270124 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcatgcc

SEQ ID NO: 270125 - DNA, 20 bp, Artificial Sequence
  Description of Artificial Sequence: Synthetic oligonucleotide
  Target: ATXN1; (+) strand; PAM type: YTN; PAM sequence: CTG
cactctagcctgggtgacag

SEQ ID NO: 270126 - DNA, 20 bp, Artificial Sequence
  Description of Artificial Sequence: Synthetic oligonucleotide
  Target: ATXN1; (+) strand; PAM type: YTN; PAM sequence: CTC
tagcctgggtgacagagtga

SEQ ID NO: 270127 - DNA, 20 bp, Artificial Sequence
  Description of Artificial Sequence: Synthetic oligonucleotide
  Target: ATXN1; (+) strand; PAM type: YTN; PAM sequence: CTA
gcctgggtgacagagtgaga

SEQ ID NO: 270128 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtgagactctc

SEQ ID NO: 270129 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctcaaaaaa

SEQ ID NO: 270130 - DNA, 20 bp, Artificial Sequence
  Description of Artificial Sequence: Synthetic oligonucleotide
  Target: ATXN1; (+) strand; PAM type: YTN; PAM sequence: CTC
tctctctctctcaaaaaaaa

SEQ ID NO: 270131 - DNA, 20 bp, Artificial Sequence
  Description of Artificial Sequence: Synthetic oligonucleotide
  Target: ATXN1; (+) strand; PAM type: YTN; PAM sequence: CTC
tctctctctcaaaaaaaaaa

SEQ ID NO: 270132 - DNA, 20 bp, Artificial Sequence
  Description of Artificial Sequence: Synthetic oligonucleotide
  Target: ATXN1; (+) strand; PAM type: YTN; PAM sequence: CTC
tctctctcaaaaaaaaaaaa

SEQ ID NO: 270133 - DNA, 20 bp, Artificial Sequence
  Description of Artificial Sequence: Synthetic oligonucleotide
  Target: ATXN1; (+) strand; PAM type: YTN; PAM sequence: CTC
tctctcaaaaaaaaaaaaaa

SEQ ID NO: 270134 - DNA, 20 bp, Artificial Sequence
  Description of Artificial Sequence: Synthetic oligonucleotide
  Target: ATXN1; (+) strand; PAM type: YTN; PAM sequence: CTC
tctcaaaaaaaaaaaaaaag

SEQ ID NO: 270135 - DNA, 20 bp, Artificial Sequence
  Description of Artificial Sequence: Synthetic oligonucleotide
  Target: ATXN1; (+) strand; PAM type: YTN; PAM sequence: CTC
tcaaaaaaaaaaaaaaagtt

SEQ ID NO: 270136 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaagttat

SEQ ID NO: 270137 - DNA, 20 bp, Artificial Sequence
  Description of Artificial Sequence: Synthetic oligonucleotide
  Target: ATXN1; (+) strand; PAM type: YTN; PAM sequence: TTA
ttattggtatattagtaaaa

SEQ ID NO: 270138 - DNA, 20 bp, Artificial Sequence
  Description of Artificial Sequence: Synthetic oligonucleotide
  Target: ATXN1; (+) strand; PAM type: YTN; PAM sequence: TTA
ttggtatattagtaaaagcc

SEQ ID NO: 270139 - DNA, 20 bp, Artificial Sequence
  Description of Artificial Sequence: Synthetic oligonucleotide
  Target: ATXN1; (+) strand; PAM type: YTN; PAM sequence: TTG
gtatattagtaaaagccatt

SEQ ID NO: 270140 - DNA, 20 bp, Artificial Sequence
  Description of Artificial Sequence: Synthetic oligonucleotide
  Target: ATXN1; (+) strand; PAM type: YTN; PAM sequence: TTA
gtaaaagccattcaaagctc

SEQ ID NO: 270141 - DNA, 20 bp, Artificial Sequence
  Description of Artificial Sequence: Synthetic oligonucleotide
  Target: ATXN1; (+) strand; PAM type: YTN; PAM sequence: TTC
aaagctcaaaaacaacagaa

SEQ ID NO: 270142 - DNA, 20 bp, Artificial Sequence
  Description of Artificial Sequence: Synthetic oligonucleotide
  Target: ATXN1; (+) strand; PAM type: YTN; PAM sequence: CTC
aaaaacaacagaattatttt

SEQ ID NO: 270143 - DNA, 20 bp, Artificial Sequence
  Description of Artificial Sequence: Synthetic oligonucleotide
  Target: ATXN1; (+) strand; PAM type: YTN; PAM sequence: TTA
ttttctgaaattcaaaatca

SEQ ID NO: 270144 - DNA, 20 bp, Artificial Sequence
  Description of Artificial Sequence: Synthetic oligonucleotide
  Target: ATXN1; (+) strand; PAM type: YTN; PAM sequence: TTT
tctgaaattcaaaatcagtg

SEQ ID NO: 270145 - DNA, 20 bp, Artificial Sequence
  Description of Artificial Sequence: Synthetic oligonucleotide
  Target: ATXN1; (+) strand; PAM type: YTN; PAM sequence: TTT
ctgaaattcaaaatcagtgc

SEQ ID NO: 270146 - DNA, 20 bp, Artificial Sequence
  Description of Artificial Sequence: Synthetic oligonucleotide
  Target: ATXN1; (+) strand; PAM type: YTN; PAM sequence: TTC
tgaaattcaaaatcagtgcc

SEQ ID NO: 270147 - DNA, 20 bp, Artificial Sequence
  Description of Artificial Sequence: Synthetic oligonucleotide
  Target: ATXN1; (+) strand; PAM type: YTN; PAM sequence: CTG
aaattcaaaatcagtgccag

SEQ ID NO: 270148 - DNA, 20 bp, Artificial Sequence
  Description of Artificial Sequence: Synthetic oligonucleotide
  Target: ATXN1; (+) strand; PAM type: YTN; PAM sequence: TTC
aaaatcagtgccagatttaa

SEQ ID NO: 270149 - DNA, 20 bp, Artificial Sequence
  Description of Artificial Sequence: Synthetic oligonucleotide
  Target: ATXN1; (+) strand; PAM type: YTN; PAM sequence: TTT
aactacttttgcataatgtt

SEQ ID NO: 270150 - DNA, 20 bp, Artificial Sequence
  Description of Artificial Sequence: Synthetic oligonucleotide
  Target: ATXN1; (+) strand; PAM type: YTN; PAM sequence: TTA
actacttttgcataatgttt

SEQ ID NO: 270151 - DNA, 20 bp, Artificial Sequence
  Description of Artificial Sequence: Synthetic oligonucleotide
  Target: ATXN1; (+) strand; PAM type: YTN; PAM sequence: CTA
cttttgcataatgtttgccc

SEQ ID NO: 270152 - DNA, 20 bp, Artificial Sequence
  Description of Artificial Sequence: Synthetic oligonucleotide
  Target: ATXN1; (+) strand; PAM type: YTN; PAM sequence: CTT
ttgcataatgtttgccccca

SEQ ID NO: 270153 - DNA, 20 bp, Artificial Sequence
  Description of Artificial Sequence: Synthetic oligonucleotide
  Target: ATXN1; (+) strand; PAM type: YTN; PAM sequence: TTT
tgcataatgtttgcccccac

SEQ ID NO: 270154 - DNA, 20 bp, Artificial Sequence
  Description of Artificial Sequence: Synthetic oligonucleotide
  Target: ATXN1; (+) strand; PAM type: YTN; PAM sequence: TTT
gcataatgtttgcccccaca

SEQ ID NO: 270155 - DNA, 20 bp, Artificial Sequence
  Description of Artificial Sequence: Synthetic oligonucleotide
  Target: ATXN1; (+) strand; PAM type: YTN; PAM sequence: TTG
cataatgtttgcccccacag

SEQ ID NO: 270156 - DNA, 20 bp, Artificial Sequence
  Description of Artificial Sequence: Synthetic oligonucleotide
  Target: ATXN1; (+) strand; PAM type: YTN; PAM sequence: TTT
gcccccacagaactttccat

SEQ ID NO: 270157 - DNA, 20 bp, Artificial Sequence
  Description of Artificial Sequence: Synthetic oligonucleotide
  Target: ATXN1; (+) strand; PAM type: YTN; PAM sequence: TTG
cccccacagaactttccata

SEQ ID NO: 270158 - DNA, 20 bp, Artificial Sequence
  Description of Artificial Sequence: Synthetic oligonucleotide
  Target: ATXN1; (+) strand; PAM type: YTN; PAM sequence: CTT
tccataataatattacgtca

SEQ ID NO: 270159 - DNA, 20 bp, Artificial Sequence
  Description of Artificial Sequence: Synthetic oligonucleotide
  Target: ATXN1; (+) strand; PAM type: YTN; PAM sequence: TTT
ccataataatattacgtcaa

SEQ ID NO: 270160 - DNA, 20 bp, Artificial Sequence
  Description of Artificial Sequence: Synthetic oligonucleotide
  Target: ATXN1; (+) strand; PAM type: YTN; PAM sequence: TTC
cataataatattacgtcaac

SEQ ID NO: 270161 - DNA, 20 bp, Artificial Sequence
  Description of Artificial Sequence: Synthetic oligonucleotide
  Target: ATXN1; (+) strand; PAM type: YTN; PAM sequence: TTA
cgtcaacagcactcattttc

SEQ ID NO: 270162 - DNA, 20 bp, Artificial Sequence
  Description of Artificial Sequence: Synthetic oligonucleotide
  Target: ATXN1; (+) strand; PAM type: YTN; PAM sequence: CTC
attttctttttggtctactt

SEQ ID NO: 270163 - DNA, 20 bp, Artificial Sequence
  Description of Artificial Sequence: Synthetic oligonucleotide
  Target: ATXN1; (+) strand; PAM type: YTN; PAM sequence: TTT
tctttttggtctacttgttt

SEQ ID NO: 270164 - DNA, 20 bp, Artificial Sequence
  Description of Artificial Sequence: Synthetic oligonucleotide
  Target: ATXN1; (+) strand; PAM type: YTN; PAM sequence: TTT
ctttttggtctacttgtttt

SEQ ID NO: 270165 - DNA, 20 bp, Artificial Sequence
  Description of Artificial Sequence: Synthetic oligonucleotide
  Target: ATXN1; (+) strand; PAM type: YTN; PAM sequence: TTC
tttttggtctacttgtttta

SEQ ID NO: 270166 - DNA, 20 bp, Artificial Sequence
  Description of Artificial Sequence: Synthetic oligonucleotide
  Target: ATXN1; (+) strand; PAM type: YTN; PAM sequence: CTT
tttggtctacttgttttact

SEQ ID NO: 270167 - DNA, 20 bp, Artificial Sequence
  Description of Artificial Sequence: Synthetic oligonucleotide
  Target: ATXN1; (+) strand; PAM type: YTN; PAM sequence: TTT
ttggtctacttgttttacta

SEQ ID NO: 270168 - DNA, 20 bp, Artificial Sequence
  Description of Artificial Sequence: Synthetic oligonucleotide
  Target: ATXN1; (+) strand; PAM type: YTN; PAM sequence: TTT
tggtctacttgttttactaa

SEQ ID NO: 270169 - DNA, 20 bp, Artificial Sequence
  Description of Artificial Sequence: Synthetic oligonucleotide
  Target: ATXN1; (+) strand; PAM type: YTN; PAM sequence: TTT
ggtctacttgttttactaaa

SEQ ID NO: 270170 - DNA, 20 bp, Artificial Sequence
  Description of Artificial Sequence: Synthetic oligonucleotide
  Target: ATXN1; (+) strand; PAM type: YTN; PAM sequence: TTG
gtctacttgttttactaaat

SEQ ID NO: 270171 - DNA, 20 bp, Artificial Sequence
  Description of Artificial Sequence: Synthetic oligonucleotide
  Target: ATXN1; (+) strand; PAM type: YTN; PAM sequence: CTA
cttgttttactaaattaaaa

SEQ ID NO: 270172 - DNA, 20 bp, Artificial Sequence
  Description of Artificial Sequence: Synthetic oligonucleotide
  Target: ATXN1; (+) strand; PAM type: YTN; PAM sequence: CTT
gttttactaaattaaaagcc

SEQ ID NO: 270173 - DNA, 20 bp, Artificial Sequence
  Description of Artificial Sequence: Synthetic oligonucleotide
  Target: ATXN1; (+) strand; PAM type: YTN; PAM sequence: TTG
ttttactaaattaaaagcca

SEQ ID NO: 270174 - DNA, 20 bp, Artificial Sequence
  Description of Artificial Sequence: Synthetic oligonucleotide
  Target: ATXN1; (+) strand; PAM type: YTN; PAM sequence: TTT
tactaaattaaaagccaaca

SEQ ID NO: 270175 - DNA, 20 bp, Artificial Sequence
  Description of Artificial Sequence: Synthetic oligonucleotide
  Target: ATXN1; (+) strand; PAM type: YTN; PAM sequence: TTT
actaaattaaaagccaacag

SEQ ID NO: 270176 - DNA, 20 bp, Artificial Sequence
  Description of Artificial Sequence: Synthetic oligonucleotide
  Target: ATXN1; (+) strand; PAM type: YTN; PAM sequence: TTA
ctaaattaaaagccaacaga

SEQ ID NO: 270177 - DNA, 20 bp, Artificial Sequence
  Description of Artificial Sequence: Synthetic oligonucleotide
  Target: ATXN1; (+) strand; PAM type: YTN; PAM sequence: CTA
aattaaaagccaacagatac

SEQ ID NO: 270178 - DNA, 20 bp, Artificial Sequence
  Description of Artificial Sequence: Synthetic oligonucleotide
  Target: ATXN1; (+) strand; PAM type: YTN; PAM sequence: TTA
aaagccaacagatacaacaa

SEQ ID NO: 270179 - DNA, 20 bp, Artificial Sequence
  Description of Artificial Sequence: Synthetic oligonucleotide
  Target: ATXN1; (+) strand; PAM type: YTN; PAM sequence: CTC
catactttaaactccttttt

SEQ ID NO: 270180 - DNA, 20 bp, Artificial Sequence
  Description of Artificial Sequence: Synthetic oligonucleotide
  Target: ATXN1; (+) strand; PAM type: YTN; PAM sequence: CTT
taaactccttttttaatact

SEQ ID NO: 270181 - DNA, 20 bp, Artificial Sequence
  Description of Artificial Sequence: Synthetic oligonucleotide
  Target: ATXN1; (+) strand; PAM type: YTN; PAM sequence: TTT
aaactccttttttaatacta

SEQ ID NO: 270182 - DNA, 20 bp, Artificial Sequence
  Description of Artificial Sequence: Synthetic oligonucleotide
  Target: ATXN1; (+) strand; PAM type: YTN; PAM sequence: TTA
aactccttttttaatactat

SEQ ID NO: 270183 - DNA, 20 bp, Artificial Sequence
  Description of Artificial Sequence: Synthetic oligonucleotide
  Target: ATXN1; (+) strand; PAM type: YTN; PAM sequence: CTC
cttttttaatactattccga

SEQ ID NO: 270184 - DNA, 20 bp, Artificial Sequence
  Description of Artificial Sequence: Synthetic oligonucleotide
  Target: ATXN1; (+) strand; PAM type: YTN; PAM sequence: CTT
ttttaatactattccgagta

SEQ ID NO: 270185 - DNA, 20 bp, Artificial Sequence
  Description of Artificial Sequence: Synthetic oligonucleotide
  Target: ATXN1; (+) strand; PAM type: YTN; PAM sequence: TTT
tttaatactattccgagtaa

SEQ ID NO: 270186 - DNA, 20 bp, Artificial Sequence
  Description of Artificial Sequence: Synthetic oligonucleotide
  Target: ATXN1; (+) strand; PAM type: YTN; PAM sequence: TTT
ttaatactattccgagtaac

SEQ ID NO: 270187 - DNA, 20 bp, Artificial Sequence
  Description of Artificial Sequence: Synthetic oligonucleotide
  Target: ATXN1; (+) strand; PAM type: YTN; PAM sequence: TTT
taatactattccgagtaact

SEQ ID NO: 270188 - DNA, 20 bp, Artificial Sequence
  Description of Artificial Sequence: Synthetic oligonucleotide
  Target: ATXN1; (+) strand; PAM type: YTN; PAM sequence: TTT
aatactattccgagtaactg

SEQ ID NO: 270189 - DNA, 20 bp, Artificial Sequence
  Description of Artificial Sequence: Synthetic oligonucleotide
  Target: ATXN1; (+) strand; PAM type: YTN; PAM sequence: TTA
atactattccgagtaactgc

SEQ ID NO: 270190 - DNA, 20 bp, Artificial Sequence
  Description of Artificial Sequence: Synthetic oligonucleotide
  Target: ATXN1; (+) strand; PAM type: YTN; PAM sequence: CTA
ttccgagtaactgcctcctt

SEQ ID NO: 270191 - DNA, 20 bp, Artificial Sequence
  Description of Artificial Sequence: Synthetic oligonucleotide
  Target: ATXN1; (+) strand; PAM type: YTN; PAM sequence: TTC
cgagtaactgcctccttgtt

SEQ ID NO: 270192 - DNA, 20 bp, Artificial Sequence
  Description of Artificial Sequence: Synthetic oligonucleotide
  Target: ATXN1; (+) strand; PAM type: YTN; PAM sequence: CTG
cctccttgtttaaatattac

SEQ ID NO: 270193 - DNA, 20 bp, Artificial Sequence
  Description of Artificial Sequence: Synthetic oligonucleotide
  Target: ATXN1; (+) strand; PAM type: YTN; PAM sequence: CTC
cttgtttaaatattacaatt

SEQ ID NO: 270194 - DNA, 20 bp, Artificial Sequence
  Description of Artificial Sequence: Synthetic oligonucleotide
  Target: ATXN1; (+) strand; PAM type: YTN; PAM sequence: CTT
gtttaaatattacaattttc

SEQ ID NO: 270195 - DNA, 20 bp, Artificial Sequence
  Description of Artificial Sequence: Synthetic oligonucleotide
  Target: ATXN1; (+) strand; PAM type: YTN; PAM sequence: TTG
tttaaatattacaattttct

SEQ ID NO: 270196 - DNA, 20 bp, Artificial Sequence
  Description of Artificial Sequence: Synthetic oligonucleotide
  Target: ATXN1; (+) strand; PAM type: YTN; PAM sequence: TTT
aaatattacaattttctgac

SEQ ID NO: 270197 - DNA, 20 bp, Artificial Sequence
  Description of Artificial Sequence: Synthetic oligonucleotide
  Target: ATXN1; (+) strand; PAM type: YTN; PAM sequence: TTA
aatattacaattttctgact

SEQ ID NO: 270198 - DNA, 20 bp, Artificial Sequence
  Description of Artificial Sequence: Synthetic oligonucleotide
  Target: ATXN1; (+) strand; PAM type: YTN; PAM sequence: TTA
caattttctgactcaatcag

SEQ ID NO: 270199 - DNA, 20 bp, Artificial Sequence
  Description of Artificial Sequence: Synthetic oligonucleotide
  Target: ATXN1; (+) strand; PAM type: YTN; PAM sequence: TTT
tctgactcaatcagaacaaa

SEQ ID NO: 270200 - DNA, 20 bp, Artificial Sequence
  Description of Artificial Sequence: Synthetic oligonucleotide
  Target: ATXN1; (+) strand; PAM type: YTN; PAM sequence: TTT
ctgactcaatcagaacaaag

SEQ ID NO: 270201 - DNA, 20 bp, Artificial Sequence
  Description of Artificial Sequence: Synthetic oligonucleotide
  Target: ATXN1; (+) strand; PAM type: YTN; PAM sequence: TTC
tgactcaatcagaacaaagt

SEQ ID NO: 270202 - DNA, 20 bp, Artificial Sequence
  Description of Artificial Sequence: Synthetic oligonucleotide
  Target: ATXN1; (+) strand; PAM type: YTN; PAM sequence: CTG
actcaatcagaacaaagtat

SEQ ID NO: 270203 - DNA, 20 bp, Artificial Sequence
  Description of Artificial Sequence: Synthetic oligonucleotide
  Target: ATXN1; (+) strand; PAM type: YTN; PAM sequence: CTC
aatcagaacaaagtattgca

SEQ ID NO: 270204 - DNA, 20 bp, Artificial Sequence
  Description of Artificial Sequence: Synthetic oligonucleotide
  Target: ATXN1; (+) strand; PAM type: YTN; PAM sequence: TTG
caagacaaaggtgctattga

SEQ ID NO: 270205 - DNA, 20 bp, Artificial Sequence
  Description of Artificial Sequence: Synthetic oligonucleotide
  Target: ATXN1; (+) strand; PAM type: YTN; PAM sequence: CTA
ttgaaaacttctcttttttt

SEQ ID NO: 270206 - DNA, 20 bp, Artificial Sequence
  Description of Artificial Sequence: Synthetic oligonucleotide
  Target: ATXN1; (+) strand; PAM type: YTN; PAM sequence: TTG
aaaacttctctttttttgga

SEQ ID NO: 270207 - DNA, 20 bp, Artificial Sequence
  Description of Artificial Sequence: Synthetic oligonucleotide
  Target: ATXN1; (+) strand; PAM type: YTN; PAM sequence: CTT
ctctttttttggaggaggct

SEQ ID NO: 270208 - DNA, 20 bp, Artificial Sequence
  Description of Artificial Sequence: Synthetic oligonucleotide
  Target: ATXN1; (+) strand; PAM type: YTN; PAM sequence: TTC
tctttttttggaggaggctt

SEQ ID NO: 270209 - DNA, 20 bp, Artificial Sequence
  Description of Artificial Sequence: Synthetic oligonucleotide
  Target: ATXN1; (+) strand; PAM type: YTN; PAM sequence: CTC
tttttttggaggaggcttca

SEQ ID NO: 270210 - DNA, 20 bp, Artificial Sequence
  Description of Artificial Sequence: Synthetic oligonucleotide
  Target: ATXN1; (+) strand; PAM type: YTN; PAM sequence: CTT
tttttggaggaggcttcata

SEQ ID NO: 270211 - DNA, 20 bp, Artificial Sequence
  Description of Artificial Sequence: Synthetic oligonucleotide
  Target: ATXN1; (+) strand; PAM type: YTN; PAM sequence: TTT
ttttggaggaggcttcataa

SEQ ID NO: 270212 - DNA, 20 bp, Artificial Sequence
  Description of Artificial Sequence: Synthetic oligonucleotide
  Target: ATXN1; (+) strand; PAM type: YTN; PAM sequence: TTT
tttggaggaggcttcataaa

SEQ ID NO: 270213 - DNA, 20 bp, Artificial Sequence
  Description of Artificial Sequence: Synthetic oligonucleotide
  Target: ATXN1; (+) strand; PAM type: YTN; PAM sequence: TTT
ttggaggaggcttcataaaa

SEQ ID NO: 270214 - DNA, 20 bp, Artificial Sequence
  Description of Artificial Sequence: Synthetic oligonucleotide
  Target: ATXN1; (+) strand; PAM type: YTN; PAM sequence: TTT
tggaggaggcttcataaaag

SEQ ID NO: 270215 - DNA, 20 bp, Artificial Sequence
  Description of Artificial Sequence: Synthetic oligonucleotide
  Target: ATXN1; (+) strand; PAM type: YTN; PAM sequence: TTT
ggaggaggcttcataaaagc

SEQ ID NO: 270216 - DNA, 20 bp, Artificial Sequence
  Description of Artificial Sequence: Synthetic oligonucleotide
  Target: ATXN1; (+) strand; PAM type: YTN; PAM sequence: TTG
gaggaggcttcataaaagca

SEQ ID NO: 270217 - DNA, 20 bp, Artificial Sequence
  Description of Artificial Sequence: Synthetic oligonucleotide
  Target: ATXN1; (+) strand; PAM type: YTN; PAM sequence: CTT
cataaaagcattctagctta

SEQ ID NO: 270218 - DNA, 20 bp, Artificial Sequence
  Description of Artificial Sequence: Synthetic oligonucleotide
  Target: ATXN1; (+) strand; PAM type: YTN; PAM sequence: TTC
ataaaagcattctagcttaa

SEQ ID NO: 270219 - DNA, 20 bp, Artificial Sequence
  Description of Artificial Sequence: Synthetic oligonucleotide
  Target: ATXN1; (+) strand; PAM type: YTN; PAM sequence: TTC
tagcttaaaactgggatttc

SEQ ID NO: 270220 - DNA, 20 bp, Artificial Sequence
  Description of Artificial Sequence: Synthetic oligonucleotide
  Target: ATXN1; (+) strand; PAM type: YTN; PAM sequence: CTA
gcttaaaactgggatttcaa

SEQ ID NO: 270221 - DNA, 20 bp, Artificial Sequence
  Description of Artificial Sequence: Synthetic oligonucleotide
  Target: ATXN1; (+) strand; PAM type: YTN; PAM sequence: CTT
aaaactgggatttcaatggt

SEQ ID NO: 270222 - DNA, 20 bp, Artificial Sequence
  Description of Artificial Sequence: Synthetic oligonucleotide
  Target: ATXN1; (+) strand; PAM type: YTN; PAM sequence: TTA
aaactgggatttcaatggtc

SEQ ID NO: 270223 - DNA, 20 bp, Artificial Sequence
  Description of Artificial Sequence: Synthetic oligonucleotide
  Target: ATXN1; (+) strand; PAM type: YTN; PAM sequence: CTG
ggatttcaatggtcttaact

SEQ ID NO: 270224 - DNA, 20 bp, Artificial Sequence
  Description of Artificial Sequence: Synthetic oligonucleotide
  Target: ATXN1; (+) strand; PAM type: YTN; PAM sequence: TTT
caatggtcttaactgtgaat

SEQ ID NO: 270225 - DNA, 20 bp, Artificial Sequence
  Description of Artificial Sequence: Synthetic oligonucleotide
  Target: ATXN1; (+) strand; PAM type: YTN; PAM sequence: TTC
aatggtcttaactgtgaata

SEQ ID NO: 270226 - DNA, 20 bp, Artificial Sequence
  Description of Artificial Sequence: Synthetic oligonucleotide
  Target: ATXN1; (+) strand; PAM type: YTN; PAM sequence: CTT
aactgtgaataccatgtagc

SEQ ID NO: 270227 - DNA, 20 bp, Artificial Sequence
  Description of Artificial Sequence: Synthetic oligonucleotide
  Target: ATXN1; (+) strand; PAM type: YTN; PAM sequence: TTA
actgtgaataccatgtagca

SEQ ID NO: 270228 - DNA, 20 bp, Artificial Sequence
  Description of Artificial Sequence: Synthetic oligonucleotide
  Target: ATXN1; (+) strand; PAM type: YTN; PAM sequence: CTG
tgaataccatgtagcagaaa

SEQ ID NO: 270229 - DNA, 20 bp, Artificial Sequence
  Description of Artificial Sequence: Synthetic oligonucleotide
  Target: ATXN1; (+) strand; PAM type: YTN; PAM sequence: CTT
ggcattatatctagggatta

SEQ ID NO: 270230 - DNA, 20 bp, Artificial Sequence
  Description of Artificial Sequence: Synthetic oligonucleotide
  Target: ATXN1; (+) strand; PAM type: YTN; PAM sequence: TTG
gcattatatctagggattac

SEQ ID NO: 270231 - DNA, 20 bp, Artificial Sequence
  Description of Artificial Sequence: Synthetic oligonucleotide
  Target: ATXN1; (+) strand; PAM type: YTN; PAM sequence: TTA
tatctagggattacctgttg

SEQ ID NO: 270232 - DNA, 20 bp, Artificial Sequence
  Description of Artificial Sequence: Synthetic oligonucleotide
  Target: ATXN1; (+) strand; PAM type: YTN; PAM sequence: CTA
gggattacctgttgaaacac

SEQ ID NO: 270233 - DNA, 20 bp, Artificial Sequence
  Description of Artificial Sequence: Synthetic oligonucleotide
  Target: ATXN1; (+) strand; PAM type: YTN; PAM sequence: TTA
cctgttgaaacaccaaagac

SEQ ID NO: 270234 - DNA, 20 bp, Artificial Sequence
  Description of Artificial Sequence: Synthetic oligonucleotide
  Target: ATXN1; (+) strand; PAM type: YTN; PAM sequence: CTG
ttgaaacaccaaagacaggt

SEQ ID NO: 270235 - DNA, 20 bp, Artificial Sequence
  Description of Artificial Sequence: Synthetic oligonucleotide
  Target: ATXN1; (+) strand; PAM type: YTN; PAM sequence: TTG
aaacaccaaagacaggtata

SEQ ID NO: 270236 - DNA, 20 bp, Artificial Sequence
  Description of Artificial Sequence: Synthetic oligonucleotide
  Target: ATXN1; (+) strand; PAM type: YTN; PAM sequence: CTT
tgatgtgggttacgcagggc

SEQ ID NO: 270237 - DNA, 20 bp, Artificial Sequence
  Description of Artificial Sequence: Synthetic oligonucleotide
  Target: ATXN1; (+) strand; PAM type: YTN; PAM sequence: TTT
gatgtgggttacgcagggcc

SEQ ID NO: 270238 - DNA, 20 bp, Artificial Sequence
  Description of Artificial Sequence: Synthetic oligonucleotide
  Target: ATXN1; (+) strand; PAM type: YTN; PAM sequence: TTG
atgtgggttacgcagggccg

SEQ ID NO: 270239 - DNA, 20 bp, Artificial Sequence
  Description of Artificial Sequence: Synthetic oligonucleotide
  Target: ATXN1; (+) strand; PAM type: YTN; PAM sequence: TTA
cgcagggccgggtaagtaac

SEQ ID NO: 270240 - DNA, 20 bp, Artificial Sequence
  Description of Artificial Sequence: Synthetic oligonucleotide
  Target: ATXN1; (+) strand; PAM type: YTN; PAM sequence: TTA
ttctttctttctatgaatgt

SEQ ID NO: 270241 - DNA, 20 bp, Artificial Sequence
  Description of Artificial Sequence: Synthetic oligonucleotide
  Target: ATXN1; (+) strand; PAM type: YTN; PAM sequence: TTC
tttctttctatgaatgtggc

SEQ ID NO: 270242 - DNA, 20 bp, Artificial Sequence
  Description of Artificial Sequence: Synthetic oligonucleotide
  Target: ATXN1; (+) strand; PAM type: YTN; PAM sequence: CTT
tctttctatgaatgtggcgc

SEQ ID NO: 270243 - DNA, 20 bp, Artificial Sequence
  Description of Artificial Sequence: Synthetic oligonucleotide
  Target: ATXN1; (+) strand; PAM type: YTN; PAM sequence: TTT
ctttctatgaatgtggcgct

SEQ ID NO: 270244 - DNA, 20 bp, Artificial Sequence
  Description of Artificial Sequence: Synthetic oligonucleotide
  Target: ATXN1; (+) strand; PAM type: YTN; PAM sequence: TTC
tttctatgaatgtggcgctg

SEQ ID NO: 270245 - DNA, 20 bp, Artificial Sequence
  Description of Artificial Sequence: Synthetic oligonucleotide
  Target: ATXN1; (+) strand; PAM type: YTN; PAM sequence: CTT
tctatgaatgtggcgctgaa

SEQ ID NO: 270246 - DNA, 20 bp, Artificial Sequence
  Description of Artificial Sequence: Synthetic oligonucleotide
  Target: ATXN1; (+) strand; PAM type: YTN; PAM sequence: TTT
ctatgaatgtggcgctgaag

SEQ ID NO: 270247 - DNA, 20 bp, Artificial Sequence
  Description of Artificial Sequence: Synthetic oligonucleotide
  Target: ATXN1; (+) strand; PAM type: YTN; PAM sequence: TTC
tatgaatgtggcgctgaaga

SEQ ID NO: 270248 - DNA, 20 bp, Artificial Sequence
  Description of Artificial Sequence: Synthetic oligonucleotide
  Target: ATXN1; (+) strand; PAM type: YTN; PAM sequence: CTA
tgaatgtggcgctgaagatt

SEQ ID NO: 270249 - DNA, 20 bp, Artificial Sequence
  Description of Artificial Sequence: Synthetic oligonucleotide
  Target: ATXN1; (+) strand; PAM type: YTN; PAM sequence: CTG
aagatttgataccatatttg

SEQ ID NO: 270250 - DNA, 20 bp, Artificial Sequence
  Description of Artificial Sequence: Synthetic oligonucleotide
  Target: ATXN1; (+) strand; PAM type: YTN; PAM sequence: TTT
gataccatatttggagcaca

SEQ ID NO: 270251 - DNA, 20 bp, Artificial Sequence
  Description of Artificial Sequence: Synthetic oligonucleotide
  Target: ATXN1; (+) strand; PAM type: YTN; PAM sequence: TTG
ataccatatttggagcacag

SEQ ID NO: 270252 - DNA, 20 bp, Artificial Sequence
  Description of Artificial Sequence: Synthetic oligonucleotide
  Target: ATXN1; (+) strand; PAM type: YTN; PAM sequence: TTT
ggagcacagatccatcgtgt

SEQ ID NO: 270253 - DNA, 20 bp, Artificial Sequence
  Description of Artificial Sequence: Synthetic oligonucleotide
  Target: ATXN1; (+) strand; PAM type: YTN; PAM sequence: TTG
gagcacagatccatcgtgtg

SEQ ID NO: 270254 - DNA, 20 bp, Artificial Sequence
  Description of Artificial Sequence: Synthetic oligonucleotide
  Target: ATXN1; (+) strand; PAM type: YTN; PAM sequence: CTG
agtgtgaccacatgtccaca

SEQ ID NO: 270255 - DNA, 20 bp, Artificial Sequence
  Description of Artificial Sequence: Synthetic oligonucleotide
  Target: ATXN1; (+) strand; PAM type: YTN; PAM sequence: CTG
tctgagctcgctacaggtca

SEQ ID NO: 270256 - DNA, 20 bp, Artificial Sequence
  Description of Artificial Sequence: Synthetic oligonucleotide
  Target: ATXN1; (+) strand; PAM type: YTN; PAM sequence: CTG
agctcgctacaggtcacact

SEQ ID NO: 270257 - DNA, 20 bp, Artificial Sequence
  Description of Artificial Sequence: Synthetic oligonucleotide
  Target: ATXN1; (+) strand; PAM type: YTN; PAM sequence: CTC
gctacaggtcacactgcatc

SEQ ID NO: 270258 - DNA, 20 bp, Artificial Sequence
  Description of Artificial Sequence: Synthetic oligonucleotide
  Target: ATXN1; (+) strand; PAM type: YTN; PAM sequence: CTA
caggtcacactgcatcatga

SEQ ID NO: 270259 - DNA, 20 bp, Artificial Sequence
  Description of Artificial Sequence: Synthetic oligonucleotide
  Target: ATXN1; (+) strand; PAM type: YTN; PAM sequence: CTG
catcatgaaggaccctgtac

SEQ ID NO: 270260 - DNA, 20 bp, Artificial Sequence
  Description of Artificial Sequence: Synthetic oligonucleotide
  Target: ATXN1; (+) strand; PAM type: YTN; PAM sequence: CTG
tactccacttgctgcaattt

SEQ ID NO: 270261 - DNA, 20 bp, Artificial Sequence
  Description of Artificial Sequence: Synthetic oligonucleotide
  Target: ATXN1; (+) strand; PAM type: YTN; PAM sequence: CTC
cacttgctgcaatttcaatg

SEQ ID NO: 270262 - DNA, 20 bp, Artificial Sequence
  Description of Artificial Sequence: Synthetic oligonucleotide
  Target: ATXN1; (+) strand; PAM type: YTN; PAM sequence: CTT
gctgcaatttcaatgcaaat

SEQ ID NO: 270263 - DNA, 20 bp, Artificial Sequence
  Description of Artificial Sequence: Synthetic oligonucleotide
  Target: ATXN1; (+) strand; PAM type: YTN; PAM sequence: TTG
ctgcaatttcaatgcaaata

SEQ ID NO: 270264 - DNA, 20 bp, Artificial Sequence
  Description of Artificial Sequence: Synthetic oligonucleotide
  Target: ATXN1; (+) strand; PAM type: YTN; PAM sequence: CTG
caatttcaatgcaaataaag

SEQ ID NO: 270265 - DNA, 20 bp, Artificial Sequence
  Description of Artificial Sequence: Synthetic oligonucleotide
  Target: ATXN1; (+) strand; PAM type: YTN; PAM sequence: TTT
caatgcaaataaagaaaaat

SEQ ID NO: 270266 - DNA, 20 bp, Artificial Sequence
  Description of Artificial Sequence: Synthetic oligonucleotide
  Target: ATXN1; (+) strand; PAM type: YTN; PAM sequence: TTC
aatgcaaataaagaaaaata

SEQ ID NO: 270267 - DNA, 20 bp, Artificial Sequence
  Description of Artificial Sequence: Synthetic oligonucleotide
  Target: ATXN1; (+) strand; PAM type: YTN; PAM sequence: CTA
ctattttatgagtaaaggac

SEQ ID NO: 270268 - DNA, 20 bp, Artificial Sequence
  Description of Artificial Sequence: Synthetic oligonucleotide
  Target: ATXN1; (+) strand; PAM type: YTN; PAM sequence: CTA
ttttatgagtaaaggacgct

SEQ ID NO: 270269 - DNA, 20 bp, Artificial Sequence
  Description of Artificial Sequence: Synthetic oligonucleotide
  Target: ATXN1; (+) strand; PAM type: YTN; PAM sequence: TTT
tatgagtaaaggacgctggc

SEQ ID NO: 270270 - DNA, 20 bp, Artificial Sequence
  Description of Artificial Sequence: Synthetic oligonucleotide
  Target: ATXN1; (+) strand; PAM type: YTN; PAM sequence: TTT
atgagtaaaggacgctggca

SEQ ID NO: 270271 - DNA, 20 bp, Artificial Sequence
  Description of Artificial Sequence: Synthetic oligonucleotide
  Target: ATXN1; (+) strand; PAM type: YTN; PAM sequence: TTA
tgagtaaaggacgctggcaa

SEQ ID NO: 270272 - DNA, 20 bp, Artificial Sequence
  Description of Artificial Sequence: Synthetic oligonucleotide
  Target: ATXN1; (+) strand; PAM type: YTN; PAM sequence: CTG
gcaagatgcagccgtggttt

SEQ ID NO: 270273 - DNA, 20 bp, Artificial Sequence
  Description of Artificial Sequence: Synthetic oligonucleotide
  Target: ATXN1; (+) strand; PAM type: YTN; PAM sequence: TTT
gtcttaagagtcctgaaact

SEQ ID NO: 270274 - DNA, 20 bp, Artificial Sequence
  Description of Artificial Sequence: Synthetic oligonucleotide
  Target: ATXN1; (+) strand; PAM type: YTN; PAM sequence: TTG
tcttaagagtcctgaaactc

SEQ ID NO: 270275 - DNA, 20 bp, Artificial Sequence
  Description of Artificial Sequence: Synthetic oligonucleotide
  Target: ATXN1; (+) strand; PAM type: YTN; PAM sequence: CTT
aagagtcctgaaactcagtt

SEQ ID NO: 270276 - DNA, 20 bp, Artificial Sequence
  Description of Artificial Sequence: Synthetic oligonucleotide
  Target: ATXN1; (+) strand; PAM type: YTN; PAM sequence: TTA
agagtcctgaaactcagtta

SEQ ID NO: 270277 - DNA, 20 bp, Artificial Sequence
  Description of Artificial Sequence: Synthetic oligonucleotide
  Target: ATXN1; (+) strand; PAM type: YTN; PAM sequence: CTG
aaactcagttaaaatacctg

SEQ ID NO: 270278 - DNA, 20 bp, Artificial Sequence
  Description of Artificial Sequence: Synthetic oligonucleotide
  Target: ATXN1; (+) strand; PAM type: YTN; PAM sequence: CTC
agttaaaatacctgatgatc

SEQ ID NO: 270279 - DNA, 20 bp, Artificial Sequence
  Description of Artificial Sequence: Synthetic oligonucleotide
  Target: ATXN1; (+) strand; PAM type: YTN; PAM sequence: TTA
aaatacctgatgatcgcgtt

SEQ ID NO: 270280 - DNA, 20 bp, Artificial Sequence
  Description of Artificial Sequence: Synthetic oligonucleotide
  Target: ATXN1; (+) strand; PAM type: YTN; PAM sequence: CTG
atgatcgcgtttcattaaaa

SEQ ID NO: 270281 - DNA, 20 bp, Artificial Sequence
  Description of Artificial Sequence: Synthetic oligonucleotide
  Target: ATXN1; (+) strand; PAM type: YTN; PAM sequence: TTT
cattaaaaaccccaaggaat

SEQ ID NO: 270282 - DNA, 20 bp, Artificial Sequence
  Description of Artificial Sequence: Synthetic oligonucleotide
  Target: ATXN1; (+) strand; PAM type: YTN; PAM sequence: TTC
attaaaaaccccaaggaatt

SEQ ID NO: 270283 - DNA, 20 bp, Artificial Sequence
  Description of Artificial Sequence: Synthetic oligonucleotide
  Target: ATXN1; (+) strand; PAM type: YTN; PAM sequence: TTA
aaaaccccaaggaatttctt

SEQ ID NO: 270284 - DNA, 20 bp, Artificial Sequence
  Description of Artificial Sequence: Synthetic oligonucleotide
  Target: ATXN1; (+) strand; PAM type: YTN; PAM sequence: TTT
ctttacaccatgagcattct

SEQ ID NO: 270285 - DNA, 20 bp, Artificial Sequence
  Description of Artificial Sequence: Synthetic oligonucleotide
  Target: ATXN1; (+) strand; PAM type: YTN; PAM sequence: TTC
tttacaccatgagcattcta

SEQ ID NO: 270286 - DNA, 20 bp, Artificial Sequence
  Description of Artificial Sequence: Synthetic oligonucleotide
  Target: ATXN1; (+) strand; PAM type: YTN; PAM sequence: CTT
tacaccatgagcattctaca

SEQ ID NO: 270287 - DNA, 20 bp, Artificial Sequence
  Description of Artificial Sequence: Synthetic oligonucleotide
  Target: ATXN1; (+) strand; PAM type: YTN; PAM sequence: TTT
acaccatgagcattctacaa

SEQ ID NO: 270288 - DNA, 20 bp, Artificial Sequence
  Description of Artificial Sequence: Synthetic oligonucleotide
  Target: ATXN1; (+) strand; PAM type: YTN; PAM sequence: TTA
caccatgagcattctacaag

SEQ ID NO: 270289 - DNA, 20 bp, Artificial Sequence
  Description of Artificial Sequence: Synthetic oligonucleotide
  Target: ATXN1; (+) strand; PAM type: YTN; PAM sequence: TTC
tacaagtttcctacctctct

SEQ ID NO: 270290 - DNA, 20 bp, Artificial Sequence
  Description of Artificial Sequence: Synthetic oligonucleotide
  Target: ATXN1; (+) strand; PAM type: YTN; PAM sequence: CTA
caagtttcctacctctcttt

SEQ ID NO: 270291 - DNA, 20 bp, Artificial Sequence
  Description of Artificial Sequence: Synthetic oligonucleotide
  Target: ATXN1; (+) strand; PAM type: YTN; PAM sequence: TTT
cctacctctctttaagacta

SEQ ID NO: 270292 - DNA, 20 bp, Artificial Sequence
  Description of Artificial Sequence: Synthetic oligonucleotide
  Target: ATXN1; (+) strand; PAM type: YTN; PAM sequence: TTC
ctacctctctttaagactaa

SEQ ID NO: 270293 - DNA, 20 bp, Artificial Sequence
  Description of Artificial Sequence: Synthetic oligonucleotide
  Target: ATXN1; (+) strand; PAM type: YTN; PAM sequence: CTA
cctctctttaagactaaata

SEQ ID NO: 270294 - DNA, 20 bp, Artificial Sequence
  Description of Artificial Sequence: Synthetic oligonucleotide
  Target: ATXN1; (+) strand; PAM type: YTN; PAM sequence: CTC
tctttaagactaaatattta

SEQ ID NO: 270295 - DNA, 20 bp, Artificial Sequence
  Description of Artificial Sequence: Synthetic oligonucleotide
  Target: ATXN1; (+) strand; PAM type: YTN; PAM sequence: CTC
tttaagactaaatatttaaa

SEQ ID NO: 270296 - DNA, 20 bp, Artificial Sequence
  Description of Artificial Sequence: Synthetic oligonucleotide
  Target: ATXN1; (+) strand; PAM type: YTN; PAM sequence: CTT
taagactaaatatttaaaac

SEQ ID NO: 270297 - DNA, 20 bp, Artificial Sequence
  Description of Artificial Sequence: Synthetic oligonucleotide
  Target: ATXN1; (+) strand; PAM type: YTN; PAM sequence: TTT
aagactaaatatttaaaact

SEQ ID NO: 270298 - DNA, 20 bp, Artificial Sequence
  Description of Artificial Sequence: Synthetic oligonucleotide
  Target: ATXN1; (+) strand; PAM type: YTN; PAM sequence: TTA
agactaaatatttaaaactc

SEQ ID NO: 270299 - DNA, 20 bp, Artificial Sequence
  Description of Artificial Sequence: Synthetic oligonucleotide
  Target: ATXN1; (+) strand; PAM type: YTN; PAM sequence: CTA
aatatttaaaactctttaga

SEQ ID NO: 270300 - DNA, 20 bp, Artificial Sequence
  Description of Artificial Sequence: Synthetic oligonucleotide
  Target: ATXN1; (+) strand; PAM type: YTN; PAM sequence: TTT
aaaactctttagaattagca

SEQ ID NO: 270301 - DNA, 20 bp, Artificial Sequence
  Description of Artificial Sequence: Synthetic oligonucleotide
  Target: ATXN1; (+) strand; PAM type: YTN; PAM sequence: TTA
aaactctttagaattagcat

SEQ ID NO: 270302 - DNA, 20 bp, Artificial Sequence
  Description of Artificial Sequence: Synthetic oligonucleotide
  Target: ATXN1; (+) strand; PAM type: YTN; PAM sequence: CTC
tttagaattagcatcatcta

SEQ ID NO: 270303 - DNA, 20 bp, Artificial Sequence
  Description of Artificial Sequence: Synthetic oligonucleotide
  Target: ATXN1; (+) strand; PAM type: YTN; PAM sequence: CTT
tagaattagcatcatctatg

SEQ ID NO: 270304 - DNA, 20 bp, Artificial Sequence
  Description of Artificial Sequence: Synthetic oligonucleotide
  Target: ATXN1; (+) strand; PAM type: YTN; PAM sequence: TTT
agaattagcatcatctatgt

SEQ ID NO: 270305 - DNA, 20 bp, Artificial Sequence
  Description of Artificial Sequence: Synthetic oligonucleotide
  Target: ATXN1; (+) strand; PAM type: YTN; PAM sequence: TTA
gaattagcatcatctatgtg

SEQ ID NO: 270306 - DNA, 20 bp, Artificial Sequence
  Description of Artificial Sequence: Synthetic oligonucleotide
  Target: ATXN1; (+) strand; PAM type: YTN; PAM sequence: TTA
gcatcatctatgtgtcactt

SEQ ID NO: 270307 - DNA, 20 bp, Artificial Sequence
  Description of Artificial Sequence: Synthetic oligonucleotide
  Target: ATXN1; (+) strand; PAM type: YTN; PAM sequence: CTA
tgtgtcacttggctctagga

SEQ ID NO: 270308 - DNA, 20 bp, Artificial Sequence
  Description of Artificial Sequence: Synthetic oligonucleotide
  Target: ATXN1; (+) strand; PAM type: YTN; PAM sequence: CTT
ggctctaggacacatattct

SEQ ID NO: 270309 - DNA, 20 bp, Artificial Sequence
  Description of Artificial Sequence: Synthetic oligonucleotide
  Target: ATXN1; (+) strand; PAM type: YTN; PAM sequence: TTG
gctctaggacacatattctc

SEQ ID NO: 270310 - DNA, 20 bp, Artificial Sequence
  Description of Artificial Sequence: Synthetic oligonucleotide
  Target: ATXN1; (+) strand; PAM type: YTN; PAM sequence: CTC
taggacacatattctcgggg

SEQ ID NO: 270311 - DNA, 20 bp, Artificial Sequence
  Description of Artificial Sequence: Synthetic oligonucleotide
  Target: ATXN1; (+) strand; PAM type: YTN; PAM sequence: CTA
ggacacatattctcggggaa

SEQ ID NO: 270312 - DNA, 20 bp, Artificial Sequence
  Description of Artificial Sequence: Synthetic oligonucleotide
  Target: ATXN1; (+) strand; PAM type: YTN; PAM sequence: TTC
tcggggaagagcatatcccc

SEQ ID NO: 270313 - DNA, 20 bp, Artificial Sequence
  Description of Artificial Sequence: Synthetic oligonucleotide
  Target: ATXN1; (+) strand; PAM type: YTN; PAM sequence: CTC
ggggaagagcatatccccat

SEQ ID NO: 270314 - DNA, 20 bp, Artificial Sequence
  Description of Artificial Sequence: Synthetic oligonucleotide
  Target: ATXN1; (+) strand; PAM type: YTN; PAM sequence: TTT
ctattaggagaaagaataac

SEQ ID NO: 270315 - DNA, 20 bp, Artificial Sequence
  Description of Artificial Sequence: Synthetic oligonucleotide
  Target: ATXN1; (+) strand; PAM type: YTN; PAM sequence: TTC
tattaggagaaagaataaca

SEQ ID NO: 270316 - DNA, 20 bp, Artificial Sequence
  Description of Artificial Sequence: Synthetic oligonucleotide
  Target: ATXN1; (+) strand; PAM type: YTN; PAM sequence: CTA
ttaggagaaagaataacagg

SEQ ID NO: 270317 - DNA, 20 bp, Artificial Sequence
  Description of Artificial Sequence: Synthetic oligonucleotide
  Target: ATXN1; (+) strand; PAM type: YTN; PAM sequence: TTA
ggagaaagaataacaggatt

SEQ ID NO: 270318 - DNA, 20 bp, Artificial Sequence
  Description of Artificial Sequence: Synthetic oligonucleotide
  Target: ATXN1; (+) strand; PAM type: YTN; PAM sequence: TTT
ctcccctcctccttcatctt

SEQ ID NO: 270319 - DNA, 20 bp, Artificial Sequence
  Description of Artificial Sequence: Synthetic oligonucleotide
  Target: ATXN1; (+) strand; PAM type: YTN; PAM sequence: TTC
tcccctcctccttcatcttg

SEQ ID NO: 270320 - DNA, 20 bp, Artificial Sequence
  Description of Artificial Sequence: Synthetic oligonucleotide
  Target: ATXN1; (+) strand; PAM type: YTN; PAM sequence: CTC
ccctcctccttcatcttgca

SEQ ID NO: 270321 - DNA, 20 bp, Artificial Sequence
  Description of Artificial Sequence: Synthetic oligonucleotide
  Target: ATXN1; (+) strand; PAM type: YTN; PAM sequence: CTC
ctccttcatcttgcagattt

SEQ ID NO: 270322 - DNA, 20 bp, Artificial Sequence
  Description of Artificial Sequence: Synthetic oligonucleotide
  Target: ATXN1; (+) strand; PAM type: YTN; PAM sequence: CTC
cttcatcttgcagatttagg

SEQ ID NO: 270323 - DNA, 20 bp, Artificial Sequence
  Description of Artificial Sequence: Synthetic oligonucleotide
  Target: ATXN1; (+) strand; PAM type: YTN; PAM sequence: CTT
catcttgcagatttaggggt

SEQ ID NO: 270324 - DNA, 20 bp, Artificial Sequence
  Description of Artificial Sequence: Synthetic oligonucleotide
  Target: ATXN1; (+) strand; PAM type: YTN; PAM sequence: TTC
atcttgcagatttaggggtt

SEQ ID NO: 270325 - DNA, 20 bp, Artificial Sequence
  Description of Artificial Sequence: Synthetic oligonucleotide
  Target: ATXN1; (+) strand; PAM type: YTN; PAM sequence: CTT
gcagatttaggggtttatcc

SEQ ID NO: 270326 - DNA, 20 bp, Artificial Sequence
  Description of Artificial Sequence: Synthetic oligonucleotide
  Target: ATXN1; (+) strand; PAM type: YTN; PAM sequence: TTG
cagatttaggggtttatcct

SEQ ID NO: 270327 - DNA, 20 bp, Artificial Sequence
  Description of Artificial Sequence: Synthetic oligonucleotide
  Target: ATXN1; (+) strand; PAM type: YTN; PAM sequence: TTT
aggggtttatcctagtatca

SEQ ID NO: 270328 - DNA, 20 bp, Artificial Sequence
  Description of Artificial Sequence: Synthetic oligonucleotide
  Target: ATXN1; (+) strand; PAM type: YTN; PAM sequence: TTA
ggggtttatcctagtatcat

SEQ ID NO: 270329 - DNA, 20 bp, Artificial Sequence
  Description of Artificial Sequence: Synthetic oligonucleotide
  Target: ATXN1; (+) strand; PAM type: YTN; PAM sequence: TTT
atcctagtatcatggctcag

SEQ ID NO: 270330 - DNA, 20 bp, Artificial Sequence
  Description of Artificial Sequence: Synthetic oligonucleotide
  Target: ATXN1; (+) strand; PAM type: YTN; PAM sequence: TTA
tcctagtatcatggctcagg

SEQ ID NO: 270331 - DNA, 20 bp, Artificial Sequence
  Description of Artificial Sequence: Synthetic oligonucleotide
  Target: ATXN1; (+) strand; PAM type: YTN; PAM sequence: CTA
gtatcatggctcaggggatt

SEQ ID NO: 270332 - DNA, 20 bp, Artificial Sequence
  Description of Artificial Sequence: Synthetic oligonucleotide
  Target: ATXN1; (+) strand; PAM type: YTN; PAM sequence: CTC
aggggattctcacacttaca

SEQ ID NO: 270333 - DNA, 20 bp, Artificial Sequence
  Description of Artificial Sequence: Synthetic oligonucleotide
  Target: ATXN1; (+) strand; PAM type: YTN; PAM sequence: TTC
tcacacttacaactcctaat

SEQ ID NO: 270334 - DNA, 20 bp, Artificial Sequence
  Description of Artificial Sequence: Synthetic oligonucleotide
  Target: ATXN1; (+) strand; PAM type: YTN; PAM sequence: CTC
acacttacaactcctaatat

SEQ ID NO: 270335 - DNA, 20 bp, Artificial Sequence
  Description of Artificial Sequence: Synthetic oligonucleotide
  Target: ATXN1; (+) strand; PAM type: YTN; PAM sequence: CTT
acaactcctaatatatcaaa

SEQ ID NO: 270336 - DNA, 20 bp, Artificial Sequence
  Description of Artificial Sequence: Synthetic oligonucleotide
  Target: ATXN1; (+) strand; PAM type: YTN; PAM sequence: TTA
caactcctaatatatcaaaa

SEQ ID NO: 270337 - DNA, 20 bp, Artificial Sequence
  Description of Artificial Sequence: Synthetic oligonucleotide
  Target: ATXN1; (+) strand; PAM type: YTN; PAM sequence: CTC
ctaatatatcaaaaaaggag

SEQ ID NO: 270338 - DNA, 20 bp, Artificial Sequence
  Description of Artificial Sequence: Synthetic oligonucleotide
  Target: ATXN1; (+) strand; PAM type: YTN; PAM sequence: CTA
atatatcaaaaaaggagaaa

SEQ ID NO: 270339 - DNA, 20 bp, Artificial Sequence
  Description of Artificial Sequence: Synthetic oligonucleotide
  Target: ATXN1; (+) strand; PAM type: YTN; PAM sequence: CTC
tcttcactgcttaattgttt

SEQ ID NO: 270340 - DNA, 20 bp, Artificial Sequence
  Description of Artificial Sequence: Synthetic oligonucleotide
  Target: ATXN1; (+) strand; PAM type: YTN; PAM sequence: CTC
ttcactgcttaattgttttg

SEQ ID NO: 270341 - DNA, 20 bp, Artificial Sequence
  Description of Artificial Sequence: Synthetic oligonucleotide
  Target: ATXN1; (+) strand; PAM type: YTN; PAM sequence: CTT
cactgcttaattgttttgtc

SEQ ID NO: 270342 - DNA, 20 bp, Artificial Sequence
  Description of Artificial Sequence: Synthetic oligonucleotide
  Target: ATXN1; (+) strand; PAM type: YTN; PAM sequence: TTC
actgcttaattgttttgtcg

SEQ ID NO: 270343 - DNA, 20 bp, Artificial Sequence
  Description of Artificial Sequence: Synthetic oligonucleotide
  Target: ATXN1; (+) strand; PAM type: YTN; PAM sequence: CTG
cttaattgttttgtcgaata

SEQ ID NO: 270344 - DNA, 20 bp, Artificial Sequence
  Description of Artificial Sequence: Synthetic oligonucleotide
  Target: ATXN1; (+) strand; PAM type: YTN; PAM sequence: CTT
aattgttttgtcgaataagc

SEQ ID NO: 270345 - DNA, 20 bp, Artificial Sequence
  Description of Artificial Sequence: Synthetic oligonucleotide
  Target: ATXN1; (+) strand; PAM type: YTN; PAM sequence: TTA
attgttttgtcgaataagct

SEQ ID NO: 270346 - DNA, 20 bp, Artificial Sequence
  Description of Artificial Sequence: Synthetic oligonucleotide
  Target: ATXN1; (+) strand; PAM type: YTN; PAM sequence: TTG
ttttgtcgaataagctctca

SEQ ID NO: 270347 - DNA, 20 bp, Artificial Sequence
  Description of Artificial Sequence: Synthetic oligonucleotide
  Target: ATXN1; (+) strand; PAM type: YTN; PAM sequence: TTT
tgtcgaataagctctcaaaa

SEQ ID NO: 270348 - DNA, 20 bp, Artificial Sequence
  Description of Artificial Sequence: Synthetic oligonucleotide
  Target: ATXN1; (+) strand; PAM type: YTN; PAM sequence: TTT
gtcgaataagctctcaaaag

SEQ ID NO: 270349 - DNA, 20 bp, Artificial Sequence
  Description of Artificial Sequence: Synthetic oligonucleotide
  Target: ATXN1; (+) strand; PAM type: YTN; PAM sequence: TTG
tcgaataagctctcaaaagt

SEQ ID NO: 270350 - DNA, 20 bp, Artificial Sequence
  Description of Artificial Sequence: Synthetic oligonucleotide
  Target: ATXN1; (+) strand; PAM type: YTN; PAM sequence: CTC
tcaaaagttcatttttgtta

SEQ ID NO: 270351 - DNA, 20 bp, Artificial Sequence
  Description of Artificial Sequence: Synthetic oligonucleotide
  Target: ATXN1; (+) strand; PAM type: YTN; PAM sequence: CTC
aaaagttcatttttgttacc

SEQ ID NO: 270352 - DNA, 20 bp, Artificial Sequence
  Description of Artificial Sequence: Synthetic oligonucleotide
  Target: ATXN1; (+) strand; PAM type: YTN; PAM sequence: TTC
atttttgttacctttttcag

SEQ ID NO: 270353 - DNA, 20 bp, Artificial Sequence
  Description of Artificial Sequence: Synthetic oligonucleotide
  Target: ATXN1; (+) strand; PAM type: YTN; PAM sequence: TTT
ttgttacctttttcaggcaa

SEQ ID NO: 270354 - DNA, 20 bp, Artificial Sequence
  Description of Artificial Sequence: Synthetic oligonucleotide
  Target: ATXN1; (+) strand; PAM type: YTN; PAM sequence: TTT
tgttacctttttcaggcaaa

SEQ ID NO: 270355 - DNA, 20 bp, Artificial Sequence
  Description of Artificial Sequence: Synthetic oligonucleotide
  Target: ATXN1; (+) strand; PAM type: YTN; PAM sequence: TTT
gttacctttttcaggcaaaa

SEQ ID NO: 270356 - DNA, 20 bp, Artificial Sequence
  Description of Artificial Sequence: Synthetic oligonucleotide
  Target: ATXN1; (+) strand; PAM type: YTN; PAM sequence: TTG
ttacctttttcaggcaaaat

SEQ ID NO: 270357 - DNA, 20 bp, Artificial Sequence
  Description of Artificial Sequence: Synthetic oligonucleotide
  Target: ATXN1; (+) strand; PAM type: YTN; PAM sequence: TTA
cctttttcaggcaaaataag

SEQ ID NO: 270358 - DNA, 20 bp, Artificial Sequence
  Description of Artificial Sequence: Synthetic oligonucleotide
  Target: ATXN1; (+) strand; PAM type: YTN; PAM sequence: CTT
tttcaggcaaaataagaggc

SEQ ID NO: 270359 - DNA, 20 bp, Artificial Sequence
  Description of Artificial Sequence: Synthetic oligonucleotide
  Target: ATXN1; (+) strand; PAM type: YTN; PAM sequence: TTT
ttcaggcaaaataagaggcc

SEQ ID NO: 270360 - DNA, 20 bp, Artificial Sequence
  Description of Artificial Sequence: Synthetic oligonucleotide
  Target: ATXN1; (+) strand; PAM type: YTN; PAM sequence: TTT
tcaggcaaaataagaggcct

SEQ ID NO: 270361 - DNA, 20 bp, Artificial Sequence
  Description of Artificial Sequence: Synthetic oligonucleotide
  Target: ATXN1; (+) strand; PAM type: YTN; PAM sequence: TTT
caggcaaaataagaggcctt

SEQ ID NO: 270362 - DNA, 20 bp, Artificial Sequence
  Description of Artificial Sequence: Synthetic oligonucleotide
  Target: ATXN1; (+) strand; PAM type: YTN; PAM sequence: TTC
aggcaaaataagaggccttt

SEQ ID NO: 270363 - DNA, 20 bp, Artificial Sequence
  Description of Artificial Sequence: Synthetic oligonucleotide
  Target: ATXN1; (+) strand; PAM type: YTN; PAM sequence: CTT
ttacaaaaattctattgcta

SEQ ID NO: 270364 - DNA, 20 bp, Artificial Sequence
  Description of Artificial Sequence: Synthetic oligonucleotide
  Target: ATXN1; (+) strand; PAM type: YTN; PAM sequence: TTT
tacaaaaattctattgctaa

SEQ ID NO: 270365 - DNA, 20 bp, Artificial Sequence
  Description of Artificial Sequence: Synthetic oligonucleotide
  Target: ATXN1; (+) strand; PAM type: YTN; PAM sequence: TTT
acaaaaattctattgctaaa

SEQ ID NO: 270366 - DNA, 20 bp, Artificial Sequence
  Description of Artificial Sequence: Synthetic oligonucleotide
  Target: ATXN1; (+) strand; PAM type: YTN; PAM sequence: TTA
caaaaattctattgctaaaa

SEQ ID NO: 270367 - DNA, 20 bp, Artificial Sequence
  Description of Artificial Sequence: Synthetic oligonucleotide
  Target: ATXN1; (+) strand; PAM type: YTN; PAM sequence: TTC
tattgctaaaacaatggaat

SEQ ID NO: 270368 - DNA, 20 bp, Artificial Sequence
  Description of Artificial Sequence: Synthetic oligonucleotide
  Target: ATXN1; (+) strand; PAM type: YTN; PAM sequence: CTA
ttgctaaaacaatggaattc

SEQ ID NO: 270369 - DNA, 20 bp, Artificial Sequence
  Description of Artificial Sequence: Synthetic oligonucleotide
  Target: ATXN1; (+) strand; PAM type: YTN; PAM sequence: TTG
ctaaaacaatggaattctcc

SEQ ID NO: 270370 - DNA, 20 bp, Artificial Sequence
  Description of Artificial Sequence: Synthetic oligonucleotide
  Target: ATXN1; (+) strand; PAM type: YTN; PAM sequence: CTA
aaacaatggaattctcccgg

SEQ ID NO: 270371 - DNA, 20 bp, Artificial Sequence
  Description of Artificial Sequence: Synthetic oligonucleotide
  Target: ATXN1; (+) strand; PAM type: YTN; PAM sequence: TTC
tcccgggaatgacttcgtta

SEQ ID NO: 270372 - DNA, 20 bp, Artificial Sequence
  Description of Artificial Sequence: Synthetic oligonucleotide
  Target: ATXN1; (+) strand; PAM type: YTN; PAM sequence: CTC
ccgggaatgacttcgttatg

SEQ ID NO: 270373 - DNA, 20 bp, Artificial Sequence
  Description of Artificial Sequence: Synthetic oligonucleotide
  Target: ATXN1; (+) strand; PAM type: YTN; PAM sequence: CTT
cgttatggaaatgaagtgac

SEQ ID NO: 270374 - DNA, 20 bp, Artificial Sequence
  Description of Artificial Sequence: Synthetic oligonucleotide
  Target: ATXN1; (+) strand; PAM type: YTN; PAM sequence: TTC
gttatggaaatgaagtgaca

SEQ ID NO: 270375 - DNA, 20 bp, Artificial Sequence
  Description of Artificial Sequence: Synthetic oligonucleotide
  Target: ATXN1; (+) strand; PAM type: YTN; PAM sequence: TTA
tggaaatgaagtgacagctt

SEQ ID NO: 270376 - DNA, 20 bp, Artificial Sequence
  Description of Artificial Sequence: Synthetic oligonucleotide
  Target: ATXN1; (+) strand; PAM type: YTN; PAM sequence: CTT
cttttatctagccaggcaga

SEQ ID NO: 270377 - DNA, 20 bp, Artificial Sequence
  Description of Artificial Sequence: Synthetic oligonucleotide
  Target: ATXN1; (+) strand; PAM type: YTN; PAM sequence: TTC
ttttatctagccaggcagaa

SEQ ID NO: 270378 - DNA, 20 bp, Artificial Sequence
  Description of Artificial Sequence: Synthetic oligonucleotide
  Target: ATXN1; (+) strand; PAM type: YTN; PAM sequence: CTT
ttatctagccaggcagaaag

SEQ ID NO: 270379 - DNA, 20 bp, Artificial Sequence
  Description of Artificial Sequence: Synthetic oligonucleotide
  Target: ATXN1; (+) strand; PAM type: YTN; PAM sequence: TTT
tatctagccaggcagaaagt

SEQ ID NO: 270380 - DNA, 20 bp, Artificial Sequence
  Description of Artificial Sequence: Synthetic oligonucleotide
  Target: ATXN1; (+) strand; PAM type: YTN; PAM sequence: TTT
atctagccaggcagaaagtc

SEQ ID NO: 270381 - DNA, 20 bp, Artificial Sequence
  Description of Artificial Sequence: Synthetic oligonucleotide
  Target: ATXN1; (+) strand; PAM type: YTN; PAM sequence: TTA
tctagccaggcagaaagtct

SEQ ID NO: 270382 - DNA, 20 bp, Artificial Sequence
  Description of Artificial Sequence: Synthetic oligonucleotide
  Target: ATXN1; (+) strand; PAM type: YTN; PAM sequence: CTA
gccaggcagaaagtctgcat

SEQ ID NO: 270383 - DNA, 20 bp, Artificial Sequence
  Description of Artificial Sequence: Synthetic oligonucleotide
  Target: ATXN1; (+) strand; PAM type: YTN; PAM sequence: CTG
catttataaaaggcattcag

SEQ ID NO: 270384 - DNA, 20 bp, Artificial Sequence
  Description of Artificial Sequence: Synthetic oligonucleotide
  Target: ATXN1; (+) strand; PAM type: YTN; PAM sequence: TTT
ataaaaggcattcagagcac

SEQ ID NO: 270385 - DNA, 20 bp, Artificial Sequence
  Description of Artificial Sequence: Synthetic oligonucleotide
  Target: ATXN1; (+) strand; PAM type: YTN; PAM sequence: TTA
taaaaggcattcagagcact

SEQ ID NO: 270386 - DNA, 20 bp, Artificial Sequence
  Description of Artificial Sequence: Synthetic oligonucleotide
  Target: ATXN1; (+) strand; PAM type: YTN; PAM sequence: TTC
agagcactcaagtgttgtgt

SEQ ID NO: 270387 - DNA, 20 bp, Artificial Sequence
  Description of Artificial Sequence: Synthetic oligonucleotide
  Target: ATXN1; (+) strand; PAM type: YTN; PAM sequence: CTC
aagtgttgtgtgtgggagga

SEQ ID NO: 270388 - DNA, 20 bp, Artificial Sequence
  Description of Artificial Sequence: Synthetic oligonucleotide
  Target: ATXN1; (+) strand; PAM type: YTN; PAM sequence: TTG
tgtgtgggaggacagaaaat

SEQ ID NO: 270389 - DNA, 20 bp, Artificial Sequence
  Description of Artificial Sequence: Synthetic oligonucleotide
  Target: ATXN1; (+) strand; PAM type: YTN; PAM sequence: CTA
tttttaattcagattgcagc

SEQ ID NO: 270390 - DNA, 20 bp, Artificial Sequence
  Description of Artificial Sequence: Synthetic oligonucleotide
  Target: ATXN1; (+) strand; PAM type: YTN; PAM sequence: TTT
ttaattcagattgcagcatt

SEQ ID NO: 270391 - DNA, 20 bp, Artificial Sequence
  Description of Artificial Sequence: Synthetic oligonucleotide
  Target: ATXN1; (+) strand; PAM type: YTN; PAM sequence: TTT
taattcagattgcagcattc

SEQ ID NO: 270392 - DNA, 20 bp, Artificial Sequence
  Description of Artificial Sequence: Synthetic oligonucleotide
  Target: ATXN1; (+) strand; PAM type: YTN; PAM sequence: TTT
aattcagattgcagcattcc

SEQ ID NO: 270393 - DNA, 20 bp, Artificial Sequence
  Description of Artificial Sequence: Synthetic oligonucleotide
  Target: ATXN1; (+) strand; PAM type: YTN; PAM sequence: TTA
attcagattgcagcattcct

SEQ ID NO: 270394 - DNA, 20 bp, Artificial Sequence
  Description of Artificial Sequence: Synthetic oligonucleotide
  Target: ATXN1; (+) strand; PAM type: YTN; PAM sequence: TTC
agattgcagcattcctccca

SEQ ID NO: 270395 - DNA, 20 bp, Artificial Sequence
  Description of Artificial Sequence: Synthetic oligonucleotide
  Target: ATXN1; (+) strand; PAM type: YTN; PAM sequence: TTG
cagcattcctcccatccagg

SEQ ID NO: 270396 - DNA, 20 bp, Artificial Sequence
  Description of Artificial Sequence: Synthetic oligonucleotide
  Target: ATXN1; (+) strand; PAM type: YTN; PAM sequence: TTC
ctcccatccaggtctttcag

SEQ ID NO: 270397 - DNA, 20 bp, Artificial Sequence
  Description of Artificial Sequence: Synthetic oligonucleotide
  Target: ATXN1; (+) strand; PAM type: YTN; PAM sequence: CTC
ccatccaggtctttcagtat

SEQ ID NO: 270398 - DNA, 20 bp, Artificial Sequence
  Description of Artificial Sequence: Synthetic oligonucleotide
  Target: ATXN1; (+) strand; PAM type: YTN; PAM sequence: CTT
tcagtataatcataatcata

SEQ ID NO: 270399 - DNA, 20 bp, Artificial Sequence
  Description of Artificial Sequence: Synthetic oligonucleotide
  Target: ATXN1; (+) strand; PAM type: YTN; PAM sequence: TTT
cagtataatcataatcataa

SEQ ID NO: 270400 - DNA, 20 bp, Artificial Sequence
  Description of Artificial Sequence: Synthetic oligonucleotide
  Target: ATXN1; (+) strand; PAM type: YTN; PAM sequence: TTC
agtataatcataatcataat

SEQ ID NO: 270401 - DNA, 20 bp, Artificial Sequence
  Description of Artificial Sequence: Synthetic oligonucleotide
  Target: ATXN1; (+) strand; PAM type: YTN; PAM sequence: CTG
atgtaaaaagaaaaaaaaaa

SEQ ID NO: 270402 - DNA, 20 bp, Artificial Sequence
  Description of Artificial Sequence: Synthetic oligonucleotide
  Target: ATXN1; (+) strand; PAM type: YTN; PAM sequence: TTC
ccattcctgctgaccccagc

SEQ ID NO: 270403 - DNA, 20 bp, Artificial Sequence
  Description of Artificial Sequence: Synthetic oligonucleotide
  Target: ATXN1; (+) strand; PAM type: YTN; PAM sequence: TTC
ctgctgaccccagcagaaaa

SEQ ID NO: 270404 - DNA, 20 bp, Artificial Sequence
  Description of Artificial Sequence: Synthetic oligonucleotide
  Target: ATXN1; (+) strand; PAM type: YTN; PAM sequence: CTG
ctgaccccagcagaaaaaga

SEQ ID NO: 270405 - DNA, 20 bp, Artificial Sequence
  Description of Artificial Sequence: Synthetic oligonucleotide
  Target: ATXN1; (+) strand; PAM type: YTN; PAM sequence: CTG
accccagcagaaaaagagag

SEQ ID NO: 270406 - DNA, 20 bp, Artificial Sequence
  Description of Artificial Sequence: Synthetic oligonucleotide
  Target: ATXN1; (+) strand; PAM type: YTN; PAM sequence: TTA
aataaatgattaatacagct

SEQ ID NO: 270407 - DNA, 20 bp, Artificial Sequence
  Description of Artificial Sequence: Synthetic oligonucleotide
  Target: ATXN1; (+) strand; PAM type: YTN; PAM sequence: TTA
atacagcttccttccacttt

SEQ ID NO: 270408 - DNA, 20 bp, Artificial Sequence
  Description of Artificial Sequence: Synthetic oligonucleotide
  Target: ATXN1; (+) strand; PAM type: YTN; PAM sequence: CTT
ccttccacttttagaccgtt

SEQ ID NO: 270409 - DNA, 20 bp, Artificial Sequence
  Description of Artificial Sequence: Synthetic oligonucleotide
  Target: ATXN1; (+) strand; PAM type: YTN; PAM sequence: TTC
cttccacttttagaccgttc

SEQ ID NO: 270410 - DNA, 20 bp, Artificial Sequence
  Description of Artificial Sequence: Synthetic oligonucleotide
  Target: ATXN1; (+) strand; PAM type: YTN; PAM sequence: CTT
ccacttttagaccgttctgt

SEQ ID NO: 270411 - DNA, 20 bp, Artificial Sequence
  Description of Artificial Sequence: Synthetic oligonucleotide
  Target: ATXN1; (+) strand; PAM type: YTN; PAM sequence: TTC
cacttttagaccgttctgtg

SEQ ID NO: 270412 - DNA, 20 bp, Artificial Sequence
  Description of Artificial Sequence: Synthetic oligonucleotide
  Target: ATXN1; (+) strand; PAM type: YTN; PAM sequence: CTT
ttagaccgttctgtgggctt

SEQ ID NO: 270413 - DNA, 20 bp, Artificial Sequence
  Description of Artificial Sequence: Synthetic oligonucleotide
  Target: ATXN1; (+) strand; PAM type: YTN; PAM sequence: TTT
tagaccgttctgtgggcttg

SEQ ID NO: 270414 - DNA, 20 bp, Artificial Sequence
  Description of Artificial Sequence: Synthetic oligonucleotide
  Target: ATXN1; (+) strand; PAM type: YTN; PAM sequence: TTT
agaccgttctgtgggcttgg

SEQ ID NO: 270415 - DNA, 20 bp, Artificial Sequence
  Description of Artificial Sequence: Synthetic oligonucleotide
  Target: ATXN1; (+) strand; PAM type: YTN; PAM sequence: TTA
gaccgttctgtgggcttgga

SEQ ID NO: 270416 - DNA, 20 bp, Artificial Sequence
  Description of Artificial Sequence: Synthetic oligonucleotide
  Target: ATXN1; (+) strand; PAM type: YTN; PAM sequence: TTC
tgtgggcttggagatccacc

SEQ ID NO: 270417 - DNA, 20 bp, Artificial Sequence
  Description of Artificial Sequence: Synthetic oligonucleotide
  Target: ATXN1; (+) strand; PAM type: YTN; PAM sequence: CTG
tgggcttggagatccacctt

SEQ ID NO: 270418 - DNA, 20 bp, Artificial Sequence
  Description of Artificial Sequence: Synthetic oligonucleotide
  Target: ATXN1; (+) strand; PAM type: YTN; PAM sequence: CTT
ggagatccaccttcgaggca

SEQ ID NO: 270419 - DNA, 20 bp, Artificial Sequence
  Description of Artificial Sequence: Synthetic oligonucleotide
  Target: ATXN1; (+) strand; PAM type: YTN; PAM sequence: TTG
gagatccaccttcgaggcaa

SEQ ID NO: 270420 - DNA, 20 bp, Artificial Sequence
  Description of Artificial Sequence: Synthetic oligonucleotide
  Target: ATXN1; (+) strand; PAM type: YTN; PAM sequence: CTT
cgaggcaatcagagcagact

SEQ ID NO: 270421 - DNA, 20 bp, Artificial Sequence
  Description of Artificial Sequence: Synthetic oligonucleotide
  Target: ATXN1; (+) strand; PAM type: YTN; PAM sequence: TTC
gaggcaatcagagcagacta

SEQ ID NO: 270422 - DNA, 20 bp, Artificial Sequence
  Description of Artificial Sequence: Synthetic oligonucleotide
  Target: ATXN1; (+) strand; PAM type: YTN; PAM sequence: CTA
tccattatccaaagttaaaa

SEQ ID NO: 270423 - DNA, 20 bp, Artificial Sequence
  Description of Artificial Sequence: Synthetic oligonucleotide
  Target: ATXN1; (+) strand; PAM type: YTN; PAM sequence: TTA
tccaaagttaaaagcacttt

SEQ ID NO: 270424 - DNA, 20 bp, Artificial Sequence
  Description of Artificial Sequence: Synthetic oligonucleotide
  Target: ATXN1; (+) strand; PAM type: YTN; PAM sequence: TTA
aaagcactttaactctgcta

SEQ ID NO: 270425 - DNA, 20 bp, Artificial Sequence
  Description of Artificial Sequence: Synthetic oligonucleotide
  Target: ATXN1; (+) strand; PAM type: YTN; PAM sequence: CTT
taactctgctagtaacagca

SEQ ID NO: 270426 - DNA, 20 bp, Artificial Sequence
  Description of Artificial Sequence: Synthetic oligonucleotide
  Target: ATXN1; (+) strand; PAM type: YTN; PAM sequence: TTT
aactctgctagtaacagcat

SEQ ID NO: 270427 - DNA, 20 bp, Artificial Sequence
  Description of Artificial Sequence: Synthetic oligonucleotide
  Target: ATXN1; (+) strand; PAM type: YTN; PAM sequence: TTA
actctgctagtaacagcatc

SEQ ID NO: 270428 - DNA, 20 bp, Artificial Sequence
  Description of Artificial Sequence: Synthetic oligonucleotide
  Target: ATXN1; (+) strand; PAM type: YTN; PAM sequence: CTC
tgctagtaacagcatcacgt

SEQ ID NO: 270429 - DNA, 20 bp, Artificial Sequence
  Description of Artificial Sequence: Synthetic oligonucleotide
  Target: ATXN1; (+) strand; PAM type: YTN; PAM sequence: CTG
ctagtaacagcatcacgtct

SEQ ID NO: 270430 - DNA, 20 bp, Artificial Sequence
  Description of Artificial Sequence: Synthetic oligonucleotide
  Target: ATXN1; (+) strand; PAM type: YTN; PAM sequence: CTA
gtaacagcatcacgtcttct

SEQ ID NO: 270431 - DNA, 20 bp, Artificial Sequence
  Description of Artificial Sequence: Synthetic oligonucleotide
  Target: ATXN1; (+) strand; PAM type: YTN; PAM sequence: CTT
ctcacacaaatttacattct

SEQ ID NO: 270432 - DNA, 20 bp, Artificial Sequence
  Description of Artificial Sequence: Synthetic oligonucleotide
  Target: ATXN1; (+) strand; PAM type: YTN; PAM sequence: TTC
tcacacaaatttacattctt

SEQ ID NO: 270433 - DNA, 20 bp, Artificial Sequence
  Description of Artificial Sequence: Synthetic oligonucleotide
  Target: ATXN1; (+) strand; PAM type: YTN; PAM sequence: CTC
acacaaatttacattcttgt

SEQ ID NO: 270434 - DNA, 20 bp, Artificial Sequence
  Description of Artificial Sequence: Synthetic oligonucleotide
  Target: ATXN1; (+) strand; PAM type: YTN; PAM sequence: TTT
acattcttgttcgtgtgact

SEQ ID NO: 270435 - DNA, 20 bp, Artificial Sequence
  Description of Artificial Sequence: Synthetic oligonucleotide
  Target: ATXN1; (+) strand; PAM type: YTN; PAM sequence: TTA
cattcttgttcgtgtgactt

SEQ ID NO: 270436 - DNA, 20 bp, Artificial Sequence
  Description of Artificial Sequence: Synthetic oligonucleotide
  Target: ATXN1; (+) strand; PAM type: YTN; PAM sequence: TTC
ttgttcgtgtgactttcact

SEQ ID NO: 270437 - DNA, 20 bp, Artificial Sequence
  Description of Artificial Sequence: Synthetic oligonucleotide
  Target: ATXN1; (+) strand; PAM type: YTN; PAM sequence: CTT
gttcgtgtgactttcactct

SEQ ID NO: 270438 - DNA, 20 bp, Artificial Sequence
  Description of Artificial Sequence: Synthetic oligonucleotide
  Target: ATXN1; (+) strand; PAM type: YTN; PAM sequence: TTG
ttcgtgtgactttcactctc

SEQ ID NO: 270439 - DNA, 20 bp, Artificial Sequence
  Description of Artificial Sequence: Synthetic oligonucleotide
  Target: ATXN1; (+) strand; PAM type: YTN; PAM sequence: TTC
gtgtgactttcactctccta

SEQ ID NO: 270440 - DNA, 20 bp, Artificial Sequence
  Description of Artificial Sequence: Synthetic oligonucleotide
  Target: ATXN1; (+) strand; PAM type: YTN; PAM sequence: CTT
tcactctcctaagtttgcag

SEQ ID NO: 270441 - DNA, 20 bp, Artificial Sequence
  Description of Artificial Sequence: Synthetic oligonucleotide
  Target: ATXN1; (+) strand; PAM type: YTN; PAM sequence: TTT
cactctcctaagtttgcagg

SEQ ID NO: 270442 - DNA, 20 bp, Artificial Sequence
  Description of Artificial Sequence: Synthetic oligonucleotide
  Target: ATXN1; (+) strand; PAM type: YTN; PAM sequence: TTC
actctcctaagtttgcagga

SEQ ID NO: 270443 - DNA, 20 bp, Artificial Sequence
  Description of Artificial Sequence: Synthetic oligonucleotide
  Target: ATXN1; (+) strand; PAM type: YTN; PAM sequence: CTC
tcctaagtttgcaggaatcg

SEQ ID NO: 270444 - DNA, 20 bp, Artificial Sequence
  Description of Artificial Sequence: Synthetic oligonucleotide
  Target: ATXN1; (+) strand; PAM type: YTN; PAM sequence: CTC
ctaagtttgcaggaatcgcc

SEQ ID NO: 270445 - DNA, 20 bp, Artificial Sequence
  Description of Artificial Sequence: Synthetic oligonucleotide
  Target: ATXN1; (+) strand; PAM type: YTN; PAM sequence: CTA
agtttgcaggaatcgcctgt

SEQ ID NO: 270446 - DNA, 20 bp, Artificial Sequence
  Description of Artificial Sequence: Synthetic oligonucleotide
  Target: ATXN1; (+) strand; PAM type: YTN; PAM sequence: TTT
gcaggaatcgcctgtgcctg

SEQ ID NO: 270447 - DNA, 20 bp, Artificial Sequence
  Description of Artificial Sequence: Synthetic oligonucleotide
  Target: ATXN1; (+) strand; PAM type: YTN; PAM sequence: TTG
caggaatcgcctgtgcctgc

SEQ ID NO: 270448 - DNA, 20 bp, Artificial Sequence
  Description of Artificial Sequence: Synthetic oligonucleotide
  Target: ATXN1; (+) strand; PAM type: YTN; PAM sequence: CTG
tgcctgctgggaaacgccgt

SEQ ID NO: 270449 - DNA, 20 bp, Artificial Sequence
  Description of Artificial Sequence: Synthetic oligonucleotide
  Target: ATXN1; (+) strand; PAM type: YTN; PAM sequence: CTG
ctgggaaacgccgtgcaagt

SEQ ID NO: 270450 - DNA, 20 bp, Artificial Sequence
  Description of Artificial Sequence: Synthetic oligonucleotide
  Target: ATXN1; (+) strand; PAM type: YTN; PAM sequence: CTG
ggaaacgccgtgcaagttcc

SEQ ID NO: 270451 - DNA, 20 bp, Artificial Sequence
  Description of Artificial Sequence: Synthetic oligonucleotide
  Target: ATXN1; (+) strand; PAM type: YTN; PAM sequence: TTC
ctccatctgtttccaagact

SEQ ID NO: 270452 - DNA, 20 bp, Artificial Sequence
  Description of Artificial Sequence: Synthetic oligonucleotide
  Target: ATXN1; (+) strand; PAM type: YTN; PAM sequence: CTC
catctgtttccaagacttaa

SEQ ID NO: 270453 - DNA, 20 bp, Artificial Sequence
  Description of Artificial Sequence: Synthetic oligonucleotide
  Target: ATXN1; (+) strand; PAM type: YTN; PAM sequence: CTG
tttccaagacttaacattcc

SEQ ID NO: 270454 - DNA, 20 bp, Artificial Sequence
  Description of Artificial Sequence: Synthetic oligonucleotide
  Target: ATXN1; (+) strand; PAM type: YTN; PAM sequence: TTT
ccaagacttaacattccttg

SEQ ID NO: 270455 - DNA, 20 bp, Artificial Sequence
  Description of Artificial Sequence: Synthetic oligonucleotide
  Target: ATXN1; (+) strand; PAM type: YTN; PAM sequence: TTC
caagacttaacattccttgg

SEQ ID NO: 270456 - DNA, 20 bp, Artificial Sequence
  Description of Artificial Sequence: Synthetic oligonucleotide
  Target: ATXN1; (+) strand; PAM type: YTN; PAM sequence: CTT
aacattccttggtgacagtg

SEQ ID NO: 270457 - DNA, 20 bp, Artificial Sequence
  Description of Artificial Sequence: Synthetic oligonucleotide
  Target: ATXN1; (+) strand; PAM type: YTN; PAM sequence: TTA
acattccttggtgacagtgc

SEQ ID NO: 270458 - DNA, 20 bp, Artificial Sequence
  Description of Artificial Sequence: Synthetic oligonucleotide
  Target: ATXN1; (+) strand; PAM type: YTN; PAM sequence: TTC
cttggtgacagtgcaatgga

SEQ ID NO: 270459 - DNA, 20 bp, Artificial Sequence
  Description of Artificial Sequence: Synthetic oligonucleotide
  Target: ATXN1; (+) strand; PAM type: YTN; PAM sequence: CTT
ggtgacagtgcaatggacga

SEQ ID NO: 270460 - DNA, 20 bp, Artificial Sequence
  Description of Artificial Sequence: Synthetic oligonucleotide
  Target: ATXN1; (+) strand; PAM type: YTN; PAM sequence: TTG
gtgacagtgcaatggacgag

SEQ ID NO: 270461 - DNA, 20 bp, Artificial Sequence
  Description of Artificial Sequence: Synthetic oligonucleotide
  Target: ATXN1; (+) strand; PAM type: YTN; PAM sequence: CTG
gtggcagggccatgctggga

SEQ ID NO: 270462 - DNA, 20 bp, Artificial Sequence
  Description of Artificial Sequence: Synthetic oligonucleotide
  Target: ATXN1; (+) strand; PAM type: YTN; PAM sequence: CTG
ggaacttgatttctaatgtc

SEQ ID NO: 270463 - DNA, 20 bp, Artificial Sequence
  Description of Artificial Sequence: Synthetic oligonucleotide
  Target: ATXN1; (+) strand; PAM type: YTN; PAM sequence: CTT
gatttctaatgtcaatcact

SEQ ID NO: 270464 - DNA, 20 bp, Artificial Sequence
  Description of Artificial Sequence: Synthetic oligonucleotide
  Target: ATXN1; (+) strand; PAM type: YTN; PAM sequence: TTG
atttctaatgtcaatcactg

SEQ ID NO: 270465 - DNA, 20 bp, Artificial Sequence
  Description of Artificial Sequence: Synthetic oligonucleotide
  Target: ATXN1; (+) strand; PAM type: YTN; PAM sequence: TTT
ctaatgtcaatcactggaat

SEQ ID NO: 270466 - DNA, 20 bp, Artificial Sequence
  Description of Artificial Sequence: Synthetic oligonucleotide
  Target: ATXN1; (+) strand; PAM type: YTN; PAM sequence: TTC
taatgtcaatcactggaatg

SEQ ID NO: 270467 - DNA, 20 bp, Artificial Sequence
  Description of Artificial Sequence: Synthetic oligonucleotide
  Target: ATXN1; (+) strand; PAM type: YTN; PAM sequence: CTA
atgtcaatcactggaatgcc

SEQ ID NO: 270468 - DNA, 20 bp, Artificial Sequence
  Description of Artificial Sequence: Synthetic oligonucleotide
  Target: ATXN1; (+) strand; PAM type: YTN; PAM sequence: CTG
gaatgcccttctagtaagga

SEQ ID NO: 270469 - DNA, 20 bp, Artificial Sequence
  Description of Artificial Sequence: Synthetic oligonucleotide
  Target: ATXN1; (+) strand; PAM type: YTN; PAM sequence: CTT
ctagtaaggaagaggtgccc

SEQ ID NO: 270470 - DNA, 20 bp, Artificial Sequence
  Description of Artificial Sequence: Synthetic oligonucleotide
  Target: ATXN1; (+) strand; PAM type: YTN; PAM sequence: TTC
tagtaaggaagaggtgccca

SEQ ID NO: 270471 - DNA, 20 bp, Artificial Sequence
  Description of Artificial Sequence: Synthetic oligonucleotide
  Target: ATXN1; (+) strand; PAM type: YTN; PAM sequence: CTA
gtaaggaagaggtgcccaag

SEQ ID NO: 270472 - DNA, 20 bp, Artificial Sequence
  Description of Artificial Sequence: Synthetic oligonucleotide
  Target: ATXN1; (+) strand; PAM type: YTN; PAM sequence: CTT
ctgtttgagttaacacagac

SEQ ID NO: 270473 - DNA, 20 bp, Artificial Sequence
  Description of Artificial Sequence: Synthetic oligonucleotide
  Target: ATXN1; (+) strand; PAM type: YTN; PAM sequence: TTC
tgtttgagttaacacagacc

SEQ ID NO: 270474 - DNA, 20 bp, Artificial Sequence
  Description of Artificial Sequence: Synthetic oligonucleotide
  Target: ATXN1; (+) strand; PAM type: YTN; PAM sequence: CTG
tttgagttaacacagacctt

SEQ ID NO: 270475 - DNA, 20 bp, Artificial Sequence
  Description of Artificial Sequence: Synthetic oligonucleotide
  Target: ATXN1; (+) strand; PAM type: YTN; PAM sequence: TTT
gagttaacacagacctttcc

SEQ ID NO: 270476 - DNA, 20 bp, Artificial Sequence
  Description of Artificial Sequence: Synthetic oligonucleotide
  Target: ATXN1; (+) strand; PAM type: YTN; PAM sequence: TTG
agttaacacagacctttcca

SEQ ID NO: 270477 - DNA, 20 bp, Artificial Sequence
  Description of Artificial Sequence: Synthetic oligonucleotide
  Target: ATXN1; (+) strand; PAM type: YTN; PAM sequence: TTA
acacagacctttccaggtca

SEQ ID NO: 270478 - DNA, 20 bp, Artificial Sequence
  Description of Artificial Sequence: Synthetic oligonucleotide
  Target: ATXN1; (+) strand; PAM type: YTN; PAM sequence: CTT
tccaggtcaggtgtagaatc

SEQ ID NO: 270479 - DNA, 20 bp, Artificial Sequence
  Description of Artificial Sequence: Synthetic oligonucleotide
  Target: ATXN1; (+) strand; PAM type: YTN; PAM sequence: TTT
ccaggtcaggtgtagaatct

SEQ ID NO: 270480 - DNA, 20 bp, Artificial Sequence
  Description of Artificial Sequence: Synthetic oligonucleotide
  Target: ATXN1; (+) strand; PAM type: YTN; PAM sequence: TTC
caggtcaggtgtagaatctg

SEQ ID NO: 270481 - DNA, 20 bp, Artificial Sequence
  Description of Artificial Sequence: Synthetic oligonucleotide
  Target: ATXN1; (+) strand; PAM type: YTN; PAM sequence: CTG
gagtgatgaatggaagggct

SEQ ID NO: 270482 - DNA, 20 bp, Artificial Sequence
  Description of Artificial Sequence: Synthetic oligonucleotide
  Target: ATXN1; (+) strand; PAM type: YTN; PAM sequence: CTG
gaaaggaaatgaagaccagt

SEQ ID NO: 270483 - DNA, 20 bp, Artificial Sequence
  Description of Artificial Sequence: Synthetic oligonucleotide
  Target: ATXN1; (+) strand; PAM type: YTN; PAM sequence: CTC
tttgcagaagttgaacatta

SEQ ID NO: 270484 - DNA, 20 bp, Artificial Sequence
  Description of Artificial Sequence: Synthetic oligonucleotide
  Target: ATXN1; (+) strand; PAM type: YTN; PAM sequence: CTT
tgcagaagttgaacattaga

SEQ ID NO: 270485 - DNA, 20 bp, Artificial Sequence
  Description of Artificial Sequence: Synthetic oligonucleotide
  Target: ATXN1; (+) strand; PAM type: YTN; PAM sequence: TTT
gcagaagttgaacattagag

SEQ ID NO: 270486 - DNA, 20 bp, Artificial Sequence
  Description of Artificial Sequence: Synthetic oligonucleotide
  Target: ATXN1; (+) strand; PAM type: YTN; PAM sequence: TTG
cagaagttgaacattagagg

SEQ ID NO: 270487 - DNA, 20 bp, Artificial Sequence
  Description of Artificial Sequence: Synthetic oligonucleotide
  Target: ATXN1; (+) strand; PAM type: YTN; PAM sequence: TTG
aacattagaggaaaaaacag

SEQ ID NO: 270488 - DNA, 20 bp, Artificial Sequence
  Description of Artificial Sequence: Synthetic oligonucleotide
  Target: ATXN1; (+) strand; PAM type: YTN; PAM sequence: TTA
gaggaaaaaacagaataaga

SEQ ID NO: 270489 - DNA, 20 bp, Artificial Sequence
  Description of Artificial Sequence: Synthetic oligonucleotide
  Target: ATXN1; (+) strand; PAM type: YTN; PAM sequence: CTG
gtttaaggctatatgtgcag

SEQ ID NO: 270490 - DNA, 20 bp, Artificial Sequence
  Description of Artificial Sequence: Synthetic oligonucleotide
  Target: ATXN1; (+) strand; PAM type: YTN; PAM sequence: TTT
aaggctatatgtgcaggatt

SEQ ID NO: 270491 - DNA, 20 bp, Artificial Sequence
  Description of Artificial Sequence: Synthetic oligonucleotide
  Target: ATXN1; (+) strand; PAM type: YTN; PAM sequence: TTA
aggctatatgtgcaggatta

SEQ ID NO: 270492 - DNA, 20 bp, Artificial Sequence
  Description of Artificial Sequence: Synthetic oligonucleotide
  Target: ATXN1; (+) strand; PAM type: YTN; PAM sequence: CTA
tatgtgcaggattagagaag

SEQ ID NO: 270493 - DNA, 20 bp, Artificial Sequence
  Description of Artificial Sequence: Synthetic oligonucleotide
  Target: ATXN1; (+) strand; PAM type: YTN; PAM sequence: TTA
gagaagagatggggtcaaag

SEQ ID NO: 270494 - DNA, 20 bp, Artificial Sequence
  Description of Artificial Sequence: Synthetic oligonucleotide
  Target: ATXN1; (+) strand; PAM type: YTN; PAM sequence: TTT
tttaatgaagataaaattca

SEQ ID NO: 270495 - DNA, 20 bp, Artificial Sequence
  Description of Artificial Sequence: Synthetic oligonucleotide
  Target: ATXN1; (+) strand; PAM type: YTN; PAM sequence: TTT
ttaatgaagataaaattcac

SEQ ID NO: 270496 - DNA, 20 bp, Artificial Sequence
  Description of Artificial Sequence: Synthetic oligonucleotide
  Target: ATXN1; (+) strand; PAM type: YTN; PAM sequence: TTT
taatgaagataaaattcaca

SEQ ID NO: 270497 - DNA, 20 bp, Artificial Sequence
  Description of Artificial Sequence: Synthetic oligonucleotide
  Target: ATXN1; (+) strand; PAM type: YTN; PAM sequence: TTT
aatgaagataaaattcacat

SEQ ID NO: 270498 - DNA, 20 bp, Artificial Sequence
  Description of Artificial Sequence: Synthetic oligonucleotide
  Target: ATXN1; (+) strand; PAM type: YTN; PAM sequence: TTA
atgaagataaaattcacata

SEQ ID NO: 270499 - DNA, 20 bp, Artificial Sequence
  Description of Artificial Sequence: Synthetic oligonucleotide
  Target: ATXN1; (+) strand; PAM type: YTN; PAM sequence: TTC
acataaaacaaaattcagca

SEQ ID NO: 270500 - DNA, 20 bp, Artificial Sequence
  Description of Artificial Sequence: Synthetic oligonucleotide
  Target: ATXN1; (+) strand; PAM type: YTN; PAM sequence: TTC
agcattttaactgtttttaa

SEQ ID NO: 270501 - DNA, 20 bp, Artificial Sequence
  Description of Artificial Sequence: Synthetic oligonucleotide
  Target: ATXN1; (+) strand; PAM type: YTN; PAM sequence: TTT
taactgtttttaaagtgtgt

SEQ ID NO: 270502 - DNA, 20 bp, Artificial Sequence
  Description of Artificial Sequence: Synthetic oligonucleotide
  Target: ATXN1; (+) strand; PAM type: YTN; PAM sequence: TTT
aactgtttttaaagtgtgta

SEQ ID NO: 270503 - DNA, 20 bp, Artificial Sequence
  Description of Artificial Sequence: Synthetic oligonucleotide
  Target: ATXN1; (+) strand; PAM type: YTN; PAM sequence: TTA
actgtttttaaagtgtgtaa

SEQ ID NO: 270504 - DNA, 20 bp, Artificial Sequence
  Description of Artificial Sequence: Synthetic oligonucleotide
  Target: ATXN1; (+) strand; PAM type: YTN; PAM sequence: CTG
tttttaaagtgtgtaagtca

SEQ ID NO: 270505 - DNA, 20 bp, Artificial Sequence
  Description of Artificial Sequence: Synthetic oligonucleotide
  Target: ATXN1; (+) strand; PAM type: YTN; PAM sequence: TTT
ttaaagtgtgtaagtcagtg

SEQ ID NO: 270506 - DNA, 20 bp, Artificial Sequence
  Description of Artificial Sequence: Synthetic oligonucleotide
  Target: ATXN1; (+) strand; PAM type: YTN; PAM sequence: TTT
taaagtgtgtaagtcagtgg

SEQ ID NO: 270507 - DNA, 20 bp, Artificial Sequence
  Description of Artificial Sequence: Synthetic oligonucleotide
  Target: ATXN1; (+) strand; PAM type: YTN; PAM sequence: TTT
aaagtgtgtaagtcagtggc

SEQ ID NO: 270508 - DNA, 20 bp, Artificial Sequence
  Description of Artificial Sequence: Synthetic oligonucleotide
  Target: ATXN1; (+) strand; PAM type: YTN; PAM sequence: TTA
aagtgtgtaagtcagtggct

SEQ ID NO: 270509 - DNA, 20 bp, Artificial Sequence
  Description of Artificial Sequence: Synthetic oligonucleotide
  Target: ATXN1; (+) strand; PAM type: YTN; PAM sequence: CTT
ttactccatccacatgttga

SEQ ID NO: 270510 - DNA, 20 bp, Artificial Sequence
  Description of Artificial Sequence: Synthetic oligonucleotide
  Target: ATXN1; (+) strand; PAM type: YTN; PAM sequence: TTT
tactccatccacatgttgaa

SEQ ID NO: 270511 - DNA, 20 bp, Artificial Sequence
  Description of Artificial Sequence: Synthetic oligonucleotide
  Target: ATXN1; (+) strand; PAM type: YTN; PAM sequence: TTT
actccatccacatgttgaac

SEQ ID NO: 270512 - DNA, 20 bp, Artificial Sequence
  Description of Artificial Sequence: Synthetic oligonucleotide
  Target: ATXN1; (+) strand; PAM type: YTN; PAM sequence: TTA
ctccatccacatgttgaaca

SEQ ID NO: 270513 - DNA, 20 bp, Artificial Sequence
  Description of Artificial Sequence: Synthetic oligonucleotide
  Target: ATXN1; (+) strand; PAM type: YTN; PAM sequence: CTC
catccacatgttgaacaacc

SEQ ID NO: 270514 - DNA, 20 bp, Artificial Sequence
  Description of Artificial Sequence: Synthetic oligonucleotide
  Target: ATXN1; (+) strand; PAM type: YTN; PAM sequence: TTG
aacaaccatcatcactatct

SEQ ID NO: 270515 - DNA, 20 bp, Artificial Sequence
  Description of Artificial Sequence: Synthetic oligonucleotide
  Target: ATXN1; (+) strand; PAM type: YTN; PAM sequence: CTA
tctaattccagaagattgtc

SEQ ID NO: 270516 - DNA, 20 bp, Artificial Sequence
  Description of Artificial Sequence: Synthetic oligonucleotide
  Target: ATXN1; (+) strand; PAM type: YTN; PAM sequence: CTA
attccagaagattgtcatca

SEQ ID NO: 270517 - DNA, 20 bp, Artificial Sequence
  Description of Artificial Sequence: Synthetic oligonucleotide
  Target: ATXN1; (+) strand; PAM type: YTN; PAM sequence: TTC
cagaagattgtcatcatccc

SEQ ID NO: 270518 - DNA, 20 bp, Artificial Sequence
  Description of Artificial Sequence: Synthetic oligonucleotide
  Target: ATXN1; (+) strand; PAM type: YTN; PAM sequence: TTG
tcatcatcccccttatccat

SEQ ID NO: 270519 - DNA, 20 bp, Artificial Sequence
  Description of Artificial Sequence: Synthetic oligonucleotide
  Target: ATXN1; (+) strand; PAM type: YTN; PAM sequence: CTT
atccatgaaacagtcactcc

SEQ ID NO: 270520 - DNA, 20 bp, Artificial Sequence
  Description of Artificial Sequence: Synthetic oligonucleotide
  Target: ATXN1; (+) strand; PAM type: YTN; PAM sequence: TTA
tccatgaaacagtcactccc

SEQ ID NO: 270521 - DNA, 20 bp, Artificial Sequence
  Description of Artificial Sequence: Synthetic oligonucleotide
  Target: ATXN1; (+) strand; PAM type: YTN; PAM sequence: CTC
cctgtcccccactcctctca

SEQ ID NO: 270522 - DNA, 20 bp, Artificial Sequence
  Description of Artificial Sequence: Synthetic oligonucleotide
  Target: ATXN1; (+) strand; PAM type: YTN; PAM sequence: CTG
tcccccactcctctcagccc

SEQ ID NO: 270523 - DNA, 20 bp, Artificial Sequence
  Description of Artificial Sequence: Synthetic oligonucleotide
  Target: ATXN1; (+) strand; PAM type: YTN; PAM sequence: CTC
ctctcagcccctggcaaaga

SEQ ID NO: 270524 - DNA, 20 bp, Artificial Sequence
  Description of Artificial Sequence: Synthetic oligonucleotide
  Target: ATXN1; (+) strand; PAM type: YTN; PAM sequence: CTC
tcagcccctggcaaagacta

SEQ ID NO: 270525 - DNA, 20 bp, Artificial Sequence
  Description of Artificial Sequence: Synthetic oligonucleotide
  Target: ATXN1; (+) strand; PAM type: YTN; PAM sequence: CTC
agcccctggcaaagactaat

SEQ ID NO: 270526 - DNA, 20 bp, Artificial Sequence
  Description of Artificial Sequence: Synthetic oligonucleotide
  Target: ATXN1; (+) strand; PAM type: YTN; PAM sequence: CTG
gcaaagactaatctactttc

SEQ ID NO: 270527 - DNA, 20 bp, Artificial Sequence
  Description of Artificial Sequence: Synthetic oligonucleotide
  Target: ATXN1; (+) strand; PAM type: YTN; PAM sequence: CTA
atctactttctgactctaag

SEQ ID NO: 270528 - DNA, 20 bp, Artificial Sequence
  Description of Artificial Sequence: Synthetic oligonucleotide
  Target: ATXN1; (+) strand; PAM type: YTN; PAM sequence: CTA
ctttctgactctaaggagtt

SEQ ID NO: 270529 - DNA, 20 bp, Artificial Sequence
  Description of Artificial Sequence: Synthetic oligonucleotide
  Target: ATXN1; (+) strand; PAM type: YTN; PAM sequence: CTT
tctgactctaaggagttgtc

SEQ ID NO: 270530 - DNA, 20 bp, Artificial Sequence
  Description of Artificial Sequence: Synthetic oligonucleotide
  Target: ATXN1; (+) strand; PAM type: YTN; PAM sequence: TTT
ctgactctaaggagttgtct

SEQ ID NO: 270531 - DNA, 20 bp, Artificial Sequence
  Description of Artificial Sequence: Synthetic oligonucleotide
  Target: ATXN1; (+) strand; PAM type: YTN; PAM sequence: TTC
tgactctaaggagttgtcta

SEQ ID NO: 270532 - DNA, 20 bp, Artificial Sequence
  Description of Artificial Sequence: Synthetic oligonucleotide
  Target: ATXN1; (+) strand; PAM type: YTN; PAM sequence: CTG
actctaaggagttgtctatt

SEQ ID NO: 270533 - DNA, 20 bp, Artificial Sequence
  Description of Artificial Sequence: Synthetic oligonucleotide
  Target: ATXN1; (+) strand; PAM type: YTN; PAM sequence: CTC
taaggagttgtctattctgg

SEQ ID NO: 270534 - DNA, 20 bp, Artificial Sequence
  Description of Artificial Sequence: Synthetic oligonucleotide
  Target: ATXN1; (+) strand; PAM type: YTN; PAM sequence: CTA
aggagttgtctattctggat

SEQ ID NO: 270535 - DNA, 20 bp, Artificial Sequence
  Description of Artificial Sequence: Synthetic oligonucleotide
  Target: ATXN1; (+) strand; PAM type: YTN; PAM sequence: TTG
tctattctggatgttgtgta

SEQ ID NO: 270536 - DNA, 20 bp, Artificial Sequence
  Description of Artificial Sequence: Synthetic oligonucleotide
  Target: ATXN1; (+) strand; PAM type: YTN; PAM sequence: CTA
ttctggatgttgtgtataaa

SEQ ID NO: 270537 - DNA, 20 bp, Artificial Sequence
  Description of Artificial Sequence: Synthetic oligonucleotide
  Target: ATXN1; (+) strand; PAM type: YTN; PAM sequence: TTC
tggatgttgtgtataaactg

SEQ ID NO: 270538 - DNA, 20 bp, Artificial Sequence
  Description of Artificial Sequence: Synthetic oligonucleotide
  Target: ATXN1; (+) strand; PAM type: YTN; PAM sequence: CTG
gatgttgtgtataaactgaa

SEQ ID NO: 270539 - DNA, 20 bp, Artificial Sequence
  Description of Artificial Sequence: Synthetic oligonucleotide
  Target: ATXN1; (+) strand; PAM type: YTN; PAM sequence: TTG
tgtataaactgaatcataca

SEQ ID NO: 270540 - DNA, 20 bp, Artificial Sequence
  Description of Artificial Sequence: Synthetic oligonucleotide
  Target: ATXN1; (+) strand; PAM type: YTN; PAM sequence: CTG
aatcatacaatatgtggcct

SEQ ID NO: 270541 - DNA, 20 bp, Artificial Sequence
  Description of Artificial Sequence: Synthetic oligonucleotide
  Target: ATXN1; (+) strand; PAM type: YTN; PAM sequence: CTT
ttgtgtctggctgctttctc

SEQ ID NO: 270542 - DNA, 20 bp, Artificial Sequence
  Description of Artificial Sequence: Synthetic oligonucleotide
  Target: ATXN1; (+) strand; PAM type: YTN; PAM sequence: TTT
tgtgtctggctgctttctct

SEQ ID NO: 270543 - DNA, 20 bp, Artificial Sequence
  Description of Artificial Sequence: Synthetic oligonucleotide
  Target: ATXN1; (+) strand; PAM type: YTN; PAM sequence: TTT
gtgtctggctgctttctctt

SEQ ID NO: 270544 - DNA, 20 bp, Artificial Sequence
  Description of Artificial Sequence: Synthetic oligonucleotide
  Target: ATXN1; (+) strand; PAM type: YTN; PAM sequence: TTG
tgtctggctgctttctcttg

SEQ ID NO: 270545 - DNA, 20 bp, Artificial Sequence
  Description of Artificial Sequence: Synthetic oligonucleotide
  Target: ATXN1; (+) strand; PAM type: YTN; PAM sequence: CTG
gctgctttctcttggcataa

SEQ ID NO: 270546 - DNA, 20 bp, Artificial Sequence
  Description of Artificial Sequence: Synthetic oligonucleotide
  Target: ATXN1; (+) strand; PAM type: YTN; PAM sequence: CTG
ctttctcttggcataatgtt

SEQ ID NO: 270547 - DNA, 20 bp, Artificial Sequence
  Description of Artificial Sequence: Synthetic oligonucleotide
  Target: ATXN1; (+) strand; PAM type: YTN; PAM sequence: CTT
tctcttggcataatgttttc

SEQ ID NO: 270548 - DNA, 20 bp, Artificial Sequence
  Description of Artificial Sequence: Synthetic oligonucleotide
  Target: ATXN1; (+) strand; PAM type: YTN; PAM sequence: TTT
ctcttggcataatgttttca

SEQ ID NO: 270549 - DNA, 20 bp, Artificial Sequence
  Description of Artificial Sequence: Synthetic oligonucleotide
  Target: ATXN1; (+) strand; PAM type: YTN; PAM sequence: TTC
tcttggcataatgttttcaa

SEQ ID NO: 270550 - DNA, 20 bp, Artificial Sequence
  Description of Artificial Sequence: Synthetic oligonucleotide
  Target: ATXN1; (+) strand; PAM type: YTN; PAM sequence: CTC
ttggcataatgttttcaagg

SEQ ID NO: 270551 - DNA, 20 bp, Artificial Sequence
  Description of Artificial Sequence: Synthetic oligonucleotide
  Target: ATXN1; (+) strand; PAM type: YTN; PAM sequence: CTT
ggcataatgttttcaaggct

SEQ ID NO: 270552 - DNA, 20 bp, Artificial Sequence
  Description of Artificial Sequence: Synthetic oligonucleotide
  Target: ATXN1; (+) strand; PAM type: YTN; PAM sequence: TTG
gcataatgttttcaaggctc

SEQ ID NO: 270553 - DNA, 20 bp, Artificial Sequence
  Description of Artificial Sequence: Synthetic oligonucleotide
  Target: ATXN1; (+) strand; PAM type: YTN; PAM sequence: TTT
tcaaggctcattcatattgt

SEQ ID NO: 270554 - DNA, 20 bp, Artificial Sequence
  Description of Artificial Sequence: Synthetic oligonucleotide
  Target: ATXN1; (+) strand; PAM type: YTN; PAM sequence: TTT
caaggctcattcatattgta

SEQ ID NO: 270555 - DNA, 20 bp, Artificial Sequence
  Description of Artificial Sequence: Synthetic oligonucleotide
  Target: ATXN1; (+) strand; PAM type: YTN; PAM sequence: TTC
aaggctcattcatattgtaa

SEQ ID NO: 270556 - DNA, 20 bp, Artificial Sequence
  Description of Artificial Sequence: Synthetic oligonucleotide
  Target: ATXN1; (+) strand; PAM type: YTN; PAM sequence: CTC
attcatattgtaacatgtac

SEQ ID NO: 270557 - DNA, 20 bp, Artificial Sequence
  Description of Artificial Sequence: Synthetic oligonucleotide
  Target: ATXN1; (+) strand; PAM type: YTN; PAM sequence: TTC
atattgtaacatgtaccagt

SEQ ID NO: 270558 - DNA, 20 bp, Artificial Sequence
  Description of Artificial Sequence: Synthetic oligonucleotide
  Target: ATXN1; (+) strand; PAM type: YTN; PAM sequence: TTG
taacatgtaccagtacttca

SEQ ID NO: 270559 - DNA, 20 bp, Artificial Sequence
  Description of Artificial Sequence: Synthetic oligonucleotide
  Target: ATXN1; (+) strand; PAM type: YTN; PAM sequence: CTT
cattcttgttttggttcaat

SEQ ID NO: 270560 - DNA, 20 bp, Artificial Sequence
  Description of Artificial Sequence: Synthetic oligonucleotide
  Target: ATXN1; (+) strand; PAM type: YTN; PAM sequence: TTC
attcttgttttggttcaata

SEQ ID NO: 270561 - DNA, 20 bp, Artificial Sequence
  Description of Artificial Sequence: Synthetic oligonucleotide
  Target: ATXN1; (+) strand; PAM type: YTN; PAM sequence: TTC
ttgttttggttcaataatac

SEQ ID NO: 270562 - DNA, 20 bp, Artificial Sequence
  Description of Artificial Sequence: Synthetic oligonucleotide
  Target: ATXN1; (+) strand; PAM type: YTN; PAM sequence: CTT
gttttggttcaataatactc

SEQ ID NO: 270563 - DNA, 20 bp, Artificial Sequence
  Description of Artificial Sequence: Synthetic oligonucleotide
  Target: ATXN1; (+) strand; PAM type: YTN; PAM sequence: TTG
ttttggttcaataatactct

SEQ ID NO: 270564 - DNA, 20 bp, Artificial Sequence
  Description of Artificial Sequence: Synthetic oligonucleotide
  Target: ATXN1; (+) strand; PAM type: YTN; PAM sequence: TTT
tggttcaataatactctatt

SEQ ID NO: 270565 - DNA, 20 bp, Artificial Sequence
  Description of Artificial Sequence: Synthetic oligonucleotide
  Target: ATXN1; (+) strand; PAM type: YTN; PAM sequence: TTT
ggttcaataatactctattg

SEQ ID NO: 270566 - DNA, 20 bp, Artificial Sequence
  Description of Artificial Sequence: Synthetic oligonucleotide
  Target: ATXN1; (+) strand; PAM type: YTN; PAM sequence: TTG
gttcaataatactctattgt

SEQ ID NO: 270567 - DNA, 20 bp, Artificial Sequence
  Description of Artificial Sequence: Synthetic oligonucleotide
  Target: ATXN1; (+) strand; PAM type: YTN; PAM sequence: TTC
aataatactctattgtaggc

SEQ ID NO: 270568 - DNA, 20 bp, Artificial Sequence
  Description of Artificial Sequence: Synthetic oligonucleotide
  Target: ATXN1; (+) strand; PAM type: YTN; PAM sequence: CTC
tattgtaggctataccacat

SEQ ID NO: 270569 - DNA, 20 bp, Artificial Sequence
  Description of Artificial Sequence: Synthetic oligonucleotide
  Target: ATXN1; (+) strand; PAM type: YTN; PAM sequence: CTA
ttgtaggctataccacattt

SEQ ID NO: 270570 - DNA, 20 bp, Artificial Sequence
  Description of Artificial Sequence: Synthetic oligonucleotide
  Target: ATXN1; (+) strand; PAM type: YTN; PAM sequence: TTG
taggctataccacattttgt

SEQ ID NO: 270571 - DNA, 20 bp, Artificial Sequence
  Description of Artificial Sequence: Synthetic oligonucleotide
  Target: ATXN1; (+) strand; PAM type: YTN; PAM sequence: CTA
taccacattttgttatttat

SEQ ID NO: 270572 - DNA, 20 bp, Artificial Sequence
  Description of Artificial Sequence: Synthetic oligonucleotide
  Target: ATXN1; (+) strand; PAM type: YTN; PAM sequence: TTT
tgttatttattcgtcagttg

SEQ ID NO: 270573 - DNA, 20 bp, Artificial Sequence
  Description of Artificial Sequence: Synthetic oligonucleotide
  Target: ATXN1; (+) strand; PAM type: YTN; PAM sequence: TTT
gttatttattcgtcagttga

SEQ ID NO: 270574 - DNA, 20 bp, Artificial Sequence
  Description of Artificial Sequence: Synthetic oligonucleotide
  Target: ATXN1; (+) strand; PAM type: YTN; PAM sequence: TTG
ttatttattcgtcagttgat

SEQ ID NO: 270575 - DNA, 20 bp, Artificial Sequence
  Description of Artificial Sequence: Synthetic oligonucleotide
  Target: ATXN1; (+) strand; PAM type: YTN; PAM sequence: TTA
tttattcgtcagttgatgga

SEQ ID NO: 270576 - DNA, 20 bp, Artificial Sequence
  Description of Artificial Sequence: Synthetic oligonucleotide
  Target: ATXN1; (+) strand; PAM type: YTN; PAM sequence: TTT
attcgtcagttgatggacat

SEQ ID NO: 270577 - DNA, 20 bp, Artificial Sequence
  Description of Artificial Sequence: Synthetic oligonucleotide
  Target: ATXN1; (+) strand; PAM type: YTN; PAM sequence: TTA
ttcgtcagttgatggacatt

SEQ ID NO: 270578 - DNA, 20 bp, Artificial Sequence
  Description of Artificial Sequence: Synthetic oligonucleotide
  Target: ATXN1; (+) strand; PAM type: YTN; PAM sequence: TTC
gtcagttgatggacatttgg

SEQ ID NO: 270579 - DNA, 20 bp, Artificial Sequence
  Description of Artificial Sequence: Synthetic oligonucleotide
  Target: ATXN1; (+) strand; PAM type: YTN; PAM sequence: TTG
atggacatttgggatgattc

SEQ ID NO: 270580 - DNA, 20 bp, Artificial Sequence
  Description of Artificial Sequence: Synthetic oligonucleotide
  Target: ATXN1; (+) strand; PAM type: YTN; PAM sequence: TTT
gggatgattccatatttggg

SEQ ID NO: 270581 - DNA, 20 bp, Artificial Sequence
  Description of Artificial Sequence: Synthetic oligonucleotide
  Target: ATXN1; (+) strand; PAM type: YTN; PAM sequence: TTG
ggatgattccatatttgggc

SEQ ID NO: 270582 - DNA, 20 bp, Artificial Sequence
  Description of Artificial Sequence: Synthetic oligonucleotide
  Target: ATXN1; (+) strand; PAM type: YTN; PAM sequence: TTC
catatttgggctactatgaa

SEQ ID NO: 270583 - DNA, 20 bp, Artificial Sequence
  Description of Artificial Sequence: Synthetic oligonucleotide
  Target: ATXN1; (+) strand; PAM type: YTN; PAM sequence: TTT
gggctactatgaatcatgct

SEQ ID NO: 270584 - DNA, 20 bp, Artificial Sequence
  Description of Artificial Sequence: Synthetic oligonucleotide
  Target: ATXN1; (+) strand; PAM type: YTN; PAM sequence: TTG
ggctactatgaatcatgctg

SEQ ID NO: 270585 - DNA, 20 bp, Artificial Sequence
  Description of Artificial Sequence: Synthetic oligonucleotide
  Target: ATXN1; (+) strand; PAM type: YTN; PAM sequence: CTA
ctatgaatcatgctgctatg

SEQ ID NO: 270586 - DNA, 20 bp, Artificial Sequence
  Description of Artificial Sequence: Synthetic oligonucleotide
  Target: ATXN1; (+) strand; PAM type: YTN; PAM sequence: CTA
tgaatcatgctgctatgaac

SEQ ID NO: 270587 - DNA, 20 bp, Artificial Sequence
  Description of Artificial Sequence: Synthetic oligonucleotide
  Target: ATXN1; (+) strand; PAM type: YTN; PAM sequence: CTG
ctatgaacattcatgtacat

SEQ ID NO: 270588 - DNA, 20 bp, Artificial Sequence
  Description of Artificial Sequence: Synthetic oligonucleotide
  Target: ATXN1; (+) strand; PAM type: YTN; PAM sequence: CTA
tgaacattcatgtacatgtt

SEQ ID NO: 270589 - DNA, 20 bp, Artificial Sequence
  Description of Artificial Sequence: Synthetic oligonucleotide
  Target: ATXN1; (+) strand; PAM type: YTN; PAM sequence: TTC
atgtacatgtttttgtttga

SEQ ID NO: 270590 - DNA, 20 bp, Artificial Sequence
  Description of Artificial Sequence: Synthetic oligonucleotide
  Target: ATXN1; (+) strand; PAM type: YTN; PAM sequence: TTT
ttgtttgaatacctgtttgc

SEQ ID NO: 270591 - DNA, 20 bp, Artificial Sequence
  Description of Artificial Sequence: Synthetic oligonucleotide
  Target: ATXN1; (+) strand; PAM type: YTN; PAM sequence: TTT
tgtttgaatacctgtttgca

SEQ ID NO: 270592 - DNA, 20 bp, Artificial Sequence
  Description of Artificial Sequence: Synthetic oligonucleotide
  Target: ATXN1; (+) strand; PAM type: YTN; PAM sequence: TTT
gtttgaatacctgtttgcaa

SEQ ID NO: 270593 - DNA, 20 bp, Artificial Sequence
  Description of Artificial Sequence: Synthetic oligonucleotide
  Target: ATXN1; (+) strand; PAM type: YTN; PAM sequence: TTG
tttgaatacctgtttgcaaa

SEQ ID NO: 270594 - DNA, 20 bp, Artificial Sequence
  Description of Artificial Sequence: Synthetic oligonucleotide
  Target: ATXN1; (+) strand; PAM type: YTN; PAM sequence: TTT
gaatacctgtttgcaaatct

SEQ ID NO: 270595 - DNA, 20 bp, Artificial Sequence
  Description of Artificial Sequence: Synthetic oligonucleotide
  Target: ATXN1; (+) strand; PAM type: YTN; PAM sequence: TTG
aatacctgtttgcaaatctc

SEQ ID NO: 270596 - DNA, 20 bp, Artificial Sequence
  Description of Artificial Sequence: Synthetic oligonucleotide
  Target: ATXN1; (+) strand; PAM type: YTN; PAM sequence: CTG
tttgcaaatctcttcagtgt

SEQ ID NO: 270597 - DNA, 20 bp, Artificial Sequence
  Description of Artificial Sequence: Synthetic oligonucleotide
  Target: ATXN1; (+) strand; PAM type: YTN; PAM sequence: TTT
gcaaatctcttcagtgtata

SEQ ID NO: 270598 - DNA, 20 bp, Artificial Sequence
  Description of Artificial Sequence: Synthetic oligonucleotide
  Target: ATXN1; (+) strand; PAM type: YTN; PAM sequence: TTG
caaatctcttcagtgtatac

SEQ ID NO: 270599 - DNA, 20 bp, Artificial Sequence
  Description of Artificial Sequence: Synthetic oligonucleotide
  Target: ATXN1; (+) strand; PAM type: YTN; PAM sequence: CTC
ttcagtgtatacctaagagc

SEQ ID NO: 270600 - DNA, 20 bp, Artificial Sequence
  Description of Artificial Sequence: Synthetic oligonucleotide
  Target: ATXN1; (+) strand; PAM type: YTN; PAM sequence: CTT
cagtgtatacctaagagcag

SEQ ID NO: 270601 - DNA, 20 bp, Artificial Sequence
  Description of Artificial Sequence: Synthetic oligonucleotide
  Target: ATXN1; (+) strand; PAM type: YTN; PAM sequence: TTC
agtgtatacctaagagcaga

SEQ ID NO: 270602 - DNA, 20 bp, Artificial Sequence
  Description of Artificial Sequence: Synthetic oligonucleotide
  Target: ATXN1; (+) strand; PAM type: YTN; PAM sequence: CTA
agagcagaactactgagtca

SEQ ID NO: 270603 - DNA, 20 bp, Artificial Sequence
  Description of Artificial Sequence: Synthetic oligonucleotide
  Target: ATXN1; (+) strand; PAM type: YTN; PAM sequence: CTA
ctgagtcatatgttaattct

SEQ ID NO: 270604 - DNA, 20 bp, Artificial Sequence
  Description of Artificial Sequence: Synthetic oligonucleotide
  Target: ATXN1; (+) strand; PAM type: YTN; PAM sequence: CTG
agtcatatgttaattctgta

SEQ ID NO: 270605 - DNA, 20 bp, Artificial Sequence
  Description of Artificial Sequence: Synthetic oligonucleotide
  Target: ATXN1; (+) strand; PAM type: YTN; PAM sequence: TTA
attctgtatttagctatttg

SEQ ID NO: 270606 - DNA, 20 bp, Artificial Sequence
  Description of Artificial Sequence: Synthetic oligonucleotide
  Target: ATXN1; (+) strand; PAM type: YTN; PAM sequence: TTC
tgtatttagctatttgagga

SEQ ID NO: 270607 - DNA, 20 bp, Artificial Sequence
  Description of Artificial Sequence: Synthetic oligonucleotide
  Target: ATXN1; (+) strand; PAM type: YTN; PAM sequence: CTG
tatttagctatttgaggact

SEQ ID NO: 270608 - DNA, 20 bp, Artificial Sequence
  Description of Artificial Sequence: Synthetic oligonucleotide
  Target: ATXN1; (+) strand; PAM type: YTN; PAM sequence: TTT
agctatttgaggacttgcca

SEQ ID NO: 270609 - DNA, 20 bp, Artificial Sequence
  Description of Artificial Sequence: Synthetic oligonucleotide
  Target: ATXN1; (+) strand; PAM type: YTN; PAM sequence: TTA
gctatttgaggacttgccaa

SEQ ID NO: 270610 - DNA, 20 bp, Artificial Sequence
  Description of Artificial Sequence: Synthetic oligonucleotide
  Target: ATXN1; (+) strand; PAM type: YTN; PAM sequence: CTA
tttgaggacttgccaaattg

SEQ ID NO: 270611 - DNA, 20 bp, Artificial Sequence
  Description of Artificial Sequence: Synthetic oligonucleotide
  Target: ATXN1; (+) strand; PAM type: YTN; PAM sequence: TTT
gaggacttgccaaattgttt

SEQ ID NO: 270612 - DNA, 20 bp, Artificial Sequence
  Description of Artificial Sequence: Synthetic oligonucleotide
  Target: ATXN1; (+) strand; PAM type: YTN; PAM sequence: TTG
aggacttgccaaattgtttt

SEQ ID NO: 270613 - DNA, 20 bp, Artificial Sequence
  Description of Artificial Sequence: Synthetic oligonucleotide
  Target: ATXN1; (+) strand; PAM type: YTN; PAM sequence: CTT
gccaaattgttttctatagt

SEQ ID NO: 270614 - DNA, 20 bp, Artificial Sequence
  Description of Artificial Sequence: Synthetic oligonucleotide
  Target: ATXN1; (+) strand; PAM type: YTN; PAM sequence: TTG
ccaaattgttttctatagtg

SEQ ID NO: 270615 - DNA, 20 bp, Artificial Sequence
  Description of Artificial Sequence: Synthetic oligonucleotide
  Target: ATXN1; (+) strand; PAM type: YTN; PAM sequence: TTG
ttttctatagtgattgcacc

SEQ ID NO: 270616 - DNA, 20 bp, Artificial Sequence
  Description of Artificial Sequence: Synthetic oligonucleotide
  Target: ATXN1; (+) strand; PAM type: YTN; PAM sequence: TTT
tctatagtgattgcaccata

SEQ ID NO: 270617 - DNA, 20 bp, Artificial Sequence
  Description of Artificial Sequence: Synthetic oligonucleotide
  Target: ATXN1; (+) strand; PAM type: YTN; PAM sequence: TTT
ctatagtgattgcaccatac

SEQ ID NO: 270618 - DNA, 20 bp, Artificial Sequence
  Description of Artificial Sequence: Synthetic oligonucleotide
  Target: ATXN1; (+) strand; PAM type: YTN; PAM sequence: TTC
tatagtgattgcaccatact

SEQ ID NO: 270619 - DNA, 20 bp, Artificial Sequence
  Description of Artificial Sequence: Synthetic oligonucleotide
  Target: ATXN1; (+) strand; PAM type: YTN; PAM sequence: CTA
tagtgattgcaccatactac

SEQ ID NO: 270620 - DNA, 20 bp, Artificial Sequence
  Description of Artificial Sequence: Synthetic oligonucleotide
  Target: ATXN1; (+) strand; PAM type: YTN; PAM sequence: TTG
caccatactacattcccacc

SEQ ID NO: 270621 - DNA, 20 bp, Artificial Sequence
  Description of Artificial Sequence: Synthetic oligonucleotide
  Target: ATXN1; (+) strand; PAM type: YTN; PAM sequence: CTA
cattcccaccagccaggtag

SEQ ID NO: 270622 - DNA, 20 bp, Artificial Sequence
  Description of Artificial Sequence: Synthetic oligonucleotide
  Target: ATXN1; (+) strand; PAM type: YTN; PAM sequence: TTC
ccaccagccaggtaggaaga

SEQ ID NO: 270623 - DNA, 20 bp, Artificial Sequence
  Description of Artificial Sequence: Synthetic oligonucleotide
  Target: ATXN1; (+) strand; PAM type: YTN; PAM sequence: TTA
ccattttttccacaagcttg

SEQ ID NO: 270624 - DNA, 20 bp, Artificial Sequence
  Description of Artificial Sequence: Synthetic oligonucleotide
  Target: ATXN1; (+) strand; PAM type: YTN; PAM sequence: TTT
tttccacaagcttgccaaca

SEQ ID NO: 270625 - DNA, 20 bp, Artificial Sequence
  Description of Artificial Sequence: Synthetic oligonucleotide
  Target: ATXN1; (+) strand; PAM type: YTN; PAM sequence: TTT
ttccacaagcttgccaacac

SEQ ID NO: 270626 - DNA, 20 bp, Artificial Sequence
  Description of Artificial Sequence: Synthetic oligonucleotide
  Target: ATXN1; (+) strand; PAM type: YTN; PAM sequence: TTT
tccacaagcttgccaacact

SEQ ID NO: 270627 - DNA, 20 bp, Artificial Sequence
  Description of Artificial Sequence: Synthetic oligonucleotide
  Target: ATXN1; (+) strand; PAM type: YTN; PAM sequence: TTT
ccacaagcttgccaacactt

SEQ ID NO: 270628 - DNA, 20 bp, Artificial Sequence
  Description of Artificial Sequence: Synthetic oligonucleotide
  Target: ATXN1; (+) strand; PAM type: YTN; PAM sequence: TTC
cacaagcttgccaacacttg

SEQ ID NO: 270629 - DNA, 20 bp, Artificial Sequence
  Description of Artificial Sequence: Synthetic oligonucleotide
  Target: ATXN1; (+) strand; PAM type: YTN; PAM sequence: CTT
gccaacacttgttattttcc

SEQ ID NO: 270630 - DNA, 20 bp, Artificial Sequence
  Description of Artificial Sequence: Synthetic oligonucleotide
  Target: ATXN1; (+) strand; PAM type: YTN; PAM sequence: TTG
ccaacacttgttattttcct

SEQ ID NO: 270631 - DNA, 20 bp, Artificial Sequence
  Description of Artificial Sequence: Synthetic oligonucleotide
  Target: ATXN1; (+) strand; PAM type: YTN; PAM sequence: CTT
gttattttccttttttaaaa

SEQ ID NO: 270632 - DNA, 20 bp, Artificial Sequence
  Description of Artificial Sequence: Synthetic oligonucleotide
  Target: ATXN1; (+) strand; PAM type: YTN; PAM sequence: TTG
ttattttccttttttaaaaa

SEQ ID NO: 270633 - DNA, 20 bp, Artificial Sequence
  Description of Artificial Sequence: Synthetic oligonucleotide
  Target: ATXN1; (+) strand; PAM type: YTN; PAM sequence: TTA
ttttccttttttaaaaaaat

SEQ ID NO: 270634 - DNA, 20 bp, Artificial Sequence
  Description of Artificial Sequence: Synthetic oligonucleotide
  Target: ATXN1; (+) strand; PAM type: YTN; PAM sequence: TTT
tccttttttaaaaaaattat

SEQ ID NO: 270635 - DNA, 20 bp, Artificial Sequence
  Description of Artificial Sequence: Synthetic oligonucleotide
  Target: ATXN1; (+) strand; PAM type: YTN; PAM sequence: TTT
ccttttttaaaaaaattatg

SEQ ID NO: 270636 - DNA, 20 bp, Artificial Sequence
  Description of Artificial Sequence: Synthetic oligonucleotide
  Target: ATXN1; (+) strand; PAM type: YTN; PAM sequence: TTC
cttttttaaaaaaattatgg

SEQ ID NO: 270637 - DNA, 20 bp, Artificial Sequence
  Description of Artificial Sequence: Synthetic oligonucleotide
  Target: ATXN1; (+) strand; PAM type: YTN; PAM sequence: CTT
ttttaaaaaaattatggcca

SEQ ID NO: 270638 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaattatggccat

SEQ ID NO: 270639 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaattatggccatc

SEQ ID NO: 270640 - DNA, 20 bp, Artificial Sequence
  Description of Artificial Sequence: Synthetic oligonucleotide
  Target: ATXN1; (+) strand; PAM type: YTN; PAM sequence: TTT
taaaaaaattatggccatca

SEQ ID NO: 270641 - DNA, 20 bp, Artificial Sequence
  Description of Artificial Sequence: Synthetic oligonucleotide
  Target: ATXN1; (+) strand; PAM type: YTN; PAM sequence: TTT
aaaaaaattatggccatcat

SEQ ID NO: 270642 - DNA, 20 bp, Artificial Sequence
  Description of Artificial Sequence: Synthetic oligonucleotide
  Target: ATXN1; (+) strand; PAM type: YTN; PAM sequence: TTA
aaaaaattatggccatcata

SEQ ID NO: 270643 - DNA, 20 bp, Artificial Sequence
  Description of Artificial Sequence: Synthetic oligonucleotide
  Target: ATXN1; (+) strand; PAM type: YTN; PAM sequence: TTA
tggccatcataatgggtgac

SEQ ID NO: 270644 - DNA, 20 bp, Artificial Sequence
  Description of Artificial Sequence: Synthetic oligonucleotide
  Target: ATXN1; (+) strand; PAM type: YTN; PAM sequence: CTC
attgtggttttgatttgcat

SEQ ID NO: 270645 - DNA, 20 bp, Artificial Sequence
  Description of Artificial Sequence: Synthetic oligonucleotide
  Target: ATXN1; (+) strand; PAM type: YTN; PAM sequence: TTG
tggttttgatttgcattccc

SEQ ID NO: 270646 - DNA, 20 bp, Artificial Sequence
  Description of Artificial Sequence: Synthetic oligonucleotide
  Target: ATXN1; (+) strand; PAM type: YTN; PAM sequence: TTT
tgatttgcattcccctaaac

SEQ ID NO: 270647 - DNA, 20 bp, Artificial Sequence
  Description of Artificial Sequence: Synthetic oligonucleotide
  Target: ATXN1; (+) strand; PAM type: YTN; PAM sequence: TTT
gatttgcattcccctaaaca

SEQ ID NO: 270648 - DNA, 20 bp, Artificial Sequence
  Description of Artificial Sequence: Synthetic oligonucleotide
  Target: ATXN1; (+) strand; PAM type: YTN; PAM sequence: TTG
atttgcattcccctaaacac

SEQ ID NO: 270649 - DNA, 20 bp, Artificial Sequence
  Description of Artificial Sequence: Synthetic oligonucleotide
  Target: ATXN1; (+) strand; PAM type: YTN; PAM sequence: TTT
gcattcccctaaacactaat

SEQ ID NO: 270650 - DNA, 20 bp, Artificial Sequence
  Description of Artificial Sequence: Synthetic oligonucleotide
  Target: ATXN1; (+) strand; PAM type: YTN; PAM sequence: TTG
cattcccctaaacactaatg

SEQ ID NO: 270651 - DNA, 20 bp, Artificial Sequence
  Description of Artificial Sequence: Synthetic oligonucleotide
  Target: ATXN1; (+) strand; PAM type: YTN; PAM sequence: TTC
ccctaaacactaatgatgtt

SEQ ID NO: 270652 - DNA, 20 bp, Artificial Sequence
  Description of Artificial Sequence: Synthetic oligonucleotide
  Target: ATXN1; (+) strand; PAM type: YTN; PAM sequence: CTA
aacactaatgatgttggaca

SEQ ID NO: 270653 - DNA, 20 bp, Artificial Sequence
  Description of Artificial Sequence: Synthetic oligonucleotide
  Target: ATXN1; (+) strand; PAM type: YTN; PAM sequence: CTA
atgatgttggacatcttttc

SEQ ID NO: 270654 - DNA, 20 bp, Artificial Sequence
  Description of Artificial Sequence: Synthetic oligonucleotide
  Target: ATXN1; (+) strand; PAM type: YTN; PAM sequence: TTG
gacatcttttcataagctta

SEQ ID NO: 270655 - DNA, 20 bp, Artificial Sequence
  Description of Artificial Sequence: Synthetic oligonucleotide
  Target: ATXN1; (+) strand; PAM type: YTN; PAM sequence: CTT
ttcataagcttattggctat

SEQ ID NO: 270656 - DNA, 20 bp, Artificial Sequence
  Description of Artificial Sequence: Synthetic oligonucleotide
  Target: ATXN1; (+) strand; PAM type: YTN; PAM sequence: TTT
tcataagcttattggctatt

SEQ ID NO: 270657 - DNA, 20 bp, Artificial Sequence
  Description of Artificial Sequence: Synthetic oligonucleotide
  Target: ATXN1; (+) strand; PAM type: YTN; PAM sequence: TTT
cataagcttattggctattt

SEQ ID NO: 270658 - DNA, 20 bp, Artificial Sequence
  Description of Artificial Sequence: Synthetic oligonucleotide
  Target: ATXN1; (+) strand; PAM type: YTN; PAM sequence: TTC
ataagcttattggctattta

SEQ ID NO: 270659 - DNA, 20 bp, Artificial Sequence
  Description of Artificial Sequence: Synthetic oligonucleotide
  Target: ATXN1; (+) strand; PAM type: YTN; PAM sequence: CTT
attggctatttatatatctt

SEQ ID NO: 270660 - DNA, 20 bp, Artificial Sequence
  Description of Artificial Sequence: Synthetic oligonucleotide
  Target: ATXN1; (+) strand; PAM type: YTN; PAM sequence: TTA
ttggctatttatatatcttc

SEQ ID NO: 270661 - DNA, 20 bp, Artificial Sequence
  Description of Artificial Sequence: Synthetic oligonucleotide
  Target: ATXN1; (+) strand; PAM type: YTN; PAM sequence: TTG
gctatttatatatcttcttt

SEQ ID NO: 270662 - DNA, 20 bp, Artificial Sequence
  Description of Artificial Sequence: Synthetic oligonucleotide
  Target: ATXN1; (+) strand; PAM type: YTN; PAM sequence: CTA
tttatatatcttctttggag

SEQ ID NO: 270663 - DNA, 20 bp, Artificial Sequence
  Description of Artificial Sequence: Synthetic oligonucleotide
  Target: ATXN1; (+) strand; PAM type: YTN; PAM sequence: TTT
atatatcttctttggagaaa

SEQ ID NO: 270664 - DNA, 20 bp, Artificial Sequence
  Description of Artificial Sequence: Synthetic oligonucleotide
  Target: ATXN1; (+) strand; PAM type: YTN; PAM sequence: TTA
tatatcttctttggagaaat

SEQ ID NO: 270665 - DNA, 20 bp, Artificial Sequence
  Description of Artificial Sequence: Synthetic oligonucleotide
  Target: ATXN1; (+) strand; PAM type: YTN; PAM sequence: CTT
ctttggagaaatctctatcc

SEQ ID NO: 270666 - DNA, 20 bp, Artificial Sequence
  Description of Artificial Sequence: Synthetic oligonucleotide
  Target: ATXN1; (+) strand; PAM type: YTN; PAM sequence: TTC
tttggagaaatctctatcca

SEQ ID NO: 270667 - DNA, 20 bp, Artificial Sequence
  Description of Artificial Sequence: Synthetic oligonucleotide
  Target: ATXN1; (+) strand; PAM type: YTN; PAM sequence: CTT
tggagaaatctctatccaat

SEQ ID NO: 270668 - DNA, 20 bp, Artificial Sequence
  Description of Artificial Sequence: Synthetic oligonucleotide
  Target: ATXN1; (+) strand; PAM type: YTN; PAM sequence: TTT
ggagaaatctctatccaatg

SEQ ID NO: 270669 - DNA, 20 bp, Artificial Sequence
  Description of Artificial Sequence: Synthetic oligonucleotide
  Target: ATXN1; (+) strand; PAM type: YTN; PAM sequence: TTG
gagaaatctctatccaatgc

SEQ ID NO: 270670 - DNA, 20 bp, Artificial Sequence
  Description of Artificial Sequence: Synthetic oligonucleotide
  Target: ATXN1; (+) strand; PAM type: YTN; PAM sequence: CTC
tatccaatgcctttgtccat

SEQ ID NO: 270671 - DNA, 20 bp, Artificial Sequence
  Description of Artificial Sequence: Synthetic oligonucleotide
  Target: ATXN1; (+) strand; PAM type: YTN; PAM sequence: CTA
tccaatgcctttgtccatct

SEQ ID NO: 270672 - DNA, 20 bp, Artificial Sequence
  Description of Artificial Sequence: Synthetic oligonucleotide
  Target: ATXN1; (+) strand; PAM type: YTN; PAM sequence: CTT
tgtccatctttaaactgggt

SEQ ID NO: 270673 - DNA, 20 bp, Artificial Sequence
  Description of Artificial Sequence: Synthetic oligonucleotide
  Target: ATXN1; (+) strand; PAM type: YTN; PAM sequence: TTT
gtccatctttaaactgggtt

SEQ ID NO: 270674 - DNA, 20 bp, Artificial Sequence
  Description of Artificial Sequence: Synthetic oligonucleotide
  Target: ATXN1; (+) strand; PAM type: YTN; PAM sequence: TTG
tccatctttaaactgggttg

SEQ ID NO: 270675 - DNA, 20 bp, Artificial Sequence
  Description of Artificial Sequence: Synthetic oligonucleotide
  Target: ATXN1; (+) strand; PAM type: YTN; PAM sequence: CTT
taaactgggttgttagtctt

SEQ ID NO: 270676 - DNA, 20 bp, Artificial Sequence
  Description of Artificial Sequence: Synthetic oligonucleotide
  Target: ATXN1; (+) strand; PAM type: YTN; PAM sequence: TTT
aaactgggttgttagtcttt

SEQ ID NO: 270677 - DNA, 20 bp, Artificial Sequence
  Description of Artificial Sequence: Synthetic oligonucleotide
  Target: ATXN1; (+) strand; PAM type: YTN; PAM sequence: TTA
aactgggttgttagtctttt

SEQ ID NO: 270678 - DNA, 20 bp, Artificial Sequence
  Description of Artificial Sequence: Synthetic oligonucleotide
  Target: ATXN1; (+) strand; PAM type: YTN; PAM sequence: CTG
ggttgttagtctttttctct

SEQ ID NO: 270679 - DNA, 20 bp, Artificial Sequence
  Description of Artificial Sequence: Synthetic oligonucleotide
  Target: ATXN1; (+) strand; PAM type: YTN; PAM sequence: TTG
ttagtctttttctctttgaa

SEQ ID NO: 270680 - DNA, 20 bp, Artificial Sequence
  Description of Artificial Sequence: Synthetic oligonucleotide
  Target: ATXN1; (+) strand; PAM type: YTN; PAM sequence: TTA
gtctttttctctttgaattg

SEQ ID NO: 270681 - DNA, 20 bp, Artificial Sequence
  Description of Artificial Sequence: Synthetic oligonucleotide
  Target: ATXN1; (+) strand; PAM type: YTN; PAM sequence: CTT
tttctctttgaattgtaaga

SEQ ID NO: 270682 - DNA, 20 bp, Artificial Sequence
  Description of Artificial Sequence: Synthetic oligonucleotide
  Target: ATXN1; (+) strand; PAM type: YTN; PAM sequence: TTT
ttctctttgaattgtaagag

SEQ ID NO: 270683 - DNA, 20 bp, Artificial Sequence
  Description of Artificial Sequence: Synthetic oligonucleotide
  Target: ATXN1; (+) strand; PAM type: YTN; PAM sequence: TTT
tctctttgaattgtaagagt

SEQ ID NO: 270684 - DNA, 20 bp, Artificial Sequence
  Description of Artificial Sequence: Synthetic oligonucleotide
  Target: ATXN1; (+) strand; PAM type: YTN; PAM sequence: TTT
ctctttgaattgtaagagtt

SEQ ID NO: 270685 - DNA, 20 bp, Artificial Sequence
  Description of Artificial Sequence: Synthetic oligonucleotide
  Target: ATXN1; (+) strand; PAM type: YTN; PAM sequence: TTC
tctttgaattgtaagagttc

SEQ ID NO: 270686 - DNA, 20 bp, Artificial Sequence
  Description of Artificial Sequence: Synthetic oligonucleotide
  Target: ATXN1; (+) strand; PAM type: YTN; PAM sequence: CTC
tttgaattgtaagagttctt

SEQ ID NO: 270687 - DNA, 20 bp, Artificial Sequence
  Description of Artificial Sequence: Synthetic oligonucleotide
  Target: ATXN1; (+) strand; PAM type: YTN; PAM sequence: CTT
tgaattgtaagagttcttta

SEQ ID NO: 270688 - DNA, 20 bp, Artificial Sequence
  Description of Artificial Sequence: Synthetic oligonucleotide
  Target: ATXN1; (+) strand; PAM type: YTN; PAM sequence: TTT
gaattgtaagagttctttat

SEQ ID NO: 270689 - DNA, 20 bp, Artificial Sequence
  Description of Artificial Sequence: Synthetic oligonucleotide
  Target: ATXN1; (+) strand; PAM type: YTN; PAM sequence: TTG
aattgtaagagttctttata

SEQ ID NO: 270690 - DNA, 20 bp, Artificial Sequence
  Description of Artificial Sequence: Synthetic oligonucleotide
  Target: ATXN1; (+) strand; PAM type: YTN; PAM sequence: TTG
taagagttctttatatattc

SEQ ID NO: 270691 - DNA, 20 bp, Artificial Sequence
  Description of Artificial Sequence: Synthetic oligonucleotide
  Target: ATXN1; (+) strand; PAM type: YTN; PAM sequence: TTC
tttatatattccagaaacta

SEQ ID NO: 270692 - DNA, 20 bp, Artificial Sequence
  Description of Artificial Sequence: Synthetic oligonucleotide
  Target: ATXN1; (+) strand; PAM type: YTN; PAM sequence: CTT
tatatattccagaaactaga

SEQ ID NO: 270693 - DNA, 20 bp, Artificial Sequence
  Description of Artificial Sequence: Synthetic oligonucleotide
  Target: ATXN1; (+) strand; PAM type: YTN; PAM sequence: TTT
atatattccagaaactagac

SEQ ID NO: 270694 - DNA, 20 bp, Artificial Sequence
  Description of Artificial Sequence: Synthetic oligonucleotide
  Target: ATXN1; (+) strand; PAM type: YTN; PAM sequence: TTA
tatattccagaaactagacc

SEQ ID NO: 270695 - DNA, 20 bp, Artificial Sequence
  Description of Artificial Sequence: Synthetic oligonucleotide
  Target: ATXN1; (+) strand; PAM type: YTN; PAM sequence: TTC
cagaaactagacccttatga

SEQ ID NO: 270696 - DNA, 20 bp, Artificial Sequence
  Description of Artificial Sequence: Synthetic oligonucleotide
  Target: ATXN1; (+) strand; PAM type: YTN; PAM sequence: CTA
gacccttatgagatactgac

SEQ ID NO: 270697 - DNA, 20 bp, Artificial Sequence
  Description of Artificial Sequence: Synthetic oligonucleotide
  Target: ATXN1; (+) strand; PAM type: YTN; PAM sequence: CTT
atgagatactgacttgcaaa

SEQ ID NO: 270698 - DNA, 20 bp, Artificial Sequence
  Description of Artificial Sequence: Synthetic oligonucleotide
  Target: ATXN1; (+) strand; PAM type: YTN; PAM sequence: TTA
tgagatactgacttgcaaat

SEQ ID NO: 270699 - DNA, 20 bp, Artificial Sequence
  Description of Artificial Sequence: Synthetic oligonucleotide
  Target: ATXN1; (+) strand; PAM type: YTN; PAM sequence: CTG
acttgcaaatattttctccc

SEQ ID NO: 270700 - DNA, 20 bp, Artificial Sequence
  Description of Artificial Sequence: Synthetic oligonucleotide
  Target: ATXN1; (+) strand; PAM type: YTN; PAM sequence: CTT
gcaaatattttctcccattc

SEQ ID NO: 270701 - DNA, 20 bp, Artificial Sequence
  Description of Artificial Sequence: Synthetic oligonucleotide
  Target: ATXN1; (+) strand; PAM type: YTN; PAM sequence: TTG
caaatattttctcccattct

SEQ ID NO: 270702 - DNA, 20 bp, Artificial Sequence
  Description of Artificial Sequence: Synthetic oligonucleotide
  Target: ATXN1; (+) strand; PAM type: YTN; PAM sequence: TTT
tctcccattctgtgggctgt

SEQ ID NO: 270703 - DNA, 20 bp, Artificial Sequence
  Description of Artificial Sequence: Synthetic oligonucleotide
  Target: ATXN1; (+) strand; PAM type: YTN; PAM sequence: TTT
ctcccattctgtgggctgtc

SEQ ID NO: 270704 - DNA, 20 bp, Artificial Sequence
  Description of Artificial Sequence: Synthetic oligonucleotide
  Target: ATXN1; (+) strand; PAM type: YTN; PAM sequence: TTC
tcccattctgtgggctgtct

SEQ ID NO: 270705 - DNA, 20 bp, Artificial Sequence
  Description of Artificial Sequence: Synthetic oligonucleotide
  Target: ATXN1; (+) strand; PAM type: YTN; PAM sequence: CTC
ccattctgtgggctgtcttt

SEQ ID NO: 270706 - DNA, 20 bp, Artificial Sequence
  Description of Artificial Sequence: Synthetic oligonucleotide
  Target: ATXN1; (+) strand; PAM type: YTN; PAM sequence: TTC
tgtgggctgtcttttgactt

SEQ ID NO: 270707 - DNA, 20 bp, Artificial Sequence
  Description of Artificial Sequence: Synthetic oligonucleotide
  Target: ATXN1; (+) strand; PAM type: YTN; PAM sequence: CTG
tgggctgtcttttgactttc

SEQ ID NO: 270708 - DNA, 20 bp, Artificial Sequence
  Description of Artificial Sequence: Synthetic oligonucleotide
  Target: ATXN1; (+) strand; PAM type: YTN; PAM sequence: CTG
tcttttgactttcttgacag

SEQ ID NO: 270709 - DNA, 20 bp, Artificial Sequence
  Description of Artificial Sequence: Synthetic oligonucleotide
  Target: ATXN1; (+) strand; PAM type: YTN; PAM sequence: CTT
ttgactttcttgacagtgcc

SEQ ID NO: 270710 - DNA, 20 bp, Artificial Sequence
  Description of Artificial Sequence: Synthetic oligonucleotide
  Target: ATXN1; (+) strand; PAM type: YTN; PAM sequence: TTT
tgactttcttgacagtgccc

SEQ ID NO: 270711 - DNA, 20 bp, Artificial Sequence
  Description of Artificial Sequence: Synthetic oligonucleotide
  Target: ATXN1; (+) strand; PAM type: YTN; PAM sequence: TTT
gactttcttgacagtgccct

SEQ ID NO: 270712 - DNA, 20 bp, Artificial Sequence
  Description of Artificial Sequence: Synthetic oligonucleotide
  Target: ATXN1; (+) strand; PAM type: YTN; PAM sequence: TTG
actttcttgacagtgccctt

SEQ ID NO: 270713 - DNA, 20 bp, Artificial Sequence
  Description of Artificial Sequence: Synthetic oligonucleotide
  Target: ATXN1; (+) strand; PAM type: YTN; PAM sequence: CTT
tcttgacagtgccctttggt

SEQ ID NO: 270714 - DNA, 20 bp, Artificial Sequence
  Description of Artificial Sequence: Synthetic oligonucleotide
  Target: ATXN1; (+) strand; PAM type: YTN; PAM sequence: TTT
cttgacagtgccctttggtt

SEQ ID NO: 270715 - DNA, 20 bp, Artificial Sequence
  Description of Artificial Sequence: Synthetic oligonucleotide
  Target: ATXN1; (+) strand; PAM type: YTN; PAM sequence: TTC
ttgacagtgccctttggttc

SEQ ID NO: 270716 - DNA, 20 bp, Artificial Sequence
  Description of Artificial Sequence: Synthetic oligonucleotide
  Target: ATXN1; (+) strand; PAM type: YTN; PAM sequence: CTT
gacagtgccctttggttcac

SEQ ID NO: 270717 - DNA, 20 bp, Artificial Sequence
  Description of Artificial Sequence: Synthetic oligonucleotide
  Target: ATXN1; (+) strand; PAM type: YTN; PAM sequence: TTG
acagtgccctttggttcaca

SEQ ID NO: 270718 - DNA, 20 bp, Artificial Sequence
  Description of Artificial Sequence: Synthetic oligonucleotide
  Target: ATXN1; (+) strand; PAM type: YTN; PAM sequence: CTT
tggttcacaaaggctttgat

SEQ ID NO: 270719 - DNA, 20 bp, Artificial Sequence
  Description of Artificial Sequence: Synthetic oligonucleotide
  Target: ATXN1; (+) strand; PAM type: YTN; PAM sequence: TTT
ggttcacaaaggctttgata

SEQ ID NO: 270720 - DNA, 20 bp, Artificial Sequence
  Description of Artificial Sequence: Synthetic oligonucleotide
  Target: ATXN1; (+) strand; PAM type: YTN; PAM sequence: TTG
gttcacaaaggctttgatac

SEQ ID NO: 270721 - DNA, 20 bp, Artificial Sequence
  Description of Artificial Sequence: Synthetic oligonucleotide
  Target: ATXN1; (+) strand; PAM type: YTN; PAM sequence: TTC
acaaaggctttgatactgat

SEQ ID NO: 270722 - DNA, 20 bp, Artificial Sequence
  Description of Artificial Sequence: Synthetic oligonucleotide
  Target: ATXN1; (+) strand; PAM type: YTN; PAM sequence: CTT
tgatactgatgaagtccaat

SEQ ID NO: 270723 - DNA, 20 bp, Artificial Sequence
  Description of Artificial Sequence: Synthetic oligonucleotide
  Target: ATXN1; (+) strand; PAM type: YTN; PAM sequence: TTT
gatactgatgaagtccaatg

SEQ ID NO: 270724 - DNA, 20 bp, Artificial Sequence
  Description of Artificial Sequence: Synthetic oligonucleotide
  Target: ATXN1; (+) strand; PAM type: YTN; PAM sequence: TTG
atactgatgaagtccaatgc

SEQ ID NO: 270725 - DNA, 20 bp, Artificial Sequence
  Description of Artificial Sequence: Synthetic oligonucleotide
  Target: ATXN1; (+) strand; PAM type: YTN; PAM sequence: CTG
atgaagtccaatgcatctat

SEQ ID NO: 270726 - DNA, 20 bp, Artificial Sequence
  Description of Artificial Sequence: Synthetic oligonucleotide
  Target: ATXN1; (+) strand; PAM type: YTN; PAM sequence: CTA
tttttttcttttgttgtttg

SEQ ID NO: 270727 - DNA, 20 bp, Artificial Sequence
  Description of Artificial Sequence: Synthetic oligonucleotide
  Target: ATXN1; (+) strand; PAM type: YTN; PAM sequence: TTT
ttttcttttgttgtttgtgc

SEQ ID NO: 270728 - DNA, 20 bp, Artificial Sequence
  Description of Artificial Sequence: Synthetic oligonucleotide
  Target: ATXN1; (+) strand; PAM type: YTN; PAM sequence: TTT
tttcttttgttgtttgtgct

SEQ ID NO: 270729 - DNA, 20 bp, Artificial Sequence
  Description of Artificial Sequence: Synthetic oligonucleotide
  Target: ATXN1; (+) strand; PAM type: YTN; PAM sequence: TTT
ttcttttgttgtttgtgctt

SEQ ID NO: 270730 - DNA, 20 bp, Artificial Sequence
  Description of Artificial Sequence: Synthetic oligonucleotide
  Target: ATXN1; (+) strand; PAM type: YTN; PAM sequence: TTT
tcttttgttgtttgtgcttt

SEQ ID NO: 270731 - DNA, 20 bp, Artificial Sequence
  Description of Artificial Sequence: Synthetic oligonucleotide
  Target: ATXN1; (+) strand; PAM type: YTN; PAM sequence: TTT
cttttgttgtttgtgctttt

SEQ ID NO: 270732 - DNA, 20 bp, Artificial Sequence
  Description of Artificial Sequence: Synthetic oligonucleotide
  Target: ATXN1; (+) strand; PAM type: YTN; PAM sequence: TTC
ttttgttgtttgtgcttttg

SEQ ID NO: 270733 - DNA, 20 bp, Artificial Sequence
  Description of Artificial Sequence: Synthetic oligonucleotide
  Target: ATXN1; (+) strand; PAM type: YTN; PAM sequence: CTT
ttgttgtttgtgcttttggt

SEQ ID NO: 270734 - DNA, 20 bp, Artificial Sequence
  Description of Artificial Sequence: Synthetic oligonucleotide
  Target: ATXN1; (+) strand; PAM type: YTN; PAM sequence: TTT
tgttgtttgtgcttttggtg

SEQ ID NO: 270735 - DNA, 20 bp, Artificial Sequence
  Description of Artificial Sequence: Synthetic oligonucleotide
  Target: ATXN1; (+) strand; PAM type: YTN; PAM sequence: TTT
gttgtttgtgcttttggtgt

SEQ ID NO: 270736 - DNA, 20 bp, Artificial Sequence
  Description of Artificial Sequence: Synthetic oligonucleotide
  Target: ATXN1; (+) strand; PAM type: YTN; PAM sequence: TTG
ttgtttgtgcttttggtgtc

SEQ ID NO: 270737 - DNA, 20 bp, Artificial Sequence
  Description of Artificial Sequence: Synthetic oligonucleotide
  Target: ATXN1; (+) strand; PAM type: YTN; PAM sequence: TTG
tttgtgcttttggtgtcaca

SEQ ID NO: 270738 - DNA, 20 bp, Artificial Sequence
  Description of Artificial Sequence: Synthetic oligonucleotide
  Target: ATXN1; (+) strand; PAM type: YTN; PAM sequence: TTT
gtgcttttggtgtcacatct

SEQ ID NO: 270739 - DNA, 20 bp, Artificial Sequence
  Description of Artificial Sequence: Synthetic oligonucleotide
  Target: ATXN1; (+) strand; PAM type: YTN; PAM sequence: TTG
tgcttttggtgtcacatcta

SEQ ID NO: 270740 - DNA, 20 bp, Artificial Sequence
  Description of Artificial Sequence: Synthetic oligonucleotide
  Target: ATXN1; (+) strand; PAM type: YTN; PAM sequence: CTT
ttggtgtcacatctaagaat

SEQ ID NO: 270741 - DNA, 20 bp, Artificial Sequence
  Description of Artificial Sequence: Synthetic oligonucleotide
  Target: ATXN1; (+) strand; PAM type: YTN; PAM sequence: TTT
tggtgtcacatctaagaatc

SEQ ID NO: 270742 - DNA, 20 bp, Artificial Sequence
  Description of Artificial Sequence: Synthetic oligonucleotide
  Target: ATXN1; (+) strand; PAM type: YTN; PAM sequence: TTT
ggtgtcacatctaagaatct

SEQ ID NO: 270743 - DNA, 20 bp, Artificial Sequence
  Description of Artificial Sequence: Synthetic oligonucleotide
  Target: ATXN1; (+) strand; PAM type: YTN; PAM sequence: TTG
gtgtcacatctaagaatcta

SEQ ID NO: 270744 - DNA, 20 bp, Artificial Sequence
  Description of Artificial Sequence: Synthetic oligonucleotide
  Target: ATXN1; (+) strand; PAM type: YTN; PAM sequence: CTA
agaatctattgccaaatcca

SEQ ID NO: 270745 - DNA, 20 bp, Artificial Sequence
  Description of Artificial Sequence: Synthetic oligonucleotide
  Target: ATXN1; (+) strand; PAM type: YTN; PAM sequence: CTA
ttgccaaatccatggtcatg

SEQ ID NO: 270746 - DNA, 20 bp, Artificial Sequence
  Description of Artificial Sequence: Synthetic oligonucleotide
  Target: ATXN1; (+) strand; PAM type: YTN; PAM sequence: TTG
ccaaatccatggtcatgaag

SEQ ID NO: 270747 - DNA, 20 bp, Artificial Sequence
  Description of Artificial Sequence: Synthetic oligonucleotide
  Target: ATXN1; (+) strand; PAM type: YTN; PAM sequence: TTT
actcctgttttcatttaaaa

SEQ ID NO: 270748 - DNA, 20 bp, Artificial Sequence
  Description of Artificial Sequence: Synthetic oligonucleotide
  Target: ATXN1; (+) strand; PAM type: YTN; PAM sequence: TTA
ctcctgttttcatttaaaag

SEQ ID NO: 270749 - DNA, 20 bp, Artificial Sequence
  Description of Artificial Sequence: Synthetic oligonucleotide
  Target: ATXN1; (+) strand; PAM type: YTN; PAM sequence: CTC
ctgttttcatttaaaagttt

SEQ ID NO: 270750 - DNA, 20 bp, Artificial Sequence
  Description of Artificial Sequence: Synthetic oligonucleotide
  Target: ATXN1; (+) strand; PAM type: YTN; PAM sequence: CTG
ttttcatttaaaagttttat

SEQ ID NO: 270751 - DNA, 20 bp, Artificial Sequence
  Description of Artificial Sequence: Synthetic oligonucleotide
  Target: ATXN1; (+) strand; PAM type: YTN; PAM sequence: TTT
tcatttaaaagttttatagt

SEQ ID NO: 270752 - DNA, 20 bp, Artificial Sequence
  Description of Artificial Sequence: Synthetic oligonucleotide
  Target: ATXN1; (+) strand; PAM type: YTN; PAM sequence: TTT
catttaaaagttttatagtt

SEQ ID NO: 270753 - DNA, 20 bp, Artificial Sequence
  Description of Artificial Sequence: Synthetic oligonucleotide
  Target: ATXN1; (+) strand; PAM type: YTN; PAM sequence: TTC
atttaaaagttttatagttt

SEQ ID NO: 270754 - DNA, 20 bp, Artificial Sequence
  Description of Artificial Sequence: Synthetic oligonucleotide
  Target: ATXN1; (+) strand; PAM type: YTN; PAM sequence: TTT
aaaagttttatagtttcagt

SEQ ID NO: 270755 - DNA, 20 bp, Artificial Sequence
  Description of Artificial Sequence: Synthetic oligonucleotide
  Target: ATXN1; (+) strand; PAM type: YTN; PAM sequence: TTA
aaagttttatagtttcagtt

SEQ ID NO: 270756 - DNA, 20 bp, Artificial Sequence
  Description of Artificial Sequence: Synthetic oligonucleotide
  Target: ATXN1; (+) strand; PAM type: YTN; PAM sequence: TTT
tatagtttcagttcctacat

SEQ ID NO: 270757 - DNA, 20 bp, Artificial Sequence
  Description of Artificial Sequence: Synthetic oligonucleotide
  Target: ATXN1; (+) strand; PAM type: YTN; PAM sequence: TTT
atagtttcagttcctacatt

SEQ ID NO: 270758 - DNA, 20 bp, Artificial Sequence
  Description of Artificial Sequence: Synthetic oligonucleotide
  Target: ATXN1; (+) strand; PAM type: YTN; PAM sequence: TTA
tagtttcagttcctacattt

SEQ ID NO: 270759 - DNA, 20 bp, Artificial Sequence
  Description of Artificial Sequence: Synthetic oligonucleotide
  Target: ATXN1; (+) strand; PAM type: YTN; PAM sequence: TTT
cagttcctacatttagggta

SEQ ID NO: 270760 - DNA, 20 bp, Artificial Sequence
  Description of Artificial Sequence: Synthetic oligonucleotide
  Target: ATXN1; (+) strand; PAM type: YTN; PAM sequence: TTC
agttcctacatttagggtat

SEQ ID NO: 270761 - DNA, 20 bp, Artificial Sequence
  Description of Artificial Sequence: Synthetic oligonucleotide
  Target: ATXN1; (+) strand; PAM type: YTN; PAM sequence: TTC
ctacatttagggtattgatc

SEQ ID NO: 270762 - DNA, 20 bp, Artificial Sequence
  Description of Artificial Sequence: Synthetic oligonucleotide
  Target: ATXN1; (+) strand; PAM type: YTN; PAM sequence: CTA
catttagggtattgatccat

SEQ ID NO: 270763 - DNA, 20 bp, Artificial Sequence
  Description of Artificial Sequence: Synthetic oligonucleotide
  Target: ATXN1; (+) strand; PAM type: YTN; PAM sequence: TTT
agggtattgatccattttta

SEQ ID NO: 270764 - DNA, 20 bp, Artificial Sequence
  Description of Artificial Sequence: Synthetic oligonucleotide
  Target: ATXN1; (+) strand; PAM type: YTN; PAM sequence: TTA
gggtattgatccatttttag

SEQ ID NO: 270765 - DNA, 20 bp, Artificial Sequence
  Description of Artificial Sequence: Synthetic oligonucleotide
  Target: ATXN1; (+) strand; PAM type: YTN; PAM sequence: TTG
atccatttttagttcatttt

SEQ ID NO: 270766 - DNA, 20 bp, Artificial Sequence
  Description of Artificial Sequence: Synthetic oligonucleotide
  Target: ATXN1; (+) strand; PAM type: YTN; PAM sequence: TTT
ttagttcatttttgtatatg

SEQ ID NO: 270767 - DNA, 20 bp, Artificial Sequence
  Description of Artificial Sequence: Synthetic oligonucleotide
  Target: ATXN1; (+) strand; PAM type: YTN; PAM sequence: TTT
tagttcatttttgtatatgg

SEQ ID NO: 270768 - DNA, 20 bp, Artificial Sequence
  Description of Artificial Sequence: Synthetic oligonucleotide
  Target: ATXN1; (+) strand; PAM type: YTN; PAM sequence: TTT
agttcatttttgtatatggt

SEQ ID NO: 270769 - DNA, 20 bp, Artificial Sequence
  Description of Artificial Sequence: Synthetic oligonucleotide
  Target: ATXN1; (+) strand; PAM type: YTN; PAM sequence: TTA
gttcatttttgtatatggtg

SEQ ID NO: 270770 - DNA, 20 bp, Artificial Sequence
  Description of Artificial Sequence: Synthetic oligonucleotide
  Target: ATXN1; (+) strand; PAM type: YTN; PAM sequence: TTC
atttttgtatatggtgtgag

SEQ ID NO: 270771 - DNA, 20 bp, Artificial Sequence
  Description of Artificial Sequence: Synthetic oligonucleotide
  Target: ATXN1; (+) strand; PAM type: YTN; PAM sequence: TTT
ttgtatatggtgtgaggtaa

SEQ ID NO: 270772 - DNA, 20 bp, Artificial Sequence
  Description of Artificial Sequence: Synthetic oligonucleotide
  Target: ATXN1; (+) strand; PAM type: YTN; PAM sequence: TTT
tgtatatggtgtgaggtaag

SEQ ID NO: 270773 - DNA, 20 bp, Artificial Sequence
  Description of Artificial Sequence: Synthetic oligonucleotide
  Target: ATXN1; (+) strand; PAM type: YTN; PAM sequence: TTT
gtatatggtgtgaggtaagg

SEQ ID NO: 270774 - DNA, 20 bp, Artificial Sequence
  Description of Artificial Sequence: Synthetic oligonucleotide
  Target: ATXN1; (+) strand; PAM type: YTN; PAM sequence: TTG
tatatggtgtgaggtaaggg

SEQ ID NO: 270775 - DNA, 20 bp, Artificial Sequence
  Description of Artificial Sequence: Synthetic oligonucleotide
  Target: ATXN1; (+) strand; PAM type: YTN; PAM sequence: TTC
aacttctttctctggcatgt

SEQ ID NO: 270776 - DNA, 20 bp, Artificial Sequence
  Description of Artificial Sequence: Synthetic oligonucleotide
  Target: ATXN1; (+) strand; PAM type: YTN; PAM sequence: CTT
ctttctctggcatgtgtccc

SEQ ID NO: 270777 - DNA, 20 bp, Artificial Sequence
  Description of Artificial Sequence: Synthetic oligonucleotide
  Target: ATXN1; (+) strand; PAM type: YTN; PAM sequence: TTC
tttctctggcatgtgtccca

SEQ ID NO: 270778 - DNA, 20 bp, Artificial Sequence
  Description of Artificial Sequence: Synthetic oligonucleotide
  Target: ATXN1; (+) strand; PAM type: YTN; PAM sequence: CTT
tctctggcatgtgtcccagg

SEQ ID NO: 270779 - DNA, 20 bp, Artificial Sequence
  Description of Artificial Sequence: Synthetic oligonucleotide
  Target: ATXN1; (+) strand; PAM type: YTN; PAM sequence: TTT
ctctggcatgtgtcccaggt

SEQ ID NO: 270780 - DNA, 20 bp, Artificial Sequence
  Description of Artificial Sequence: Synthetic oligonucleotide
  Target: ATXN1; (+) strand; PAM type: YTN; PAM sequence: TTC
tctggcatgtgtcccaggtg

SEQ ID NO: 270781 - DNA, 20 bp, Artificial Sequence
  Description of Artificial Sequence: Synthetic oligonucleotide
  Target: ATXN1; (+) strand; PAM type: YTN; PAM sequence: CTC
tggcatgtgtcccaggtgac

SEQ ID NO: 270782 - DNA, 20 bp, Artificial Sequence
  Description of Artificial Sequence: Synthetic oligonucleotide
  Target: ATXN1; (+) strand; PAM type: YTN; PAM sequence: CTG
gcatgtgtcccaggtgactt

SEQ ID NO: 270783 - DNA, 20 bp, Artificial Sequence
  Description of Artificial Sequence: Synthetic oligonucleotide
  Target: ATXN1; (+) strand; PAM type: YTN; PAM sequence: CTT
tttccattgtctcagcacca

SEQ ID NO: 270784 - DNA, 20 bp, Artificial Sequence
  Description of Artificial Sequence: Synthetic oligonucleotide
  Target: ATXN1; (+) strand; PAM type: YTN; PAM sequence: TTT
ttccattgtctcagcaccaa

SEQ ID NO: 270785 - DNA, 20 bp, Artificial Sequence
  Description of Artificial Sequence: Synthetic oligonucleotide
  Target: ATXN1; (+) strand; PAM type: YTN; PAM sequence: TTT
tccattgtctcagcaccaat

SEQ ID NO: 270786 - DNA, 20 bp, Artificial Sequence
  Description of Artificial Sequence: Synthetic oligonucleotide
  Target: ATXN1; (+) strand; PAM type: YTN; PAM sequence: TTT
ccattgtctcagcaccaatt

SEQ ID NO: 270787 - DNA, 20 bp, Artificial Sequence
  Description of Artificial Sequence: Synthetic oligonucleotide
  Target: ATXN1; (+) strand; PAM type: YTN; PAM sequence: TTC
cattgtctcagcaccaattg

SEQ ID NO: 270788 - DNA, 20 bp, Artificial Sequence
  Description of Artificial Sequence: Synthetic oligonucleotide
  Target: ATXN1; (+) strand; PAM type: YTN; PAM sequence: TTG
tctcagcaccaattgttgaa

SEQ ID NO: 270789 - DNA, 20 bp, Artificial Sequence
  Description of Artificial Sequence: Synthetic oligonucleotide
  Target: ATXN1; (+) strand; PAM type: YTN; PAM sequence: CTC
agcaccaattgttgaaaaga

SEQ ID NO: 270790 - DNA, 20 bp, Artificial Sequence
  Description of Artificial Sequence: Synthetic oligonucleotide
  Target: ATXN1; (+) strand; PAM type: YTN; PAM sequence: TTG
ttgaaaagaggtaagagaga

SEQ ID NO: 270791 - DNA, 20 bp, Artificial Sequence
  Description of Artificial Sequence: Synthetic oligonucleotide
  Target: ATXN1; (+) strand; PAM type: YTN; PAM sequence: TTG
aaaagaggtaagagagattt

SEQ ID NO: 270792 - DNA, 20 bp, Artificial Sequence
  Description of Artificial Sequence: Synthetic oligonucleotide
  Target: ATXN1; (+) strand; PAM type: YTN; PAM sequence: TTT
tgagtatgaagtgattttag

SEQ ID NO: 270793 - DNA, 20 bp, Artificial Sequence
  Description of Artificial Sequence: Synthetic oligonucleotide
  Target: ATXN1; (+) strand; PAM type: YTN; PAM sequence: TTT
gagtatgaagtgattttagt

SEQ ID NO: 270794 - DNA, 20 bp, Artificial Sequence
  Description of Artificial Sequence: Synthetic oligonucleotide
  Target: ATXN1; (+) strand; PAM type: YTN; PAM sequence: TTG
agtatgaagtgattttagtc

SEQ ID NO: 270795 - DNA, 20 bp, Artificial Sequence
  Description of Artificial Sequence: Synthetic oligonucleotide
  Target: ATXN1; (+) strand; PAM type: YTN; PAM sequence: TTT
tagtcttttctcttgaaaaa

SEQ ID NO: 270796 - DNA, 20 bp, Artificial Sequence
  Description of Artificial Sequence: Synthetic oligonucleotide
  Target: ATXN1; (+) strand; PAM type: YTN; PAM sequence: TTT
agtcttttctcttgaaaaaa

SEQ ID NO: 270797 - DNA, 20 bp, Artificial Sequence
  Description of Artificial Sequence: Synthetic oligonucleotide
  Target: ATXN1; (+) strand; PAM type: YTN; PAM sequence: TTA
gtcttttctcttgaaaaaac

SEQ ID NO: 270798 - DNA, 20 bp, Artificial Sequence
  Description of Artificial Sequence: Synthetic oligonucleotide
  Target: ATXN1; (+) strand; PAM type: YTN; PAM sequence: CTT
ttctcttgaaaaaacaaaac

SEQ ID NO: 270799 - DNA, 20 bp, Artificial Sequence
  Description of Artificial Sequence: Synthetic oligonucleotide
  Target: ATXN1; (+) strand; PAM type: YTN; PAM sequence: TTT
tctcttgaaaaaacaaaact

SEQ ID NO: 270800 - DNA, 20 bp, Artificial Sequence
  Description of Artificial Sequence: Synthetic oligonucleotide
  Target: ATXN1; (+) strand; PAM type: YTN; PAM sequence: TTT
ctcttgaaaaaacaaaactt

SEQ ID NO: 270801 - DNA, 20 bp, Artificial Sequence
  Description of Artificial Sequence: Synthetic oligonucleotide
  Target: ATXN1; (+) strand; PAM type: YTN; PAM sequence: TTC
tcttgaaaaaacaaaacttt

SEQ ID NO: 270802 - DNA, 20 bp, Artificial Sequence
  Description of Artificial Sequence: Synthetic oligonucleotide
  Target: ATXN1; (+) strand; PAM type: YTN; PAM sequence: CTC
ttgaaaaaacaaaactttaa

SEQ ID NO: 270803 - DNA, 20 bp, Artificial Sequence
  Description of Artificial Sequence: Synthetic oligonucleotide
  Target: ATXN1; (+) strand; PAM type: YTN; PAM sequence: CTT
gaaaaaacaaaactttaaaa

SEQ ID NO: 270804 - DNA, 20 bp, Artificial Sequence
  Description of Artificial Sequence: Synthetic oligonucleotide
  Target: ATXN1; (+) strand; PAM type: YTN; PAM sequence: TTG
aaaaaacaaaactttaaaaa

SEQ ID NO: 270805 - DNA, 20 bp, Artificial Sequence
  Description of Artificial Sequence: Synthetic oligonucleotide
  Target: ATXN1; (+) strand; PAM type: YTN; PAM sequence: CTT
taaaaatatacattatttta

SEQ ID NO: 270806 - DNA, 20 bp, Artificial Sequence
  Description of Artificial Sequence: Synthetic oligonucleotide
  Target: ATXN1; (+) strand; PAM type: YTN; PAM sequence: TTT
aaaaatatacattattttaa

SEQ ID NO: 270807 - DNA, 20 bp, Artificial Sequence
  Description of Artificial Sequence: Synthetic oligonucleotide
  Target: ATXN1; (+) strand; PAM type: YTN; PAM sequence: TTA
aaaatatacattattttaaa

SEQ ID NO: 270808 - DNA, 20 bp, Artificial Sequence
  Description of Artificial Sequence: Synthetic oligonucleotide
  Target: ATXN1; (+) strand; PAM type: YTN; PAM sequence: TTA
ttttaaaaattaattttctg

SEQ ID NO: 270809 - DNA, 20 bp, Artificial Sequence
  Description of Artificial Sequence: Synthetic oligonucleotide
  Target: ATXN1; (+) strand; PAM type: YTN; PAM sequence: TTT
taaaaattaattttctggct

SEQ ID NO: 270810 - DNA, 20 bp, Artificial Sequence
  Description of Artificial Sequence: Synthetic oligonucleotide
  Target: ATXN1; (+) strand; PAM type: YTN; PAM sequence: TTT
aaaaattaattttctggctt

SEQ ID NO: 270811 - DNA, 20 bp, Artificial Sequence
  Description of Artificial Sequence: Synthetic oligonucleotide
  Target: ATXN1; (+) strand; PAM type: YTN; PAM sequence: TTA
aaaattaattttctggcttt

SEQ ID NO: 270812 - DNA, 20 bp, Artificial Sequence
  Description of Artificial Sequence: Synthetic oligonucleotide
  Target: ATXN1; (+) strand; PAM type: YTN; PAM sequence: TTA
attttctggcttttggttac

SEQ ID NO: 270813 - DNA, 20 bp, Artificial Sequence
  Description of Artificial Sequence: Synthetic oligonucleotide
  Target: ATXN1; (+) strand; PAM type: YTN; PAM sequence: TTT
tctggcttttggttacacta

SEQ ID NO: 270814 - DNA, 20 bp, Artificial Sequence
  Description of Artificial Sequence: Synthetic oligonucleotide
  Target: ATXN1; (+) strand; PAM type: YTN; PAM sequence: TTT
ctggcttttggttacactat

SEQ ID NO: 270815 - DNA, 20 bp, Artificial Sequence
  Description of Artificial Sequence: Synthetic oligonucleotide
  Target: ATXN1; (+) strand; PAM type: YTN; PAM sequence: TTC
tggcttttggttacactatg

SEQ ID NO: 270816 - DNA, 20 bp, Artificial Sequence
  Description of Artificial Sequence: Synthetic oligonucleotide
  Target: ATXN1; (+) strand; PAM type: YTN; PAM sequence: CTG
gcttttggttacactatgac

SEQ ID NO: 270817 - DNA, 20 bp, Artificial Sequence
  Description of Artificial Sequence: Synthetic oligonucleotide
  Target: ATXN1; (+) strand; PAM type: YTN; PAM sequence: CTT
ttggttacactatgactgta

SEQ ID NO: 270818 - DNA, 20 bp, Artificial Sequence
  Description of Artificial Sequence: Synthetic oligonucleotide
  Target: ATXN1; (+) strand; PAM type: YTN; PAM sequence: TTT
tggttacactatgactgtat

SEQ ID NO: 270819 - DNA, 20 bp, Artificial Sequence
  Description of Artificial Sequence: Synthetic oligonucleotide
  Target: ATXN1; (+) strand; PAM type: YTN; PAM sequence: TTT
ggttacactatgactgtatt

SEQ ID NO: 270820 - DNA, 20 bp, Artificial Sequence
  Description of Artificial Sequence: Synthetic oligonucleotide
  Target: ATXN1; (+) strand; PAM type: YTN; PAM sequence: TTG
gttacactatgactgtattc

SEQ ID NO: 270821 - DNA, 20 bp, Artificial Sequence
  Description of Artificial Sequence: Synthetic oligonucleotide
  Target: ATXN1; (+) strand; PAM type: YTN; PAM sequence: TTA
cactatgactgtattcagcc

SEQ ID NO: 270822 - DNA, 20 bp, Artificial Sequence
  Description of Artificial Sequence: Synthetic oligonucleotide
  Target: ATXN1; (+) strand; PAM type: YTN; PAM sequence: CTA
tgactgtattcagccactat

SEQ ID NO: 270823 - DNA, 20 bp, Artificial Sequence
  Description of Artificial Sequence: Synthetic oligonucleotide
  Target: ATXN1; (+) strand; PAM type: YTN; PAM sequence: CTG
tattcagccactatttaaat

SEQ ID NO: 270824 - DNA, 20 bp, Artificial Sequence
  Description of Artificial Sequence: Synthetic oligonucleotide
  Target: ATXN1; (+) strand; PAM type: YTN; PAM sequence: TTC
agccactatttaaatgtttt

SEQ ID NO: 270825 - DNA, 20 bp, Artificial Sequence
  Description of Artificial Sequence: Synthetic oligonucleotide
  Target: ATXN1; (+) strand; PAM type: YTN; PAM sequence: CTA
tttaaatgtttttcctcatc

SEQ ID NO: 270826 - DNA, 20 bp, Artificial Sequence
  Description of Artificial Sequence: Synthetic oligonucleotide
  Target: ATXN1; (+) strand; PAM type: YTN; PAM sequence: TTT
aaatgtttttcctcatccca

SEQ ID NO: 270827 - DNA, 20 bp, Artificial Sequence
  Description of Artificial Sequence: Synthetic oligonucleotide
  Target: ATXN1; (+) strand; PAM type: YTN; PAM sequence: TTA
aatgtttttcctcatcccac

SEQ ID NO: 270828 - DNA, 20 bp, Artificial Sequence
  Description of Artificial Sequence: Synthetic oligonucleotide
  Target: ATXN1; (+) strand; PAM type: YTN; PAM sequence: TTT
ttcctcatcccacattttaa

SEQ ID NO: 270829 - DNA, 20 bp, Artificial Sequence
  Description of Artificial Sequence: Synthetic oligonucleotide
  Target: ATXN1; (+) strand; PAM type: YTN; PAM sequence: TTT
tcctcatcccacattttaaa

SEQ ID NO: 270830 - DNA, 20 bp, Artificial Sequence
  Description of Artificial Sequence: Synthetic oligonucleotide
  Target: ATXN1; (+) strand; PAM type: YTN; PAM sequence: TTT
cctcatcccacattttaaag

SEQ ID NO: 270831 - DNA, 20 bp, Artificial Sequence
  Description of Artificial Sequence: Synthetic oligonucleotide
  Target: ATXN1; (+) strand; PAM type: YTN; PAM sequence: TTC
ctcatcccacattttaaaga

SEQ ID NO: 270832 - DNA, 20 bp, Artificial Sequence
  Description of Artificial Sequence: Synthetic oligonucleotide
  Target: ATXN1; (+) strand; PAM type: YTN; PAM sequence: CTC
atcccacattttaaagatgc

SEQ ID NO: 270833 - DNA, 20 bp, Artificial Sequence
  Description of Artificial Sequence: Synthetic oligonucleotide
  Target: ATXN1; (+) strand; PAM type: YTN; PAM sequence: TTT
taaagatgcagcaagttttc

SEQ ID NO: 270834 - DNA, 20 bp, Artificial Sequence
  Description of Artificial Sequence: Synthetic oligonucleotide
  Target: ATXN1; (+) strand; PAM type: YTN; PAM sequence: TTT
aaagatgcagcaagttttca

SEQ ID NO: 270835 - DNA, 20 bp, Artificial Sequence
  Description of Artificial Sequence: Synthetic oligonucleotide
  Target: ATXN1; (+) strand; PAM type: YTN; PAM sequence: TTA
aagatgcagcaagttttcat

SEQ ID NO: 270836 - DNA, 20 bp, Artificial Sequence
  Description of Artificial Sequence: Synthetic oligonucleotide
  Target: ATXN1; (+) strand; PAM type: YTN; PAM sequence: TTT
tcatgaatgatgacccacca

SEQ ID NO: 270837 - DNA, 20 bp, Artificial Sequence
  Description of Artificial Sequence: Synthetic oligonucleotide
  Target: ATXN1; (+) strand; PAM type: YTN; PAM sequence: TTT
catgaatgatgacccaccag

SEQ ID NO: 270838 - DNA, 20 bp, Artificial Sequence
  Description of Artificial Sequence: Synthetic oligonucleotide
  Target: ATXN1; (+) strand; PAM type: YTN; PAM sequence: TTC
atgaatgatgacccaccaga

SEQ ID NO: 270839 - DNA, 20 bp, Artificial Sequence
  Description of Artificial Sequence: Synthetic oligonucleotide
  Target: ATXN1; (+) strand; PAM type: YTN; PAM sequence: CTG
agctttcagggaagccaacc

SEQ ID NO: 270840 - DNA, 20 bp, Artificial Sequence
  Description of Artificial Sequence: Synthetic oligonucleotide
  Target: ATXN1; (+) strand; PAM type: YTN; PAM sequence: CTT
tcagggaagccaaccacctc

SEQ ID NO: 270841 - DNA, 20 bp, Artificial Sequence
  Description of Artificial Sequence: Synthetic oligonucleotide
  Target: ATXN1; (+) strand; PAM type: YTN; PAM sequence: TTT
cagggaagccaaccacctct

SEQ ID NO: 270842 - DNA, 20 bp, Artificial Sequence
  Description of Artificial Sequence: Synthetic oligonucleotide
  Target: ATXN1; (+) strand; PAM type: YTN; PAM sequence: TTC
agggaagccaaccacctctt

SEQ ID NO: 270843 - DNA, 20 bp, Artificial Sequence
  Description of Artificial Sequence: Synthetic oligonucleotide
  Target: ATXN1; (+) strand; PAM type: YTN; PAM sequence: CTC
ttgaggtggtgcttttgcaa

SEQ ID NO: 270844 - DNA, 20 bp, Artificial Sequence
  Description of Artificial Sequence: Synthetic oligonucleotide
  Target: ATXN1; (+) strand; PAM type: YTN; PAM sequence: CTT
gaggtggtgcttttgcaaga

SEQ ID NO: 270845 - DNA, 20 bp, Artificial Sequence
  Description of Artificial Sequence: Synthetic oligonucleotide
  Target: ATXN1; (+) strand; PAM type: YTN; PAM sequence: TTG
aggtggtgcttttgcaagaa

SEQ ID NO: 270846 - DNA, 20 bp, Artificial Sequence
  Description of Artificial Sequence: Synthetic oligonucleotide
  Target: ATXN1; (+) strand; PAM type: YTN; PAM sequence: CTT
ttgcaagaactaattttcaa

SEQ ID NO: 270847 - DNA, 20 bp, Artificial Sequence
  Description of Artificial Sequence: Synthetic oligonucleotide
  Target: ATXN1; (+) strand; PAM type: YTN; PAM sequence: TTT
tgcaagaactaattttcaaa

SEQ ID NO: 270848 - DNA, 20 bp, Artificial Sequence
  Description of Artificial Sequence: Synthetic oligonucleotide
  Target: ATXN1; (+) strand; PAM type: YTN; PAM sequence: TTT
gcaagaactaattttcaaaa

SEQ ID NO: 270849 - DNA, 20 bp, Artificial Sequence
  Description of Artificial Sequence: Synthetic oligonucleotide
  Target: ATXN1; (+) strand; PAM type: YTN; PAM sequence: TTG
caagaactaattttcaaaag

SEQ ID NO: 270850 - DNA, 20 bp, Artificial Sequence
  Description of Artificial Sequence: Synthetic oligonucleotide
  Target: ATXN1; (+) strand; PAM type: YTN; PAM sequence: CTA
attttcaaaagcaacagtag

SEQ ID NO: 270851 - DNA, 20 bp, Artificial Sequence
  Description of Artificial Sequence: Synthetic oligonucleotide
  Target: ATXN1; (+) strand; PAM type: YTN; PAM sequence: TTT
tcaaaagcaacagtagcttg

SEQ ID NO: 270852 - DNA, 20 bp, Artificial Sequence
  Description of Artificial Sequence: Synthetic oligonucleotide
  Target: ATXN1; (+) strand; PAM type: YTN; PAM sequence: TTT
caaaagcaacagtagcttga

SEQ ID NO: 270853 - DNA, 20 bp, Artificial Sequence
  Description of Artificial Sequence: Synthetic oligonucleotide
  Target: ATXN1; (+) strand; PAM type: YTN; PAM sequence: TTC
aaaagcaacagtagcttgaa

SEQ ID NO: 270854 - DNA, 20 bp, Artificial Sequence
  Description of Artificial Sequence: Synthetic oligonucleotide
  Target: ATXN1; (+) strand; PAM type: YTN; PAM sequence: CTT
gaaattgctgactttgggtt

SEQ ID NO: 270855 - DNA, 20 bp, Artificial Sequence
  Description of Artificial Sequence: Synthetic oligonucleotide
  Target: ATXN1; (+) strand; PAM type: YTN; PAM sequence: TTG
aaattgctgactttgggttg

SEQ ID NO: 270856 - DNA, 20 bp, Artificial Sequence
  Description of Artificial Sequence: Synthetic oligonucleotide
  Target: ATXN1; (+) strand; PAM type: YTN; PAM sequence: TTG
ctgactttgggttgcatttg

SEQ ID NO: 270857 - DNA, 20 bp, Artificial Sequence
  Description of Artificial Sequence: Synthetic oligonucleotide
  Target: ATXN1; (+) strand; PAM type: YTN; PAM sequence: CTG
actttgggttgcatttgcct

SEQ ID NO: 270858 - DNA, 20 bp, Artificial Sequence
  Description of Artificial Sequence: Synthetic oligonucleotide
  Target: ATXN1; (+) strand; PAM type: YTN; PAM sequence: CTT
tgggttgcatttgcctctgt

SEQ ID NO: 270859 - DNA, 20 bp, Artificial Sequence
  Description of Artificial Sequence: Synthetic oligonucleotide
  Target: ATXN1; (+) strand; PAM type: YTN; PAM sequence: TTT
gggttgcatttgcctctgtg

SEQ ID NO: 270860 - DNA, 20 bp, Artificial Sequence
  Description of Artificial Sequence: Synthetic oligonucleotide
  Target: ATXN1; (+) strand; PAM type: YTN; PAM sequence: TTG
ggttgcatttgcctctgtgt

SEQ ID NO: 270861 - DNA, 20 bp, Artificial Sequence
  Description of Artificial Sequence: Synthetic oligonucleotide
  Target: ATXN1; (+) strand; PAM type: YTN; PAM sequence: TTG
catttgcctctgtgtttgtg

SEQ ID NO: 270862 - DNA, 20 bp, Artificial Sequence
  Description of Artificial Sequence: Synthetic oligonucleotide
  Target: ATXN1; (+) strand; PAM type: YTN; PAM sequence: TTT
gcctctgtgtttgtgcccct

SEQ ID NO: 270863 - DNA, 20 bp, Artificial Sequence
  Description of Artificial Sequence: Synthetic oligonucleotide
  Target: ATXN1; (+) strand; PAM type: YTN; PAM sequence: TTG
cctctgtgtttgtgcccctc

SEQ ID NO: 270864 - DNA, 20 bp, Artificial Sequence
  Description of Artificial Sequence: Synthetic oligonucleotide
  Target: ATXN1; (+) strand; PAM type: YTN; PAM sequence: CTC
tgtgtttgtgcccctctagt

SEQ ID NO: 270865 - DNA, 20 bp, Artificial Sequence
  Description of Artificial Sequence: Synthetic oligonucleotide
  Target: ATXN1; (+) strand; PAM type: YTN; PAM sequence: CTG
tgtttgtgcccctctagtga

SEQ ID NO: 270866 - DNA, 20 bp, Artificial Sequence
  Description of Artificial Sequence: Synthetic oligonucleotide
  Target: ATXN1; (+) strand; PAM type: YTN; PAM sequence: TTT
gtgcccctctagtgaacagc

SEQ ID NO: 270867 - DNA, 20 bp, Artificial Sequence
  Description of Artificial Sequence: Synthetic oligonucleotide
  Target: ATXN1; (+) strand; PAM type: YTN; PAM sequence: TTG
tgcccctctagtgaacagcc

SEQ ID NO: 270868 - DNA, 20 bp, Artificial Sequence
  Description of Artificial Sequence: Synthetic oligonucleotide
  Target: ATXN1; (+) strand; PAM type: YTN; PAM sequence: CTC
tagtgaacagcccctgtctt

SEQ ID NO: 270869 - DNA, 20 bp, Artificial Sequence
  Description of Artificial Sequence: Synthetic oligonucleotide
  Target: ATXN1; (+) strand; PAM type: YTN; PAM sequence: CTA
gtgaacagcccctgtcttca

SEQ ID NO: 270870 - DNA, 20 bp, Artificial Sequence
  Description of Artificial Sequence: Synthetic oligonucleotide
  Target: ATXN1; (+) strand; PAM type: YTN; PAM sequence: CTG
tcttcagatatccacagacc

SEQ ID NO: 270871 - DNA, 20 bp, Artificial Sequence
  Description of Artificial Sequence: Synthetic oligonucleotide
  Target: ATXN1; (+) strand; PAM type: YTN; PAM sequence: CTT
cagatatccacagacctctg

SEQ ID NO: 270872 - DNA, 20 bp, Artificial Sequence
  Description of Artificial Sequence: Synthetic oligonucleotide
  Target: ATXN1; (+) strand; PAM type: YTN; PAM sequence: TTC
agatatccacagacctctgt

SEQ ID NO: 270873 - DNA, 20 bp, Artificial Sequence
  Description of Artificial Sequence: Synthetic oligonucleotide
  Target: ATXN1; (+) strand; PAM type: YTN; PAM sequence: CTC
tgttctctttccaagcccga

SEQ ID NO: 270874 - DNA, 20 bp, Artificial Sequence
  Description of Artificial Sequence: Synthetic oligonucleotide
  Target: ATXN1; (+) strand; PAM type: YTN; PAM sequence: CTG
ttctctttccaagcccgaca

SEQ ID NO: 270875 - DNA, 20 bp, Artificial Sequence
  Description of Artificial Sequence: Synthetic oligonucleotide
  Target: ATXN1; (+) strand; PAM type: YTN; PAM sequence: TTC
tctttccaagcccgacaccc

SEQ ID NO: 270876 - DNA, 20 bp, Artificial Sequence
  Description of Artificial Sequence: Synthetic oligonucleotide
  Target: ATXN1; (+) strand; PAM type: YTN; PAM sequence: CTC
tttccaagcccgacacccac

SEQ ID NO: 270877 - DNA, 20 bp, Artificial Sequence
  Description of Artificial Sequence: Synthetic oligonucleotide
  Target: ATXN1; (+) strand; PAM type: YTN; PAM sequence: CTT
tccaagcccgacacccaccc

SEQ ID NO: 270878 - DNA, 20 bp, Artificial Sequence
  Description of Artificial Sequence: Synthetic oligonucleotide
  Target: ATXN1; (+) strand; PAM type: YTN; PAM sequence: TTT
ccaagcccgacacccaccca

SEQ ID NO: 270879 - DNA, 20 bp, Artificial Sequence
  Description of Artificial Sequence: Synthetic oligonucleotide
  Target: ATXN1; (+) strand; PAM type: YTN; PAM sequence: TTC
caagcccgacacccacccat

SEQ ID NO: 270880 - DNA, 20 bp, Artificial Sequence
  Description of Artificial Sequence: Synthetic oligonucleotide
  Target: ATXN1; (+) strand; PAM type: YTN; PAM sequence: TTA
agattggctctttggagaaa

SEQ ID NO: 270881 - DNA, 20 bp, Artificial Sequence
  Description of Artificial Sequence: Synthetic oligonucleotide
  Target: ATXN1; (+) strand; PAM type: YTN; PAM sequence: TTG
gctctttggagaaaacttaa

SEQ ID NO: 270882 - DNA, 20 bp, Artificial Sequence
  Description of Artificial Sequence: Synthetic oligonucleotide
  Target: ATXN1; (+) strand; PAM type: YTN; PAM sequence: CTC
tttggagaaaacttaataaa

SEQ ID NO: 270883 - DNA, 20 bp, Artificial Sequence
  Description of Artificial Sequence: Synthetic oligonucleotide
  Target: ATXN1; (+) strand; PAM type: YTN; PAM sequence: CTT
tggagaaaacttaataaact

SEQ ID NO: 270884 - DNA, 20 bp, Artificial Sequence
  Description of Artificial Sequence: Synthetic oligonucleotide
  Target: ATXN1; (+) strand; PAM type: YTN; PAM sequence: TTT
ggagaaaacttaataaacta

SEQ ID NO: 270885 - DNA, 20 bp, Artificial Sequence
  Description of Artificial Sequence: Synthetic oligonucleotide
  Target: ATXN1; (+) strand; PAM type: YTN; PAM sequence: TTG
gagaaaacttaataaactaa

SEQ ID NO: 270886 - DNA, 20 bp, Artificial Sequence
  Description of Artificial Sequence: Synthetic oligonucleotide
  Target: ATXN1; (+) strand; PAM type: YTN; PAM sequence: CTT
aataaactaattcatgccaa

SEQ ID NO: 270887 - DNA, 20 bp, Artificial Sequence
  Description of Artificial Sequence: Synthetic oligonucleotide
  Target: ATXN1; (+) strand; PAM type: YTN; PAM sequence: TTA
ataaactaattcatgccaaa

SEQ ID NO: 270888 - DNA, 20 bp, Artificial Sequence
  Description of Artificial Sequence: Synthetic oligonucleotide
  Target: ATXN1; (+) strand; PAM type: YTN; PAM sequence: CTA
attcatgccaaatcgtgtat

SEQ ID NO: 270889 - DNA, 20 bp, Artificial Sequence
  Description of Artificial Sequence: Synthetic oligonucleotide
  Target: ATXN1; (+) strand; PAM type: YTN; PAM sequence: TTC
atgccaaatcgtgtataacc

SEQ ID NO: 270890 - DNA, 20 bp, Artificial Sequence
  Description of Artificial Sequence: Synthetic oligonucleotide
  Target: ATXN1; (+) strand; PAM type: YTN; PAM sequence: CTT
ttggcatgatacctaagact

SEQ ID NO: 270891 - DNA, 20 bp, Artificial Sequence
  Description of Artificial Sequence: Synthetic oligonucleotide
  Target: ATXN1; (+) strand; PAM type: YTN; PAM sequence: TTT
tggcatgatacctaagactc

SEQ ID NO: 270892 - DNA, 20 bp, Artificial Sequence
  Description of Artificial Sequence: Synthetic oligonucleotide
  Target: ATXN1; (+) strand; PAM type: YTN; PAM sequence: TTT
ggcatgatacctaagactct

SEQ ID NO: 270893 - DNA, 20 bp, Artificial Sequence
  Description of Artificial Sequence: Synthetic oligonucleotide
  Target: ATXN1; (+) strand; PAM type: YTN; PAM sequence: TTG
gcatgatacctaagactctg

SEQ ID NO: 270894 - DNA, 20 bp, Artificial Sequence
  Description of Artificial Sequence: Synthetic oligonucleotide
  Target: ATXN1; (+) strand; PAM type: YTN; PAM sequence: CTA
agactctgtttatcttaagc

SEQ ID NO: 270895 - DNA, 20 bp, Artificial Sequence
  Description of Artificial Sequence: Synthetic oligonucleotide
  Target: ATXN1; (+) strand; PAM type: YTN; PAM sequence: CTC
tgtttatcttaagcaaaaag

SEQ ID NO: 270896 - DNA, 20 bp, Artificial Sequence
  Description of Artificial Sequence: Synthetic oligonucleotide
  Target: ATXN1; (+) strand; PAM type: YTN; PAM sequence: CTG
tttatcttaagcaaaaagaa

SEQ ID NO: 270897 - DNA, 20 bp, Artificial Sequence
  Description of Artificial Sequence: Synthetic oligonucleotide
  Target: ATXN1; (+) strand; PAM type: YTN; PAM sequence: TTT
atcttaagcaaaaagaatac

SEQ ID NO: 270898 - DNA, 20 bp, Artificial Sequence
  Description of Artificial Sequence: Synthetic oligonucleotide
  Target: ATXN1; (+) strand; PAM type: YTN; PAM sequence: TTA
tcttaagcaaaaagaataca

SEQ ID NO: 270899 - DNA, 20 bp, Artificial Sequence
  Description of Artificial Sequence: Synthetic oligonucleotide
  Target: ATXN1; (+) strand; PAM type: YTN; PAM sequence: CTT
aagcaaaaagaatacagtgt

SEQ ID NO: 270900 - DNA, 20 bp, Artificial Sequence
  Description of Artificial Sequence: Synthetic oligonucleotide
  Target: ATXN1; (+) strand; PAM type: YTN; PAM sequence: TTA
agcaaaaagaatacagtgta

SEQ ID NO: 270901 - DNA, 20 bp, Artificial Sequence
  Description of Artificial Sequence: Synthetic oligonucleotide
  Target: ATXN1; (+) strand; PAM type: YTN; PAM sequence: TTG
tagaattctggctatcatca

SEQ ID NO: 270902 - DNA, 20 bp, Artificial Sequence
  Description of Artificial Sequence: Synthetic oligonucleotide
  Target: ATXN1; (+) strand; PAM type: YTN; PAM sequence: TTC
tggctatcatcaattcagcc

SEQ ID NO: 270903 - DNA, 20 bp, Artificial Sequence
  Description of Artificial Sequence: Synthetic oligonucleotide
  Target: ATXN1; (+) strand; PAM type: YTN; PAM sequence: CTG
gctatcatcaattcagccaa

SEQ ID NO: 270904 - DNA, 20 bp, Artificial Sequence
  Description of Artificial Sequence: Synthetic oligonucleotide
  Target: ATXN1; (+) strand; PAM type: YTN; PAM sequence: CTA
tcatcaattcagccaatgca

SEQ ID NO: 270905 - DNA, 20 bp, Artificial Sequence
  Description of Artificial Sequence: Synthetic oligonucleotide
  Target: ATXN1; (+) strand; PAM type: YTN; PAM sequence: TTC
agccaatgcaaggagtgaag

SEQ ID NO: 270906 - DNA, 20 bp, Artificial Sequence
  Description of Artificial Sequence: Synthetic oligonucleotide
  Target: ATXN1; (+) strand; PAM type: YTN; PAM sequence: CTT
ttaaatccccctaaagcatc

SEQ ID NO: 270907 - DNA, 20 bp, Artificial Sequence
  Description of Artificial Sequence: Synthetic oligonucleotide
  Target: ATXN1; (+) strand; PAM type: YTN; PAM sequence: TTT
taaatccccctaaagcatca

SEQ ID NO: 270908 - DNA, 20 bp, Artificial Sequence
  Description of Artificial Sequence: Synthetic oligonucleotide
  Target: ATXN1; (+) strand; PAM type: YTN; PAM sequence: TTT
aaatccccctaaagcatcag

SEQ ID NO: 270909 - DNA, 20 bp, Artificial Sequence
  Description of Artificial Sequence: Synthetic oligonucleotide
  Target: ATXN1; (+) strand; PAM type: YTN; PAM sequence: TTA
aatccccctaaagcatcagt

SEQ ID NO: 270910 - DNA, 20 bp, Artificial Sequence
  Description of Artificial Sequence: Synthetic oligonucleotide
  Target: ATXN1; (+) strand; PAM type: YTN; PAM sequence: CTA
aagcatcagttctccaactt

SEQ ID NO: 270911 - DNA, 20 bp, Artificial Sequence
  Description of Artificial Sequence: Synthetic oligonucleotide
  Target: ATXN1; (+) strand; PAM type: YTN; PAM sequence: TTC
tccaacttggctacacattg

SEQ ID NO: 270912 - DNA, 20 bp, Artificial Sequence
  Description of Artificial Sequence: Synthetic oligonucleotide
  Target: ATXN1; (+) strand; PAM type: YTN; PAM sequence: CTC
caacttggctacacattgtg

SEQ ID NO: 270913 - DNA, 20 bp, Artificial Sequence
  Description of Artificial Sequence: Synthetic oligonucleotide
  Target: ATXN1; (+) strand; PAM type: YTN; PAM sequence: CTT
ggctacacattgtgaccacc

SEQ ID NO: 270914 - DNA, 20 bp, Artificial Sequence
  Description of Artificial Sequence: Synthetic oligonucleotide
  Target: ATXN1; (+) strand; PAM type: YTN; PAM sequence: TTG
gctacacattgtgaccaccc

SEQ ID NO: 270915 - DNA, 20 bp, Artificial Sequence
  Description of Artificial Sequence: Synthetic oligonucleotide
  Target: ATXN1; (+) strand; PAM type: YTN; PAM sequence: CTA
cacattgtgaccacccagag

SEQ ID NO: 270916 - DNA, 20 bp, Artificial Sequence
  Description of Artificial Sequence: Synthetic oligonucleotide
  Target: ATXN1; (+) strand; PAM type: YTN; PAM sequence: TTG
tgaccacccagagagattta

SEQ ID NO: 270917 - DNA, 20 bp, Artificial Sequence
  Description of Artificial Sequence: Synthetic oligonucleotide
  Target: ATXN1; (+) strand; PAM type: YTN; PAM sequence: TTT
agaaagtactaatgtctggg

SEQ ID NO: 270918 - DNA, 20 bp, Artificial Sequence
  Description of Artificial Sequence: Synthetic oligonucleotide
  Target: ATXN1; (+) strand; PAM type: YTN; PAM sequence: TTA
gaaagtactaatgtctgggt

SEQ ID NO: 270919 - DNA, 20 bp, Artificial Sequence
  Description of Artificial Sequence: Synthetic oligonucleotide
  Target: ATXN1; (+) strand; PAM type: YTN; PAM sequence: CTA
atgtctgggttccacccaca

SEQ ID NO: 270920 - DNA, 20 bp, Artificial Sequence
  Description of Artificial Sequence: Synthetic oligonucleotide
  Target: ATXN1; (+) strand; PAM type: YTN; PAM sequence: CTG
ggttccacccacagagatcc

SEQ ID NO: 270921 - DNA, 20 bp, Artificial Sequence
  Description of Artificial Sequence: Synthetic oligonucleotide
  Target: ATXN1; (+) strand; PAM type: YTN; PAM sequence: TTC
cacccacagagatccttact

SEQ ID NO: 270922 - DNA, 20 bp, Artificial Sequence
  Description of Artificial Sequence: Synthetic oligonucleotide
  Target: ATXN1; (+) strand; PAM type: YTN; PAM sequence: CTT
acttaactggtctggggtat

SEQ ID NO: 270923 - DNA, 20 bp, Artificial Sequence
  Description of Artificial Sequence: Synthetic oligonucleotide
  Target: ATXN1; (+) strand; PAM type: YTN; PAM sequence: TTA
cttaactggtctggggtatg

SEQ ID NO: 270924 - DNA, 20 bp, Artificial Sequence
  Description of Artificial Sequence: Synthetic oligonucleotide
  Target: ATXN1; (+) strand; PAM type: YTN; PAM sequence: CTT
aactggtctggggtatggct

SEQ ID NO: 270925 - DNA, 20 bp, Artificial Sequence
  Description of Artificial Sequence: Synthetic oligonucleotide
  Target: ATXN1; (+) strand; PAM type: YTN; PAM sequence: TTA
actggtctggggtatggctc

SEQ ID NO: 270926 - DNA, 20 bp, Artificial Sequence
  Description of Artificial Sequence: Synthetic oligonucleotide
  Target: ATXN1; (+) strand; PAM type: YTN; PAM sequence: CTG
gtctggggtatggctcaggc

SEQ ID NO: 270927 - DNA, 20 bp, Artificial Sequence
  Description of Artificial Sequence: Synthetic oligonucleotide
  Target: ATXN1; (+) strand; PAM type: YTN; PAM sequence: CTG
gggtatggctcaggcaatag

SEQ ID NO: 270928 - DNA, 20 bp, Artificial Sequence
  Description of Artificial Sequence: Synthetic oligonucleotide
  Target: ATXN1; (+) strand; PAM type: YTN; PAM sequence: CTC
aggcaatagaattttggaaa

SEQ ID NO: 270929 - DNA, 20 bp, Artificial Sequence
  Description of Artificial Sequence: Synthetic oligonucleotide
  Target: ATXN1; (+) strand; PAM type: YTN; PAM sequence: TTT
tggaaagctccccaagtgat

SEQ ID NO: 270930 - DNA, 20 bp, Artificial Sequence
  Description of Artificial Sequence: Synthetic oligonucleotide
  Target: ATXN1; (+) strand; PAM type: YTN; PAM sequence: TTT
ggaaagctccccaagtgatt

SEQ ID NO: 270931 - DNA, 20 bp, Artificial Sequence
  Description of Artificial Sequence: Synthetic oligonucleotide
  Target: ATXN1; (+) strand; PAM type: YTN; PAM sequence: TTG
gaaagctccccaagtgattc

SEQ ID NO: 270932 - DNA, 20 bp, Artificial Sequence
  Description of Artificial Sequence: Synthetic oligonucleotide
  Target: ATXN1; (+) strand; PAM type: YTN; PAM sequence: CTC
cccaagtgattctactatgc

SEQ ID NO: 270933 - DNA, 20 bp, Artificial Sequence
  Description of Artificial Sequence: Synthetic oligonucleotide
  Target: ATXN1; (+) strand; PAM type: YTN; PAM sequence: TTC
tactatgcagccaaggtgga

SEQ ID NO: 270934 - DNA, 20 bp, Artificial Sequence
  Description of Artificial Sequence: Synthetic oligonucleotide
  Target: ATXN1; (+) strand; PAM type: YTN; PAM sequence: CTA
ctatgcagccaaggtggaga

SEQ ID NO: 270935 - DNA, 20 bp, Artificial Sequence
  Description of Artificial Sequence: Synthetic oligonucleotide
  Target: ATXN1; (+) strand; PAM type: YTN; PAM sequence: CTA
tgcagccaaggtggagagtc

SEQ ID NO: 270936 - DNA, 20 bp, Artificial Sequence
  Description of Artificial Sequence: Synthetic oligonucleotide
  Target: ATXN1; (+) strand; PAM type: YTN; PAM sequence: CTG
tcctgaagtcatcagaggtt

SEQ ID NO: 270937 - DNA, 20 bp, Artificial Sequence
  Description of Artificial Sequence: Synthetic oligonucleotide
  Target: ATXN1; (+) strand; PAM type: YTN; PAM sequence: CTG
aagtcatcagaggttgccac

SEQ ID NO: 270938 - DNA, 20 bp, Artificial Sequence
  Description of Artificial Sequence: Synthetic oligonucleotide
  Target: ATXN1; (+) strand; PAM type: YTN; PAM sequence: TTG
ccacctactcctcccacaaa

SEQ ID NO: 270939 - DNA, 20 bp, Artificial Sequence
  Description of Artificial Sequence: Synthetic oligonucleotide
  Target: ATXN1; (+) strand; PAM type: YTN; PAM sequence: CTA
ctcctcccacaaaggtggct

SEQ ID NO: 270940 - DNA, 20 bp, Artificial Sequence
  Description of Artificial Sequence: Synthetic oligonucleotide
  Target: ATXN1; (+) strand; PAM type: YTN; PAM sequence: CTC
ctcccacaaaggtggctcct

SEQ ID NO: 270941 - DNA, 20 bp, Artificial Sequence
  Description of Artificial Sequence: Synthetic oligonucleotide
  Target: ATXN1; (+) strand; PAM type: YTN; PAM sequence: CTC
ccacaaaggtggctcctctt

SEQ ID NO: 270942 - DNA, 20 bp, Artificial Sequence
  Description of Artificial Sequence: Synthetic oligonucleotide
  Target: ATXN1; (+) strand; PAM type: YTN; PAM sequence: CTC
ctcttgtcaccttgcaccac

SEQ ID NO: 270943 - DNA, 20 bp, Artificial Sequence
  Description of Artificial Sequence: Synthetic oligonucleotide
  Target: ATXN1; (+) strand; PAM type: YTN; PAM sequence: CTC
ttgtcaccttgcaccacttg

SEQ ID NO: 270944 - DNA, 20 bp, Artificial Sequence
  Description of Artificial Sequence: Synthetic oligonucleotide
  Target: ATXN1; (+) strand; PAM type: YTN; PAM sequence: CTT
gtcaccttgcaccacttgca

SEQ ID NO: 270945 - DNA, 20 bp, Artificial Sequence
  Description of Artificial Sequence: Synthetic oligonucleotide
  Target: ATXN1; (+) strand; PAM type: YTN; PAM sequence: TTG
tcaccttgcaccacttgcaa

SEQ ID NO: 270946 - DNA, 20 bp, Artificial Sequence
  Description of Artificial Sequence: Synthetic oligonucleotide
  Target: ATXN1; (+) strand; PAM type: YTN; PAM sequence: CTT
gcaccacttgcaagcaatta

SEQ ID NO: 270947 - DNA, 20 bp, Artificial Sequence
  Description of Artificial Sequence: Synthetic oligonucleotide
  Target: ATXN1; (+) strand; PAM type: YTN; PAM sequence: TTG
caccacttgcaagcaattag

SEQ ID NO: 270948 - DNA, 20 bp, Artificial Sequence
  Description of Artificial Sequence: Synthetic oligonucleotide
  Target: ATXN1; (+) strand; PAM type: YTN; PAM sequence: CTT
gcaagcaattagggatgtac

SEQ ID NO: 270949 - DNA, 20 bp, Artificial Sequence
  Description of Artificial Sequence: Synthetic oligonucleotide
  Target: ATXN1; (+) strand; PAM type: YTN; PAM sequence: TTG
caagcaattagggatgtaca

SEQ ID NO: 270950 - DNA, 20 bp, Artificial Sequence
  Description of Artificial Sequence: Synthetic oligonucleotide
  Target: ATXN1; (+) strand; PAM type: YTN; PAM sequence: TTA
gggatgtacatttacatgat

SEQ ID NO: 270951 - DNA, 20 bp, Artificial Sequence
  Description of Artificial Sequence: Synthetic oligonucleotide
  Target: ATXN1; (+) strand; PAM type: YTN; PAM sequence: TTT
acatgattttaaaagtctta

SEQ ID NO: 270952 - DNA, 20 bp, Artificial Sequence
  Description of Artificial Sequence: Synthetic oligonucleotide
  Target: ATXN1; (+) strand; PAM type: YTN; PAM sequence: TTA
catgattttaaaagtcttat

SEQ ID NO: 270953 - DNA, 20 bp, Artificial Sequence
  Description of Artificial Sequence: Synthetic oligonucleotide
  Target: ATXN1; (+) strand; PAM type: YTN; PAM sequence: TTT
taaaagtcttatgatgtccg

SEQ ID NO: 270954 - DNA, 20 bp, Artificial Sequence
  Description of Artificial Sequence: Synthetic oligonucleotide
  Target: ATXN1; (+) strand; PAM type: YTN; PAM sequence: TTT
aaaagtcttatgatgtccga

SEQ ID NO: 270955 - DNA, 20 bp, Artificial Sequence
  Description of Artificial Sequence: Synthetic oligonucleotide
  Target: ATXN1; (+) strand; PAM type: YTN; PAM sequence: TTA
aaagtcttatgatgtccgat

SEQ ID NO: 270956 - DNA, 20 bp, Artificial Sequence
  Description of Artificial Sequence: Synthetic oligonucleotide
  Target: ATXN1; (+) strand; PAM type: YTN; PAM sequence: CTT
atgatgtccgattaaaacta

SEQ ID NO: 270957 - DNA, 20 bp, Artificial Sequence
  Description of Artificial Sequence: Synthetic oligonucleotide
  Target: ATXN1; (+) strand; PAM type: YTN; PAM sequence: TTA
tgatgtccgattaaaactaa

SEQ ID NO: 270958 - DNA, 20 bp, Artificial Sequence
  Description of Artificial Sequence: Synthetic oligonucleotide
  Target: ATXN1; (+) strand; PAM type: YTN; PAM sequence: TTA
aaactaacaaaacttgaatt

SEQ ID NO: 270959 - DNA, 20 bp, Artificial Sequence
  Description of Artificial Sequence: Synthetic oligonucleotide
  Target: ATXN1; (+) strand; PAM type: YTN; PAM sequence: CTA
acaaaacttgaatttcttgt

SEQ ID NO: 270960 - DNA, 20 bp, Artificial Sequence
  Description of Artificial Sequence: Synthetic oligonucleotide
  Target: ATXN1; (+) strand; PAM type: YTN; PAM sequence: CTT
gaatttcttgtatcagttat

SEQ ID NO: 270961 - DNA, 20 bp, Artificial Sequence
  Description of Artificial Sequence: Synthetic oligonucleotide
  Target: ATXN1; (+) strand; PAM type: YTN; PAM sequence: TTG
aatttcttgtatcagttatc

SEQ ID NO: 270962 - DNA, 20 bp, Artificial Sequence
  Description of Artificial Sequence: Synthetic oligonucleotide
  Target: ATXN1; (+) strand; PAM type: YTN; PAM sequence: TTT
cttgtatcagttatcattca

SEQ ID NO: 270963 - DNA, 20 bp, Artificial Sequence
  Description of Artificial Sequence: Synthetic oligonucleotide
  Target: ATXN1; (+) strand; PAM type: YTN; PAM sequence: TTC
ttgtatcagttatcattcac

SEQ ID NO: 270964 - DNA, 20 bp, Artificial Sequence
  Description of Artificial Sequence: Synthetic oligonucleotide
  Target: ATXN1; (+) strand; PAM type: YTN; PAM sequence: CTT
gtatcagttatcattcactc

SEQ ID NO: 270965 - DNA, 20 bp, Artificial Sequence
  Description of Artificial Sequence: Synthetic oligonucleotide
  Target: ATXN1; (+) strand; PAM type: YTN; PAM sequence: TTG
tatcagttatcattcactct

SEQ ID NO: 270966 - DNA, 20 bp, Artificial Sequence
  Description of Artificial Sequence: Synthetic oligonucleotide
  Target: ATXN1; (+) strand; PAM type: YTN; PAM sequence: TTA
tcattcactcttctcaacaa

SEQ ID NO: 270967 - DNA, 20 bp, Artificial Sequence
  Description of Artificial Sequence: Synthetic oligonucleotide
  Target: ATXN1; (+) strand; PAM type: YTN; PAM sequence: TTC
actcttctcaacaaccgtgt

SEQ ID NO: 270968 - DNA, 20 bp, Artificial Sequence
  Description of Artificial Sequence: Synthetic oligonucleotide
  Target: ATXN1; (+) strand; PAM type: YTN; PAM sequence: CTC
ttctcaacaaccgtgtgaaa

SEQ ID NO: 270969 - DNA, 20 bp, Artificial Sequence
  Description of Artificial Sequence: Synthetic oligonucleotide
  Target: ATXN1; (+) strand; PAM type: YTN; PAM sequence: CTT
ctcaacaaccgtgtgaaagt

SEQ ID NO: 270970 - DNA, 20 bp, Artificial Sequence
  Description of Artificial Sequence: Synthetic oligonucleotide
  Target: ATXN1; (+) strand; PAM type: YTN; PAM sequence: TTC
tcaacaaccgtgtgaaagta

SEQ ID NO: 270971 - DNA, 20 bp, Artificial Sequence
  Description of Artificial Sequence: Synthetic oligonucleotide
  Target: ATXN1; (+) strand; PAM type: YTN; PAM sequence: CTC
aacaaccgtgtgaaagtaag

SEQ ID NO: 270972 - DNA, 20 bp, Artificial Sequence
  Description of Artificial Sequence: Synthetic oligonucleotide
  Target: ATXN1; (+) strand; PAM type: YTN; PAM sequence: TTT
attgttcccatatgacacac

SEQ ID NO: 270973 - DNA, 20 bp, Artificial Sequence
  Description of Artificial Sequence: Synthetic oligonucleotide
  Target: ATXN1; (+) strand; PAM type: YTN; PAM sequence: TTA
ttgttcccatatgacacacg

SEQ ID NO: 270974 - DNA, 20 bp, Artificial Sequence
  Description of Artificial Sequence: Synthetic oligonucleotide
  Target: ATXN1; (+) strand; PAM type: YTN; PAM sequence: TTG
ttcccatatgacacacgagg

SEQ ID NO: 270975 - DNA, 20 bp, Artificial Sequence
  Description of Artificial Sequence: Synthetic oligonucleotide
  Target: ATXN1; (+) strand; PAM type: YTN; PAM sequence: TTC
ccatatgacacacgaggaaa

SEQ ID NO: 270976 - DNA, 20 bp, Artificial Sequence
  Description of Artificial Sequence: Synthetic oligonucleotide
  Target: ATXN1; (+) strand; PAM type: YTN; PAM sequence: CTC
tgagagattaattaagcgac

SEQ ID NO: 270977 - DNA, 20 bp, Artificial Sequence
  Description of Artificial Sequence: Synthetic oligonucleotide
  Target: ATXN1; (+) strand; PAM type: YTN; PAM sequence: CTG
agagattaattaagcgacag

SEQ ID NO: 270978 - DNA, 20 bp, Artificial Sequence
  Description of Artificial Sequence: Synthetic oligonucleotide
  Target: ATXN1; (+) strand; PAM type: YTN; PAM sequence: TTA
attaagcgacagccctagat

SEQ ID NO: 270979 - DNA, 20 bp, Artificial Sequence
  Description of Artificial Sequence: Synthetic oligonucleotide
  Target: ATXN1; (+) strand; PAM type: YTN; PAM sequence: TTA
agcgacagccctagatcaca

SEQ ID NO: 270980 - DNA, 20 bp, Artificial Sequence
  Description of Artificial Sequence: Synthetic oligonucleotide
  Target: ATXN1; (+) strand; PAM type: YTN; PAM sequence: CTA
gatcacagaacttggaagtg

SEQ ID NO: 270981 - DNA, 20 bp, Artificial Sequence
  Description of Artificial Sequence: Synthetic oligonucleotide
  Target: ATXN1; (+) strand; PAM type: YTN; PAM sequence: CTT
ggaagtggcagaaaattgat

SEQ ID NO: 270982 - DNA, 20 bp, Artificial Sequence
  Description of Artificial Sequence: Synthetic oligonucleotide
  Target: ATXN1; (+) strand; PAM type: YTN; PAM sequence: TTG
gaagtggcagaaaattgatt

SEQ ID NO: 270983 - DNA, 20 bp, Artificial Sequence
  Description of Artificial Sequence: Synthetic oligonucleotide
  Target: ATXN1; (+) strand; PAM type: YTN; PAM sequence: TTG
attttaatacaattgtttca

SEQ ID NO: 270984 - DNA, 20 bp, Artificial Sequence
  Description of Artificial Sequence: Synthetic oligonucleotide
  Target: ATXN1; (+) strand; PAM type: YTN; PAM sequence: TTT
taatacaattgtttcaaccc

SEQ ID NO: 270985 - DNA, 20 bp, Artificial Sequence
  Description of Artificial Sequence: Synthetic oligonucleotide
  Target: ATXN1; (+) strand; PAM type: YTN; PAM sequence: TTT
aatacaattgtttcaacccc

SEQ ID NO: 270986 - DNA, 20 bp, Artificial Sequence
  Description of Artificial Sequence: Synthetic oligonucleotide
  Target: ATXN1; (+) strand; PAM type: YTN; PAM sequence: TTA
atacaattgtttcaacccca

SEQ ID NO: 270987 - DNA, 20 bp, Artificial Sequence
  Description of Artificial Sequence: Synthetic oligonucleotide
  Target: ATXN1; (+) strand; PAM type: YTN; PAM sequence: TTG
tttcaaccccacagtctgta

SEQ ID NO: 270988 - DNA, 20 bp, Artificial Sequence
  Description of Artificial Sequence: Synthetic oligonucleotide
  Target: ATXN1; (+) strand; PAM type: YTN; PAM sequence: TTT
caaccccacagtctgtatca

SEQ ID NO: 270989 - DNA, 20 bp, Artificial Sequence
  Description of Artificial Sequence: Synthetic oligonucleotide
  Target: ATXN1; (+) strand; PAM type: YTN; PAM sequence: TTC
aaccccacagtctgtatcat

SEQ ID NO: 270990 - DNA, 20 bp, Artificial Sequence
  Description of Artificial Sequence: Synthetic oligonucleotide
  Target: ATXN1; (+) strand; PAM type: YTN; PAM sequence: CTG
tatcattataatctcccagt

SEQ ID NO: 270991 - DNA, 20 bp, Artificial Sequence
  Description of Artificial Sequence: Synthetic oligonucleotide
  Target: ATXN1; (+) strand; PAM type: YTN; PAM sequence: TTA
taatctcccagtaatttcaa

SEQ ID NO: 270992 - DNA, 20 bp, Artificial Sequence
  Description of Artificial Sequence: Synthetic oligonucleotide
  Target: ATXN1; (+) strand; PAM type: YTN; PAM sequence: CTC
ccagtaatttcaaaagggcc

SEQ ID NO: 270993 - DNA, 20 bp, Artificial Sequence
  Description of Artificial Sequence: Synthetic oligonucleotide
  Target: ATXN1; (+) strand; PAM type: YTN; PAM sequence: TTT
caaaagggccaaccactgtg

SEQ ID NO: 270994 - DNA, 20 bp, Artificial Sequence
  Description of Artificial Sequence: Synthetic oligonucleotide
  Target: ATXN1; (+) strand; PAM type: YTN; PAM sequence: TTC
aaaagggccaaccactgtga

SEQ ID NO: 270995 - DNA, 20 bp, Artificial Sequence
  Description of Artificial Sequence: Synthetic oligonucleotide
  Target: ATXN1; (+) strand; PAM type: YTN; PAM sequence: CTG
tgagtgtgggcatgtaattt

SEQ ID NO: 270996 - DNA, 20 bp, Artificial Sequence
  Description of Artificial Sequence: Synthetic oligonucleotide
  Target: ATXN1; (+) strand; PAM type: YTN; PAM sequence: TTT
ggttgcatcttcaatgtggc

SEQ ID NO: 270997 - DNA, 20 bp, Artificial Sequence
  Description of Artificial Sequence: Synthetic oligonucleotide
  Target: ATXN1; (+) strand; PAM type: YTN; PAM sequence: TTG
gttgcatcttcaatgtggca

SEQ ID NO: 270998 - DNA, 20 bp, Artificial Sequence
  Description of Artificial Sequence: Synthetic oligonucleotide
  Target: ATXN1; (+) strand; PAM type: YTN; PAM sequence: TTG
catcttcaatgtggcaccca

SEQ ID NO: 270999 - DNA, 20 bp, Artificial Sequence
  Description of Artificial Sequence: Synthetic oligonucleotide
  Target: ATXN1; (+) strand; PAM type: YTN; PAM sequence: CTT
caatgtggcacccatcttgt

SEQ ID NO: 271000 - DNA, 20 bp, Artificial Sequence
  Description of Artificial Sequence: Synthetic oligonucleotide
  Target: ATXN1; (+) strand; PAM type: YTN; PAM sequence: TTC
aatgtggcacccatcttgtg

SEQ ID NO: 271001 - DNA, 20 bp, Artificial Sequence
  Description of Artificial Sequence: Synthetic oligonucleotide
  Target: ATXN1; (+) strand; PAM type: YTN; PAM sequence: CTT
gtggaatgggacgaggggat

SEQ ID NO: 271002 - DNA, 20 bp, Artificial Sequence
  Description of Artificial Sequence: Synthetic oligonucleotide
  Target: ATXN1; (+) strand; PAM type: YTN; PAM sequence: TTG
tggaatgggacgaggggata

SEQ ID NO: 271003 - DNA, 20 bp, Artificial Sequence
  Description of Artificial Sequence: Synthetic oligonucleotide
  Target: ATXN1; (+) strand; PAM type: YTN; PAM sequence: CTC
gctgaagagaatagcaggca

SEQ ID NO: 271004 - DNA, 20 bp, Artificial Sequence
  Description of Artificial Sequence: Synthetic oligonucleotide
  Target: ATXN1; (+) strand; PAM type: YTN; PAM sequence: CTG
aagagaatagcaggcactac

SEQ ID NO: 271005 - DNA, 20 bp, Artificial Sequence
  Description of Artificial Sequence: Synthetic oligonucleotide
  Target: ATXN1; (+) strand; PAM type: YTN; PAM sequence: CTA
cctctgtcggttactattta

SEQ ID NO: 271006 - DNA, 20 bp, Artificial Sequence
  Description of Artificial Sequence: Synthetic oligonucleotide
  Target: ATXN1; (+) strand; PAM type: YTN; PAM sequence: CTC
tgtcggttactatttacctt

SEQ ID NO: 271007 - DNA, 20 bp, Artificial Sequence
  Description of Artificial Sequence: Synthetic oligonucleotide
  Target: ATXN1; (+) strand; PAM type: YTN; PAM sequence: CTG
tcggttactatttacctttc

SEQ ID NO: 271008 - DNA, 20 bp, Artificial Sequence
  Description of Artificial Sequence: Synthetic oligonucleotide
  Target: ATXN1; (+) strand; PAM type: YTN; PAM sequence: TTA
ctatttacctttctttctct

SEQ ID NO: 271009 - DNA, 20 bp, Artificial Sequence
  Description of Artificial Sequence: Synthetic oligonucleotide
  Target: ATXN1; (+) strand; PAM type: YTN; PAM sequence: CTA
tttacctttctttctctata

SEQ ID NO: 271010 - DNA, 20 bp, Artificial Sequence
  Description of Artificial Sequence: Synthetic oligonucleotide
  Target: ATXN1; (+) strand; PAM type: YTN; PAM sequence: TTT
acctttctttctctatattg

SEQ ID NO: 271011 - DNA, 20 bp, Artificial Sequence
  Description of Artificial Sequence: Synthetic oligonucleotide
  Target: ATXN1; (+) strand; PAM type: YTN; PAM sequence: TTA
cctttctttctctatattgt

SEQ ID NO: 271012 - DNA, 20 bp, Artificial Sequence
  Description of Artificial Sequence: Synthetic oligonucleotide
  Target: ATXN1; (+) strand; PAM type: YTN; PAM sequence: CTT
tctttctctatattgtatgc

SEQ ID NO: 271013 - DNA, 20 bp, Artificial Sequence
  Description of Artificial Sequence: Synthetic oligonucleotide
  Target: ATXN1; (+) strand; PAM type: YTN; PAM sequence: TTT
ctttctctatattgtatgca

SEQ ID NO: 271014 - DNA, 20 bp, Artificial Sequence
  Description of Artificial Sequence: Synthetic oligonucleotide
  Target: ATXN1; (+) strand; PAM type: YTN; PAM sequence: TTC
tttctctatattgtatgcat

SEQ ID NO: 271015 - DNA, 20 bp, Artificial Sequence
  Description of Artificial Sequence: Synthetic oligonucleotide
  Target: ATXN1; (+) strand; PAM type: YTN; PAM sequence: CTT
tctctatattgtatgcatgt

SEQ ID NO: 271016 - DNA, 20 bp, Artificial Sequence
  Description of Artificial Sequence: Synthetic oligonucleotide
  Target: ATXN1; (+) strand; PAM type: YTN; PAM sequence: TTT
ctctatattgtatgcatgtg

SEQ ID NO: 271017 - DNA, 20 bp, Artificial Sequence
  Description of Artificial Sequence: Synthetic oligonucleotide
  Target: ATXN1; (+) strand; PAM type: YTN; PAM sequence: TTC
tctatattgtatgcatgtgg

SEQ ID NO: 271018 - DNA, 20 bp, Artificial Sequence
  Description of Artificial Sequence: Synthetic oligonucleotide
  Target: ATXN1; (+) strand; PAM type: YTN; PAM sequence: CTC
tatattgtatgcatgtgggt

SEQ ID NO: 271019 - DNA, 20 bp, Artificial Sequence
  Description of Artificial Sequence: Synthetic oligonucleotide
  Target: ATXN1; (+) strand; PAM type: YTN; PAM sequence: CTA
tattgtatgcatgtgggtgt

SEQ ID NO: 271020 - DNA, 20 bp, Artificial Sequence
  Description of Artificial Sequence: Synthetic oligonucleotide
  Target: ATXN1; (+) strand; PAM type: YTN; PAM sequence: TTG
tatgcatgtgggtgtgtgag

SEQ ID NO: 271021 - DNA, 20 bp, Artificial Sequence
  Description of Artificial Sequence: Synthetic oligonucleotide
  Target: ATXN1; (+) strand; PAM type: YTN; PAM sequence: CTA
aggaaagtggacctcaaggg

SEQ ID NO: 271022 - DNA, 20 bp, Artificial Sequence
  Description of Artificial Sequence: Synthetic oligonucleotide
  Target: ATXN1; (+) strand; PAM type: YTN; PAM sequence: CTC
aagggtatatctgaattgag

SEQ ID NO: 271023 - DNA, 20 bp, Artificial Sequence
  Description of Artificial Sequence: Synthetic oligonucleotide
  Target: ATXN1; (+) strand; PAM type: YTN; PAM sequence: CTG
aattgagaaacatatggccc

SEQ ID NO: 271024 - DNA, 20 bp, Artificial Sequence
  Description of Artificial Sequence: Synthetic oligonucleotide
  Target: ATXN1; (+) strand; PAM type: YTN; PAM sequence: TTG
agaaacatatggcccaacta

SEQ ID NO: 271025 - DNA, 20 bp, Artificial Sequence
  Description of Artificial Sequence: Synthetic oligonucleotide
  Target: ATXN1; (+) strand; PAM type: YTN; PAM sequence: CTA
caagaaggtacctgggtagg

SEQ ID NO: 271026 - DNA, 20 bp, Artificial Sequence
  Description of Artificial Sequence: Synthetic oligonucleotide
  Target: ATXN1; (+) strand; PAM type: YTN; PAM sequence: CTG
ggtagggttttcagagatgt

SEQ ID NO: 271027 - DNA, 20 bp, Artificial Sequence
  Description of Artificial Sequence: Synthetic oligonucleotide
  Target: ATXN1; (+) strand; PAM type: YTN; PAM sequence: TTT
tcagagatgtagtaattctt

SEQ ID NO: 271028 - DNA, 20 bp, Artificial Sequence
  Description of Artificial Sequence: Synthetic oligonucleotide
  Target: ATXN1; (+) strand; PAM type: YTN; PAM sequence: TTT
cagagatgtagtaattcttt

SEQ ID NO: 271029 - DNA, 20 bp, Artificial Sequence
  Description of Artificial Sequence: Synthetic oligonucleotide
  Target: ATXN1; (+) strand; PAM type: YTN; PAM sequence: TTC
agagatgtagtaattctttc

SEQ ID NO: 271030 - DNA, 20 bp, Artificial Sequence
  Description of Artificial Sequence: Synthetic oligonucleotide
  Target: ATXN1; (+) strand; PAM type: YTN; PAM sequence: TTC
tttccaagatgtgataagac

SEQ ID NO: 271031 - DNA, 20 bp, Artificial Sequence
  Description of Artificial Sequence: Synthetic oligonucleotide
  Target: ATXN1; (+) strand; PAM type: YTN; PAM sequence: CTT
tccaagatgtgataagactg

SEQ ID NO: 271032 - DNA, 20 bp, Artificial Sequence
  Description of Artificial Sequence: Synthetic oligonucleotide
  Target: ATXN1; (+) strand; PAM type: YTN; PAM sequence: TTT
ccaagatgtgataagactgg

SEQ ID NO: 271033 - DNA, 20 bp, Artificial Sequence
  Description of Artificial Sequence: Synthetic oligonucleotide
  Target: ATXN1; (+) strand; PAM type: YTN; PAM sequence: TTC
caagatgtgataagactggt

SEQ ID NO: 271034 - DNA, 20 bp, Artificial Sequence
  Description of Artificial Sequence: Synthetic oligonucleotide
  Target: ATXN1; (+) strand; PAM type: YTN; PAM sequence: CTG
gtaaaaggtcatgaaatatc

SEQ ID NO: 271035 - DNA, 20 bp, Artificial Sequence
  Description of Artificial Sequence: Synthetic oligonucleotide
  Target: ATXN1; (+) strand; PAM type: YTN; PAM sequence: CTT
cattatgataaaaaaaaaaa

SEQ ID NO: 271036 - DNA, 20 bp, Artificial Sequence
  Description of Artificial Sequence: Synthetic oligonucleotide
  Target: ATXN1; (+) strand; PAM type: YTN; PAM sequence: TTC
attatgataaaaaaaaaaaa

SEQ ID NO: 271037 - DNA, 20 bp, Artificial Sequence
  Description of Artificial Sequence: Synthetic oligonucleotide
  Target: ATXN1; (+) strand; PAM type: YTN; PAM sequence: TTA
tgataaaaaaaaaaaaaaaa

SEQ ID NO: 271038 - DNA, 20 bp, Artificial Sequence
  Description of Artificial Sequence: Synthetic oligonucleotide
  Target: ATXN1; (+) strand; PAM type: YTN; PAM sequence: TTG
aggaaactaccaattcattc

SEQ ID NO: 271039 - DNA, 20 bp, Artificial Sequence
  Description of Artificial Sequence: Synthetic oligonucleotide
  Target: ATXN1; (+) strand; PAM type: YTN; PAM sequence: CTA
ccaattcattcatttatgga

SEQ ID NO: 271040 - DNA, 20 bp, Artificial Sequence
  Description of Artificial Sequence: Synthetic oligonucleotide
  Target: ATXN1; (+) strand; PAM type: YTN; PAM sequence: TTC
attcatttatggattcatct

SEQ ID NO: 271041 - DNA, 20 bp, Artificial Sequence
  Description of Artificial Sequence: Synthetic oligonucleotide
  Target: ATXN1; (+) strand; PAM type: YTN; PAM sequence: TTC
atttatggattcatctaatg

SEQ ID NO: 271042 - DNA, 20 bp, Artificial Sequence
  Description of Artificial Sequence: Synthetic oligonucleotide
  Target: ATXN1; (+) strand; PAM type: YTN; PAM sequence: TTT
atggattcatctaatgccca

SEQ ID NO: 271043 - DNA, 20 bp, Artificial Sequence
  Description of Artificial Sequence: Synthetic oligonucleotide
  Target: ATXN1; (+) strand; PAM type: YTN; PAM sequence: TTA
tggattcatctaatgcccat

SEQ ID NO: 271044 - DNA, 20 bp, Artificial Sequence
  Description of Artificial Sequence: Synthetic oligonucleotide
  Target: ATXN1; (+) strand; PAM type: YTN; PAM sequence: TTC
atctaatgcccatatataga

SEQ ID NO: 271045 - DNA, 20 bp, Artificial Sequence
  Description of Artificial Sequence: Synthetic oligonucleotide
  Target: ATXN1; (+) strand; PAM type: YTN; PAM sequence: CTA
atgcccatatatagattaca

SEQ ID NO: 271046 - DNA, 20 bp, Artificial Sequence
  Description of Artificial Sequence: Synthetic oligonucleotide
  Target: ATXN1; (+) strand; PAM type: YTN; PAM sequence: TTA
caaagcttaatcagtagtga

SEQ ID NO: 271047 - DNA, 20 bp, Artificial Sequence
  Description of Artificial Sequence: Synthetic oligonucleotide
  Target: ATXN1; (+) strand; PAM type: YTN; PAM sequence: CTT
aatcagtagtgagtgacaag

SEQ ID NO: 271048 - DNA, 20 bp, Artificial Sequence
  Description of Artificial Sequence: Synthetic oligonucleotide
  Target: ATXN1; (+) strand; PAM type: YTN; PAM sequence: TTA
atcagtagtgagtgacaaga

SEQ ID NO: 271049 - DNA, 20 bp, Artificial Sequence
  Description of Artificial Sequence: Synthetic oligonucleotide
  Target: ATXN1; (+) strand; PAM type: YTN; PAM sequence: CTG
aagaatatcaggcaaaaatc

SEQ ID NO: 271050 - DNA, 20 bp, Artificial Sequence
  Description of Artificial Sequence: Synthetic oligonucleotide
  Target: ATXN1; (+) strand; PAM type: YTN; PAM sequence: CTC
ccatacttaaatattcaggt

SEQ ID NO: 271051 - DNA, 20 bp, Artificial Sequence
  Description of Artificial Sequence: Synthetic oligonucleotide
  Target: ATXN1; (+) strand; PAM type: YTN; PAM sequence: CTT
aaatattcaggttcttataa

SEQ ID NO: 271052 - DNA, 20 bp, Artificial Sequence
  Description of Artificial Sequence: Synthetic oligonucleotide
  Target: ATXN1; (+) strand; PAM type: YTN; PAM sequence: TTA
aatattcaggttcttataat

SEQ ID NO: 271053 - DNA, 20 bp, Artificial Sequence
  Description of Artificial Sequence: Synthetic oligonucleotide
  Target: ATXN1; (+) strand; PAM type: YTN; PAM sequence: TTC
aggttcttataatagacaag

SEQ ID NO: 271054 - DNA, 20 bp, Artificial Sequence
  Description of Artificial Sequence: Synthetic oligonucleotide
  Target: ATXN1; (+) strand; PAM type: YTN; PAM sequence: TTC
ttataatagacaagacacaa

SEQ ID NO: 271055 - DNA, 20 bp, Artificial Sequence
  Description of Artificial Sequence: Synthetic oligonucleotide
  Target: ATXN1; (+) strand; PAM type: YTN; PAM sequence: CTT
ataatagacaagacacaatt

SEQ ID NO: 271056 - DNA, 20 bp, Artificial Sequence
  Description of Artificial Sequence: Synthetic oligonucleotide
  Target: ATXN1; (+) strand; PAM type: YTN; PAM sequence: TTA
taatagacaagacacaattt

SEQ ID NO: 271057 - DNA, 20 bp, Artificial Sequence
  Description of Artificial Sequence: Synthetic oligonucleotide
  Target: ATXN1; (+) strand; PAM type: YTN; PAM sequence: TTT
ccacataatatcatcttgtc

SEQ ID NO: 271058 - DNA, 20 bp, Artificial Sequence
  Description of Artificial Sequence: Synthetic oligonucleotide
  Target: ATXN1; (+) strand; PAM type: YTN; PAM sequence: TTC
cacataatatcatcttgtct

SEQ ID NO: 271059 - DNA, 20 bp, Artificial Sequence
  Description of Artificial Sequence: Synthetic oligonucleotide
  Target: ATXN1; (+) strand; PAM type: YTN; PAM sequence: CTT
gtctgccaatgcatggggca

SEQ ID NO: 271060 - DNA, 20 bp, Artificial Sequence
  Description of Artificial Sequence: Synthetic oligonucleotide
  Target: ATXN1; (+) strand; PAM type: YTN; PAM sequence: TTG
tctgccaatgcatggggcac

SEQ ID NO: 271061 - DNA, 20 bp, Artificial Sequence
  Description of Artificial Sequence: Synthetic oligonucleotide
  Target: ATXN1; (+) strand; PAM type: YTN; PAM sequence: CTG
ccaatgcatggggcacatta

SEQ ID NO: 271062 - DNA, 20 bp, Artificial Sequence
  Description of Artificial Sequence: Synthetic oligonucleotide
  Target: ATXN1; (+) strand; PAM type: YTN; PAM sequence: TTA
actagccttgacacaatagt

SEQ ID NO: 271063 - DNA, 20 bp, Artificial Sequence
  Description of Artificial Sequence: Synthetic oligonucleotide
  Target: ATXN1; (+) strand; PAM type: YTN; PAM sequence: CTA
gccttgacacaatagtagaa

SEQ ID NO: 271064 - DNA, 20 bp, Artificial Sequence
  Description of Artificial Sequence: Synthetic oligonucleotide
  Target: ATXN1; (+) strand; PAM type: YTN; PAM sequence: CTT
gacacaatagtagaacaaat

SEQ ID NO: 271065 - DNA, 20 bp, Artificial Sequence
  Description of Artificial Sequence: Synthetic oligonucleotide
  Target: ATXN1; (+) strand; PAM type: YTN; PAM sequence: TTG
acacaatagtagaacaaatc

SEQ ID NO: 271066 - DNA, 20 bp, Artificial Sequence
  Description of Artificial Sequence: Synthetic oligonucleotide
  Target: ATXN1; (+) strand; PAM type: YTN; PAM sequence: TTG
gtaaaatgtattattaatga

SEQ ID NO: 271067 - DNA, 20 bp, Artificial Sequence
  Description of Artificial Sequence: Synthetic oligonucleotide
  Target: ATXN1; (+) strand; PAM type: YTN; PAM sequence: TTA
ttaatgatggtagaaattgg

SEQ ID NO: 271068 - DNA, 20 bp, Artificial Sequence
  Description of Artificial Sequence: Synthetic oligonucleotide
  Target: ATXN1; (+) strand; PAM type: YTN; PAM sequence: TTA
atgatggtagaaattgggaa

SEQ ID NO: 271069 - DNA, 20 bp, Artificial Sequence
  Description of Artificial Sequence: Synthetic oligonucleotide
  Target: ATXN1; (+) strand; PAM type: YTN; PAM sequence: TTG
ggaagtgagtttcatgtcac

SEQ ID NO: 271070 - DNA, 20 bp, Artificial Sequence
  Description of Artificial Sequence: Synthetic oligonucleotide
  Target: ATXN1; (+) strand; PAM type: YTN; PAM sequence: TTT
catgtcacttttttctctta

SEQ ID NO: 271071 - DNA, 20 bp, Artificial Sequence
  Description of Artificial Sequence: Synthetic oligonucleotide
  Target: ATXN1; (+) strand; PAM type: YTN; PAM sequence: TTC
atgtcacttttttctcttat

SEQ ID NO: 271072 - DNA, 20 bp, Artificial Sequence
  Description of Artificial Sequence: Synthetic oligonucleotide
  Target: ATXN1; (+) strand; PAM type: YTN; PAM sequence: CTT
ttttctcttattttaaactg

SEQ ID NO: 271073 - DNA, 20 bp, Artificial Sequence
  Description of Artificial Sequence: Synthetic oligonucleotide
  Target: ATXN1; (+) strand; PAM type: YTN; PAM sequence: TTT
tttctcttattttaaactgg

SEQ ID NO: 271074 - DNA, 20 bp, Artificial Sequence
  Description of Artificial Sequence: Synthetic oligonucleotide
  Target: ATXN1; (+) strand; PAM type: YTN; PAM sequence: TTT
ttctcttattttaaactggt

SEQ ID NO: 271075 - DNA, 20 bp, Artificial Sequence
  Description of Artificial Sequence: Synthetic oligonucleotide
  Target: ATXN1; (+) strand; PAM type: YTN; PAM sequence: TTT
tctcttattttaaactggtg

SEQ ID NO: 271076 - DNA, 20 bp, Artificial Sequence
  Description of Artificial Sequence: Synthetic oligonucleotide
  Target: ATXN1; (+) strand; PAM type: YTN; PAM sequence: TTT
ctcttattttaaactggtgc

SEQ ID NO: 271077 - DNA, 20 bp, Artificial Sequence
  Description of Artificial Sequence: Synthetic oligonucleotide
  Target: ATXN1; (+) strand; PAM type: YTN; PAM sequence: TTC
tcttattttaaactggtgca

SEQ ID NO: 271078 - DNA, 20 bp, Artificial Sequence
  Description of Artificial Sequence: Synthetic oligonucleotide
  Target: ATXN1; (+) strand; PAM type: YTN; PAM sequence: CTC
ttattttaaactggtgcact

SEQ ID NO: 271079 - DNA, 20 bp, Artificial Sequence
  Description of Artificial Sequence: Synthetic oligonucleotide
  Target: ATXN1; (+) strand; PAM type: YTN; PAM sequence: CTT
attttaaactggtgcactca

SEQ ID NO: 271080 - DNA, 20 bp, Artificial Sequence
  Description of Artificial Sequence: Synthetic oligonucleotide
  Target: ATXN1; (+) strand; PAM type: YTN; PAM sequence: TTA
ttttaaactggtgcactcaa

SEQ ID NO: 271081 - DNA, 20 bp, Artificial Sequence
  Description of Artificial Sequence: Synthetic oligonucleotide
  Target: ATXN1; (+) strand; PAM type: YTN; PAM sequence: TTT
taaactggtgcactcaaatg

SEQ ID NO: 271082 - DNA, 20 bp, Artificial Sequence
  Description of Artificial Sequence: Synthetic oligonucleotide
  Target: ATXN1; (+) strand; PAM type: YTN; PAM sequence: TTT
aaactggtgcactcaaatgt

SEQ ID NO: 271083 - DNA, 20 bp, Artificial Sequence
  Description of Artificial Sequence: Synthetic oligonucleotide
  Target: ATXN1; (+) strand; PAM type: YTN; PAM sequence: TTA
aactggtgcactcaaatgtg

SEQ ID NO: 271084 - DNA, 20 bp, Artificial Sequence
  Description of Artificial Sequence: Synthetic oligonucleotide
  Target: ATXN1; (+) strand; PAM type: YTN; PAM sequence: CTG
gtgcactcaaatgtgtaggt

SEQ ID NO: 271085 - DNA, 20 bp, Artificial Sequence
  Description of Artificial Sequence: Synthetic oligonucleotide
  Target: ATXN1; (+) strand; PAM type: YTN; PAM sequence: CTC
aaatgtgtaggtttgtgcat

SEQ ID NO: 271086 - DNA, 20 bp, Artificial Sequence
  Description of Artificial Sequence: Synthetic oligonucleotide
  Target: ATXN1; (+) strand; PAM type: YTN; PAM sequence: TTT
gtgcatgtgcgtgagtgtgc

SEQ ID NO: 271087 - DNA, 20 bp, Artificial Sequence
  Description of Artificial Sequence: Synthetic oligonucleotide
  Target: ATXN1; (+) strand; PAM type: YTN; PAM sequence: TTG
tgcatgtgcgtgagtgtgca

SEQ ID NO: 271088 - DNA, 20 bp, Artificial Sequence
  Description of Artificial Sequence: Synthetic oligonucleotide
  Target: ATXN1; (+) strand; PAM type: YTN; PAM sequence: CTT
gagtgaagactccatttcag

SEQ ID NO: 271089 - DNA, 20 bp, Artificial Sequence
  Description of Artificial Sequence: Synthetic oligonucleotide
  Target: ATXN1; (+) strand; PAM type: YTN; PAM sequence: TTG
agtgaagactccatttcagt

SEQ ID NO: 271090 - DNA, 20 bp, Artificial Sequence
  Description of Artificial Sequence: Synthetic oligonucleotide
  Target: ATXN1; (+) strand; PAM type: YTN; PAM sequence: CTC
catttcagttctgccattgt

SEQ ID NO: 271091 - DNA, 20 bp, Artificial Sequence
  Description of Artificial Sequence: Synthetic oligonucleotide
  Target: ATXN1; (+) strand; PAM type: YTN; PAM sequence: TTT
cagttctgccattgttcaca

SEQ ID NO: 271092 - DNA, 20 bp, Artificial Sequence
  Description of Artificial Sequence: Synthetic oligonucleotide
  Target: ATXN1; (+) strand; PAM type: YTN; PAM sequence: TTC
agttctgccattgttcacag

SEQ ID NO: 271093 - DNA, 20 bp, Artificial Sequence
  Description of Artificial Sequence: Synthetic oligonucleotide
  Target: ATXN1; (+) strand; PAM type: YTN; PAM sequence: TTC
tgccattgttcacaggccta

SEQ ID NO: 271094 - DNA, 20 bp, Artificial Sequence
  Description of Artificial Sequence: Synthetic oligonucleotide
  Target: ATXN1; (+) strand; PAM type: YTN; PAM sequence: CTG
ccattgttcacaggcctaac

SEQ ID NO: 271095 - DNA, 20 bp, Artificial Sequence
  Description of Artificial Sequence: Synthetic oligonucleotide
  Target: ATXN1; (+) strand; PAM type: YTN; PAM sequence: TTG
ttcacaggcctaacaactta

SEQ ID NO: 271096 - DNA, 20 bp, Artificial Sequence
  Description of Artificial Sequence: Synthetic oligonucleotide
  Target: ATXN1; (+) strand; PAM type: YTN; PAM sequence: TTC
acaggcctaacaacttactt

SEQ ID NO: 271097 - DNA, 20 bp, Artificial Sequence
  Description of Artificial Sequence: Synthetic oligonucleotide
  Target: ATXN1; (+) strand; PAM type: YTN; PAM sequence: CTA
acaacttacttttccttaaa

SEQ ID NO: 271098 - DNA, 20 bp, Artificial Sequence
  Description of Artificial Sequence: Synthetic oligonucleotide
  Target: ATXN1; (+) strand; PAM type: YTN; PAM sequence: CTT
acttttccttaaaacaagga

SEQ ID NO: 271099 - DNA, 20 bp, Artificial Sequence
  Description of Artificial Sequence: Synthetic oligonucleotide
  Target: ATXN1; (+) strand; PAM type: YTN; PAM sequence: TTA
cttttccttaaaacaaggaa

SEQ ID NO: 271100 - DNA, 20 bp, Artificial Sequence
  Description of Artificial Sequence: Synthetic oligonucleotide
  Target: ATXN1; (+) strand; PAM type: YTN; PAM sequence: CTT
ttccttaaaacaaggaaagg

SEQ ID NO: 271101 - DNA, 20 bp, Artificial Sequence
  Description of Artificial Sequence: Synthetic oligonucleotide
  Target: ATXN1; (+) strand; PAM type: YTN; PAM sequence: TTT
tccttaaaacaaggaaagga

SEQ ID NO: 271102 - DNA, 20 bp, Artificial Sequence
  Description of Artificial Sequence: Synthetic oligonucleotide
  Target: ATXN1; (+) strand; PAM type: YTN; PAM sequence: TTT
ccttaaaacaaggaaaggag

SEQ ID NO: 271103 - DNA, 20 bp, Artificial Sequence
  Description of Artificial Sequence: Synthetic oligonucleotide
  Target: ATXN1; (+) strand; PAM type: YTN; PAM sequence: TTC
cttaaaacaaggaaaggagg

SEQ ID NO: 271104 - DNA, 20 bp, Artificial Sequence
  Description of Artificial Sequence: Synthetic oligonucleotide
  Target: ATXN1; (+) strand; PAM type: YTN; PAM sequence: CTT
aaaacaaggaaaggagggtt

SEQ ID NO: 271105 - DNA, 20 bp, Artificial Sequence
  Description of Artificial Sequence: Synthetic oligonucleotide
  Target: ATXN1; (+) strand; PAM type: YTN; PAM sequence: TTA
aaacaaggaaaggagggttg

SEQ ID NO: 271106 - DNA, 20 bp, Artificial Sequence
  Description of Artificial Sequence: Synthetic oligonucleotide
  Target: ATXN1; (+) strand; PAM type: YTN; PAM sequence: TTG
tcatgttattattctgtttc

SEQ ID NO: 271107 - DNA, 20 bp, Artificial Sequence
  Description of Artificial Sequence: Synthetic oligonucleotide
  Target: ATXN1; (+) strand; PAM type: YTN; PAM sequence: TTA
ttattctgtttccattatta

SEQ ID NO: 271108 - DNA, 20 bp, Artificial Sequence
  Description of Artificial Sequence: Synthetic oligonucleotide
  Target: ATXN1; (+) strand; PAM type: YTN; PAM sequence: TTA
ttctgtttccattattatgc

SEQ ID NO: 271109 - DNA, 20 bp, Artificial Sequence
  Description of Artificial Sequence: Synthetic oligonucleotide
  Target: ATXN1; (+) strand; PAM type: YTN; PAM sequence: TTC
tgtttccattattatgccat

SEQ ID NO: 271110 - DNA, 20 bp, Artificial Sequence
  Description of Artificial Sequence: Synthetic oligonucleotide
  Target: ATXN1; (+) strand; PAM type: YTN; PAM sequence: CTG
tttccattattatgccataa

SEQ ID NO: 271111 - DNA, 20 bp, Artificial Sequence
  Description of Artificial Sequence: Synthetic oligonucleotide
  Target: ATXN1; (+) strand; PAM type: YTN; PAM sequence: TTT
ccattattatgccataagga

SEQ ID NO: 271112 - DNA, 20 bp, Artificial Sequence
  Description of Artificial Sequence: Synthetic oligonucleotide
  Target: ATXN1; (+) strand; PAM type: YTN; PAM sequence: TTC
cattattatgccataaggaa

SEQ ID NO: 271113 - DNA, 20 bp, Artificial Sequence
  Description of Artificial Sequence: Synthetic oligonucleotide
  Target: ATXN1; (+) strand; PAM type: YTN; PAM sequence: TTA
ttatgccataaggaaactgg

SEQ ID NO: 271114 - DNA, 20 bp, Artificial Sequence
  Description of Artificial Sequence: Synthetic oligonucleotide
  Target: ATXN1; (+) strand; PAM type: YTN; PAM sequence: TTA
tgccataaggaaactggaag

SEQ ID NO: 271115 - DNA, 20 bp, Artificial Sequence
  Description of Artificial Sequence: Synthetic oligonucleotide
  Target: ATXN1; (+) strand; PAM type: YTN; PAM sequence: CTG
gaagaattctttatttttaa

SEQ ID NO: 271116 - DNA, 20 bp, Artificial Sequence
  Description of Artificial Sequence: Synthetic oligonucleotide
  Target: ATXN1; (+) strand; PAM type: YTN; PAM sequence: TTC
tttatttttaaaatattttt

SEQ ID NO: 271117 - DNA, 20 bp, Artificial Sequence
  Description of Artificial Sequence: Synthetic oligonucleotide
  Target: ATXN1; (+) strand; PAM type: YTN; PAM sequence: CTT
tatttttaaaatatttttaa

SEQ ID NO: 271118 - DNA, 20 bp, Artificial Sequence
  Description of Artificial Sequence: Synthetic oligonucleotide
  Target: ATXN1; (+) strand; PAM type: YTN; PAM sequence: TTT
atttttaaaatatttttaaa

SEQ ID NO: 271119 - DNA, 20 bp, Artificial Sequence
  Description of Artificial Sequence: Synthetic oligonucleotide
  Target: ATXN1; (+) strand; PAM type: YTN; PAM sequence: TTA
tttttaaaatatttttaaat

SEQ ID NO: 271120 - DNA, 20 bp, Artificial Sequence
  Description of Artificial Sequence: Synthetic oligonucleotide
  Target: ATXN1; (+) strand; PAM type: YTN; PAM sequence: TTT
ttaaaatatttttaaatttt

SEQ ID NO: 271121 - DNA, 20 bp, Artificial Sequence
  Description of Artificial Sequence: Synthetic oligonucleotide
  Target: ATXN1; (+) strand; PAM type: YTN; PAM sequence: TTT
taaaatatttttaaatttta

SEQ ID NO: 271122 - DNA, 20 bp, Artificial Sequence
  Description of Artificial Sequence: Synthetic oligonucleotide
  Target: ATXN1; (+) strand; PAM type: YTN; PAM sequence: TTT
aaaatatttttaaattttac

SEQ ID NO: 271123 - DNA, 20 bp, Artificial Sequence
  Description of Artificial Sequence: Synthetic oligonucleotide
  Target: ATXN1; (+) strand; PAM type: YTN; PAM sequence: TTA
aaatatttttaaattttact

SEQ ID NO: 271124 - DNA, 20 bp, Artificial Sequence
  Description of Artificial Sequence: Synthetic oligonucleotide
  Target: ATXN1; (+) strand; PAM type: YTN; PAM sequence: TTT
ttaaattttactttaagttc

SEQ ID NO: 271125 - DNA, 20 bp, Artificial Sequence
  Description of Artificial Sequence: Synthetic oligonucleotide
  Target: ATXN1; (+) strand; PAM type: YTN; PAM sequence: TTT
taaattttactttaagttct

SEQ ID NO: 271126 - DNA, 20 bp, Artificial Sequence
  Description of Artificial Sequence: Synthetic oligonucleotide
  Target: ATXN1; (+) strand; PAM type: YTN; PAM sequence: TTT
aaattttactttaagttctg

SEQ ID NO: 271127 - DNA, 20 bp, Artificial Sequence
  Description of Artificial Sequence: Synthetic oligonucleotide
  Target: ATXN1; (+) strand; PAM type: YTN; PAM sequence: TTA
aattttactttaagttctgg

SEQ ID NO: 271128 - DNA, 20 bp, Artificial Sequence
  Description of Artificial Sequence: Synthetic oligonucleotide
  Target: ATXN1; (+) strand; PAM type: YTN; PAM sequence: TTT
tactttaagttctgggatac

SEQ ID NO: 271129 - DNA, 20 bp, Artificial Sequence
  Description of Artificial Sequence: Synthetic oligonucleotide
  Target: ATXN1; (+) strand; PAM type: YTN; PAM sequence: TTT
actttaagttctgggataca

SEQ ID NO: 271130 - DNA, 20 bp, Artificial Sequence
  Description of Artificial Sequence: Synthetic oligonucleotide
  Target: ATXN1; (+) strand; PAM type: YTN; PAM sequence: TTA
ctttaagttctgggatacat

SEQ ID NO: 271131 - DNA, 20 bp, Artificial Sequence
  Description of Artificial Sequence: Synthetic oligonucleotide
  Target: ATXN1; (+) strand; PAM type: YTN; PAM sequence: CTT
taagttctgggatacatgtg

SEQ ID NO: 271132 - DNA, 20 bp, Artificial Sequence
  Description of Artificial Sequence: Synthetic oligonucleotide
  Target: ATXN1; (+) strand; PAM type: YTN; PAM sequence: TTT
aagttctgggatacatgtgc

SEQ ID NO: 271133 - DNA, 20 bp, Artificial Sequence
  Description of Artificial Sequence: Synthetic oligonucleotide
  Target: ATXN1; (+) strand; PAM type: YTN; PAM sequence: TTA
agttctgggatacatgtgca

SEQ ID NO: 271134 - DNA, 20 bp, Artificial Sequence
  Description of Artificial Sequence: Synthetic oligonucleotide
  Target: ATXN1; (+) strand; PAM type: YTN; PAM sequence: TTC
tgggatacatgtgcagaaca

SEQ ID NO: 271135 - DNA, 20 bp, Artificial Sequence
  Description of Artificial Sequence: Synthetic oligonucleotide
  Target: ATXN1; (+) strand; PAM type: YTN; PAM sequence: CTG
ggatacatgtgcagaacatg

SEQ ID NO: 271136 - DNA, 20 bp, Artificial Sequence
  Description of Artificial Sequence: Synthetic oligonucleotide
  Target: ATXN1; (+) strand; PAM type: YTN; PAM sequence: TTT
gttacataggtatacatgtg

SEQ ID NO: 271137 - DNA, 20 bp, Artificial Sequence
  Description of Artificial Sequence: Synthetic oligonucleotide
  Target: ATXN1; (+) strand; PAM type: YTN; PAM sequence: TTG
ttacataggtatacatgtgc

SEQ ID NO: 271138 - DNA, 20 bp, Artificial Sequence
  Description of Artificial Sequence: Synthetic oligonucleotide
  Target: ATXN1; (+) strand; PAM type: YTN; PAM sequence: TTA
cataggtatacatgtgccat

SEQ ID NO: 271139 - DNA, 20 bp, Artificial Sequence
  Description of Artificial Sequence: Synthetic oligonucleotide
  Target: ATXN1; (+) strand; PAM type: YTN; PAM sequence: TTT
gctgcacctatcaacccatc

SEQ ID NO: 271140 - DNA, 20 bp, Artificial Sequence
  Description of Artificial Sequence: Synthetic oligonucleotide
  Target: ATXN1; (+) strand; PAM type: YTN; PAM sequence: TTG
ctgcacctatcaacccatca

SEQ ID NO: 271141 - DNA, 20 bp, Artificial Sequence
  Description of Artificial Sequence: Synthetic oligonucleotide
  Target: ATXN1; (+) strand; PAM type: YTN; PAM sequence: CTG
cacctatcaacccatcatct

SEQ ID NO: 271142 - DNA, 20 bp, Artificial Sequence
  Description of Artificial Sequence: Synthetic oligonucleotide
  Target: ATXN1; (+) strand; PAM type: YTN; PAM sequence: CTA
tcaacccatcatctaggttt

SEQ ID NO: 271143 - DNA, 20 bp, Artificial Sequence
  Description of Artificial Sequence: Synthetic oligonucleotide
  Target: ATXN1; (+) strand; PAM type: YTN; PAM sequence: CTA
ggttttaagcccctcatgca

SEQ ID NO: 271144 - DNA, 20 bp, Artificial Sequence
  Description of Artificial Sequence: Synthetic oligonucleotide
  Target: ATXN1; (+) strand; PAM type: YTN; PAM sequence: TTT
taagcccctcatgcattagg

SEQ ID NO: 271145 - DNA, 20 bp, Artificial Sequence
  Description of Artificial Sequence: Synthetic oligonucleotide
  Target: ATXN1; (+) strand; PAM type: YTN; PAM sequence: TTT
aagcccctcatgcattaggt

SEQ ID NO: 271146 - DNA, 20 bp, Artificial Sequence
  Description of Artificial Sequence: Synthetic oligonucleotide
  Target: ATXN1; (+) strand; PAM type: YTN; PAM sequence: TTA
agcccctcatgcattaggta

SEQ ID NO: 271147 - DNA, 20 bp, Artificial Sequence
  Description of Artificial Sequence: Synthetic oligonucleotide
  Target: ATXN1; (+) strand; PAM type: YTN; PAM sequence: CTC
atgcattaggtatttgtcct

SEQ ID NO: 271148 - DNA, 20 bp, Artificial Sequence
  Description of Artificial Sequence: Synthetic oligonucleotide
  Target: ATXN1; (+) strand; PAM type: YTN; PAM sequence: TTA
ggtatttgtcctaattctct

SEQ ID NO: 271149 - DNA, 20 bp, Artificial Sequence
  Description of Artificial Sequence: Synthetic oligonucleotide
  Target: ATXN1; (+) strand; PAM type: YTN; PAM sequence: TTT
gtcctaattctctccctccc

SEQ ID NO: 271150 - DNA, 20 bp, Artificial Sequence
  Description of Artificial Sequence: Synthetic oligonucleotide
  Target: ATXN1; (+) strand; PAM type: YTN; PAM sequence: TTG
tcctaattctctccctcccc

SEQ ID NO: 271151 - DNA, 20 bp, Artificial Sequence
  Description of Artificial Sequence: Synthetic oligonucleotide
  Target: ATXN1; (+) strand; PAM type: YTN; PAM sequence: CTA
attctctccctccccttgcc

SEQ ID NO: 271152 - DNA, 20 bp, Artificial Sequence
  Description of Artificial Sequence: Synthetic oligonucleotide
  Target: ATXN1; (+) strand; PAM type: YTN; PAM sequence: TTC
tctccctccccttgcccccc

SEQ ID NO: 271153 - DNA, 20 bp, Artificial Sequence
  Description of Artificial Sequence: Synthetic oligonucleotide
  Target: ATXN1; (+) strand; PAM type: YTN; PAM sequence: CTC
tccctccccttgccccccac

SEQ ID NO: 271154 - DNA, 20 bp, Artificial Sequence
  Description of Artificial Sequence: Synthetic oligonucleotide
  Target: ATXN1; (+) strand; PAM type: YTN; PAM sequence: CTC
cctccccttgccccccactc

SEQ ID NO: 271155 - DNA, 20 bp, Artificial Sequence
  Description of Artificial Sequence: Synthetic oligonucleotide
  Target: ATXN1; (+) strand; PAM type: YTN; PAM sequence: CTC
cccttgccccccactcaccg

SEQ ID NO: 271156 - DNA, 20 bp, Artificial Sequence
  Description of Artificial Sequence: Synthetic oligonucleotide
  Target: ATXN1; (+) strand; PAM type: YTN; PAM sequence: CTT
gccccccactcaccgatagg

SEQ ID NO: 271157 - DNA, 20 bp, Artificial Sequence
  Description of Artificial Sequence: Synthetic oligonucleotide
  Target: ATXN1; (+) strand; PAM type: YTN; PAM sequence: TTG
ccccccactcaccgataggc

SEQ ID NO: 271158 - DNA, 20 bp, Artificial Sequence
  Description of Artificial Sequence: Synthetic oligonucleotide
  Target: ATXN1; (+) strand; PAM type: YTN; PAM sequence: CTC
accgataggccctggtgtgt

SEQ ID NO: 271159 - DNA, 20 bp, Artificial Sequence
  Description of Artificial Sequence: Synthetic oligonucleotide
  Target: ATXN1; (+) strand; PAM type: YTN; PAM sequence: CTG
gtgtgtgatgttcccctccc

SEQ ID NO: 271160 - DNA, 20 bp, Artificial Sequence
  Description of Artificial Sequence: Synthetic oligonucleotide
  Target: ATXN1; (+) strand; PAM type: YTN; PAM sequence: TTC
ccctccctgtgtccatgtgt

SEQ ID NO: 271161 - DNA, 20 bp, Artificial Sequence
  Description of Artificial Sequence: Synthetic oligonucleotide
  Target: ATXN1; (+) strand; PAM type: YTN; PAM sequence: CTC
cctgtgtccatgtgttctca

SEQ ID NO: 271162 - DNA, 20 bp, Artificial Sequence
  Description of Artificial Sequence: Synthetic oligonucleotide
  Target: ATXN1; (+) strand; PAM type: YTN; PAM sequence: CTG
tgtccatgtgttctcattat

SEQ ID NO: 271163 - DNA, 20 bp, Artificial Sequence
  Description of Artificial Sequence: Synthetic oligonucleotide
  Target: ATXN1; (+) strand; PAM type: YTN; PAM sequence: TTC
tcattattcaactcctacta

SEQ ID NO: 271164 - DNA, 20 bp, Artificial Sequence
  Description of Artificial Sequence: Synthetic oligonucleotide
  Target: ATXN1; (+) strand; PAM type: YTN; PAM sequence: CTC
attattcaactcctactatg

SEQ ID NO: 271165 - DNA, 20 bp, Artificial Sequence
  Description of Artificial Sequence: Synthetic oligonucleotide
  Target: ATXN1; (+) strand; PAM type: YTN; PAM sequence: TTA
ttcaactcctactatgagtg

SEQ ID NO: 271166 - DNA, 20 bp, Artificial Sequence
  Description of Artificial Sequence: Synthetic oligonucleotide
  Target: ATXN1; (+) strand; PAM type: YTN; PAM sequence: TTC
aactcctactatgagtgaga

SEQ ID NO: 271167 - DNA, 20 bp, Artificial Sequence
  Description of Artificial Sequence: Synthetic oligonucleotide
  Target: ATXN1; (+) strand; PAM type: YTN; PAM sequence: CTC
ctactatgagtgagaacatg

SEQ ID NO: 271168 - DNA, 20 bp, Artificial Sequence
  Description of Artificial Sequence: Synthetic oligonucleotide
  Target: ATXN1; (+) strand; PAM type: YTN; PAM sequence: CTA
ctatgagtgagaacatgcgg

SEQ ID NO: 271169 - DNA, 20 bp, Artificial Sequence
  Description of Artificial Sequence: Synthetic oligonucleotide
  Target: ATXN1; (+) strand; PAM type: YTN; PAM sequence: CTA
tgagtgagaacatgcggtgt

SEQ ID NO: 271170 - DNA, 20 bp, Artificial Sequence
  Description of Artificial Sequence: Synthetic oligonucleotide
  Target: ATXN1; (+) strand; PAM type: YTN; PAM sequence: TTT
ggttttctgttcctgtgtta

SEQ ID NO: 271171 - DNA, 20 bp, Artificial Sequence
  Description of Artificial Sequence: Synthetic oligonucleotide
  Target: ATXN1; (+) strand; PAM type: YTN; PAM sequence: TTG
gttttctgttcctgtgttag

SEQ ID NO: 271172 - DNA, 20 bp, Artificial Sequence
  Description of Artificial Sequence: Synthetic oligonucleotide
  Target: ATXN1; (+) strand; PAM type: YTN; PAM sequence: TTT
tctgttcctgtgttagtttg

SEQ ID NO: 271173 - DNA, 20 bp, Artificial Sequence
  Description of Artificial Sequence: Synthetic oligonucleotide
  Target: ATXN1; (+) strand; PAM type: YTN; PAM sequence: TTT
ctgttcctgtgttagtttgc

SEQ ID NO: 271174 - DNA, 20 bp, Artificial Sequence
  Description of Artificial Sequence: Synthetic oligonucleotide
  Target: ATXN1; (+) strand; PAM type: YTN; PAM sequence: TTC
tgttcctgtgttagtttgct

SEQ ID NO: 271175 - DNA, 20 bp, Artificial Sequence
  Description of Artificial Sequence: Synthetic oligonucleotide
  Target: ATXN1; (+) strand; PAM type: YTN; PAM sequence: CTG
ttcctgtgttagtttgctga

SEQ ID NO: 271176 - DNA, 20 bp, Artificial Sequence
  Description of Artificial Sequence: Synthetic oligonucleotide
  Target: ATXN1; (+) strand; PAM type: YTN; PAM sequence: TTC
ctgtgttagtttgctgagaa

SEQ ID NO: 271177 - DNA, 20 bp, Artificial Sequence
  Description of Artificial Sequence: Synthetic oligonucleotide
  Target: ATXN1; (+) strand; PAM type: YTN; PAM sequence: CTG
tgttagtttgctgagaatga

SEQ ID NO: 271178 - DNA, 20 bp, Artificial Sequence
  Description of Artificial Sequence: Synthetic oligonucleotide
  Target: ATXN1; (+) strand; PAM type: YTN; PAM sequence: TTA
gtttgctgagaatgaggctt

SEQ ID NO: 271179 - DNA, 20 bp, Artificial Sequence
  Description of Artificial Sequence: Synthetic oligonucleotide
  Target: ATXN1; (+) strand; PAM type: YTN; PAM sequence: TTT
gctgagaatgaggcttccag

SEQ ID NO: 271180 - DNA, 20 bp, Artificial Sequence
  Description of Artificial Sequence: Synthetic oligonucleotide
  Target: ATXN1; (+) strand; PAM type: YTN; PAM sequence: TTG
ctgagaatgaggcttccagc

SEQ ID NO: 271181 - DNA, 20 bp, Artificial Sequence
  Description of Artificial Sequence: Synthetic oligonucleotide
  Target: ATXN1; (+) strand; PAM type: YTN; PAM sequence: CTG
agaatgaggcttccagcttc

SEQ ID NO: 271182 - DNA, 20 bp, Artificial Sequence
  Description of Artificial Sequence: Synthetic oligonucleotide
  Target: ATXN1; (+) strand; PAM type: YTN; PAM sequence: CTT
ccagcttcatccatgtccct

SEQ ID NO: 271183 - DNA, 20 bp, Artificial Sequence
  Description of Artificial Sequence: Synthetic oligonucleotide
  Target: ATXN1; (+) strand; PAM type: YTN; PAM sequence: TTC
cagcttcatccatgtccctg

SEQ ID NO: 271184 - DNA, 20 bp, Artificial Sequence
  Description of Artificial Sequence: Synthetic oligonucleotide
  Target: ATXN1; (+) strand; PAM type: YTN; PAM sequence: CTT
catccatgtccctgtaaagg

SEQ ID NO: 271185 - DNA, 20 bp, Artificial Sequence
  Description of Artificial Sequence: Synthetic oligonucleotide
  Target: ATXN1; (+) strand; PAM type: YTN; PAM sequence: TTC
atccatgtccctgtaaagga

SEQ ID NO: 271186 - DNA, 20 bp, Artificial Sequence
  Description of Artificial Sequence: Synthetic oligonucleotide
  Target: ATXN1; (+) strand; PAM type: YTN; PAM sequence: CTG
taaaggacatgagctcattc

SEQ ID NO: 271187 - DNA, 20 bp, Artificial Sequence
  Description of Artificial Sequence: Synthetic oligonucleotide
  Target: ATXN1; (+) strand; PAM type: YTN; PAM sequence: CTC
attcttttttatggctgcat

SEQ ID NO: 271188 - DNA, 20 bp, Artificial Sequence
  Description of Artificial Sequence: Synthetic oligonucleotide
  Target: ATXN1; (+) strand; PAM type: YTN; PAM sequence: TTC
ttttttatggctgcatagta

SEQ ID NO: 271189 - DNA, 20 bp, Artificial Sequence
  Description of Artificial Sequence: Synthetic oligonucleotide
  Target: ATXN1; (+) strand; PAM type: YTN; PAM sequence: CTT
ttttatggctgcatagtatt

SEQ ID NO: 271190 - DNA, 20 bp, Artificial Sequence
  Description of Artificial Sequence: Synthetic oligonucleotide
  Target: ATXN1; (+) strand; PAM type: YTN; PAM sequence: TTT
tttatggctgcatagtattc

SEQ ID NO: 271191 - DNA, 20 bp, Artificial Sequence
  Description of Artificial Sequence: Synthetic oligonucleotide
  Target: ATXN1; (+) strand; PAM type: YTN; PAM sequence: TTT
ttatggctgcatagtattcc

SEQ ID NO: 271192 - DNA, 20 bp, Artificial Sequence
  Description of Artificial Sequence: Synthetic oligonucleotide
  Target: ATXN1; (+) strand; PAM type: YTN; PAM sequence: TTT
tatggctgcatagtattcca

SEQ ID NO: 271193 - DNA, 20 bp, Artificial Sequence
  Description of Artificial Sequence: Synthetic oligonucleotide
  Target: ATXN1; (+) strand; PAM type: YTN; PAM sequence: TTT
atggctgcatagtattccat

SEQ ID NO: 271194 - DNA, 20 bp, Artificial Sequence
  Description of Artificial Sequence: Synthetic oligonucleotide
  Target: ATXN1; (+) strand; PAM type: YTN; PAM sequence: TTA
tggctgcatagtattccatg

SEQ ID NO: 271195 - DNA, 20 bp, Artificial Sequence
  Description of Artificial Sequence: Synthetic oligonucleotide
  Target: ATXN1; (+) strand; PAM type: YTN; PAM sequence: CTG
catagtattccatggtgtat

SEQ ID NO: 271196 - DNA, 20 bp, Artificial Sequence
  Description of Artificial Sequence: Synthetic oligonucleotide
  Target: ATXN1; (+) strand; PAM type: YTN; PAM sequence: TTC
catggtgtatatttaccaca

SEQ ID NO: 271197 - DNA, 20 bp, Artificial Sequence
  Description of Artificial Sequence: Synthetic oligonucleotide
  Target: ATXN1; (+) strand; PAM type: YTN; PAM sequence: TTT
accacattttctttatccag

SEQ ID NO: 271198 - DNA, 20 bp, Artificial Sequence
  Description of Artificial Sequence: Synthetic oligonucleotide
  Target: ATXN1; (+) strand; PAM type: YTN; PAM sequence: TTA
ccacattttctttatccagt

SEQ ID NO: 271199 - DNA, 20 bp, Artificial Sequence
  Description of Artificial Sequence: Synthetic oligonucleotide
  Target: ATXN1; (+) strand; PAM type: YTN; PAM sequence: TTT
tctttatccagtctatcatt

SEQ ID NO: 271200 - DNA, 20 bp, Artificial Sequence
  Description of Artificial Sequence: Synthetic oligonucleotide
  Target: ATXN1; (+) strand; PAM type: YTN; PAM sequence: TTT
ctttatccagtctatcattg

SEQ ID NO: 271201 - DNA, 20 bp, Artificial Sequence
  Description of Artificial Sequence: Synthetic oligonucleotide
  Target: ATXN1; (+) strand; PAM type: YTN; PAM sequence: TTC
tttatccagtctatcattga

SEQ ID NO: 271202 - DNA, 20 bp, Artificial Sequence
  Description of Artificial Sequence: Synthetic oligonucleotide
  Target: ATXN1; (+) strand; PAM type: YTN; PAM sequence: CTT
tatccagtctatcattgatg

SEQ ID NO: 271203 - DNA, 20 bp, Artificial Sequence
  Description of Artificial Sequence: Synthetic oligonucleotide
  Target: ATXN1; (+) strand; PAM type: YTN; PAM sequence: TTT
atccagtctatcattgatgg

SEQ ID NO: 271204 - DNA, 20 bp, Artificial Sequence
  Description of Artificial Sequence: Synthetic oligonucleotide
  Target: ATXN1; (+) strand; PAM type: YTN; PAM sequence: TTA
tccagtctatcattgatggg

SEQ ID NO: 271205 - DNA, 20 bp, Artificial Sequence
  Description of Artificial Sequence: Synthetic oligonucleotide
  Target: ATXN1; (+) strand; PAM type: YTN; PAM sequence: CTA
tcattgatgggcatttgggt

SEQ ID NO: 271206 - DNA, 20 bp, Artificial Sequence
  Description of Artificial Sequence: Synthetic oligonucleotide
  Target: ATXN1; (+) strand; PAM type: YTN; PAM sequence: TTG
atgggcatttgggttggttt

SEQ ID NO: 271207 - DNA, 20 bp, Artificial Sequence
  Description of Artificial Sequence: Synthetic oligonucleotide
  Target: ATXN1; (+) strand; PAM type: YTN; PAM sequence: TTT
gggttggtttccagtcttta

SEQ ID NO: 271208 - DNA, 20 bp, Artificial Sequence
  Description of Artificial Sequence: Synthetic oligonucleotide
  Target: ATXN1; (+) strand; PAM type: YTN; PAM sequence: TTG
ggttggtttccagtctttac

SEQ ID NO: 271209 - DNA, 20 bp, Artificial Sequence
  Description of Artificial Sequence: Synthetic oligonucleotide
  Target: ATXN1; (+) strand; PAM type: YTN; PAM sequence: TTG
gtttccagtctttactattg

SEQ ID NO: 271210 - DNA, 20 bp, Artificial Sequence
  Description of Artificial Sequence: Synthetic oligonucleotide
  Target: ATXN1; (+) strand; PAM type: YTN; PAM sequence: TTT
ccagtctttactattgtaaa

SEQ ID NO: 271211 - DNA, 20 bp, Artificial Sequence
  Description of Artificial Sequence: Synthetic oligonucleotide
  Target: ATXN1; (+) strand; PAM type: YTN; PAM sequence: TTC
cagtctttactattgtaaat

SEQ ID NO: 271212 - DNA, 20 bp, Artificial Sequence
  Description of Artificial Sequence: Synthetic oligonucleotide
  Target: ATXN1; (+) strand; PAM type: YTN; PAM sequence: CTT
tactattgtaaatactgctg

SEQ ID NO: 271213 - DNA, 20 bp, Artificial Sequence
  Description of Artificial Sequence: Synthetic oligonucleotide
  Target: ATXN1; (+) strand; PAM type: YTN; PAM sequence: TTT
actattgtaaatactgctgc

SEQ ID NO: 271214 - DNA, 20 bp, Artificial Sequence
  Description of Artificial Sequence: Synthetic oligonucleotide
  Target: ATXN1; (+) strand; PAM type: YTN; PAM sequence: TTA
ctattgtaaatactgctgca

SEQ ID NO: 271215 - DNA, 20 bp, Artificial Sequence
  Description of Artificial Sequence: Synthetic oligonucleotide
  Target: ATXN1; (+) strand; PAM type: YTN; PAM sequence: CTA
ttgtaaatactgctgcagta

SEQ ID NO: 271216 - DNA, 20 bp, Artificial Sequence
  Description of Artificial Sequence: Synthetic oligonucleotide
  Target: ATXN1; (+) strand; PAM type: YTN; PAM sequence: TTG
taaatactgctgcagtaaac

SEQ ID NO: 271217 - DNA, 20 bp, Artificial Sequence
  Description of Artificial Sequence: Synthetic oligonucleotide
  Target: ATXN1; (+) strand; PAM type: YTN; PAM sequence: CTG
ctgcagtaaacatatgtgtg

SEQ ID NO: 271218 - DNA, 20 bp, Artificial Sequence
  Description of Artificial Sequence: Synthetic oligonucleotide
  Target: ATXN1; (+) strand; PAM type: YTN; PAM sequence: CTG
cagtaaacatatgtgtgcat

SEQ ID NO: 271219 - DNA, 20 bp, Artificial Sequence
  Description of Artificial Sequence: Synthetic oligonucleotide
  Target: ATXN1; (+) strand; PAM type: YTN; PAM sequence: CTT
tataacagaatgatttataa

SEQ ID NO: 271220 - DNA, 20 bp, Artificial Sequence
  Description of Artificial Sequence: Synthetic oligonucleotide
  Target: ATXN1; (+) strand; PAM type: YTN; PAM sequence: TTT
ataacagaatgatttataat

SEQ ID NO: 271221 - DNA, 20 bp, Artificial Sequence
  Description of Artificial Sequence: Synthetic oligonucleotide
  Target: ATXN1; (+) strand; PAM type: YTN; PAM sequence: TTA
taacagaatgatttataatc

SEQ ID NO: 271222 - DNA, 20 bp, Artificial Sequence
  Description of Artificial Sequence: Synthetic oligonucleotide
  Target: ATXN1; (+) strand; PAM type: YTN; PAM sequence: TTT
ataatcctttgggtatataa

SEQ ID NO: 271223 - DNA, 20 bp, Artificial Sequence
  Description of Artificial Sequence: Synthetic oligonucleotide
  Target: ATXN1; (+) strand; PAM type: YTN; PAM sequence: TTA
taatcctttgggtatataac

SEQ ID NO: 271224 - DNA, 20 bp, Artificial Sequence
  Description of Artificial Sequence: Synthetic oligonucleotide
  Target: ATXN1; (+) strand; PAM type: YTN; PAM sequence: CTT
tgggtatataaccagtaacg

SEQ ID NO: 271225 - DNA, 20 bp, Artificial Sequence
  Description of Artificial Sequence: Synthetic oligonucleotide
  Target: ATXN1; (+) strand; PAM type: YTN; PAM sequence: TTT
gggtatataaccagtaacgg

SEQ ID NO: 271226 - DNA, 20 bp, Artificial Sequence
  Description of Artificial Sequence: Synthetic oligonucleotide
  Target: ATXN1; (+) strand; PAM type: YTN; PAM sequence: TTG
ggtatataaccagtaacggg

SEQ ID NO: 271227 - DNA, 20 bp, Artificial Sequence
  Description of Artificial Sequence: Synthetic oligonucleotide
  Target: ATXN1; (+) strand; PAM type: YTN; PAM sequence: TTG
ctgggtcaaatggtatttct

SEQ ID NO: 271228 - DNA, 20 bp, Artificial Sequence
  Description of Artificial Sequence: Synthetic oligonucleotide
  Target: ATXN1; (+) strand; PAM type: YTN; PAM sequence: CTG
ggtcaaatggtatttctggt

SEQ ID NO: 271229 - DNA, 20 bp, Artificial Sequence
  Description of Artificial Sequence: Synthetic oligonucleotide
  Target: ATXN1; (+) strand; PAM type: YTN; PAM sequence: TTT
ctggttctagatccttgagg

SEQ ID NO: 271230 - DNA, 20 bp, Artificial Sequence
  Description of Artificial Sequence: Synthetic oligonucleotide
  Target: ATXN1; (+) strand; PAM type: YTN; PAM sequence: TTC
tggttctagatccttgagga

SEQ ID NO: 271231 - DNA, 20 bp, Artificial Sequence
  Description of Artificial Sequence: Synthetic oligonucleotide
  Target: ATXN1; (+) strand; PAM type: YTN; PAM sequence: CTG
gttctagatccttgaggaat

SEQ ID NO: 271232 - DNA, 20 bp, Artificial Sequence
  Description of Artificial Sequence: Synthetic oligonucleotide
  Target: ATXN1; (+) strand; PAM type: YTN; PAM sequence: TTC
tagatccttgaggaatcgcc

SEQ ID NO: 271233 - DNA, 20 bp, Artificial Sequence
  Description of Artificial Sequence: Synthetic oligonucleotide
  Target: ATXN1; (+) strand; PAM type: YTN; PAM sequence: CTA
gatccttgaggaatcgccac

SEQ ID NO: 271234 - DNA, 20 bp, Artificial Sequence
  Description of Artificial Sequence: Synthetic oligonucleotide
  Target: ATXN1; (+) strand; PAM type: YTN; PAM sequence: CTT
gaggaatcgccacactgtct

SEQ ID NO: 271235 - DNA, 20 bp, Artificial Sequence
  Description of Artificial Sequence: Synthetic oligonucleotide
  Target: ATXN1; (+) strand; PAM type: YTN; PAM sequence: TTG
aggaatcgccacactgtctt

SEQ ID NO: 271236 - DNA, 20 bp, Artificial Sequence
  Description of Artificial Sequence: Synthetic oligonucleotide
  Target: ATXN1; (+) strand; PAM type: YTN; PAM sequence: CTG
tcttccacaatggttgaact

SEQ ID NO: 271237 - DNA, 20 bp, Artificial Sequence
  Description of Artificial Sequence: Synthetic oligonucleotide
  Target: ATXN1; (+) strand; PAM type: YTN; PAM sequence: CTT
ccacaatggttgaactaatt

SEQ ID NO: 271238 - DNA, 20 bp, Artificial Sequence
  Description of Artificial Sequence: Synthetic oligonucleotide
  Target: ATXN1; (+) strand; PAM type: YTN; PAM sequence: TTC
cacaatggttgaactaattt

SEQ ID NO: 271239 - DNA, 20 bp, Artificial Sequence
  Description of Artificial Sequence: Synthetic oligonucleotide
  Target: ATXN1; (+) strand; PAM type: YTN; PAM sequence: TTG
aactaatttacagtccccca

SEQ ID NO: 271240 - DNA, 20 bp, Artificial Sequence
  Description of Artificial Sequence: Synthetic oligonucleotide
  Target: ATXN1; (+) strand; PAM type: YTN; PAM sequence: CTA
atttacagtcccccaacagc

SEQ ID NO: 271241 - DNA, 20 bp, Artificial Sequence
  Description of Artificial Sequence: Synthetic oligonucleotide
  Target: ATXN1; (+) strand; PAM type: YTN; PAM sequence: TTT
acagtcccccaacagcataa

SEQ ID NO: 271242 - DNA, 20 bp, Artificial Sequence
  Description of Artificial Sequence: Synthetic oligonucleotide
  Target: ATXN1; (+) strand; PAM type: YTN; PAM sequence: TTA
cagtcccccaacagcataaa

SEQ ID NO: 271243 - DNA, 20 bp, Artificial Sequence
  Description of Artificial Sequence: Synthetic oligonucleotide
  Target: ATXN1; (+) strand; PAM type: YTN; PAM sequence: TTC
ctatttctccacagcctcgc

SEQ ID NO: 271244 - DNA, 20 bp, Artificial Sequence
  Description of Artificial Sequence: Synthetic oligonucleotide
  Target: ATXN1; (+) strand; PAM type: YTN; PAM sequence: CTA
tttctccacagcctcgccag

SEQ ID NO: 271245 - DNA, 20 bp, Artificial Sequence
  Description of Artificial Sequence: Synthetic oligonucleotide
  Target: ATXN1; (+) strand; PAM type: YTN; PAM sequence: TTT
ctccacagcctcgccagcat

SEQ ID NO: 271246 - DNA, 20 bp, Artificial Sequence
  Description of Artificial Sequence: Synthetic oligonucleotide
  Target: ATXN1; (+) strand; PAM type: YTN; PAM sequence: TTC
tccacagcctcgccagcatc

SEQ ID NO: 271247 - DNA, 20 bp, Artificial Sequence
  Description of Artificial Sequence: Synthetic oligonucleotide
  Target: ATXN1; (+) strand; PAM type: YTN; PAM sequence: CTC
cacagcctcgccagcatcta

SEQ ID NO: 271248 - DNA, 20 bp, Artificial Sequence
  Description of Artificial Sequence: Synthetic oligonucleotide
  Target: ATXN1; (+) strand; PAM type: YTN; PAM sequence: CTC
gccagcatctattaggaaac

SEQ ID NO: 271249 - DNA, 20 bp, Artificial Sequence
  Description of Artificial Sequence: Synthetic oligonucleotide
  Target: ATXN1; (+) strand; PAM type: YTN; PAM sequence: CTA
ttaggaaactggaagaattc

SEQ ID NO: 271250 - DNA, 20 bp, Artificial Sequence
  Description of Artificial Sequence: Synthetic oligonucleotide
  Target: ATXN1; (+) strand; PAM type: YTN; PAM sequence: TTA
ggaaactggaagaattctat

SEQ ID NO: 271251 - DNA, 20 bp, Artificial Sequence
  Description of Artificial Sequence: Synthetic oligonucleotide
  Target: ATXN1; (+) strand; PAM type: YTN; PAM sequence: CTG
gaagaattctatacaataga

SEQ ID NO: 271252 - DNA, 20 bp, Artificial Sequence
  Description of Artificial Sequence: Synthetic oligonucleotide
  Target: ATXN1; (+) strand; PAM type: YTN; PAM sequence: TTC
tatacaatagatttaggagc

SEQ ID NO: 271253 - DNA, 20 bp, Artificial Sequence
  Description of Artificial Sequence: Synthetic oligonucleotide
  Target: ATXN1; (+) strand; PAM type: YTN; PAM sequence: CTA
tacaatagatttaggagctg

SEQ ID NO: 271254 - DNA, 20 bp, Artificial Sequence
  Description of Artificial Sequence: Synthetic oligonucleotide
  Target: ATXN1; (+) strand; PAM type: YTN; PAM sequence: TTT
aggagctgcaaaggagtaag

SEQ ID NO: 271255 - DNA, 20 bp, Artificial Sequence
  Description of Artificial Sequence: Synthetic oligonucleotide
  Target: ATXN1; (+) strand; PAM type: YTN; PAM sequence: TTA
ggagctgcaaaggagtaagg

SEQ ID NO: 271256 - DNA, 20 bp, Artificial Sequence
  Description of Artificial Sequence: Synthetic oligonucleotide
  Target: ATXN1; (+) strand; PAM type: YTN; PAM sequence: CTG
caaaggagtaaggatttgct

SEQ ID NO: 271257 - DNA, 20 bp, Artificial Sequence
  Description of Artificial Sequence: Synthetic oligonucleotide
  Target: ATXN1; (+) strand; PAM type: YTN; PAM sequence: TTT
gctgaagattttcttaggca

SEQ ID NO: 271258 - DNA, 20 bp, Artificial Sequence
  Description of Artificial Sequence: Synthetic oligonucleotide
  Target: ATXN1; (+) strand; PAM type: YTN; PAM sequence: TTG
ctgaagattttcttaggcaa

SEQ ID NO: 271259 - DNA, 20 bp, Artificial Sequence
  Description of Artificial Sequence: Synthetic oligonucleotide
  Target: ATXN1; (+) strand; PAM type: YTN; PAM sequence: CTG
aagattttcttaggcaagta

SEQ ID NO: 271260 - DNA, 20 bp, Artificial Sequence
  Description of Artificial Sequence: Synthetic oligonucleotide
  Target: ATXN1; (+) strand; PAM type: YTN; PAM sequence: TTT
tcttaggcaagtattagaag

SEQ ID NO: 271261 - DNA, 20 bp, Artificial Sequence
  Description of Artificial Sequence: Synthetic oligonucleotide
  Target: ATXN1; (+) strand; PAM type: YTN; PAM sequence: TTT
cttaggcaagtattagaagt

SEQ ID NO: 271262 - DNA, 20 bp, Artificial Sequence
  Description of Artificial Sequence: Synthetic oligonucleotide
  Target: ATXN1; (+) strand; PAM type: YTN; PAM sequence: TTC
ttaggcaagtattagaagtt

SEQ ID NO: 271263 - DNA, 20 bp, Artificial Sequence
  Description of Artificial Sequence: Synthetic oligonucleotide
  Target: ATXN1; (+) strand; PAM type: YTN; PAM sequence: CTT
aggcaagtattagaagttgg

SEQ ID NO: 271264 - DNA, 20 bp, Artificial Sequence
  Description of Artificial Sequence: Synthetic oligonucleotide
  Target: ATXN1; (+) strand; PAM type: YTN; PAM sequence: TTA
ggcaagtattagaagttggt

SEQ ID NO: 271265 - DNA, 20 bp, Artificial Sequence
  Description of Artificial Sequence: Synthetic oligonucleotide
  Target: ATXN1; (+) strand; PAM type: YTN; PAM sequence: TTA
gaagttggttagatgagaaa

SEQ ID NO: 271266 - DNA, 20 bp, Artificial Sequence
  Description of Artificial Sequence: Synthetic oligonucleotide
  Target: ATXN1; (+) strand; PAM type: YTN; PAM sequence: TTG
gttagatgagaaaagttttc

SEQ ID NO: 271267 - DNA, 20 bp, Artificial Sequence
  Description of Artificial Sequence: Synthetic oligonucleotide
  Target: ATXN1; (+) strand; PAM type: YTN; PAM sequence: TTA
gatgagaaaagttttcacaa

SEQ ID NO: 271268 - DNA, 20 bp, Artificial Sequence
  Description of Artificial Sequence: Synthetic oligonucleotide
  Target: ATXN1; (+) strand; PAM type: YTN; PAM sequence: TTT
tcacaagtgggagttgtacc

SEQ ID NO: 271269 - DNA, 20 bp, Artificial Sequence
  Description of Artificial Sequence: Synthetic oligonucleotide
  Target: ATXN1; (+) strand; PAM type: YTN; PAM sequence: TTT
cacaagtgggagttgtacct

SEQ ID NO: 271270 - DNA, 20 bp, Artificial Sequence
  Description of Artificial Sequence: Synthetic oligonucleotide
  Target: ATXN1; (+) strand; PAM type: YTN; PAM sequence: TTC
acaagtgggagttgtacctc

SEQ ID NO: 271271 - DNA, 20 bp, Artificial Sequence
  Description of Artificial Sequence: Synthetic oligonucleotide
  Target: ATXN1; (+) strand; PAM type: YTN; PAM sequence: TTG
tacctccttgtctcctaatt

SEQ ID NO: 271272 - DNA, 20 bp, Artificial Sequence
  Description of Artificial Sequence: Synthetic oligonucleotide
  Target: ATXN1; (+) strand; PAM type: YTN; PAM sequence: CTC
cttgtctcctaattgtagtg

SEQ ID NO: 271273 - DNA, 20 bp, Artificial Sequence
  Description of Artificial Sequence: Synthetic oligonucleotide
  Target: ATXN1; (+) strand; PAM type: YTN; PAM sequence: CTT
gtctcctaattgtagtgaat

SEQ ID NO: 271274 - DNA, 20 bp, Artificial Sequence
  Description of Artificial Sequence: Synthetic oligonucleotide
  Target: ATXN1; (+) strand; PAM type: YTN; PAM sequence: TTG
tctcctaattgtagtgaatc

SEQ ID NO: 271275 - DNA, 20 bp, Artificial Sequence
  Description of Artificial Sequence: Synthetic oligonucleotide
  Target: ATXN1; (+) strand; PAM type: YTN; PAM sequence: CTC
ctaattgtagtgaatctgtc

SEQ ID NO: 271276 - DNA, 20 bp, Artificial Sequence
  Description of Artificial Sequence: Synthetic oligonucleotide
  Target: ATXN1; (+) strand; PAM type: YTN; PAM sequence: CTA
attgtagtgaatctgtcaac

SEQ ID NO: 271277 - DNA, 20 bp, Artificial Sequence
  Description of Artificial Sequence: Synthetic oligonucleotide
  Target: ATXN1; (+) strand; PAM type: YTN; PAM sequence: TTG
tagtgaatctgtcaactttc

SEQ ID NO: 271278 - DNA, 20 bp, Artificial Sequence
  Description of Artificial Sequence: Synthetic oligonucleotide
  Target: ATXN1; (+) strand; PAM type: YTN; PAM sequence: CTG
tcaactttcttttcagtgta

SEQ ID NO: 271279 - DNA, 20 bp, Artificial Sequence
  Description of Artificial Sequence: Synthetic oligonucleotide
  Target: ATXN1; (+) strand; PAM type: YTN; PAM sequence: CTT
tcttttcagtgtatcaagac

SEQ ID NO: 271280 - DNA, 20 bp, Artificial Sequence
  Description of Artificial Sequence: Synthetic oligonucleotide
  Target: ATXN1; (+) strand; PAM type: YTN; PAM sequence: TTT
cttttcagtgtatcaagact

SEQ ID NO: 271281 - DNA, 20 bp, Artificial Sequence
  Description of Artificial Sequence: Synthetic oligonucleotide
  Target: ATXN1; (+) strand; PAM type: YTN; PAM sequence: TTC
ttttcagtgtatcaagactt

SEQ ID NO: 271282 - DNA, 20 bp, Artificial Sequence
  Description of Artificial Sequence: Synthetic oligonucleotide
  Target: ATXN1; (+) strand; PAM type: YTN; PAM sequence: CTT
ttcagtgtatcaagacttta

SEQ ID NO: 271283 - DNA, 20 bp, Artificial Sequence
  Description of Artificial Sequence: Synthetic oligonucleotide
  Target: ATXN1; (+) strand; PAM type: YTN; PAM sequence: TTT
tcagtgtatcaagactttac

SEQ ID NO: 271284 - DNA, 20 bp, Artificial Sequence
  Description of Artificial Sequence: Synthetic oligonucleotide
  Target: ATXN1; (+) strand; PAM type: YTN; PAM sequence: TTT
cagtgtatcaagactttact

SEQ ID NO: 271285 - DNA, 20 bp, Artificial Sequence
  Description of Artificial Sequence: Synthetic oligonucleotide
  Target: ATXN1; (+) strand; PAM type: YTN; PAM sequence: TTC
agtgtatcaagactttactc

SEQ ID NO: 271286 - DNA, 20 bp, Artificial Sequence
  Description of Artificial Sequence: Synthetic oligonucleotide
  Target: ATXN1; (+) strand; PAM type: YTN; PAM sequence: CTT
tactcttcaaaatcattctc

SEQ ID NO: 271287 - DNA, 20 bp, Artificial Sequence
  Description of Artificial Sequence: Synthetic oligonucleotide
  Target: ATXN1; (+) strand; PAM type: YTN; PAM sequence: TTT
actcttcaaaatcattctca

SEQ ID NO: 271288 - DNA, 20 bp, Artificial Sequence
  Description of Artificial Sequence: Synthetic oligonucleotide
  Target: ATXN1; (+) strand; PAM type: YTN; PAM sequence: TTA
ctcttcaaaatcattctcag

SEQ ID NO: 271289 - DNA, 20 bp, Artificial Sequence
  Description of Artificial Sequence: Synthetic oligonucleotide
  Target: ATXN1; (+) strand; PAM type: YTN; PAM sequence: CTC
ttcaaaatcattctcagtat

SEQ ID NO: 271290 - DNA, 20 bp, Artificial Sequence
  Description of Artificial Sequence: Synthetic oligonucleotide
  Target: ATXN1; (+) strand; PAM type: YTN; PAM sequence: CTT
caaaatcattctcagtatgc

SEQ ID NO: 271291 - DNA, 20 bp, Artificial Sequence
  Description of Artificial Sequence: Synthetic oligonucleotide
  Target: ATXN1; (+) strand; PAM type: YTN; PAM sequence: TTC
aaaatcattctcagtatgct

SEQ ID NO: 271292 - DNA, 20 bp, Artificial Sequence
  Description of Artificial Sequence: Synthetic oligonucleotide
  Target: ATXN1; (+) strand; PAM type: YTN; PAM sequence: TTC
tcagtatgctctgaattgct

SEQ ID NO: 271293 - DNA, 20 bp, Artificial Sequence
  Description of Artificial Sequence: Synthetic oligonucleotide
  Target: ATXN1; (+) strand; PAM type: YTN; PAM sequence: CTC
agtatgctctgaattgctat

SEQ ID NO: 271294 - DNA, 20 bp, Artificial Sequence
  Description of Artificial Sequence: Synthetic oligonucleotide
  Target: ATXN1; (+) strand; PAM type: YTN; PAM sequence: CTC
tgaattgctatacttttaag

SEQ ID NO: 271295 - DNA, 20 bp, Artificial Sequence
  Description of Artificial Sequence: Synthetic oligonucleotide
  Target: ATXN1; (+) strand; PAM type: YTN; PAM sequence: CTG
aattgctatacttttaagtt

SEQ ID NO: 271296 - DNA, 20 bp, Artificial Sequence
  Description of Artificial Sequence: Synthetic oligonucleotide
  Target: ATXN1; (+) strand; PAM type: YTN; PAM sequence: TTG
ctatacttttaagttaacta

SEQ ID NO: 271297 - DNA, 20 bp, Artificial Sequence
  Description of Artificial Sequence: Synthetic oligonucleotide
  Target: ATXN1; (+) strand; PAM type: YTN; PAM sequence: CTA
tacttttaagttaactactt

SEQ ID NO: 271298 - DNA, 20 bp, Artificial Sequence
  Description of Artificial Sequence: Synthetic oligonucleotide
  Target: ATXN1; (+) strand; PAM type: YTN; PAM sequence: CTT
ttaagttaactacttctcaa

SEQ ID NO: 271299 - DNA, 20 bp, Artificial Sequence
  Description of Artificial Sequence: Synthetic oligonucleotide
  Target: ATXN1; (+) strand; PAM type: YTN; PAM sequence: TTT
taagttaactacttctcaaa

SEQ ID NO: 271300 - DNA, 20 bp, Artificial Sequence
  Description of Artificial Sequence: Synthetic oligonucleotide
  Target: ATXN1; (+) strand; PAM type: YTN; PAM sequence: TTT
aagttaactacttctcaaag

SEQ ID NO: 271301 - DNA, 20 bp, Artificial Sequence
  Description of Artificial Sequence: Synthetic oligonucleotide
  Target: ATXN1; (+) strand; PAM type: YTN; PAM sequence: TTA
agttaactacttctcaaagt

SEQ ID NO: 271302 - DNA, 20 bp, Artificial Sequence
  Description of Artificial Sequence: Synthetic oligonucleotide
  Target: ATXN1; (+) strand; PAM type: YTN; PAM sequence: TTA
actacttctcaaagtgctgt

SEQ ID NO: 271303 - DNA, 20 bp, Artificial Sequence
  Description of Artificial Sequence: Synthetic oligonucleotide
  Target: ATXN1; (+) strand; PAM type: YTN; PAM sequence: CTA
cttctcaaagtgctgtttaa

SEQ ID NO: 271304 - DNA, 20 bp, Artificial Sequence
  Description of Artificial Sequence: Synthetic oligonucleotide
  Target: ATXN1; (+) strand; PAM type: YTN; PAM sequence: CTT
ctcaaagtgctgtttaaaaa

SEQ ID NO: 271305 - DNA, 20 bp, Artificial Sequence
  Description of Artificial Sequence: Synthetic oligonucleotide
  Target: ATXN1; (+) strand; PAM type: YTN; PAM sequence: TTC
tcaaagtgctgtttaaaaac

SEQ ID NO: 271306 - DNA, 20 bp, Artificial Sequence
  Description of Artificial Sequence: Synthetic oligonucleotide
  Target: ATXN1; (+) strand; PAM type: YTN; PAM sequence: CTC
aaagtgctgtttaaaaactg

SEQ ID NO: 271307 - DNA, 20 bp, Artificial Sequence
  Description of Artificial Sequence: Synthetic oligonucleotide
  Target: ATXN1; (+) strand; PAM type: YTN; PAM sequence: CTG
tttaaaaactgacatcttca

SEQ ID NO: 271308 - DNA, 20 bp, Artificial Sequence
  Description of Artificial Sequence: Synthetic oligonucleotide
  Target: ATXN1; (+) strand; PAM type: YTN; PAM sequence: TTT
aaaaactgacatcttcaacc

SEQ ID NO: 271309 - DNA, 20 bp, Artificial Sequence
  Description of Artificial Sequence: Synthetic oligonucleotide
  Target: ATXN1; (+) strand; PAM type: YTN; PAM sequence: TTA
aaaactgacatcttcaacca

SEQ ID NO: 271310 - DNA, 20 bp, Artificial Sequence
  Description of Artificial Sequence: Synthetic oligonucleotide
  Target: ATXN1; (+) strand; PAM type: YTN; PAM sequence: CTG
acatcttcaaccacatttca

SEQ ID NO: 271311 - DNA, 20 bp, Artificial Sequence
  Description of Artificial Sequence: Synthetic oligonucleotide
  Target: ATXN1; (+) strand; PAM type: YTN; PAM sequence: CTT
caaccacatttcaggcttag

SEQ ID NO: 271312 - DNA, 20 bp, Artificial Sequence
  Description of Artificial Sequence: Synthetic oligonucleotide
  Target: ATXN1; (+) strand; PAM type: YTN; PAM sequence: TTC
aaccacatttcaggcttaga

SEQ ID NO: 271313 - DNA, 20 bp, Artificial Sequence
  Description of Artificial Sequence: Synthetic oligonucleotide
  Target: ATXN1; (+) strand; PAM type: YTN; PAM sequence: TTT
caggcttagaatctatctaa

SEQ ID NO: 271314 - DNA, 20 bp, Artificial Sequence
  Description of Artificial Sequence: Synthetic oligonucleotide
  Target: ATXN1; (+) strand; PAM type: YTN; PAM sequence: TTC
aggcttagaatctatctaaa

SEQ ID NO: 271315 - DNA, 20 bp, Artificial Sequence
  Description of Artificial Sequence: Synthetic oligonucleotide
  Target: ATXN1; (+) strand; PAM type: YTN; PAM sequence: CTT
agaatctatctaaatttgca

SEQ ID NO: 271316 - DNA, 20 bp, Artificial Sequence
  Description of Artificial Sequence: Synthetic oligonucleotide
  Target: ATXN1; (+) strand; PAM type: YTN; PAM sequence: TTA
gaatctatctaaatttgcaa

SEQ ID NO: 271317 - DNA, 20 bp, Artificial Sequence
  Description of Artificial Sequence: Synthetic oligonucleotide
  Target: ATXN1; (+) strand; PAM type: YTN; PAM sequence: CTA
tctaaatttgcaaagtttca

SEQ ID NO: 271318 - DNA, 20 bp, Artificial Sequence
  Description of Artificial Sequence: Synthetic oligonucleotide
  Target: ATXN1; (+) strand; PAM type: YTN; PAM sequence: CTA
aatttgcaaagtttcattgg

SEQ ID NO: 271319 - DNA, 20 bp, Artificial Sequence
  Description of Artificial Sequence: Synthetic oligonucleotide
  Target: ATXN1; (+) strand; PAM type: YTN; PAM sequence: TTT
gcaaagtttcattggttctt

SEQ ID NO: 271320 - DNA, 20 bp, Artificial Sequence
  Description of Artificial Sequence: Synthetic oligonucleotide
  Target: ATXN1; (+) strand; PAM type: YTN; PAM sequence: TTG
caaagtttcattggttctta

SEQ ID NO: 271321 - DNA, 20 bp, Artificial Sequence
  Description of Artificial Sequence: Synthetic oligonucleotide
  Target: ATXN1; (+) strand; PAM type: YTN; PAM sequence: TTT
cattggttcttatgaaagtg

SEQ ID NO: 271322 - DNA, 20 bp, Artificial Sequence
  Description of Artificial Sequence: Synthetic oligonucleotide
  Target: ATXN1; (+) strand; PAM type: YTN; PAM sequence: TTC
attggttcttatgaaagtgc

SEQ ID NO: 271323 - DNA, 20 bp, Artificial Sequence
  Description of Artificial Sequence: Synthetic oligonucleotide
  Target: ATXN1; (+) strand; PAM type: YTN; PAM sequence: TTG
gttcttatgaaagtgctact

SEQ ID NO: 271324 - DNA, 20 bp, Artificial Sequence
  Description of Artificial Sequence: Synthetic oligonucleotide
  Target: ATXN1; (+) strand; PAM type: YTN; PAM sequence: TTC
ttatgaaagtgctacttaaa

SEQ ID NO: 271325 - DNA, 20 bp, Artificial Sequence
  Description of Artificial Sequence: Synthetic oligonucleotide
  Target: ATXN1; (+) strand; PAM type: YTN; PAM sequence: CTT
atgaaagtgctacttaaaaa

SEQ ID NO: 271326 - DNA, 20 bp, Artificial Sequence
  Description of Artificial Sequence: Synthetic oligonucleotide
  Target: ATXN1; (+) strand; PAM type: YTN; PAM sequence: TTA
tgaaagtgctacttaaaaaa

SEQ ID NO: 271327 - DNA, 20 bp, Artificial Sequence
  Description of Artificial Sequence: Synthetic oligonucleotide
  Target: ATXN1; (+) strand; PAM type: YTN; PAM sequence: CTA
cttaaaaaaatacacttgac

SEQ ID NO: 271328 - DNA, 20 bp, Artificial Sequence
  Description of Artificial Sequence: Synthetic oligonucleotide
  Target: ATXN1; (+) strand; PAM type: YTN; PAM sequence: CTT
aaaaaaatacacttgacagc

SEQ ID NO: 271329 - DNA, 20 bp, Artificial Sequence
  Description of Artificial Sequence: Synthetic oligonucleotide
  Target: ATXN1; (+) strand; PAM type: YTN; PAM sequence: TTA
aaaaaatacacttgacagcc

SEQ ID NO: 271330 - DNA, 20 bp, Artificial Sequence
  Description of Artificial Sequence: Synthetic oligonucleotide
  Target: ATXN1; (+) strand; PAM type: YTN; PAM sequence: CTT
gacagccaatctcttgaaaa

SEQ ID NO: 271331 - DNA, 20 bp, Artificial Sequence
  Description of Artificial Sequence: Synthetic oligonucleotide
  Target: ATXN1; (+) strand; PAM type: YTN; PAM sequence: TTG
acagccaatctcttgaaaat

SEQ ID NO: 271332 - DNA, 20 bp, Artificial Sequence
  Description of Artificial Sequence: Synthetic oligonucleotide
  Target: ATXN1; (+) strand; PAM type: YTN; PAM sequence: CTC
ttgaaaatgatttgtgcaga

SEQ ID NO: 271333 - DNA, 20 bp, Artificial Sequence
  Description of Artificial Sequence: Synthetic oligonucleotide
  Target: ATXN1; (+) strand; PAM type: YTN; PAM sequence: CTT
gaaaatgatttgtgcagaaa

SEQ ID NO: 271334 - DNA, 20 bp, Artificial Sequence
  Description of Artificial Sequence: Synthetic oligonucleotide
  Target: ATXN1; (+) strand; PAM type: YTN; PAM sequence: TTG
aaaatgatttgtgcagaaat

SEQ ID NO: 271335 - DNA, 20 bp, Artificial Sequence
  Description of Artificial Sequence: Synthetic oligonucleotide
  Target: ATXN1; (+) strand; PAM type: YTN; PAM sequence: TTT
gtgcagaaattgtgttcaaa

SEQ ID NO: 271336 - DNA, 20 bp, Artificial Sequence
  Description of Artificial Sequence: Synthetic oligonucleotide
  Target: ATXN1; (+) strand; PAM type: YTN; PAM sequence: TTG
tgcagaaattgtgttcaaat

SEQ ID NO: 271337 - DNA, 20 bp, Artificial Sequence
  Description of Artificial Sequence: Synthetic oligonucleotide
  Target: ATXN1; (+) strand; PAM type: YTN; PAM sequence: TTG
tgttcaaattactttatatc

SEQ ID NO: 271338 - DNA, 20 bp, Artificial Sequence
  Description of Artificial Sequence: Synthetic oligonucleotide
  Target: ATXN1; (+) strand; PAM type: YTN; PAM sequence: TTC
aaattactttatatcaagac

SEQ ID NO: 271339 - DNA, 20 bp, Artificial Sequence
  Description of Artificial Sequence: Synthetic oligonucleotide
  Target: ATXN1; (+) strand; PAM type: YTN; PAM sequence: TTA
ctttatatcaagacatttaa

SEQ ID NO: 271340 - DNA, 20 bp, Artificial Sequence
  Description of Artificial Sequence: Synthetic oligonucleotide
  Target: ATXN1; (+) strand; PAM type: YTN; PAM sequence: CTT
tatatcaagacatttaagag

SEQ ID NO: 271341 - DNA, 20 bp, Artificial Sequence
  Description of Artificial Sequence: Synthetic oligonucleotide
  Target: ATXN1; (+) strand; PAM type: YTN; PAM sequence: TTT
atatcaagacatttaagaga

SEQ ID NO: 271342 - DNA, 20 bp, Artificial Sequence
  Description of Artificial Sequence: Synthetic oligonucleotide
  Target: ATXN1; (+) strand; PAM type: YTN; PAM sequence: TTA
tatcaagacatttaagagaa

SEQ ID NO: 271343 - DNA, 20 bp, Artificial Sequence
  Description of Artificial Sequence: Synthetic oligonucleotide
  Target: ATXN1; (+) strand; PAM type: YTN; PAM sequence: TTT
aagagaaaatgtggttttct

SEQ ID NO: 271344 - DNA, 20 bp, Artificial Sequence
  Description of Artificial Sequence: Synthetic oligonucleotide
  Target: ATXN1; (+) strand; PAM type: YTN; PAM sequence: TTA
agagaaaatgtggttttctt

SEQ ID NO: 271345 - DNA, 20 bp, Artificial Sequence
  Description of Artificial Sequence: Synthetic oligonucleotide
  Target: ATXN1; (+) strand; PAM type: YTN; PAM sequence: TTT
tctttgtaataggctaaaaa

SEQ ID NO: 271346 - DNA, 20 bp, Artificial Sequence
  Description of Artificial Sequence: Synthetic oligonucleotide
  Target: ATXN1; (+) strand; PAM type: YTN; PAM sequence: TTT
ctttgtaataggctaaaaat

SEQ ID NO: 271347 - DNA, 20 bp, Artificial Sequence
  Description of Artificial Sequence: Synthetic oligonucleotide
  Target: ATXN1; (+) strand; PAM type: YTN; PAM sequence: TTC
tttgtaataggctaaaaata

SEQ ID NO: 271348 - DNA, 20 bp, Artificial Sequence
  Description of Artificial Sequence: Synthetic oligonucleotide
  Target: ATXN1; (+) strand; PAM type: YTN; PAM sequence: CTT
tgtaataggctaaaaataat

SEQ ID NO: 271349 - DNA, 20 bp, Artificial Sequence
  Description of Artificial Sequence: Synthetic oligonucleotide
  Target: ATXN1; (+) strand; PAM type: YTN; PAM sequence: TTT
gtaataggctaaaaataatg

SEQ ID NO: 271350 - DNA, 20 bp, Artificial Sequence
  Description of Artificial Sequence: Synthetic oligonucleotide
  Target: ATXN1; (+) strand; PAM type: YTN; PAM sequence: TTG
taataggctaaaaataatga

SEQ ID NO: 271351 - DNA, 20 bp, Artificial Sequence
  Description of Artificial Sequence: Synthetic oligonucleotide
  Target: ATXN1; (+) strand; PAM type: YTN; PAM sequence: CTA
aaaataatgatatcctttat

SEQ ID NO: 271352 - DNA, 20 bp, Artificial Sequence
  Description of Artificial Sequence: Synthetic oligonucleotide
  Target: ATXN1; (+) strand; PAM type: YTN; PAM sequence: CTT
tatcttcaactgaacatgta

SEQ ID NO: 271353 - DNA, 20 bp, Artificial Sequence
  Description of Artificial Sequence: Synthetic oligonucleotide
  Target: ATXN1; (+) strand; PAM type: YTN; PAM sequence: TTT
atcttcaactgaacatgtac

SEQ ID NO: 271354 - DNA, 20 bp, Artificial Sequence
  Description of Artificial Sequence: Synthetic oligonucleotide
  Target: ATXN1; (+) strand; PAM type: YTN; PAM sequence: TTA
tcttcaactgaacatgtaca

SEQ ID NO: 271355 - DNA, 20 bp, Artificial Sequence
  Description of Artificial Sequence: Synthetic oligonucleotide
  Target: ATXN1; (+) strand; PAM type: YTN; PAM sequence: CTT
caactgaacatgtacatatg

SEQ ID NO: 271356 - DNA, 20 bp, Artificial Sequence
  Description of Artificial Sequence: Synthetic oligonucleotide
  Target: ATXN1; (+) strand; PAM type: YTN; PAM sequence: TTC
aactgaacatgtacatatgc

SEQ ID NO: 271357 - DNA, 20 bp, Artificial Sequence
  Description of Artificial Sequence: Synthetic oligonucleotide
  Target: ATXN1; (+) strand; PAM type: YTN; PAM sequence: CTG
aacatgtacatatgctgtat

SEQ ID NO: 271358 - DNA, 20 bp, Artificial Sequence
  Description of Artificial Sequence: Synthetic oligonucleotide
  Target: ATXN1; (+) strand; PAM type: YTN; PAM sequence: CTG
tataagctgttgcatttaaa

SEQ ID NO: 271359 - DNA, 20 bp, Artificial Sequence
  Description of Artificial Sequence: Synthetic oligonucleotide
  Target: ATXN1; (+) strand; PAM type: YTN; PAM sequence: CTG
ttgcatttaaacaaattgaa

SEQ ID NO: 271360 - DNA, 20 bp, Artificial Sequence
  Description of Artificial Sequence: Synthetic oligonucleotide
  Target: ATXN1; (+) strand; PAM type: YTN; PAM sequence: TTG
catttaaacaaattgaaaaa

SEQ ID NO: 271361 - DNA, 20 bp, Artificial Sequence
  Description of Artificial Sequence: Synthetic oligonucleotide
  Target: ATXN1; (+) strand; PAM type: YTN; PAM sequence: TTT
aaacaaattgaaaaacagta

SEQ ID NO: 271362 - DNA, 20 bp, Artificial Sequence
  Description of Artificial Sequence: Synthetic oligonucleotide
  Target: ATXN1; (+) strand; PAM type: YTN; PAM sequence: TTA
aacaaattgaaaaacagtag

SEQ ID NO: 271363 - DNA, 20 bp, Artificial Sequence
  Description of Artificial Sequence: Synthetic oligonucleotide
  Target: ATXN1; (+) strand; PAM type: YTN; PAM sequence: TTG
aaaaacagtaggattctggc

SEQ ID NO: 271364 - DNA, 20 bp, Artificial Sequence
  Description of Artificial Sequence: Synthetic oligonucleotide
  Target: ATXN1; (+) strand; PAM type: YTN; PAM sequence: TTC
tggctatagaccgtaaagaa

SEQ ID NO: 271365 - DNA, 20 bp, Artificial Sequence
  Description of Artificial Sequence: Synthetic oligonucleotide
  Target: ATXN1; (+) strand; PAM type: YTN; PAM sequence: CTG
gctatagaccgtaaagaaac

SEQ ID NO: 271366 - DNA, 20 bp, Artificial Sequence
  Description of Artificial Sequence: Synthetic oligonucleotide
  Target: ATXN1; (+) strand; PAM type: YTN; PAM sequence: CTA
tagaccgtaaagaaacaaaa

SEQ ID NO: 271367 - DNA, 20 bp, Artificial Sequence
  Description of Artificial Sequence: Synthetic oligonucleotide
  Target: ATXN1; (+) strand; PAM type: YTN; PAM sequence: CTT
gcccagaatatcattttaag

SEQ ID NO: 271368 - DNA, 20 bp, Artificial Sequence
  Description of Artificial Sequence: Synthetic oligonucleotide
  Target: ATXN1; (+) strand; PAM type: YTN; PAM sequence: TTG
cccagaatatcattttaagc

SEQ ID NO: 271369 - DNA, 20 bp, Artificial Sequence
  Description of Artificial Sequence: Synthetic oligonucleotide
  Target: ATXN1; (+) strand; PAM type: YTN; PAM sequence: TTT
taagcattaaaaaatacaat

SEQ ID NO: 271370 - DNA, 20 bp, Artificial Sequence
  Description of Artificial Sequence: Synthetic oligonucleotide
  Target: ATXN1; (+) strand; PAM type: YTN; PAM sequence: TTT
aagcattaaaaaatacaatt

SEQ ID NO: 271371 - DNA, 20 bp, Artificial Sequence
  Description of Artificial Sequence: Synthetic oligonucleotide
  Target: ATXN1; (+) strand; PAM type: YTN; PAM sequence: TTA
agcattaaaaaatacaatta

SEQ ID NO: 271372 - DNA, 20 bp, Artificial Sequence
  Description of Artificial Sequence: Synthetic oligonucleotide
  Target: ATXN1; (+) strand; PAM type: YTN; PAM sequence: TTA
aaaaatacaattaactgcta

SEQ ID NO: 271373 - DNA, 20 bp, Artificial Sequence
  Description of Artificial Sequence: Synthetic oligonucleotide
  Target: ATXN1; (+) strand; PAM type: YTN; PAM sequence: TTA
actgctatttcccacaaagt

SEQ ID NO: 271374 - DNA, 20 bp, Artificial Sequence
  Description of Artificial Sequence: Synthetic oligonucleotide
  Target: ATXN1; (+) strand; PAM type: YTN; PAM sequence: CTG
ctatttcccacaaagttcaa

SEQ ID NO: 271375 - DNA, 20 bp, Artificial Sequence
  Description of Artificial Sequence: Synthetic oligonucleotide
  Target: ATXN1; (+) strand; PAM type: YTN; PAM sequence: CTA
tttcccacaaagttcaatcc

SEQ ID NO: 271376 - DNA, 20 bp, Artificial Sequence
  Description of Artificial Sequence: Synthetic oligonucleotide
  Target: ATXN1; (+) strand; PAM type: YTN; PAM sequence: TTT
cccacaaagttcaatcctac

SEQ ID NO: 271377 - DNA, 20 bp, Artificial Sequence
  Description of Artificial Sequence: Synthetic oligonucleotide
  Target: ATXN1; (+) strand; PAM type: YTN; PAM sequence: TTC
ccacaaagttcaatcctaca

SEQ ID NO: 271378 - DNA, 20 bp, Artificial Sequence
  Description of Artificial Sequence: Synthetic oligonucleotide
  Target: ATXN1; (+) strand; PAM type: YTN; PAM sequence: TTC
aatcctacatacagaatcgg

SEQ ID NO: 271379 - DNA, 20 bp, Artificial Sequence
  Description of Artificial Sequence: Synthetic oligonucleotide
  Target: ATXN1; (+) strand; PAM type: YTN; PAM sequence: CTA
catacagaatcggaattgtc

SEQ ID NO: 271380 - DNA, 20 bp, Artificial Sequence
  Description of Artificial Sequence: Synthetic oligonucleotide
  Target: ATXN1; (+) strand; PAM type: YTN; PAM sequence: TTG
tcaaccaggtccaaagcatc

SEQ ID NO: 271381 - DNA, 20 bp, Artificial Sequence
  Description of Artificial Sequence: Synthetic oligonucleotide
  Target: ATXN1; (+) strand; PAM type: YTN; PAM sequence: TTA
taaaacctgatgtctcagaa

SEQ ID NO: 271382 - DNA, 20 bp, Artificial Sequence
  Description of Artificial Sequence: Synthetic oligonucleotide
  Target: ATXN1; (+) strand; PAM type: YTN; PAM sequence: CTG
atgtctcagaaatagacaag

SEQ ID NO: 271383 - DNA, 20 bp, Artificial Sequence
  Description of Artificial Sequence: Synthetic oligonucleotide
  Target: ATXN1; (+) strand; PAM type: YTN; PAM sequence: CTC
agaaatagacaagaaaactc

SEQ ID NO: 271384 - DNA, 20 bp, Artificial Sequence
  Description of Artificial Sequence: Synthetic oligonucleotide
  Target: ATXN1; (+) strand; PAM type: YTN; PAM sequence: CTC
agaaaaaataattattacag

SEQ ID NO: 271385 - DNA, 20 bp, Artificial Sequence
  Description of Artificial Sequence: Synthetic oligonucleotide
  Target: ATXN1; (+) strand; PAM type: YTN; PAM sequence: TTA
ttacagtccaatcgcacaca

SEQ ID NO: 271386 - DNA, 20 bp, Artificial Sequence
  Description of Artificial Sequence: Synthetic oligonucleotide
  Target: ATXN1; (+) strand; PAM type: YTN; PAM sequence: TTA
cagtccaatcgcacacaaag

SEQ ID NO: 271387 - DNA, 20 bp, Artificial Sequence
  Description of Artificial Sequence: Synthetic oligonucleotide
  Target: ATXN1; (+) strand; PAM type: YTN; PAM sequence: TTA
tatagtttatatttctacaa

SEQ ID NO: 271388 - DNA, 20 bp, Artificial Sequence
  Description of Artificial Sequence: Synthetic oligonucleotide
  Target: ATXN1; (+) strand; PAM type: YTN; PAM sequence: TTT
atatttctacaaattccttt

SEQ ID NO: 271389 - DNA, 20 bp, Artificial Sequence
  Description of Artificial Sequence: Synthetic oligonucleotide
  Target: ATXN1; (+) strand; PAM type: YTN; PAM sequence: TTA
tatttctacaaattcctttt

SEQ ID NO: 271390 - DNA, 20 bp, Artificial Sequence
  Description of Artificial Sequence: Synthetic oligonucleotide
  Target: ATXN1; (+) strand; PAM type: YTN; PAM sequence: TTT
ctacaaattccttttgagtt

SEQ ID NO: 271391 - DNA, 20 bp, Artificial Sequence
  Description of Artificial Sequence: Synthetic oligonucleotide
  Target: ATXN1; (+) strand; PAM type: YTN; PAM sequence: TTC
tacaaattccttttgagtta

SEQ ID NO: 271392 - DNA, 20 bp, Artificial Sequence
  Description of Artificial Sequence: Synthetic oligonucleotide
  Target: ATXN1; (+) strand; PAM type: YTN; PAM sequence: CTA
caaattccttttgagttact

SEQ ID NO: 271393 - DNA, 20 bp, Artificial Sequence
  Description of Artificial Sequence: Synthetic oligonucleotide
  Target: ATXN1; (+) strand; PAM type: YTN; PAM sequence: TTC
cttttgagttactgggcaac

SEQ ID NO: 271394 - DNA, 20 bp, Artificial Sequence
  Description of Artificial Sequence: Synthetic oligonucleotide
  Target: ATXN1; (+) strand; PAM type: YTN; PAM sequence: CTT
ttgagttactgggcaacatt

SEQ ID NO: 271395 - DNA, 20 bp, Artificial Sequence
  Description of Artificial Sequence: Synthetic oligonucleotide
  Target: ATXN1; (+) strand; PAM type: YTN; PAM sequence: TTT
tgagttactgggcaacattc

SEQ ID NO: 271396 - DNA, 20 bp, Artificial Sequence
  Description of Artificial Sequence: Synthetic oligonucleotide
  Target: ATXN1; (+) strand; PAM type: YTN; PAM sequence: TTT
gagttactgggcaacattct

SEQ ID NO: 271397 - DNA, 20 bp, Artificial Sequence
  Description of Artificial Sequence: Synthetic oligonucleotide
  Target: ATXN1; (+) strand; PAM type: YTN; PAM sequence: TTG
agttactgggcaacattcta

SEQ ID NO: 271398 - DNA, 20 bp, Artificial Sequence
  Description of Artificial Sequence: Synthetic oligonucleotide
  Target: ATXN1; (+) strand; PAM type: YTN; PAM sequence: TTA
ctgggcaacattctatttaa

SEQ ID NO: 271399 - DNA, 20 bp, Artificial Sequence
  Description of Artificial Sequence: Synthetic oligonucleotide
  Target: ATXN1; (+) strand; PAM type: YTN; PAM sequence: CTG
ggcaacattctatttaagtg

SEQ ID NO: 271400 - DNA, 20 bp, Artificial Sequence
  Description of Artificial Sequence: Synthetic oligonucleotide
  Target: ATXN1; (+) strand; PAM type: YTN; PAM sequence: TTC
tatttaagtggacccttatg

SEQ ID NO: 271401 - DNA, 20 bp, Artificial Sequence
  Description of Artificial Sequence: Synthetic oligonucleotide
  Target: ATXN1; (+) strand; PAM type: YTN; PAM sequence: CTA
tttaagtggacccttatgac

SEQ ID NO: 271402 - DNA, 20 bp, Artificial Sequence
  Description of Artificial Sequence: Synthetic oligonucleotide
  Target: ATXN1; (+) strand; PAM type: YTN; PAM sequence: TTT
aagtggacccttatgacagt

SEQ ID NO: 271403 - DNA, 20 bp, Artificial Sequence
  Description of Artificial Sequence: Synthetic oligonucleotide
  Target: ATXN1; (+) strand; PAM type: YTN; PAM sequence: TTA
agtggacccttatgacagta

SEQ ID NO: 271404 - DNA, 20 bp, Artificial Sequence
  Description of Artificial Sequence: Synthetic oligonucleotide
  Target: ATXN1; (+) strand; PAM type: YTN; PAM sequence: CTT
atgacagtagtataatgaaa

SEQ ID NO: 271405 - DNA, 20 bp, Artificial Sequence
  Description of Artificial Sequence: Synthetic oligonucleotide
  Target: ATXN1; (+) strand; PAM type: YTN; PAM sequence: TTA
tgacagtagtataatgaaaa

SEQ ID NO: 271406 - DNA, 20 bp, Artificial Sequence
  Description of Artificial Sequence: Synthetic oligonucleotide
  Target: ATXN1; (+) strand; PAM type: YTN; PAM sequence: CTA
agtcatagccctaaaacaat

SEQ ID NO: 271407 - DNA, 20 bp, Artificial Sequence
  Description of Artificial Sequence: Synthetic oligonucleotide
  Target: ATXN1; (+) strand; PAM type: YTN; PAM sequence: CTA
aaacaattcccactgaacat

SEQ ID NO: 271408 - DNA, 20 bp, Artificial Sequence
  Description of Artificial Sequence: Synthetic oligonucleotide
  Target: ATXN1; (+) strand; PAM type: YTN; PAM sequence: TTC
ccactgaacatttcattgaa

SEQ ID NO: 271409 - DNA, 20 bp, Artificial Sequence
  Description of Artificial Sequence: Synthetic oligonucleotide
  Target: ATXN1; (+) strand; PAM type: YTN; PAM sequence: CTG
aacatttcattgaatgctta

SEQ ID NO: 271410 - DNA, 20 bp, Artificial Sequence
  Description of Artificial Sequence: Synthetic oligonucleotide
  Target: ATXN1; (+) strand; PAM type: YTN; PAM sequence: TTT
cattgaatgcttagtatgtg

SEQ ID NO: 271411 - DNA, 20 bp, Artificial Sequence
  Description of Artificial Sequence: Synthetic oligonucleotide
  Target: ATXN1; (+) strand; PAM type: YTN; PAM sequence: TTC
attgaatgcttagtatgtgc

SEQ ID NO: 271412 - DNA, 20 bp, Artificial Sequence
  Description of Artificial Sequence: Synthetic oligonucleotide
  Target: ATXN1; (+) strand; PAM type: YTN; PAM sequence: TTG
aatgcttagtatgtgcaaag

SEQ ID NO: 271413 - DNA, 20 bp, Artificial Sequence
  Description of Artificial Sequence: Synthetic oligonucleotide
  Target: ATXN1; (+) strand; PAM type: YTN; PAM sequence: CTT
agtatgtgcaaagtactgtg

SEQ ID NO: 271414 - DNA, 20 bp, Artificial Sequence
  Description of Artificial Sequence: Synthetic oligonucleotide
  Target: ATXN1; (+) strand; PAM type: YTN; PAM sequence: TTA
gtatgtgcaaagtactgtga

SEQ ID NO: 271415 - DNA, 20 bp, Artificial Sequence
  Description of Artificial Sequence: Synthetic oligonucleotide
  Target: ATXN1; (+) strand; PAM type: YTN; PAM sequence: CTG
tgaggtgaggttcagaaatg

SEQ ID NO: 271416 - DNA, 20 bp, Artificial Sequence
  Description of Artificial Sequence: Synthetic oligonucleotide
  Target: ATXN1; (+) strand; PAM type: YTN; PAM sequence: TTC
agaaatggagaaagaaggtt

SEQ ID NO: 271417 - DNA, 20 bp, Artificial Sequence
  Description of Artificial Sequence: Synthetic oligonucleotide
  Target: ATXN1; (+) strand; PAM type: YTN; PAM sequence: TTT
attgctttgaatgcagaata

SEQ ID NO: 271418 - DNA, 20 bp, Artificial Sequence
  Description of Artificial Sequence: Synthetic oligonucleotide
  Target: ATXN1; (+) strand; PAM type: YTN; PAM sequence: TTA
ttgctttgaatgcagaatat

SEQ ID NO: 271419 - DNA, 20 bp, Artificial Sequence
  Description of Artificial Sequence: Synthetic oligonucleotide
  Target: ATXN1; (+) strand; PAM type: YTN; PAM sequence: TTG
ctttgaatgcagaatattga

SEQ ID NO: 271420 - DNA, 20 bp, Artificial Sequence
  Description of Artificial Sequence: Synthetic oligonucleotide
  Target: ATXN1; (+) strand; PAM type: YTN; PAM sequence: CTT
tgaatgcagaatattgattt

SEQ ID NO: 271421 - DNA, 20 bp, Artificial Sequence
  Description of Artificial Sequence: Synthetic oligonucleotide
  Target: ATXN1; (+) strand; PAM type: YTN; PAM sequence: TTT
gaatgcagaatattgatttt

SEQ ID NO: 271422 - DNA, 20 bp, Artificial Sequence
  Description of Artificial Sequence: Synthetic oligonucleotide
  Target: ATXN1; (+) strand; PAM type: YTN; PAM sequence: TTG
aatgcagaatattgattttt

SEQ ID NO: 271423 - DNA, 20 bp, Artificial Sequence
  Description of Artificial Sequence: Synthetic oligonucleotide
  Target: ATXN1; (+) strand; PAM type: YTN; PAM sequence: TTG
atttttaaaacactaagcta

SEQ ID NO: 271424 - DNA, 20 bp, Artificial Sequence
  Description of Artificial Sequence: Synthetic oligonucleotide
  Target: ATXN1; (+) strand; PAM type: YTN; PAM sequence: TTT
ttaaaacactaagctaatcg

SEQ ID NO: 271425 - DNA, 20 bp, Artificial Sequence
  Description of Artificial Sequence: Synthetic oligonucleotide
  Target: ATXN1; (+) strand; PAM type: YTN; PAM sequence: TTT
taaaacactaagctaatcgt

SEQ ID NO: 271426 - DNA, 20 bp, Artificial Sequence
  Description of Artificial Sequence: Synthetic oligonucleotide
  Target: ATXN1; (+) strand; PAM type: YTN; PAM sequence: TTT
aaaacactaagctaatcgtc

SEQ ID NO: 271427 - DNA, 20 bp, Artificial Sequence
  Description of Artificial Sequence: Synthetic oligonucleotide
  Target: ATXN1; (+) strand; PAM type: YTN; PAM sequence: TTA
aaacactaagctaatcgtca

SEQ ID NO: 271428 - DNA, 20 bp, Artificial Sequence
  Description of Artificial Sequence: Synthetic oligonucleotide
  Target: ATXN1; (+) strand; PAM type: YTN; PAM sequence: CTA
agctaatcgtcaccaactat

SEQ ID NO: 271429 - DNA, 20 bp, Artificial Sequence
  Description of Artificial Sequence: Synthetic oligonucleotide
  Target: ATXN1; (+) strand; PAM type: YTN; PAM sequence: CTA
atcgtcaccaactataataa

SEQ ID NO: 271430 - DNA, 20 bp, Artificial Sequence
  Description of Artificial Sequence: Synthetic oligonucleotide
  Target: ATXN1; (+) strand; PAM type: YTN; PAM sequence: CTA
taataattttttatgattcc

SEQ ID NO: 271431 - DNA, 20 bp, Artificial Sequence
  Description of Artificial Sequence: Synthetic oligonucleotide
  Target: ATXN1; (+) strand; PAM type: YTN; PAM sequence: TTT
tttatgattcctcattgcca

SEQ ID NO: 271432 - DNA, 20 bp, Artificial Sequence
  Description of Artificial Sequence: Synthetic oligonucleotide
  Target: ATXN1; (+) strand; PAM type: YTN; PAM sequence: TTT
ttatgattcctcattgccaa

SEQ ID NO: 271433 - DNA, 20 bp, Artificial Sequence
  Description of Artificial Sequence: Synthetic oligonucleotide
  Target: ATXN1; (+) strand; PAM type: YTN; PAM sequence: TTT
tatgattcctcattgccaac

SEQ ID NO: 271434 - DNA, 20 bp, Artificial Sequence
  Description of Artificial Sequence: Synthetic oligonucleotide
  Target: ATXN1; (+) strand; PAM type: YTN; PAM sequence: TTT
atgattcctcattgccaaca

SEQ ID NO: 271435 - DNA, 20 bp, Artificial Sequence
  Description of Artificial Sequence: Synthetic oligonucleotide
  Target: ATXN1; (+) strand; PAM type: YTN; PAM sequence: TTA
tgattcctcattgccaacag

SEQ ID NO: 271436 - DNA, 20 bp, Artificial Sequence
  Description of Artificial Sequence: Synthetic oligonucleotide
  Target: ATXN1; (+) strand; PAM type: YTN; PAM sequence: TTC
ctcattgccaacagcaatga

SEQ ID NO: 271437 - DNA, 20 bp, Artificial Sequence
  Description of Artificial Sequence: Synthetic oligonucleotide
  Target: ATXN1; (+) strand; PAM type: YTN; PAM sequence: CTC
attgccaacagcaatgattt

SEQ ID NO: 271438 - DNA, 20 bp, Artificial Sequence
  Description of Artificial Sequence: Synthetic oligonucleotide
  Target: ATXN1; (+) strand; PAM type: YTN; PAM sequence: TTG
ccaacagcaatgattttcaa

SEQ ID NO: 271439 - DNA, 20 bp, Artificial Sequence
  Description of Artificial Sequence: Synthetic oligonucleotide
  Target: ATXN1; (+) strand; PAM type: YTN; PAM sequence: TTT
tcaaatgtgttttttaaaag

SEQ ID NO: 271440 - DNA, 20 bp, Artificial Sequence
  Description of Artificial Sequence: Synthetic oligonucleotide
  Target: ATXN1; (+) strand; PAM type: YTN; PAM sequence: TTT
caaatgtgttttttaaaagc

SEQ ID NO: 271441 - DNA, 20 bp, Artificial Sequence
  Description of Artificial Sequence: Synthetic oligonucleotide
  Target: ATXN1; (+) strand; PAM type: YTN; PAM sequence: TTC
aaatgtgttttttaaaagcc

SEQ ID NO: 271442 - DNA, 20 bp, Artificial Sequence
  Description of Artificial Sequence: Synthetic oligonucleotide
  Target: ATXN1; (+) strand; PAM type: YTN; PAM sequence: TTT
tttaaaagccagaactctgc

SEQ ID NO: 271443 - DNA, 20 bp, Artificial Sequence
  Description of Artificial Sequence: Synthetic oligonucleotide
  Target: ATXN1; (+) strand; PAM type: YTN; PAM sequence: TTT
ttaaaagccagaactctgcc

SEQ ID NO: 271444 - DNA, 20 bp, Artificial Sequence
  Description of Artificial Sequence: Synthetic oligonucleotide
  Target: ATXN1; (+) strand; PAM type: YTN; PAM sequence: TTT
taaaagccagaactctgcct

SEQ ID NO: 271445 - DNA, 20 bp, Artificial Sequence
  Description of Artificial Sequence: Synthetic oligonucleotide
  Target: ATXN1; (+) strand; PAM type: YTN; PAM sequence: TTT
aaaagccagaactctgcctt

SEQ ID NO: 271446 - DNA, 20 bp, Artificial Sequence
  Description of Artificial Sequence: Synthetic oligonucleotide
  Target: ATXN1; (+) strand; PAM type: YTN; PAM sequence: TTA
aaagccagaactctgccttc

SEQ ID NO: 271447 - DNA, 20 bp, Artificial Sequence
  Description of Artificial Sequence: Synthetic oligonucleotide
  Target: ATXN1; (+) strand; PAM type: YTN; PAM sequence: CTC
tgccttcaaacaaaatctta

SEQ ID NO: 271448 - DNA, 20 bp, Artificial Sequence
  Description of Artificial Sequence: Synthetic oligonucleotide
  Target: ATXN1; (+) strand; PAM type: YTN; PAM sequence: CTG
ccttcaaacaaaatcttata

SEQ ID NO: 271449 - DNA, 20 bp, Artificial Sequence
  Description of Artificial Sequence: Synthetic oligonucleotide
  Target: ATXN1; (+) strand; PAM type: YTN; PAM sequence: CTT
caaacaaaatcttatataga

SEQ ID NO: 271450 - DNA, 20 bp, Artificial Sequence
  Description of Artificial Sequence: Synthetic oligonucleotide
  Target: ATXN1; (+) strand; PAM type: YTN; PAM sequence: TTC
aaacaaaatcttatatagaa

SEQ ID NO: 271451 - DNA, 20 bp, Artificial Sequence
  Description of Artificial Sequence: Synthetic oligonucleotide
  Target: ATXN1; (+) strand; PAM type: YTN; PAM sequence: CTT
atatagaaatctaatacaca

SEQ ID NO: 271452 - DNA, 20 bp, Artificial Sequence
  Description of Artificial Sequence: Synthetic oligonucleotide
  Target: ATXN1; (+) strand; PAM type: YTN; PAM sequence: TTA
tatagaaatctaatacacaa

SEQ ID NO: 271453 - DNA, 20 bp, Artificial Sequence
  Description of Artificial Sequence: Synthetic oligonucleotide
  Target: ATXN1; (+) strand; PAM type: YTN; PAM sequence: CTA
atacacaagataaataaaat

SEQ ID NO: 271454 - DNA, 20 bp, Artificial Sequence
  Description of Artificial Sequence: Synthetic oligonucleotide
  Target: ATXN1; (+) strand; PAM type: YTN; PAM sequence: TTG
aggctacttacactatctag

SEQ ID NO: 271455 - DNA, 20 bp, Artificial Sequence
  Description of Artificial Sequence: Synthetic oligonucleotide
  Target: ATXN1; (+) strand; PAM type: YTN; PAM sequence: CTA
cttacactatctagttttat

SEQ ID NO: 271456 - DNA, 20 bp, Artificial Sequence
  Description of Artificial Sequence: Synthetic oligonucleotide
  Target: ATXN1; (+) strand; PAM type: YTN; PAM sequence: CTT
acactatctagttttatcgg

SEQ ID NO: 271457 - DNA, 20 bp, Artificial Sequence
  Description of Artificial Sequence: Synthetic oligonucleotide
  Target: ATXN1; (+) strand; PAM type: YTN; PAM sequence: TTA
cactatctagttttatcggt

SEQ ID NO: 271458 - DNA, 20 bp, Artificial Sequence
  Description of Artificial Sequence: Synthetic oligonucleotide
  Target: ATXN1; (+) strand; PAM type: YTN; PAM sequence: CTA
tctagttttatcggttcctc

SEQ ID NO: 271459 - DNA, 20 bp, Artificial Sequence
  Description of Artificial Sequence: Synthetic oligonucleotide
  Target: ATXN1; (+) strand; PAM type: YTN; PAM sequence: CTA
gttttatcggttcctcctac

SEQ ID NO: 271460 - DNA, 20 bp, Artificial Sequence
  Description of Artificial Sequence: Synthetic oligonucleotide
  Target: ATXN1; (+) strand; PAM type: YTN; PAM sequence: TTT
tatcggttcctcctactcct

SEQ ID NO: 271461 - DNA, 20 bp, Artificial Sequence
  Description of Artificial Sequence: Synthetic oligonucleotide
  Target: ATXN1; (+) strand; PAM type: YTN; PAM sequence: TTT
atcggttcctcctactcctc

SEQ ID NO: 271462 - DNA, 20 bp, Artificial Sequence
  Description of Artificial Sequence: Synthetic oligonucleotide
  Target: ATXN1; (+) strand; PAM type: YTN; PAM sequence: TTA
tcggttcctcctactcctca

SEQ ID NO: 271463 - DNA, 20 bp, Artificial Sequence
  Description of Artificial Sequence: Synthetic oligonucleotide
  Target: ATXN1; (+) strand; PAM type: YTN; PAM sequence: TTC
ctcctactcctcatccatca

SEQ ID NO: 271464 - DNA, 20 bp, Artificial Sequence
  Description of Artificial Sequence: Synthetic oligonucleotide
  Target: ATXN1; (+) strand; PAM type: YTN; PAM sequence: CTC
ctactcctcatccatcacca

SEQ ID NO: 271465 - DNA, 20 bp, Artificial Sequence
  Description of Artificial Sequence: Synthetic oligonucleotide
  Target: ATXN1; (+) strand; PAM type: YTN; PAM sequence: CTA
ctcctcatccatcaccacca

SEQ ID NO: 271466 - DNA, 20 bp, Artificial Sequence
  Description of Artificial Sequence: Synthetic oligonucleotide
  Target: ATXN1; (+) strand; PAM type: YTN; PAM sequence: CTC
ctcatccatcaccaccaagt

SEQ ID NO: 271467 - DNA, 20 bp, Artificial Sequence
  Description of Artificial Sequence: Synthetic oligonucleotide
  Target: ATXN1; (+) strand; PAM type: YTN; PAM sequence: CTC
atccatcaccaccaagtact

SEQ ID NO: 271468 - DNA, 20 bp, Artificial Sequence
  Description of Artificial Sequence: Synthetic oligonucleotide
  Target: ATXN1; (+) strand; PAM type: YTN; PAM sequence: CTT
ctgaaggcagccccacagag

SEQ ID NO: 271469 - DNA, 20 bp, Artificial Sequence
  Description of Artificial Sequence: Synthetic oligonucleotide
  Target: ATXN1; (+) strand; PAM type: YTN; PAM sequence: TTC
tgaaggcagccccacagagg

SEQ ID NO: 271470 - DNA, 20 bp, Artificial Sequence
  Description of Artificial Sequence: Synthetic oligonucleotide
  Target: ATXN1; (+) strand; PAM type: YTN; PAM sequence: CTG
aaggcagccccacagaggtt

SEQ ID NO: 271471 - DNA, 20 bp, Artificial Sequence
  Description of Artificial Sequence: Synthetic oligonucleotide
  Target: ATXN1; (+) strand; PAM type: YTN; PAM sequence: TTC
acagggcagaggttgggaga

SEQ ID NO: 271472 - DNA, 20 bp, Artificial Sequence
  Description of Artificial Sequence: Synthetic oligonucleotide
  Target: ATXN1; (+) strand; PAM type: YTN; PAM sequence: TTG
ggagactgagaaatcctcag

SEQ ID NO: 271473 - DNA, 20 bp, Artificial Sequence
  Description of Artificial Sequence: Synthetic oligonucleotide
  Target: ATXN1; (+) strand; PAM type: YTN; PAM sequence: CTG
agaaatcctcaggctactgg

SEQ ID NO: 271474 - DNA, 20 bp, Artificial Sequence
  Description of Artificial Sequence: Synthetic oligonucleotide
  Target: ATXN1; (+) strand; PAM type: YTN; PAM sequence: CTC
aggctactggagaatgtggt

SEQ ID NO: 271475 - DNA, 20 bp, Artificial Sequence
  Description of Artificial Sequence: Synthetic oligonucleotide
  Target: ATXN1; (+) strand; PAM type: YTN; PAM sequence: CTA
ctggagaatgtggtctgacc

SEQ ID NO: 271476 - DNA, 20 bp, Artificial Sequence
  Description of Artificial Sequence: Synthetic oligonucleotide
  Target: ATXN1; (+) strand; PAM type: YTN; PAM sequence: CTG
gagaatgtggtctgacctcc

SEQ ID NO: 271477 - DNA, 20 bp, Artificial Sequence
  Description of Artificial Sequence: Synthetic oligonucleotide
  Target: ATXN1; (+) strand; PAM type: YTN; PAM sequence: CTG
acctccaccgagctgaggag

SEQ ID NO: 271478 - DNA, 20 bp, Artificial Sequence
  Description of Artificial Sequence: Synthetic oligonucleotide
  Target: ATXN1; (+) strand; PAM type: YTN; PAM sequence: CTC
caccgagctgaggagtctgt

SEQ ID NO: 271479 - DNA, 20 bp, Artificial Sequence
  Description of Artificial Sequence: Synthetic oligonucleotide
  Target: ATXN1; (+) strand; PAM type: YTN; PAM sequence: CTG
aggagtctgtactccttaac

SEQ ID NO: 271480 - DNA, 20 bp, Artificial Sequence
  Description of Artificial Sequence: Synthetic oligonucleotide
  Target: ATXN1; (+) strand; PAM type: YTN; PAM sequence: CTG
tactccttaacatggcctat

SEQ ID NO: 271481 - DNA, 20 bp, Artificial Sequence
  Description of Artificial Sequence: Synthetic oligonucleotide
  Target: ATXN1; (+) strand; PAM type: YTN; PAM sequence: CTC
cttaacatggcctatgagac

SEQ ID NO: 271482 - DNA, 20 bp, Artificial Sequence
  Description of Artificial Sequence: Synthetic oligonucleotide
  Target: ATXN1; (+) strand; PAM type: YTN; PAM sequence: CTT
aacatggcctatgagaccct

SEQ ID NO: 271483 - DNA, 20 bp, Artificial Sequence
  Description of Artificial Sequence: Synthetic oligonucleotide
  Target: ATXN1; (+) strand; PAM type: YTN; PAM sequence: TTA
acatggcctatgagaccctc

SEQ ID NO: 271484 - DNA, 20 bp, Artificial Sequence
  Description of Artificial Sequence: Synthetic oligonucleotide
  Target: ATXN1; (+) strand; PAM type: YTN; PAM sequence: CTA
tgagaccctctatggtttgc

SEQ ID NO: 271485 - DNA, 20 bp, Artificial Sequence
  Description of Artificial Sequence: Synthetic oligonucleotide
  Target: ATXN1; (+) strand; PAM type: YTN; PAM sequence: CTC
tatggtttgctcctggcctc

SEQ ID NO: 271486 - DNA, 20 bp, Artificial Sequence
  Description of Artificial Sequence: Synthetic oligonucleotide
  Target: ATXN1; (+) strand; PAM type: YTN; PAM sequence: CTA
tggtttgctcctggcctcat

SEQ ID NO: 271487 - DNA, 20 bp, Artificial Sequence
  Description of Artificial Sequence: Synthetic oligonucleotide
  Target: ATXN1; (+) strand; PAM type: YTN; PAM sequence: TTT
gctcctggcctcatgacaag

SEQ ID NO: 271488 - DNA, 20 bp, Artificial Sequence
  Description of Artificial Sequence: Synthetic oligonucleotide
  Target: ATXN1; (+) strand; PAM type: YTN; PAM sequence: TTG
ctcctggcctcatgacaagt

SEQ ID NO: 271489 - DNA, 20 bp, Artificial Sequence
  Description of Artificial Sequence: Synthetic oligonucleotide
  Target: ATXN1; (+) strand; PAM type: YTN; PAM sequence: CTC
ctggcctcatgacaagttac

SEQ ID NO: 271490 - DNA, 20 bp, Artificial Sequence
  Description of Artificial Sequence: Synthetic oligonucleotide
  Target: ATXN1; (+) strand; PAM type: YTN; PAM sequence: CTG
gcctcatgacaagttaccac

SEQ ID NO: 271491 - DNA, 20 bp, Artificial Sequence
  Description of Artificial Sequence: Synthetic oligonucleotide
  Target: ATXN1; (+) strand; PAM type: YTN; PAM sequence: CTC
atgacaagttaccaccaatg

SEQ ID NO: 271492 - DNA, 20 bp, Artificial Sequence
  Description of Artificial Sequence: Synthetic oligonucleotide
  Target: ATXN1; (+) strand; PAM type: YTN; PAM sequence: TTA
ccaccaatggagtactgact

SEQ ID NO: 271493 - DNA, 20 bp, Artificial Sequence
  Description of Artificial Sequence: Synthetic oligonucleotide
  Target: ATXN1; (+) strand; PAM type: YTN; PAM sequence: CTG
actgttccctgcacacactg

SEQ ID NO: 271494 - DNA, 20 bp, Artificial Sequence
  Description of Artificial Sequence: Synthetic oligonucleotide
  Target: ATXN1; (+) strand; PAM type: YTN; PAM sequence: CTG
ttccctgcacacactgcacc

SEQ ID NO: 271495 - DNA, 20 bp, Artificial Sequence
  Description of Artificial Sequence: Synthetic oligonucleotide
  Target: ATXN1; (+) strand; PAM type: YTN; PAM sequence: TTC
cctgcacacactgcaccatg

SEQ ID NO: 271496 - DNA, 20 bp, Artificial Sequence
  Description of Artificial Sequence: Synthetic oligonucleotide
  Target: ATXN1; (+) strand; PAM type: YTN; PAM sequence: CTG
cacacactgcaccatgctgt

SEQ ID NO: 271497 - DNA, 20 bp, Artificial Sequence
  Description of Artificial Sequence: Synthetic oligonucleotide
  Target: ATXN1; (+) strand; PAM type: YTN; PAM sequence: CTG
caccatgctgtttgttccct

SEQ ID NO: 271498 - DNA, 20 bp, Artificial Sequence
  Description of Artificial Sequence: Synthetic oligonucleotide
  Target: ATXN1; (+) strand; PAM type: YTN; PAM sequence: CTG
tttgttccctgtgctttgtc

SEQ ID NO: 271499 - DNA, 20 bp, Artificial Sequence
  Description of Artificial Sequence: Synthetic oligonucleotide
  Target: ATXN1; (+) strand; PAM type: YTN; PAM sequence: TTT
gttccctgtgctttgtccat

SEQ ID NO: 271500 - DNA, 20 bp, Artificial Sequence
  Description of Artificial Sequence: Synthetic oligonucleotide
  Target: ATXN1; (+) strand; PAM type: YTN; PAM sequence: TTG
ttccctgtgctttgtccatg

SEQ ID NO: 271501 - DNA, 20 bp, Artificial Sequence
  Description of Artificial Sequence: Synthetic oligonucleotide
  Target: ATXN1; (+) strand; PAM type: YTN; PAM sequence: TTC
cctgtgctttgtccatgctg

SEQ ID NO: 271502 - DNA, 20 bp, Artificial Sequence
  Description of Artificial Sequence: Synthetic oligonucleotide
  Target: ATXN1; (+) strand; PAM type: YTN; PAM sequence: CTG
tgctttgtccatgctgtccc

SEQ ID NO: 271503 - DNA, 20 bp, Artificial Sequence
  Description of Artificial Sequence: Synthetic oligonucleotide
  Target: ATXN1; (+) strand; PAM type: YTN; PAM sequence: CTT
tgtccatgctgtcccttggc

SEQ ID NO: 271504 - DNA, 20 bp, Artificial Sequence
  Description of Artificial Sequence: Synthetic oligonucleotide
  Target: ATXN1; (+) strand; PAM type: YTN; PAM sequence: TTT
gtccatgctgtcccttggca

SEQ ID NO: 271505 - DNA, 20 bp, Artificial Sequence
  Description of Artificial Sequence: Synthetic oligonucleotide
  Target: ATXN1; (+) strand; PAM type: YTN; PAM sequence: TTG
tccatgctgtcccttggcag

SEQ ID NO: 271506 - DNA, 20 bp, Artificial Sequence
  Description of Artificial Sequence: Synthetic oligonucleotide
  Target: ATXN1; (+) strand; PAM type: YTN; PAM sequence: CTG
tcccttggcaggtgatctct

SEQ ID NO: 271507 - DNA, 20 bp, Artificial Sequence
  Description of Artificial Sequence: Synthetic oligonucleotide
  Target: ATXN1; (+) strand; PAM type: YTN; PAM sequence: CTT
ggcaggtgatctctttatgt

SEQ ID NO: 271508 - DNA, 20 bp, Artificial Sequence
  Description of Artificial Sequence: Synthetic oligonucleotide
  Target: ATXN1; (+) strand; PAM type: YTN; PAM sequence: TTG
gcaggtgatctctttatgtc

SEQ ID NO: 271509 - DNA, 20 bp, Artificial Sequence
  Description of Artificial Sequence: Synthetic oligonucleotide
  Target: ATXN1; (+) strand; PAM type: YTN; PAM sequence: CTC
tttatgtccatcttctcttt

SEQ ID NO: 271510 - DNA, 20 bp, Artificial Sequence
  Description of Artificial Sequence: Synthetic oligonucleotide
  Target: ATXN1; (+) strand; PAM type: YTN; PAM sequence: CTT
tatgtccatcttctctttga

SEQ ID NO: 271511 - DNA, 20 bp, Artificial Sequence
  Description of Artificial Sequence: Synthetic oligonucleotide
  Target: ATXN1; (+) strand; PAM type: YTN; PAM sequence: TTT
atgtccatcttctctttgac

SEQ ID NO: 271512 - DNA, 20 bp, Artificial Sequence
  Description of Artificial Sequence: Synthetic oligonucleotide
  Target: ATXN1; (+) strand; PAM type: YTN; PAM sequence: TTA
tgtccatcttctctttgaca

SEQ ID NO: 271513 - DNA, 20 bp, Artificial Sequence
  Description of Artificial Sequence: Synthetic oligonucleotide
  Target: ATXN1; (+) strand; PAM type: YTN; PAM sequence: CTT
ctctttgacagatgccaaga

SEQ ID NO: 271514 - DNA, 20 bp, Artificial Sequence
  Description of Artificial Sequence: Synthetic oligonucleotide
  Target: ATXN1; (+) strand; PAM type: YTN; PAM sequence: TTC
tctttgacagatgccaagac

SEQ ID NO: 271515 - DNA, 20 bp, Artificial Sequence
  Description of Artificial Sequence: Synthetic oligonucleotide
  Target: ATXN1; (+) strand; PAM type: YTN; PAM sequence: CTC
tttgacagatgccaagacac

SEQ ID NO: 271516 - DNA, 20 bp, Artificial Sequence
  Description of Artificial Sequence: Synthetic oligonucleotide
  Target: ATXN1; (+) strand; PAM type: YTN; PAM sequence: CTT
tgacagatgccaagacaccc

SEQ ID NO: 271517 - DNA, 20 bp, Artificial Sequence
  Description of Artificial Sequence: Synthetic oligonucleotide
  Target: ATXN1; (+) strand; PAM type: YTN; PAM sequence: TTT
gacagatgccaagacacccc

SEQ ID NO: 271518 - DNA, 20 bp, Artificial Sequence
  Description of Artificial Sequence: Synthetic oligonucleotide
  Target: ATXN1; (+) strand; PAM type: YTN; PAM sequence: TTG
acagatgccaagacacccca

SEQ ID NO: 271519 - DNA, 20 bp, Artificial Sequence
  Description of Artificial Sequence: Synthetic oligonucleotide
  Target: ATXN1; (+) strand; PAM type: YTN; PAM sequence: CTC
tgcacagctggacacagtct

SEQ ID NO: 271520 - DNA, 20 bp, Artificial Sequence
  Description of Artificial Sequence: Synthetic oligonucleotide
  Target: ATXN1; (+) strand; PAM type: YTN; PAM sequence: CTG
cacagctggacacagtctta

SEQ ID NO: 271521 - DNA, 20 bp, Artificial Sequence
  Description of Artificial Sequence: Synthetic oligonucleotide
  Target: ATXN1; (+) strand; PAM type: YTN; PAM sequence: CTG
gacacagtcttaactccaca

SEQ ID NO: 271522 - DNA, 20 bp, Artificial Sequence
  Description of Artificial Sequence: Synthetic oligonucleotide
  Target: ATXN1; (+) strand; PAM type: YTN; PAM sequence: CTT
aactccacatacacattcat

SEQ ID NO: 271523 - DNA, 20 bp, Artificial Sequence
  Description of Artificial Sequence: Synthetic oligonucleotide
  Target: ATXN1; (+) strand; PAM type: YTN; PAM sequence: TTA
actccacatacacattcatt

SEQ ID NO: 271524 - DNA, 20 bp, Artificial Sequence
  Description of Artificial Sequence: Synthetic oligonucleotide
  Target: ATXN1; (+) strand; PAM type: YTN; PAM sequence: CTC
cacatacacattcatttttg

SEQ ID NO: 271525 - DNA, 20 bp, Artificial Sequence
  Description of Artificial Sequence: Synthetic oligonucleotide
  Target: ATXN1; (+) strand; PAM type: YTN; PAM sequence: TTC
atttttggctcaccacgctg

SEQ ID NO: 271526 - DNA, 20 bp, Artificial Sequence
  Description of Artificial Sequence: Synthetic oligonucleotide
  Target: ATXN1; (+) strand; PAM type: YTN; PAM sequence: TTT
ttggctcaccacgctggctg

SEQ ID NO: 271527 - DNA, 20 bp, Artificial Sequence
  Description of Artificial Sequence: Synthetic oligonucleotide
  Target: ATXN1; (+) strand; PAM type: YTN; PAM sequence: TTT
tggctcaccacgctggctgg

SEQ ID NO: 271528 - DNA, 20 bp, Artificial Sequence
  Description of Artificial Sequence: Synthetic oligonucleotide
  Target: ATXN1; (+) strand; PAM type: YTN; PAM sequence: TTT
ggctcaccacgctggctggt

SEQ ID NO: 271529 - DNA, 20 bp, Artificial Sequence
  Description of Artificial Sequence: Synthetic oligonucleotide
  Target: ATXN1; (+) strand; PAM type: YTN; PAM sequence: TTG
gctcaccacgctggctggta

SEQ ID NO: 271530 - DNA, 20 bp, Artificial Sequence
  Description of Artificial Sequence: Synthetic oligonucleotide
  Target: ATXN1; (+) strand; PAM type: YTN; PAM sequence: CTC
accacgctggctggtaatta

SEQ ID NO: 271531 - DNA, 20 bp, Artificial Sequence
  Description of Artificial Sequence: Synthetic oligonucleotide
  Target: ATXN1; (+) strand; PAM type: YTN; PAM sequence: CTG
gctggtaattattgttcata

SEQ ID NO: 271532 - DNA, 20 bp, Artificial Sequence
  Description of Artificial Sequence: Synthetic oligonucleotide
  Target: ATXN1; (+) strand; PAM type: YTN; PAM sequence: CTG
gtaattattgttcatatggc

SEQ ID NO: 271533 - DNA, 20 bp, Artificial Sequence
  Description of Artificial Sequence: Synthetic oligonucleotide
  Target: ATXN1; (+) strand; PAM type: YTN; PAM sequence: TTA
ttgttcatatggctttcact

SEQ ID NO: 271534 - DNA, 20 bp, Artificial Sequence
  Description of Artificial Sequence: Synthetic oligonucleotide
  Target: ATXN1; (+) strand; PAM type: YTN; PAM sequence: TTG
ttcatatggctttcacttaa

SEQ ID NO: 271535 - DNA, 20 bp, Artificial Sequence
  Description of Artificial Sequence: Synthetic oligonucleotide
  Target: ATXN1; (+) strand; PAM type: YTN; PAM sequence: TTC
atatggctttcacttaaact

SEQ ID NO: 271536 - DNA, 20 bp, Artificial Sequence
  Description of Artificial Sequence: Synthetic oligonucleotide
  Target: ATXN1; (+) strand; PAM type: YTN; PAM sequence: CTT
tcacttaaactaacctcaga

SEQ ID NO: 271537 - DNA, 20 bp, Artificial Sequence
  Description of Artificial Sequence: Synthetic oligonucleotide
  Target: ATXN1; (+) strand; PAM type: YTN; PAM sequence: TTT
cacttaaactaacctcagag

SEQ ID NO: 271538 - DNA, 20 bp, Artificial Sequence
  Description of Artificial Sequence: Synthetic oligonucleotide
  Target: ATXN1; (+) strand; PAM type: YTN; PAM sequence: TTC
acttaaactaacctcagagt

SEQ ID NO: 271539 - DNA, 20 bp, Artificial Sequence
  Description of Artificial Sequence: Synthetic oligonucleotide
  Target: ATXN1; (+) strand; PAM type: YTN; PAM sequence: CTT
aaactaacctcagagtaaca

SEQ ID NO: 271540 - DNA, 20 bp, Artificial Sequence
  Description of Artificial Sequence: Synthetic oligonucleotide
  Target: ATXN1; (+) strand; PAM type: YTN; PAM sequence: TTA
aactaacctcagagtaacac

SEQ ID NO: 271541 - DNA, 20 bp, Artificial Sequence
  Description of Artificial Sequence: Synthetic oligonucleotide
  Target: ATXN1; (+) strand; PAM type: YTN; PAM sequence: CTA
acctcagagtaacacaagca

SEQ ID NO: 271542 - DNA, 20 bp, Artificial Sequence
  Description of Artificial Sequence: Synthetic oligonucleotide
  Target: ATXN1; (+) strand; PAM type: YTN; PAM sequence: CTC
agagtaacacaagcacagaa

SEQ ID NO: 271543 - DNA, 20 bp, Artificial Sequence
  Description of Artificial Sequence: Synthetic oligonucleotide
  Target: ATXN1; (+) strand; PAM type: YTN; PAM sequence: TTC
atagttatattccagcttgg

SEQ ID NO: 271544 - DNA, 20 bp, Artificial Sequence
  Description of Artificial Sequence: Synthetic oligonucleotide
  Target: ATXN1; (+) strand; PAM type: YTN; PAM sequence: TTA
tattccagcttggaacacag

SEQ ID NO: 271545 - DNA, 20 bp, Artificial Sequence
  Description of Artificial Sequence: Synthetic oligonucleotide
  Target: ATXN1; (+) strand; PAM type: YTN; PAM sequence: TTC
cagcttggaacacagatgtt

SEQ ID NO: 271546 - DNA, 20 bp, Artificial Sequence
  Description of Artificial Sequence: Synthetic oligonucleotide
  Target: ATXN1; (+) strand; PAM type: YTN; PAM sequence: CTT
ggaacacagatgttgaccta

SEQ ID NO: 271547 - DNA, 20 bp, Artificial Sequence
  Description of Artificial Sequence: Synthetic oligonucleotide
  Target: ATXN1; (+) strand; PAM type: YTN; PAM sequence: TTG
gaacacagatgttgacctaa

SEQ ID NO: 271548 - DNA, 20 bp, Artificial Sequence
  Description of Artificial Sequence: Synthetic oligonucleotide
  Target: ATXN1; (+) strand; PAM type: YTN; PAM sequence: TTG
acctaacagtggcttcataa

SEQ ID NO: 271549 - DNA, 20 bp, Artificial Sequence
  Description of Artificial Sequence: Synthetic oligonucleotide
  Target: ATXN1; (+) strand; PAM type: YTN; PAM sequence: CTA
acagtggcttcataaatatt

SEQ ID NO: 271550 - DNA, 20 bp, Artificial Sequence
  Description of Artificial Sequence: Synthetic oligonucleotide
  Target: ATXN1; (+) strand; PAM type: YTN; PAM sequence: CTT
cataaatatttgttgaatga

SEQ ID NO: 271551 - DNA, 20 bp, Artificial Sequence
  Description of Artificial Sequence: Synthetic oligonucleotide
  Target: ATXN1; (+) strand; PAM type: YTN; PAM sequence: TTC
ataaatatttgttgaatgaa

SEQ ID NO: 271552 - DNA, 20 bp, Artificial Sequence
  Description of Artificial Sequence: Synthetic oligonucleotide
  Target: ATXN1; (+) strand; PAM type: YTN; PAM sequence: TTT
gttgaatgaatgaataaaga

SEQ ID NO: 271553 - DNA, 20 bp, Artificial Sequence
  Description of Artificial Sequence: Synthetic oligonucleotide
  Target: ATXN1; (+) strand; PAM type: YTN; PAM sequence: TTG
ttgaatgaatgaataaagat

SEQ ID NO: 271554 - DNA, 20 bp, Artificial Sequence
  Description of Artificial Sequence: Synthetic oligonucleotide
  Target: ATXN1; (+) strand; PAM type: YTN; PAM sequence: TTG
aatgaatgaataaagatgga

SEQ ID NO: 271555 - DNA, 20 bp, Artificial Sequence
  Description of Artificial Sequence: Synthetic oligonucleotide
  Target: ATXN1; (+) strand; PAM type: YTN; PAM sequence: CTT
tcatcaaactagggaaaaat

SEQ ID NO: 271556 - DNA, 20 bp, Artificial Sequence
  Description of Artificial Sequence: Synthetic oligonucleotide
  Target: ATXN1; (+) strand; PAM type: YTN; PAM sequence: TTT
catcaaactagggaaaaata

SEQ ID NO: 271557 - DNA, 20 bp, Artificial Sequence
  Description of Artificial Sequence: Synthetic oligonucleotide
  Target: ATXN1; (+) strand; PAM type: YTN; PAM sequence: TTC
atcaaactagggaaaaatat

SEQ ID NO: 271558 - DNA, 20 bp, Artificial Sequence
  Description of Artificial Sequence: Synthetic oligonucleotide
  Target: ATXN1; (+) strand; PAM type: YTN; PAM sequence: CTA
gggaaaaatatttatgtaaa

SEQ ID NO: 271559 - DNA, 20 bp, Artificial Sequence
  Description of Artificial Sequence: Synthetic oligonucleotide
  Target: ATXN1; (+) strand; PAM type: YTN; PAM sequence: TTT
atgtaaatatacatatatat

SEQ ID NO: 271560 - DNA, 20 bp, Artificial Sequence
  Description of Artificial Sequence: Synthetic oligonucleotide
  Target: ATXN1; (+) strand; PAM type: YTN; PAM sequence: TTA
tgtaaatatacatatatatt

SEQ ID NO: 271561 - DNA, 20 bp, Artificial Sequence
  Description of Artificial Sequence: Synthetic oligonucleotide
  Target: ATXN1; (+) strand; PAM type: YTN; PAM sequence: TTA
catatatacttctaaaaatt

SEQ ID NO: 271562 - DNA, 20 bp, Artificial Sequence
  Description of Artificial Sequence: Synthetic oligonucleotide
  Target: ATXN1; (+) strand; PAM type: YTN; PAM sequence: CTT
ctaaaaattgtggtaaacta

SEQ ID NO: 271563 - DNA, 20 bp, Artificial Sequence
  Description of Artificial Sequence: Synthetic oligonucleotide
  Target: ATXN1; (+) strand; PAM type: YTN; PAM sequence: TTC
taaaaattgtggtaaactac

SEQ ID NO: 271564 - DNA, 20 bp, Artificial Sequence
  Description of Artificial Sequence: Synthetic oligonucleotide
  Target: ATXN1; (+) strand; PAM type: YTN; PAM sequence: CTA
aaaattgtggtaaactacac

SEQ ID NO: 271565 - DNA, 20 bp, Artificial Sequence
  Description of Artificial Sequence: Synthetic oligonucleotide
  Target: ATXN1; (+) strand; PAM type: YTN; PAM sequence: TTG
tggtaaactacacaaatata

SEQ ID NO: 271566 - DNA, 20 bp, Artificial Sequence
  Description of Artificial Sequence: Synthetic oligonucleotide
  Target: ATXN1; (+) strand; PAM type: YTN; PAM sequence: CTA
cacaaatataaaatgtacca

SEQ ID NO: 271567 - DNA, 20 bp, Artificial Sequence
  Description of Artificial Sequence: Synthetic oligonucleotide
  Target: ATXN1; (+) strand; PAM type: YTN; PAM sequence: CTT
aaacatttttaactatacag

SEQ ID NO: 271568 - DNA, 20 bp, Artificial Sequence
  Description of Artificial Sequence: Synthetic oligonucleotide
  Target: ATXN1; (+) strand; PAM type: YTN; PAM sequence: TTA
aacatttttaactatacagt

SEQ ID NO: 271569 - DNA, 20 bp, Artificial Sequence
  Description of Artificial Sequence: Synthetic oligonucleotide
  Target: ATXN1; (+) strand; PAM type: YTN; PAM sequence: TTT
ttaactatacagtcagtggc

SEQ ID NO: 271570 - DNA, 20 bp, Artificial Sequence
  Description of Artificial Sequence: Synthetic oligonucleotide
  Target: ATXN1; (+) strand; PAM type: YTN; PAM sequence: TTT
taactatacagtcagtggca

SEQ ID NO: 271571 - DNA, 20 bp, Artificial Sequence
  Description of Artificial Sequence: Synthetic oligonucleotide
  Target: ATXN1; (+) strand; PAM type: YTN; PAM sequence: TTT
aactatacagtcagtggcat

SEQ ID NO: 271572 - DNA, 20 bp, Artificial Sequence
  Description of Artificial Sequence: Synthetic oligonucleotide
  Target: ATXN1; (+) strand; PAM type: YTN; PAM sequence: TTA
actatacagtcagtggcatt

SEQ ID NO: 271573 - DNA, 20 bp, Artificial Sequence
  Description of Artificial Sequence: Synthetic oligonucleotide
  Target: ATXN1; (+) strand; PAM type: YTN; PAM sequence: CTA
tacagtcagtggcattaagt

SEQ ID NO: 271574 - DNA, 20 bp, Artificial Sequence
  Description of Artificial Sequence: Synthetic oligonucleotide
  Target: ATXN1; (+) strand; PAM type: YTN; PAM sequence: TTA
agtacgttcacaatgatgca

SEQ ID NO: 271575 - DNA, 20 bp, Artificial Sequence
  Description of Artificial Sequence: Synthetic oligonucleotide
  Target: ATXN1; (+) strand; PAM type: YTN; PAM sequence: TTC
acaatgatgcacaaccatta

SEQ ID NO: 271576 - DNA, 20 bp, Artificial Sequence
  Description of Artificial Sequence: Synthetic oligonucleotide
  Target: ATXN1; (+) strand; PAM type: YTN; PAM sequence: TTA
ccaccatccaccccccaaac

SEQ ID NO: 271577 - DNA, 20 bp, Artificial Sequence
  Description of Artificial Sequence: Synthetic oligonucleotide
  Target: ATXN1; (+) strand; PAM type: YTN; PAM sequence: CTC
ttcattttgcaaaactgaaa

SEQ ID NO: 271578 - DNA, 20 bp, Artificial Sequence
  Description of Artificial Sequence: Synthetic oligonucleotide
  Target: ATXN1; (+) strand; PAM type: YTN; PAM sequence: CTT
cattttgcaaaactgaaact

SEQ ID NO: 271579 - DNA, 20 bp, Artificial Sequence
  Description of Artificial Sequence: Synthetic oligonucleotide
  Target: ATXN1; (+) strand; PAM type: YTN; PAM sequence: TTC
attttgcaaaactgaaactt

SEQ ID NO: 271580 - DNA, 20 bp, Artificial Sequence
  Description of Artificial Sequence: Synthetic oligonucleotide
  Target: ATXN1; (+) strand; PAM type: YTN; PAM sequence: TTT
tgcaaaactgaaacttttta

SEQ ID NO: 271581 - DNA, 20 bp, Artificial Sequence
  Description of Artificial Sequence: Synthetic oligonucleotide
  Target: ATXN1; (+) strand; PAM type: YTN; PAM sequence: TTT
gcaaaactgaaactttttaa

SEQ ID NO: 271582 - DNA, 20 bp, Artificial Sequence
  Description of Artificial Sequence: Synthetic oligonucleotide
  Target: ATXN1; (+) strand; PAM type: YTN; PAM sequence: TTG
caaaactgaaactttttaac

SEQ ID NO: 271583 - DNA, 20 bp, Artificial Sequence
  Description of Artificial Sequence: Synthetic oligonucleotide
  Target: ATXN1; (+) strand; PAM type: YTN; PAM sequence: CTG
aaactttttaacatacgtac

SEQ ID NO: 271584 - DNA, 20 bp, Artificial Sequence
  Description of Artificial Sequence: Synthetic oligonucleotide
  Target: ATXN1; (+) strand; PAM type: YTN; PAM sequence: CTT
tttaacatacgtacatttaa

SEQ ID NO: 271585 - DNA, 20 bp, Artificial Sequence
  Description of Artificial Sequence: Synthetic oligonucleotide
  Target: ATXN1; (+) strand; PAM type: YTN; PAM sequence: TTT
ttaacatacgtacatttaaa

SEQ ID NO: 271586 - DNA, 20 bp, Artificial Sequence
  Description of Artificial Sequence: Synthetic oligonucleotide
  Target: ATXN1; (+) strand; PAM type: YTN; PAM sequence: TTT
taacatacgtacatttaaaa

SEQ ID NO: 271587 - DNA, 20 bp, Artificial Sequence
  Description of Artificial Sequence: Synthetic oligonucleotide
  Target: ATXN1; (+) strand; PAM type: YTN; PAM sequence: TTT
aacatacgtacatttaaaaa

SEQ ID NO: 271588 - DNA, 20 bp, Artificial Sequence
  Description of Artificial Sequence: Synthetic oligonucleotide
  Target: ATXN1; (+) strand; PAM type: YTN; PAM sequence: TTA
acatacgtacatttaaaaaa

SEQ ID NO: 271589 - DNA, 20 bp, Artificial Sequence
  Description of Artificial Sequence: Synthetic oligonucleotide
  Target: ATXN1; (+) strand; PAM type: YTN; PAM sequence: TTT
aaaaaattcttaaaaatgta

SEQ ID NO: 271590 - DNA, 20 bp, Artificial Sequence
  Description of Artificial Sequence: Synthetic oligonucleotide
  Target: ATXN1; (+) strand; PAM type: YTN; PAM sequence: TTA
aaaaattcttaaaaatgtaa

SEQ ID NO: 271591 - DNA, 20 bp, Artificial Sequence
  Description of Artificial Sequence: Synthetic oligonucleotide
  Target: ATXN1; (+) strand; PAM type: YTN; PAM sequence: TTC
ttaaaaatgtaattgaatga

SEQ ID NO: 271592 - DNA, 20 bp, Artificial Sequence
  Description of Artificial Sequence: Synthetic oligonucleotide
  Target: ATXN1; (+) strand; PAM type: YTN; PAM sequence: CTT
aaaaatgtaattgaatgatc

SEQ ID NO: 271593 - DNA, 20 bp, Artificial Sequence
  Description of Artificial Sequence: Synthetic oligonucleotide
  Target: ATXN1; (+) strand; PAM type: YTN; PAM sequence: TTA
aaaatgtaattgaatgatct

SEQ ID NO: 271594 - DNA, 20 bp, Artificial Sequence
  Description of Artificial Sequence: Synthetic oligonucleotide
  Target: ATXN1; (+) strand; PAM type: YTN; PAM sequence: TTG
aatgatctagggtgtggggt

SEQ ID NO: 271595 - DNA, 20 bp, Artificial Sequence
  Description of Artificial Sequence: Synthetic oligonucleotide
  Target: ATXN1; (+) strand; PAM type: YTN; PAM sequence: CTA
gggtgtggggtacccaggtt

SEQ ID NO: 271596 - DNA, 20 bp, Artificial Sequence
  Description of Artificial Sequence: Synthetic oligonucleotide
  Target: ATXN1; (+) strand; PAM type: YTN; PAM sequence: TTC
ttcacttcccccttgccccc

SEQ ID NO: 271597 - DNA, 20 bp, Artificial Sequence
  Description of Artificial Sequence: Synthetic oligonucleotide
  Target: ATXN1; (+) strand; PAM type: YTN; PAM sequence: CTT
cacttcccccttgcccccac

SEQ ID NO: 271598 - DNA, 20 bp, Artificial Sequence
  Description of Artificial Sequence: Synthetic oligonucleotide
  Target: ATXN1; (+) strand; PAM type: YTN; PAM sequence: TTC
acttcccccttgcccccacc

SEQ ID NO: 271599 - DNA, 20 bp, Artificial Sequence
  Description of Artificial Sequence: Synthetic oligonucleotide
  Target: ATXN1; (+) strand; PAM type: YTN; PAM sequence: CTT
cccccttgcccccacctgct

SEQ ID NO: 271600 - DNA, 20 bp, Artificial Sequence
  Description of Artificial Sequence: Synthetic oligonucleotide
  Target: ATXN1; (+) strand; PAM type: YTN; PAM sequence: TTC
ccccttgcccccacctgcta

SEQ ID NO: 271601 - DNA, 20 bp, Artificial Sequence
  Description of Artificial Sequence: Synthetic oligonucleotide
  Target: ATXN1; (+) strand; PAM type: YTN; PAM sequence: CTT
gcccccacctgctatatatc

SEQ ID NO: 271602 - DNA, 20 bp, Artificial Sequence
  Description of Artificial Sequence: Synthetic oligonucleotide
  Target: ATXN1; (+) strand; PAM type: YTN; PAM sequence: TTG
cccccacctgctatatatct

SEQ ID NO: 271603 - DNA, 20 bp, Artificial Sequence
  Description of Artificial Sequence: Synthetic oligonucleotide
  Target: ATXN1; (+) strand; PAM type: YTN; PAM sequence: CTG
ctatatatcttgtgcctttc

SEQ ID NO: 271604 - DNA, 20 bp, Artificial Sequence
  Description of Artificial Sequence: Synthetic oligonucleotide
  Target: ATXN1; (+) strand; PAM type: YTN; PAM sequence: CTA
tatatcttgtgcctttcagc

SEQ ID NO: 271605 - DNA, 20 bp, Artificial Sequence
  Description of Artificial Sequence: Synthetic oligonucleotide
  Target: ATXN1; (+) strand; PAM type: YTN; PAM sequence: CTT
gtgcctttcagccccactta

SEQ ID NO: 271606 - DNA, 20 bp, Artificial Sequence
  Description of Artificial Sequence: Synthetic oligonucleotide
  Target: ATXN1; (+) strand; PAM type: YTN; PAM sequence: TTG
tgcctttcagccccacttag

SEQ ID NO: 271607 - DNA, 20 bp, Artificial Sequence
  Description of Artificial Sequence: Synthetic oligonucleotide
  Target: ATXN1; (+) strand; PAM type: YTN; PAM sequence: CTT
tcagccccacttagggcatc

SEQ ID NO: 271608 - DNA, 20 bp, Artificial Sequence
  Description of Artificial Sequence: Synthetic oligonucleotide
  Target: ATXN1; (+) strand; PAM type: YTN; PAM sequence: TTT
cagccccacttagggcatct

SEQ ID NO: 271609 - DNA, 20 bp, Artificial Sequence
  Description of Artificial Sequence: Synthetic oligonucleotide
  Target: ATXN1; (+) strand; PAM type: YTN; PAM sequence: TTC
agccccacttagggcatctt

SEQ ID NO: 271610 - DNA, 20 bp, Artificial Sequence
  Description of Artificial Sequence: Synthetic oligonucleotide
  Target: ATXN1; (+) strand; PAM type: YTN; PAM sequence: CTT
agggcatctttagcaagaaa

SEQ ID NO: 271611 - DNA, 20 bp, Artificial Sequence
  Description of Artificial Sequence: Synthetic oligonucleotide
  Target: ATXN1; (+) strand; PAM type: YTN; PAM sequence: TTA
gggcatctttagcaagaaat

SEQ ID NO: 271612 - DNA, 20 bp, Artificial Sequence
  Description of Artificial Sequence: Synthetic oligonucleotide
  Target: ATXN1; (+) strand; PAM type: YTN; PAM sequence: CTT
tagcaagaaatgtggtaaat

SEQ ID NO: 271613 - DNA, 20 bp, Artificial Sequence
  Description of Artificial Sequence: Synthetic oligonucleotide
  Target: ATXN1; (+) strand; PAM type: YTN; PAM sequence: TTT
agcaagaaatgtggtaaatg

SEQ ID NO: 271614 - DNA, 20 bp, Artificial Sequence
  Description of Artificial Sequence: Synthetic oligonucleotide
  Target: ATXN1; (+) strand; PAM type: YTN; PAM sequence: TTA
gcaagaaatgtggtaaatgt

SEQ ID NO: 271615 - DNA, 20 bp, Artificial Sequence
  Description of Artificial Sequence: Synthetic oligonucleotide
  Target: ATXN1; (+) strand; PAM type: YTN; PAM sequence: TTG
agacatgtggtcaatgaaac

SEQ ID NO: 271616 - DNA, 20 bp, Artificial Sequence
  Description of Artificial Sequence: Synthetic oligonucleotide
  Target: ATXN1; (+) strand; PAM type: YTN; PAM sequence: CTC
ctgcctactagcttagctac

SEQ ID NO: 271617 - DNA, 20 bp, Artificial Sequence
  Description of Artificial Sequence: Synthetic oligonucleotide
  Target: ATXN1; (+) strand; PAM type: YTN; PAM sequence: CTG
cctactagcttagctactag

SEQ ID NO: 271618 - DNA, 20 bp, Artificial Sequence
  Description of Artificial Sequence: Synthetic oligonucleotide
  Target: ATXN1; (+) strand; PAM type: YTN; PAM sequence: CTA
ctagcttagctactagctag

SEQ ID NO: 271619 - DNA, 20 bp, Artificial Sequence
  Description of Artificial Sequence: Synthetic oligonucleotide
  Target: ATXN1; (+) strand; PAM type: YTN; PAM sequence: CTA
gcttagctactagctagcag

SEQ ID NO: 271620 - DNA, 20 bp, Artificial Sequence
  Description of Artificial Sequence: Synthetic oligonucleotide
  Target: ATXN1; (+) strand; PAM type: YTN; PAM sequence: CTT
agctactagctagcagtttg

SEQ ID NO: 271621 - DNA, 20 bp, Artificial Sequence
  Description of Artificial Sequence: Synthetic oligonucleotide
  Target: ATXN1; (+) strand; PAM type: YTN; PAM sequence: TTA
gctactagctagcagtttgg

SEQ ID NO: 271622 - DNA, 20 bp, Artificial Sequence
  Description of Artificial Sequence: Synthetic oligonucleotide
  Target: ATXN1; (+) strand; PAM type: YTN; PAM sequence: CTA
ctagctagcagtttgggctg

SEQ ID NO: 271623 - DNA, 20 bp, Artificial Sequence
  Description of Artificial Sequence: Synthetic oligonucleotide
  Target: ATXN1; (+) strand; PAM type: YTN; PAM sequence: CTA
gctagcagtttgggctgctc

SEQ ID NO: 271624 - DNA, 20 bp, Artificial Sequence
  Description of Artificial Sequence: Synthetic oligonucleotide
  Target: ATXN1; (+) strand; PAM type: YTN; PAM sequence: CTA
gcagtttgggctgctcaaaa

SEQ ID NO: 271625 - DNA, 20 bp, Artificial Sequence
  Description of Artificial Sequence: Synthetic oligonucleotide
  Target: ATXN1; (+) strand; PAM type: YTN; PAM sequence: TTT
gggctgctcaaaatgaattt

SEQ ID NO: 271626 - DNA, 20 bp, Artificial Sequence
  Description of Artificial Sequence: Synthetic oligonucleotide
  Target: ATXN1; (+) strand; PAM type: YTN; PAM sequence: TTG
ggctgctcaaaatgaatttc

SEQ ID NO: 271627 - DNA, 20 bp, Artificial Sequence
  Description of Artificial Sequence: Synthetic oligonucleotide
  Target: ATXN1; (+) strand; PAM type: YTN; PAM sequence: CTG
ctcaaaatgaatttcctgga

SEQ ID NO: 271628 - DNA, 20 bp, Artificial Sequence
  Description of Artificial Sequence: Synthetic oligonucleotide
  Target: ATXN1; (+) strand; PAM type: YTN; PAM sequence: CTC
aaaatgaatttcctggataa

SEQ ID NO: 271629 - DNA, 20 bp, Artificial Sequence
  Description of Artificial Sequence: Synthetic oligonucleotide
  Target: ATXN1; (+) strand; PAM type: YTN; PAM sequence: TTT
cctggataattttcctaagc

SEQ ID NO: 271630 - DNA, 20 bp, Artificial Sequence
  Description of Artificial Sequence: Synthetic oligonucleotide
  Target: ATXN1; (+) strand; PAM type: YTN; PAM sequence: TTC
ctggataattttcctaagcc

SEQ ID NO: 271631 - DNA, 20 bp, Artificial Sequence
  Description of Artificial Sequence: Synthetic oligonucleotide
  Target: ATXN1; (+) strand; PAM type: YTN; PAM sequence: CTG
gataattttcctaagccctc

SEQ ID NO: 271632 - DNA, 20 bp, Artificial Sequence
  Description of Artificial Sequence: Synthetic oligonucleotide
  Target: ATXN1; (+) strand; PAM type: YTN; PAM sequence: TTT
tcctaagccctcactgactc

SEQ ID NO: 271633 - DNA, 20 bp, Artificial Sequence
  Description of Artificial Sequence: Synthetic oligonucleotide
  Target: ATXN1; (+) strand; PAM type: YTN; PAM sequence: TTT
cctaagccctcactgactcc

SEQ ID NO: 271634 - DNA, 20 bp, Artificial Sequence
  Description of Artificial Sequence: Synthetic oligonucleotide
  Target: ATXN1; (+) strand; PAM type: YTN; PAM sequence: TTC
ctaagccctcactgactcct

SEQ ID NO: 271635 - DNA, 20 bp, Artificial Sequence
  Description of Artificial Sequence: Synthetic oligonucleotide
  Target: ATXN1; (+) strand; PAM type: YTN; PAM sequence: CTA
agccctcactgactcctact

SEQ ID NO: 271636 - DNA, 20 bp, Artificial Sequence
  Description of Artificial Sequence: Synthetic oligonucleotide
  Target: ATXN1; (+) strand; PAM type: YTN; PAM sequence: CTC
actgactcctactcgcatgt

SEQ ID NO: 271637 - DNA, 20 bp, Artificial Sequence
  Description of Artificial Sequence: Synthetic oligonucleotide
  Target: ATXN1; (+) strand; PAM type: YTN; PAM sequence: CTG
actcctactcgcatgtattg

SEQ ID NO: 271638 - DNA, 20 bp, Artificial Sequence
  Description of Artificial Sequence: Synthetic oligonucleotide
  Target: ATXN1; (+) strand; PAM type: YTN; PAM sequence: CTC
ctactcgcatgtattgctag

SEQ ID NO: 271639 - DNA, 20 bp, Artificial Sequence
  Description of Artificial Sequence: Synthetic oligonucleotide
  Target: ATXN1; (+) strand; PAM type: YTN; PAM sequence: CTA
ctcgcatgtattgctaggag

SEQ ID NO: 271640 - DNA, 20 bp, Artificial Sequence
  Description of Artificial Sequence: Synthetic oligonucleotide
  Target: ATXN1; (+) strand; PAM type: YTN; PAM sequence: CTC
gcatgtattgctaggagcca

SEQ ID NO: 271641 - DNA, 20 bp, Artificial Sequence
  Description of Artificial Sequence: Synthetic oligonucleotide
  Target: ATXN1; (+) strand; PAM type: YTN; PAM sequence: TTG
ctaggagccagctttcactc

SEQ ID NO: 271642 - DNA, 20 bp, Artificial Sequence
  Description of Artificial Sequence: Synthetic oligonucleotide
  Target: ATXN1; (+) strand; PAM type: YTN; PAM sequence: CTA
ggagccagctttcactcctg

SEQ ID NO: 271643 - DNA, 20 bp, Artificial Sequence
  Description of Artificial Sequence: Synthetic oligonucleotide
  Target: ATXN1; (+) strand; PAM type: YTN; PAM sequence: CTT
tcactcctgggactggtttg

SEQ ID NO: 271644 - DNA, 20 bp, Artificial Sequence
  Description of Artificial Sequence: Synthetic oligonucleotide
  Target: ATXN1; (+) strand; PAM type: YTN; PAM sequence: TTT
cactcctgggactggtttgg

SEQ ID NO: 271645 - DNA, 20 bp, Artificial Sequence
  Description of Artificial Sequence: Synthetic oligonucleotide
  Target: ATXN1; (+) strand; PAM type: YTN; PAM sequence: TTC
actcctgggactggtttggg

SEQ ID NO: 271646 - DNA, 20 bp, Artificial Sequence
  Description of Artificial Sequence: Synthetic oligonucleotide
  Target: ATXN1; (+) strand; PAM type: YTN; PAM sequence: CTC
ctgggactggtttgggcttc

SEQ ID NO: 271647 - DNA, 20 bp, Artificial Sequence
  Description of Artificial Sequence: Synthetic oligonucleotide
  Target: ATXN1; (+) strand; PAM type: YTN; PAM sequence: CTG
ggactggtttgggcttccag

SEQ ID NO: 271648 - DNA, 20 bp, Artificial Sequence
  Description of Artificial Sequence: Synthetic oligonucleotide
  Target: ATXN1; (+) strand; PAM type: YTN; PAM sequence: CTG
gtttgggcttccagaaagca

SEQ ID NO: 271649 - DNA, 20 bp, Artificial Sequence
  Description of Artificial Sequence: Synthetic oligonucleotide
  Target: ATXN1; (+) strand; PAM type: YTN; PAM sequence: TTT
gggcttccagaaagcatgcc

SEQ ID NO: 271650 - DNA, 20 bp, Artificial Sequence
  Description of Artificial Sequence: Synthetic oligonucleotide
  Target: ATXN1; (+) strand; PAM type: YTN; PAM sequence: TTG
ggcttccagaaagcatgcct

SEQ ID NO: 271651 - DNA, 20 bp, Artificial Sequence
  Description of Artificial Sequence: Synthetic oligonucleotide
  Target: ATXN1; (+) strand; PAM type: YTN; PAM sequence: CTT
ccagaaagcatgccttgtaa

SEQ ID NO: 271652 - DNA, 20 bp, Artificial Sequence
  Description of Artificial Sequence: Synthetic oligonucleotide
  Target: ATXN1; (+) strand; PAM type: YTN; PAM sequence: TTC
cagaaagcatgccttgtaaa

SEQ ID NO: 271653 - DNA, 20 bp, Artificial Sequence
  Description of Artificial Sequence: Synthetic oligonucleotide
  Target: ATXN1; (+) strand; PAM type: YTN; PAM sequence: CTT
gtaaagaacagggcctgtgt

SEQ ID NO: 271654 - DNA, 20 bp, Artificial Sequence
  Description of Artificial Sequence: Synthetic oligonucleotide
  Target: ATXN1; (+) strand; PAM type: YTN; PAM sequence: TTG
taaagaacagggcctgtgtg

SEQ ID NO: 271655 - DNA, 20 bp, Artificial Sequence
  Description of Artificial Sequence: Synthetic oligonucleotide
  Target: ATXN1; (+) strand; PAM type: YTN; PAM sequence: CTG
tgtgtcaaacagcctgtata

SEQ ID NO: 271656 - DNA, 20 bp, Artificial Sequence
  Description of Artificial Sequence: Synthetic oligonucleotide
  Target: ATXN1; (+) strand; PAM type: YTN; PAM sequence: CTG
tatacaacacacatagctta

SEQ ID NO: 271657 - DNA, 20 bp, Artificial Sequence
  Description of Artificial Sequence: Synthetic oligonucleotide
  Target: ATXN1; (+) strand; PAM type: YTN; PAM sequence: CTT
atatatgacaaccatgtgat

SEQ ID NO: 271658 - DNA, 20 bp, Artificial Sequence
  Description of Artificial Sequence: Synthetic oligonucleotide
  Target: ATXN1; (+) strand; PAM type: YTN; PAM sequence: TTA
tatatgacaaccatgtgatt

SEQ ID NO: 271659 - DNA, 20 bp, Artificial Sequence
  Description of Artificial Sequence: Synthetic oligonucleotide
  Target: ATXN1; (+) strand; PAM type: YTN; PAM sequence: TTT
ttgtcattttaacatttctg

SEQ ID NO: 271660 - DNA, 20 bp, Artificial Sequence
  Description of Artificial Sequence: Synthetic oligonucleotide
  Target: ATXN1; (+) strand; PAM type: YTN; PAM sequence: TTT
tgtcattttaacatttctga

SEQ ID NO: 271661 - DNA, 20 bp, Artificial Sequence
  Description of Artificial Sequence: Synthetic oligonucleotide
  Target: ATXN1; (+) strand; PAM type: YTN; PAM sequence: TTT
gtcattttaacatttctgaa

SEQ ID NO: 271662 - DNA, 20 bp, Artificial Sequence
  Description of Artificial Sequence: Synthetic oligonucleotide
  Target: ATXN1; (+) strand; PAM type: YTN; PAM sequence: TTG
tcattttaacatttctgaac

SEQ ID NO: 271663 - DNA, 20 bp, Artificial Sequence
  Description of Artificial Sequence: Synthetic oligonucleotide
  Target: ATXN1; (+) strand; PAM type: YTN; PAM sequence: TTT
taacatttctgaactcagga

SEQ ID NO: 271664 - DNA, 20 bp, Artificial Sequence
  Description of Artificial Sequence: Synthetic oligonucleotide
  Target: ATXN1; (+) strand; PAM type: YTN; PAM sequence: TTT
aacatttctgaactcaggac

SEQ ID NO: 271665 - DNA, 20 bp, Artificial Sequence
  Description of Artificial Sequence: Synthetic oligonucleotide
  Target: ATXN1; (+) strand; PAM type: YTN; PAM sequence: TTA
acatttctgaactcaggact

SEQ ID NO: 271666 - DNA, 20 bp, Artificial Sequence
  Description of Artificial Sequence: Synthetic oligonucleotide
  Target: ATXN1; (+) strand; PAM type: YTN; PAM sequence: TTT
ctgaactcaggacttatttt

SEQ ID NO: 271667 - DNA, 20 bp, Artificial Sequence
  Description of Artificial Sequence: Synthetic oligonucleotide
  Target: ATXN1; (+) strand; PAM type: YTN; PAM sequence: TTC
tgaactcaggacttatttta

SEQ ID NO: 271668 - DNA, 20 bp, Artificial Sequence
  Description of Artificial Sequence: Synthetic oligonucleotide
  Target: ATXN1; (+) strand; PAM type: YTN; PAM sequence: CTG
aactcaggacttattttata

SEQ ID NO: 271669 - DNA, 20 bp, Artificial Sequence
  Description of Artificial Sequence: Synthetic oligonucleotide
  Target: ATXN1; (+) strand; PAM type: YTN; PAM sequence: CTC
aggacttattttatatatga

SEQ ID NO: 271670 - DNA, 20 bp, Artificial Sequence
  Description of Artificial Sequence: Synthetic oligonucleotide
  Target: ATXN1; (+) strand; PAM type: YTN; PAM sequence: CTT
attttatatatgattggtac

SEQ ID NO: 271671 - DNA, 20 bp, Artificial Sequence
  Description of Artificial Sequence: Synthetic oligonucleotide
  Target: ATXN1; (+) strand; PAM type: YTN; PAM sequence: TTA
ttttatatatgattggtaca

SEQ ID NO: 271672 - DNA, 20 bp, Artificial Sequence
  Description of Artificial Sequence: Synthetic oligonucleotide
  Target: ATXN1; (+) strand; PAM type: YTN; PAM sequence: TTT
tatatatgattggtacataa

SEQ ID NO: 271673 - DNA, 20 bp, Artificial Sequence
  Description of Artificial Sequence: Synthetic oligonucleotide
  Target: ATXN1; (+) strand; PAM type: YTN; PAM sequence: TTT
atatatgattggtacataaa

SEQ ID NO: 271674 - DNA, 20 bp, Artificial Sequence
  Description of Artificial Sequence: Synthetic oligonucleotide
  Target: ATXN1; (+) strand; PAM type: YTN; PAM sequence: TTA
tatatgattggtacataaaa

SEQ ID NO: 271675 - DNA, 20 bp, Artificial Sequence
  Description of Artificial Sequence: Synthetic oligonucleotide
  Target: ATXN1; (+) strand; PAM type: YTN; PAM sequence: TTG
gtacataaaagagtggtagc

SEQ ID NO: 271676 - DNA, 20 bp, Artificial Sequence
  Description of Artificial Sequence: Synthetic oligonucleotide
  Target: ATXN1; (+) strand; PAM type: YTN; PAM sequence: CTA
atcatttaatctacagtgca

SEQ ID NO: 271677 - DNA, 20 bp, Artificial Sequence
  Description of Artificial Sequence: Synthetic oligonucleotide
  Target: ATXN1; (+) strand; PAM type: YTN; PAM sequence: TTT
aatctacagtgcatattatc

SEQ ID NO: 271678 - DNA, 20 bp, Artificial Sequence
  Description of Artificial Sequence: Synthetic oligonucleotide
  Target: ATXN1; (+) strand; PAM type: YTN; PAM sequence: TTA
atctacagtgcatattatca

SEQ ID NO: 271679 - DNA, 20 bp, Artificial Sequence
  Description of Artificial Sequence: Synthetic oligonucleotide
  Target: ATXN1; (+) strand; PAM type: YTN; PAM sequence: CTA
cagtgcatattatcatcagt

SEQ ID NO: 271680 - DNA, 20 bp, Artificial Sequence
  Description of Artificial Sequence: Synthetic oligonucleotide
  Target: ATXN1; (+) strand; PAM type: YTN; PAM sequence: TTA
tcatcagtgacactacagaa

SEQ ID NO: 271681 - DNA, 20 bp, Artificial Sequence
  Description of Artificial Sequence: Synthetic oligonucleotide
  Target: ATXN1; (+) strand; PAM type: YTN; PAM sequence: CTA
cagaaatcaaagaaaactgg

SEQ ID NO: 271682 - DNA, 20 bp, Artificial Sequence
  Description of Artificial Sequence: Synthetic oligonucleotide
  Target: ATXN1; (+) strand; PAM type: YTN; PAM sequence: CTG
gtatctatttcatatttgca

SEQ ID NO: 271683 - DNA, 20 bp, Artificial Sequence
  Description of Artificial Sequence: Synthetic oligonucleotide
  Target: ATXN1; (+) strand; PAM type: YTN; PAM sequence: CTA
tttcatatttgcacagaatc

SEQ ID NO: 271684 - DNA, 20 bp, Artificial Sequence
  Description of Artificial Sequence: Synthetic oligonucleotide
  Target: ATXN1; (+) strand; PAM type: YTN; PAM sequence: TTT
catatttgcacagaatcgtt

SEQ ID NO: 271685 - DNA, 20 bp, Artificial Sequence
  Description of Artificial Sequence: Synthetic oligonucleotide
  Target: ATXN1; (+) strand; PAM type: YTN; PAM sequence: TTC
atatttgcacagaatcgttt

SEQ ID NO: 271686 - DNA, 20 bp, Artificial Sequence
  Description of Artificial Sequence: Synthetic oligonucleotide
  Target: ATXN1; (+) strand; PAM type: YTN; PAM sequence: TTT
gcacagaatcgtttttaatt

SEQ ID NO: 271687 - DNA, 20 bp, Artificial Sequence
  Description of Artificial Sequence: Synthetic oligonucleotide
  Target: ATXN1; (+) strand; PAM type: YTN; PAM sequence: TTG
cacagaatcgtttttaattt

SEQ ID NO: 271688 - DNA, 20 bp, Artificial Sequence
  Description of Artificial Sequence: Synthetic oligonucleotide
  Target: ATXN1; (+) strand; PAM type: YTN; PAM sequence: TTT
ttaattttaaatgtttttca

SEQ ID NO: 271689 - DNA, 20 bp, Artificial Sequence
  Description of Artificial Sequence: Synthetic oligonucleotide
  Target: ATXN1; (+) strand; PAM type: YTN; PAM sequence: TTT
taattttaaatgtttttcat

SEQ ID NO: 271690 - DNA, 20 bp, Artificial Sequence
  Description of Artificial Sequence: Synthetic oligonucleotide
  Target: ATXN1; (+) strand; PAM type: YTN; PAM sequence: TTT
aattttaaatgtttttcata

SEQ ID NO: 271691 - DNA, 20 bp, Artificial Sequence
  Description of Artificial Sequence: Synthetic oligonucleotide
  Target: ATXN1; (+) strand; PAM type: YTN; PAM sequence: TTA
attttaaatgtttttcatat

SEQ ID NO: 271692 - DNA, 20 bp, Artificial Sequence
  Description of Artificial Sequence: Synthetic oligonucleotide
  Target: ATXN1; (+) strand; PAM type: YTN; PAM sequence: TTT
taaatgtttttcatataatg

SEQ ID NO: 271693 - DNA, 20 bp, Artificial Sequence
  Description of Artificial Sequence: Synthetic oligonucleotide
  Target: ATXN1; (+) strand; PAM type: YTN; PAM sequence: TTT
aaatgtttttcatataatga

SEQ ID NO: 271694 - DNA, 20 bp, Artificial Sequence
  Description of Artificial Sequence: Synthetic oligonucleotide
  Target: ATXN1; (+) strand; PAM type: YTN; PAM sequence: TTA
aatgtttttcatataatgat

SEQ ID NO: 271695 - DNA, 20 bp, Artificial Sequence
  Description of Artificial Sequence: Synthetic oligonucleotide
  Target: ATXN1; (+) strand; PAM type: YTN; PAM sequence: TTT
ttcatataatgatcacattg

SEQ ID NO: 271696 - DNA, 20 bp, Artificial Sequence
  Description of Artificial Sequence: Synthetic oligonucleotide
  Target: ATXN1; (+) strand; PAM type: YTN; PAM sequence: TTT
tcatataatgatcacattgc

SEQ ID NO: 271697 - DNA, 20 bp, Artificial Sequence
  Description of Artificial Sequence: Synthetic oligonucleotide
  Target: ATXN1; (+) strand; PAM type: YTN; PAM sequence: TTT
catataatgatcacattgcc

SEQ ID NO: 271698 - DNA, 20 bp, Artificial Sequence
  Description of Artificial Sequence: Synthetic oligonucleotide
  Target: ATXN1; (+) strand; PAM type: YTN; PAM sequence: TTC
atataatgatcacattgcca

SEQ ID NO: 271699 - DNA, 20 bp, Artificial Sequence
  Description of Artificial Sequence: Synthetic oligonucleotide
  Target: ATXN1; (+) strand; PAM type: YTN; PAM sequence: TTG
ccaatctcacacttggagaa

SEQ ID NO: 271700 - DNA, 20 bp, Artificial Sequence
  Description of Artificial Sequence: Synthetic oligonucleotide
  Target: ATXN1; (+) strand; PAM type: YTN; PAM sequence: CTC
acacttggagaagcaaaaag

SEQ ID NO: 271701 - DNA, 20 bp, Artificial Sequence
  Description of Artificial Sequence: Synthetic oligonucleotide
  Target: ATXN1; (+) strand; PAM type: YTN; PAM sequence: CTT
ggagaagcaaaaagcaaaga

SEQ ID NO: 271702 - DNA, 20 bp, Artificial Sequence
  Description of Artificial Sequence: Synthetic oligonucleotide
  Target: ATXN1; (+) strand; PAM type: YTN; PAM sequence: TTG
gagaagcaaaaagcaaagaa

SEQ ID NO: 271703 - DNA, 20 bp, Artificial Sequence
  Description of Artificial Sequence: Synthetic oligonucleotide
  Target: ATXN1; (+) strand; PAM type: YTN; PAM sequence: CTT
gaaaagggtgacaagtcact

SEQ ID NO: 271704 - DNA, 20 bp, Artificial Sequence
  Description of Artificial Sequence: Synthetic oligonucleotide
  Target: ATXN1; (+) strand; PAM type: YTN; PAM sequence: TTG
aaaagggtgacaagtcactc

SEQ ID NO: 271705 - DNA, 20 bp, Artificial Sequence
  Description of Artificial Sequence: Synthetic oligonucleotide
  Target: ATXN1; (+) strand; PAM type: YTN; PAM sequence: CTC
aggtgaatgggatgaggcca

SEQ ID NO: 271706 - DNA, 20 bp, Artificial Sequence
  Description of Artificial Sequence: Synthetic oligonucleotide
  Target: ATXN1; (+) strand; PAM type: YTN; PAM sequence: CTG
gatctgacgtgaactgctcc

SEQ ID NO: 271707 - DNA, 20 bp, Artificial Sequence
  Description of Artificial Sequence: Synthetic oligonucleotide
  Target: ATXN1; (+) strand; PAM type: YTN; PAM sequence: CTG
acgtgaactgctccccacaa

SEQ ID NO: 271708 - DNA, 20 bp, Artificial Sequence
  Description of Artificial Sequence: Synthetic oligonucleotide
  Target: ATXN1; (+) strand; PAM type: YTN; PAM sequence: CTG
ctccccacaaagacctctcc

SEQ ID NO: 271709 - DNA, 20 bp, Artificial Sequence
  Description of Artificial Sequence: Synthetic oligonucleotide
  Target: ATXN1; (+) strand; PAM type: YTN; PAM sequence: CTC
cccacaaagacctctccacg

SEQ ID NO: 271710 - DNA, 20 bp, Artificial Sequence
  Description of Artificial Sequence: Synthetic oligonucleotide
  Target: ATXN1; (+) strand; PAM type: YTN; PAM sequence: CTC
tccacggcgctcagcctcag

SEQ ID NO: 271711 - DNA, 20 bp, Artificial Sequence
  Description of Artificial Sequence: Synthetic oligonucleotide
  Target: ATXN1; (+) strand; PAM type: YTN; PAM sequence: CTC
cacggcgctcagcctcagac

SEQ ID NO: 271712 - DNA, 20 bp, Artificial Sequence
  Description of Artificial Sequence: Synthetic oligonucleotide
  Target: ATXN1; (+) strand; PAM type: YTN; PAM sequence: CTC
agcctcagactcccctcatg

SEQ ID NO: 271713 - DNA, 20 bp, Artificial Sequence
  Description of Artificial Sequence: Synthetic oligonucleotide
  Target: ATXN1; (+) strand; PAM type: YTN; PAM sequence: CTC
agactcccctcatgtgtaaa

SEQ ID NO: 271714 - DNA, 20 bp, Artificial Sequence
  Description of Artificial Sequence: Synthetic oligonucleotide
  Target: ATXN1; (+) strand; PAM type: YTN; PAM sequence: CTC
ccctcatgtgtaaaataaca

SEQ ID NO: 271715 - DNA, 20 bp, Artificial Sequence
  Description of Artificial Sequence: Synthetic oligonucleotide
  Target: ATXN1; (+) strand; PAM type: YTN; PAM sequence: CTC
atgtgtaaaataacacaggg

SEQ ID NO: 271716 - DNA, 20 bp, Artificial Sequence
  Description of Artificial Sequence: Synthetic oligonucleotide
  Target: ATXN1; (+) strand; PAM type: YTN; PAM sequence: TTA
aaccagtgttaagctgttcc

SEQ ID NO: 271717 - DNA, 20 bp, Artificial Sequence
  Description of Artificial Sequence: Synthetic oligonucleotide
  Target: ATXN1; (+) strand; PAM type: YTN; PAM sequence: TTA
agctgttcctgacgtgcttc

SEQ ID NO: 271718 - DNA, 20 bp, Artificial Sequence
  Description of Artificial Sequence: Synthetic oligonucleotide
  Target: ATXN1; (+) strand; PAM type: YTN; PAM sequence: CTG
ttcctgacgtgcttcctgca

SEQ ID NO: 271719 - DNA, 20 bp, Artificial Sequence
  Description of Artificial Sequence: Synthetic oligonucleotide
  Target: ATXN1; (+) strand; PAM type: YTN; PAM sequence: TTC
ctgacgtgcttcctgcacca

SEQ ID NO: 271720 - DNA, 20 bp, Artificial Sequence
  Description of Artificial Sequence: Synthetic oligonucleotide
  Target: ATXN1; (+) strand; PAM type: YTN; PAM sequence: CTG
acgtgcttcctgcaccaaca

SEQ ID NO: 271721 - DNA, 20 bp, Artificial Sequence
  Description of Artificial Sequence: Synthetic oligonucleotide
  Target: ATXN1; (+) strand; PAM type: YTN; PAM sequence: CTT
cctgcaccaacattcaacca

SEQ ID NO: 271722 - DNA, 20 bp, Artificial Sequence
  Description of Artificial Sequence: Synthetic oligonucleotide
  Target: ATXN1; (+) strand; PAM type: YTN; PAM sequence: TTC
ctgcaccaacattcaaccag

SEQ ID NO: 271723 - DNA, 20 bp, Artificial Sequence
  Description of Artificial Sequence: Synthetic oligonucleotide
  Target: ATXN1; (+) strand; PAM type: YTN; PAM sequence: CTG
caccaacattcaaccagctc

SEQ ID NO: 271724 - DNA, 20 bp, Artificial Sequence
  Description of Artificial Sequence: Synthetic oligonucleotide
  Target: ATXN1; (+) strand; PAM type: YTN; PAM sequence: TTC
aaccagctctctgaccttct

SEQ ID NO: 271725 - DNA, 20 bp, Artificial Sequence
  Description of Artificial Sequence: Synthetic oligonucleotide
  Target: ATXN1; (+) strand; PAM type: YTN; PAM sequence: CTC
tctgaccttcttacgaggct

SEQ ID NO: 271726 - DNA, 20 bp, Artificial Sequence
  Description of Artificial Sequence: Synthetic oligonucleotide
  Target: ATXN1; (+) strand; PAM type: YTN; PAM sequence: CTC
tgaccttcttacgaggctca

SEQ ID NO: 271727 - DNA, 20 bp, Artificial Sequence
  Description of Artificial Sequence: Synthetic oligonucleotide
  Target: ATXN1; (+) strand; PAM type: YTN; PAM sequence: CTG
accttcttacgaggctcagg

SEQ ID NO: 271728 - DNA, 20 bp, Artificial Sequence
  Description of Artificial Sequence: Synthetic oligonucleotide
  Target: ATXN1; (+) strand; PAM type: YTN; PAM sequence: CTT
cttacgaggctcaggagtcc

SEQ ID NO: 271729 - DNA, 20 bp, Artificial Sequence
  Description of Artificial Sequence: Synthetic oligonucleotide
  Target: ATXN1; (+) strand; PAM type: YTN; PAM sequence: TTC
ttacgaggctcaggagtcct

SEQ ID NO: 271730 - DNA, 20 bp, Artificial Sequence
  Description of Artificial Sequence: Synthetic oligonucleotide
  Target: ATXN1; (+) strand; PAM type: YTN; PAM sequence: CTT
acgaggctcaggagtcctcc

SEQ ID NO: 271731 - DNA, 20 bp, Artificial Sequence
  Description of Artificial Sequence: Synthetic oligonucleotide
  Target: ATXN1; (+) strand; PAM type: YTN; PAM sequence: TTA
cgaggctcaggagtcctcct

SEQ ID NO: 271732 - DNA, 20 bp, Artificial Sequence
  Description of Artificial Sequence: Synthetic oligonucleotide
  Target: ATXN1; (+) strand; PAM type: YTN; PAM sequence: CTC
aggagtcctcctgggggaaa

SEQ ID NO: 271733 - DNA, 20 bp, Artificial Sequence
  Description of Artificial Sequence: Synthetic oligonucleotide
  Target: ATXN1; (+) strand; PAM type: YTN; PAM sequence: CTC
ctgggggaaagagctgcaac

SEQ ID NO: 271734 - DNA, 20 bp, Artificial Sequence
  Description of Artificial Sequence: Synthetic oligonucleotide
  Target: ATXN1; (+) strand; PAM type: YTN; PAM sequence: CTG
ggggaaagagctgcaacacc

SEQ ID NO: 271735 - DNA, 20 bp, Artificial Sequence
  Description of Artificial Sequence: Synthetic oligonucleotide
  Target: ATXN1; (+) strand; PAM type: YTN; PAM sequence: CTG
caacacctgctattctactt

SEQ ID NO: 271736 - DNA, 20 bp, Artificial Sequence
  Description of Artificial Sequence: Synthetic oligonucleotide
  Target: ATXN1; (+) strand; PAM type: YTN; PAM sequence: CTG
ctattctactttgcatggtt

SEQ ID NO: 271737 - DNA, 20 bp, Artificial Sequence
  Description of Artificial Sequence: Synthetic oligonucleotide
  Target: ATXN1; (+) strand; PAM type: YTN; PAM sequence: CTA
ttctactttgcatggttggt

SEQ ID NO: 271738 - DNA, 20 bp, Artificial Sequence
  Description of Artificial Sequence: Synthetic oligonucleotide
  Target: ATXN1; (+) strand; PAM type: YTN; PAM sequence: TTC
tactttgcatggttggttca

SEQ ID NO: 271739 - DNA, 20 bp, Artificial Sequence
  Description of Artificial Sequence: Synthetic oligonucleotide
  Target: ATXN1; (+) strand; PAM type: YTN; PAM sequence: CTA
ctttgcatggttggttcagg

SEQ ID NO: 271740 - DNA, 20 bp, Artificial Sequence
  Description of Artificial Sequence: Synthetic oligonucleotide
  Target: ATXN1; (+) strand; PAM type: YTN; PAM sequence: CTT
tgcatggttggttcaggctc

SEQ ID NO: 271741 - DNA, 20 bp, Artificial Sequence
  Description of Artificial Sequence: Synthetic oligonucleotide
  Target: ATXN1; (+) strand; PAM type: YTN; PAM sequence: TTT
gcatggttggttcaggctct

SEQ ID NO: 271742 - DNA, 20 bp, Artificial Sequence
  Description of Artificial Sequence: Synthetic oligonucleotide
  Target: ATXN1; (+) strand; PAM type: YTN; PAM sequence: TTG
catggttggttcaggctcta

SEQ ID NO: 271743 - DNA, 20 bp, Artificial Sequence
  Description of Artificial Sequence: Synthetic oligonucleotide
  Target: ATXN1; (+) strand; PAM type: YTN; PAM sequence: TTG
gttcaggctctagaaaatag

SEQ ID NO: 271744 - DNA, 20 bp, Artificial Sequence
  Description of Artificial Sequence: Synthetic oligonucleotide
  Target: ATXN1; (+) strand; PAM type: YTN; PAM sequence: TTC
aggctctagaaaatagcaag

SEQ ID NO: 271745 - DNA, 20 bp, Artificial Sequence
  Description of Artificial Sequence: Synthetic oligonucleotide
  Target: ATXN1; (+) strand; PAM type: YTN; PAM sequence: CTC
tagaaaatagcaagagccca

SEQ ID NO: 271746 - DNA, 20 bp, Artificial Sequence
  Description of Artificial Sequence: Synthetic oligonucleotide
  Target: ATXN1; (+) strand; PAM type: YTN; PAM sequence: CTA
gaaaatagcaagagcccacc

SEQ ID NO: 271747 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctgcaatcagc

SEQ ID NO: 271748 - DNA, 20 bp, Artificial Sequence
  Description of Artificial Sequence: Synthetic oligonucleotide
  Target: ATXN1; (+) strand; PAM type: YTN; PAM sequence: CTC
ctcctcctgcaatcagctct

SEQ ID NO: 271749 - DNA, 20 bp, Artificial Sequence
  Description of Artificial Sequence: Synthetic oligonucleotide
  Target: ATXN1; (+) strand; PAM type: YTN; PAM sequence: CTC
ctcctgcaatcagctctcct

SEQ ID NO: 271750 - DNA, 20 bp, Artificial Sequence
  Description of Artificial Sequence: Synthetic oligonucleotide
  Target: ATXN1; (+) strand; PAM type: YTN; PAM sequence: CTC
ctgcaatcagctctcctgtt

SEQ ID NO: 271751 - DNA, 20 bp, Artificial Sequence
  Description of Artificial Sequence: Synthetic oligonucleotide
  Target: ATXN1; (+) strand; PAM type: YTN; PAM sequence: CTG
caatcagctctcctgtttcc

SEQ ID NO: 271752 - DNA, 20 bp, Artificial Sequence
  Description of Artificial Sequence: Synthetic oligonucleotide
  Target: ATXN1; (+) strand; PAM type: YTN; PAM sequence: CTC
tcctgtttcctttttttttt

SEQ ID NO: 271753 - DNA, 20 bp, Artificial Sequence
  Description of Artificial Sequence: Synthetic oligonucleotide
  Target: ATXN1; (+) strand; PAM type: YTN; PAM sequence: CTC
ctgtttcctttttttttttt

SEQ ID NO: 271754 - DNA, 20 bp, Artificial Sequence
  Description of Artificial Sequence: Synthetic oligonucleotide
  Target: ATXN1; (+) strand; PAM type: YTN; PAM sequence: CTG
tttccttttttttttttttt

SEQ ID NO: 271755 - DNA, 20 bp, Artificial Sequence
  Description of Artificial Sequence: Synthetic oligonucleotide
  Target: ATXN1; (+) strand; PAM type: YTN; PAM sequence: TTT
ccttttttttttttttttta

SEQ ID NO: 271756 - DNA, 20 bp, Artificial Sequence
  Description of Artificial Sequence: Synthetic oligonucleotide
  Target: ATXN1; (+) strand; PAM type: YTN; PAM sequence: TTC
ctttttttttttttttttag

SEQ ID NO: 271757 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttagctt

SEQ ID NO: 271758 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttagcttt

SEQ ID NO: 271759 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttagcttta

SEQ ID NO: 271760 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttagctttag

SEQ ID NO: 271761 - DNA, 20 bp, Artificial Sequence
  Description of Artificial Sequence: Synthetic oligonucleotide
  Target: ATXN1; (+) strand; PAM type: YTN; PAM sequence: TTT
tttttttttttagctttagc

SEQ ID NO: 271762 - DNA, 20 bp, Artificial Sequence
  Description of Artificial Sequence: Synthetic oligonucleotide
  Target: ATXN1; (+) strand; PAM type: YTN; PAM sequence: TTT
ttttttttttagctttagct

SEQ ID NO: 271763 - DNA, 20 bp, Artificial Sequence
  Description of Artificial Sequence: Synthetic oligonucleotide
  Target: ATXN1; (+) strand; PAM type: YTN; PAM sequence: TTT
tttttttttagctttagctc

SEQ ID NO: 271764 - DNA, 20 bp, Artificial Sequence
  Description of Artificial Sequence: Synthetic oligonucleotide
  Target: ATXN1; (+) strand; PAM type: YTN; PAM sequence: TTT
ttttttttagctttagctct

SEQ ID NO: 271765 - DNA, 20 bp, Artificial Sequence
  Description of Artificial Sequence: Synthetic oligonucleotide
  Target: ATXN1; (+) strand; PAM type: YTN; PAM sequence: TTT
tttttttagctttagctcta

SEQ ID NO: 271766 - DNA, 20 bp, Artificial Sequence
  Description of Artificial Sequence: Synthetic oligonucleotide
  Target: ATXN1; (+) strand; PAM type: YTN; PAM sequence: TTT
ttttttagctttagctctac

SEQ ID NO: 271767 - DNA, 20 bp, Artificial Sequence
  Description of Artificial Sequence: Synthetic oligonucleotide
  Target: ATXN1; (+) strand; PAM type: YTN; PAM sequence: TTT
tttttagctttagctctact

SEQ ID NO: 271768 - DNA, 20 bp, Artificial Sequence
  Description of Artificial Sequence: Synthetic oligonucleotide
  Target: ATXN1; (+) strand; PAM type: YTN; PAM sequence: TTT
ttttagctttagctctactt

SEQ ID NO: 271769 - DNA, 20 bp, Artificial Sequence
  Description of Artificial Sequence: Synthetic oligonucleotide
  Target: ATXN1; (+) strand; PAM type: YTN; PAM sequence: TTT
tttagctttagctctacttc

SEQ ID NO: 271770 - DNA, 20 bp, Artificial Sequence
  Description of Artificial Sequence: Synthetic oligonucleotide
  Target: ATXN1; (+) strand; PAM type: YTN; PAM sequence: TTT
ttagctttagctctacttct

SEQ ID NO: 271771 - DNA, 20 bp, Artificial Sequence
  Description of Artificial Sequence: Synthetic oligonucleotide
  Target: ATXN1; (+) strand; PAM type: YTN; PAM sequence: TTT
tagctttagctctacttcta

SEQ ID NO: 271772 - DNA, 20 bp, Artificial Sequence
  Description of Artificial Sequence: Synthetic oligonucleotide
  Target: ATXN1; (+) strand; PAM type: YTN; PAM sequence: TTT
agctttagctctacttctat

SEQ ID NO: 271773 - DNA, 20 bp, Artificial Sequence
  Description of Artificial Sequence: Synthetic oligonucleotide
  Target: ATXN1; (+) strand; PAM type: YTN; PAM sequence: TTA
gctttagctctacttctatt

SEQ ID NO: 271774 - DNA, 20 bp, Artificial Sequence
  Description of Artificial Sequence: Synthetic oligonucleotide
  Target: ATXN1; (+) strand; PAM type: YTN; PAM sequence: CTT
tagctctacttctattttcc

SEQ ID NO: 271775 - DNA, 20 bp, Artificial Sequence
  Description of Artificial Sequence: Synthetic oligonucleotide
  Target: ATXN1; (+) strand; PAM type: YTN; PAM sequence: TTT
agctctacttctattttcca

SEQ ID NO: 271776 - DNA, 20 bp, Artificial Sequence
  Description of Artificial Sequence: Synthetic oligonucleotide
  Target: ATXN1; (+) strand; PAM type: YTN; PAM sequence: TTA
gctctacttctattttccaa

SEQ ID NO: 271777 - DNA, 20 bp, Artificial Sequence
  Description of Artificial Sequence: Synthetic oligonucleotide
  Target: ATXN1; (+) strand; PAM type: YTN; PAM sequence: CTC
tacttctattttccaactgg

SEQ ID NO: 271778 - DNA, 20 bp, Artificial Sequence
  Description of Artificial Sequence: Synthetic oligonucleotide
  Target: ATXN1; (+) strand; PAM type: YTN; PAM sequence: CTA
cttctattttccaactggga

SEQ ID NO: 271779 - DNA, 20 bp, Artificial Sequence
  Description of Artificial Sequence: Synthetic oligonucleotide
  Target: ATXN1; (+) strand; PAM type: YTN; PAM sequence: CTT
ctattttccaactgggatca

SEQ ID NO: 271780 - DNA, 20 bp, Artificial Sequence
  Description of Artificial Sequence: Synthetic oligonucleotide
  Target: ATXN1; (+) strand; PAM type: YTN; PAM sequence: TTC
tattttccaactgggatcat

SEQ ID NO: 271781 - DNA, 20 bp, Artificial Sequence
  Description of Artificial Sequence: Synthetic oligonucleotide
  Target: ATXN1; (+) strand; PAM type: YTN; PAM sequence: CTA
ttttccaactgggatcatgg

SEQ ID NO: 271782 - DNA, 20 bp, Artificial Sequence
  Description of Artificial Sequence: Synthetic oligonucleotide
  Target: ATXN1; (+) strand; PAM type: YTN; PAM sequence: TTT
tccaactgggatcatggcta

SEQ ID NO: 271783 - DNA, 20 bp, Artificial Sequence
  Description of Artificial Sequence: Synthetic oligonucleotide
  Target: ATXN1; (+) strand; PAM type: YTN; PAM sequence: TTT
ccaactgggatcatggctac

SEQ ID NO: 271784 - DNA, 20 bp, Artificial Sequence
  Description of Artificial Sequence: Synthetic oligonucleotide
  Target: ATXN1; (+) strand; PAM type: YTN; PAM sequence: TTC
caactgggatcatggctact

SEQ ID NO: 271785 - DNA, 20 bp, Artificial Sequence
  Description of Artificial Sequence: Synthetic oligonucleotide
  Target: ATXN1; (+) strand; PAM type: YTN; PAM sequence: CTG
ggatcatggctactgccttc

SEQ ID NO: 271786 - DNA, 20 bp, Artificial Sequence
  Description of Artificial Sequence: Synthetic oligonucleotide
  Target: ATXN1; (+) strand; PAM type: YTN; PAM sequence: CTA
ctgccttctactactcagca

SEQ ID NO: 271787 - DNA, 20 bp, Artificial Sequence
  Description of Artificial Sequence: Synthetic oligonucleotide
  Target: ATXN1; (+) strand; PAM type: YTN; PAM sequence: CTG
ccttctactactcagcagct

SEQ ID NO: 271788 - DNA, 20 bp, Artificial Sequence
  Description of Artificial Sequence: Synthetic oligonucleotide
  Target: ATXN1; (+) strand; PAM type: YTN; PAM sequence: CTT
ctactactcagcagctaatt

SEQ ID NO: 271789 - DNA, 20 bp, Artificial Sequence
  Description of Artificial Sequence: Synthetic oligonucleotide
  Target: ATXN1; (+) strand; PAM type: YTN; PAM sequence: TTC
tactactcagcagctaatta

SEQ ID NO: 271790 - DNA, 20 bp, Artificial Sequence
  Description of Artificial Sequence: Synthetic oligonucleotide
  Target: ATXN1; (+) strand; PAM type: YTN; PAM sequence: CTA
ctactcagcagctaattaca

SEQ ID NO: 271791 - DNA, 20 bp, Artificial Sequence
  Description of Artificial Sequence: Synthetic oligonucleotide
  Target: ATXN1; (+) strand; PAM type: YTN; PAM sequence: CTA
ctcagcagctaattacacac

SEQ ID NO: 271792 - DNA, 20 bp, Artificial Sequence
  Description of Artificial Sequence: Synthetic oligonucleotide
  Target: ATXN1; (+) strand; PAM type: YTN; PAM sequence: CTC
agcagctaattacacacacc

SEQ ID NO: 271793 - DNA, 20 bp, Artificial Sequence
  Description of Artificial Sequence: Synthetic oligonucleotide
  Target: ATXN1; (+) strand; PAM type: YTN; PAM sequence: CTA
attacacacaccctccgagg

SEQ ID NO: 271794 - DNA, 20 bp, Artificial Sequence
  Description of Artificial Sequence: Synthetic oligonucleotide
  Target: ATXN1; (+) strand; PAM type: YTN; PAM sequence: TTA
cacacaccctccgaggaacg

SEQ ID NO: 271795 - DNA, 20 bp, Artificial Sequence
  Description of Artificial Sequence: Synthetic oligonucleotide
  Target: ATXN1; (+) strand; PAM type: YTN; PAM sequence: CTC
cgaggaacgtaggccactga

SEQ ID NO: 271796 - DNA, 20 bp, Artificial Sequence
  Description of Artificial Sequence: Synthetic oligonucleotide
  Target: ATXN1; (+) strand; PAM type: YTN; PAM sequence: CTG
agtgaggggcccaaactcag

SEQ ID NO: 271797 - DNA, 20 bp, Artificial Sequence
  Description of Artificial Sequence: Synthetic oligonucleotide
  Target: ATXN1; (+) strand; PAM type: YTN; PAM sequence: CTC
agctggacacaatccctgct

SEQ ID NO: 271798 - DNA, 20 bp, Artificial Sequence
  Description of Artificial Sequence: Synthetic oligonucleotide
  Target: ATXN1; (+) strand; PAM type: YTN; PAM sequence: CTG
gacacaatccctgcttatcc

SEQ ID NO: 271799 - DNA, 20 bp, Artificial Sequence
  Description of Artificial Sequence: Synthetic oligonucleotide
  Target: ATXN1; (+) strand; PAM type: YTN; PAM sequence: CTG
cttatccctctcagctgtgg

SEQ ID NO: 271800 - DNA, 20 bp, Artificial Sequence
  Description of Artificial Sequence: Synthetic oligonucleotide
  Target: ATXN1; (+) strand; PAM type: YTN; PAM sequence: CTT
atccctctcagctgtggtca

SEQ ID NO: 271801 - DNA, 20 bp, Artificial Sequence
  Description of Artificial Sequence: Synthetic oligonucleotide
  Target: ATXN1; (+) strand; PAM type: YTN; PAM sequence: TTA
tccctctcagctgtggtcag

SEQ ID NO: 271802 - DNA, 20 bp, Artificial Sequence
  Description of Artificial Sequence: Synthetic oligonucleotide
  Target: ATXN1; (+) strand; PAM type: YTN; PAM sequence: CTC
tcagctgtggtcagctggac

SEQ ID NO: 271803 - DNA, 20 bp, Artificial Sequence
  Description of Artificial Sequence: Synthetic oligonucleotide
  Target: ATXN1; (+) strand; PAM type: YTN; PAM sequence: CTC
agctgtggtcagctggacac

SEQ ID NO: 271804 - DNA, 20 bp, Artificial Sequence
  Description of Artificial Sequence: Synthetic oligonucleotide
  Target: ATXN1; (+) strand; PAM type: YTN; PAM sequence: CTG
tggtcagctggacacctagg

SEQ ID NO: 271805 - DNA, 20 bp, Artificial Sequence
  Description of Artificial Sequence: Synthetic oligonucleotide
  Target: ATXN1; (+) strand; PAM type: YTN; PAM sequence: CTG
gacacctaggcacacatggg

SEQ ID NO: 271806 - DNA, 20 bp, Artificial Sequence
  Description of Artificial Sequence: Synthetic oligonucleotide
  Target: ATXN1; (+) strand; PAM type: YTN; PAM sequence: CTA
ggcacacatggggaagccac

SEQ ID NO: 271807 - DNA, 20 bp, Artificial Sequence
  Description of Artificial Sequence: Synthetic oligonucleotide
  Target: ATXN1; (+) strand; PAM type: YTN; PAM sequence: CTC
agtccttgcctgaaagaaga

SEQ ID NO: 271808 - DNA, 20 bp, Artificial Sequence
  Description of Artificial Sequence: Synthetic oligonucleotide
  Target: ATXN1; (+) strand; PAM type: YTN; PAM sequence: CTT
gcctgaaagaagaaaacata

SEQ ID NO: 271809 - DNA, 20 bp, Artificial Sequence
  Description of Artificial Sequence: Synthetic oligonucleotide
  Target: ATXN1; (+) strand; PAM type: YTN; PAM sequence: TTG
cctgaaagaagaaaacatac

SEQ ID NO: 271810 - DNA, 20 bp, Artificial Sequence
  Description of Artificial Sequence: Synthetic oligonucleotide
  Target: ATXN1; (+) strand; PAM type: YTN; PAM sequence: CTG
aaagaagaaaacataccggc

SEQ ID NO: 271811 - DNA, 20 bp, Artificial Sequence
  Description of Artificial Sequence: Synthetic oligonucleotide
  Target: ATXN1; (+) strand; PAM type: YTN; PAM sequence: CTC
aaccttcttcactaacaggc

SEQ ID NO: 271812 - DNA, 20 bp, Artificial Sequence
  Description of Artificial Sequence: Synthetic oligonucleotide
  Target: ATXN1; (+) strand; PAM type: YTN; PAM sequence: CTT
cttcactaacaggcaagctt

SEQ ID NO: 271813 - DNA, 20 bp, Artificial Sequence
  Description of Artificial Sequence: Synthetic oligonucleotide
  Target: ATXN1; (+) strand; PAM type: YTN; PAM sequence: TTC
ttcactaacaggcaagctta

SEQ ID NO: 271814 - DNA, 20 bp, Artificial Sequence
  Description of Artificial Sequence: Synthetic oligonucleotide
  Target: ATXN1; (+) strand; PAM type: YTN; PAM sequence: CTT
cactaacaggcaagcttacc

SEQ ID NO: 271815 - DNA, 20 bp, Artificial Sequence
  Description of Artificial Sequence: Synthetic oligonucleotide
  Target: ATXN1; (+) strand; PAM type: YTN; PAM sequence: TTC
actaacaggcaagcttacca

SEQ ID NO: 271816 - DNA, 20 bp, Artificial Sequence
  Description of Artificial Sequence: Synthetic oligonucleotide
  Target: ATXN1; (+) strand; PAM type: YTN; PAM sequence: CTA
acaggcaagcttaccatgtg

SEQ ID NO: 271817 - DNA, 20 bp, Artificial Sequence
  Description of Artificial Sequence: Synthetic oligonucleotide
  Target: ATXN1; (+) strand; PAM type: YTN; PAM sequence: CTT
accatgtgttgaatttaacc

SEQ ID NO: 271818 - DNA, 20 bp, Artificial Sequence
  Description of Artificial Sequence: Synthetic oligonucleotide
  Target: ATXN1; (+) strand; PAM type: YTN; PAM sequence: TTA
ccatgtgttgaatttaacca

SEQ ID NO: 271819 - DNA, 20 bp, Artificial Sequence
  Description of Artificial Sequence: Synthetic oligonucleotide
  Target: ATXN1; (+) strand; PAM type: YTN; PAM sequence: TTG
aatttaaccagccagcacca

SEQ ID NO: 271820 - DNA, 20 bp, Artificial Sequence
  Description of Artificial Sequence: Synthetic oligonucleotide
  Target: ATXN1; (+) strand; PAM type: YTN; PAM sequence: TTT
aaccagccagcaccaaacca

SEQ ID NO: 271821 - DNA, 20 bp, Artificial Sequence
  Description of Artificial Sequence: Synthetic oligonucleotide
  Target: ATXN1; (+) strand; PAM type: YTN; PAM sequence: TTA
accagccagcaccaaaccat

SEQ ID NO: 271822 - DNA, 20 bp, Artificial Sequence
  Description of Artificial Sequence: Synthetic oligonucleotide
  Target: ATXN1; (+) strand; PAM type: YTN; PAM sequence: CTT
tctgttactcagaaataagt

SEQ ID NO: 271823 - DNA, 20 bp, Artificial Sequence
  Description of Artificial Sequence: Synthetic oligonucleotide
  Target: ATXN1; (+) strand; PAM type: YTN; PAM sequence: TTT
ctgttactcagaaataagta

SEQ ID NO: 271824 - DNA, 20 bp, Artificial Sequence
  Description of Artificial Sequence: Synthetic oligonucleotide
  Target: ATXN1; (+) strand; PAM type: YTN; PAM sequence: TTC
tgttactcagaaataagtaa

SEQ ID NO: 271825 - DNA, 20 bp, Artificial Sequence
  Description of Artificial Sequence: Synthetic oligonucleotide
  Target: ATXN1; (+) strand; PAM type: YTN; PAM sequence: CTG
ttactcagaaataagtaaac

SEQ ID NO: 271826 - DNA, 20 bp, Artificial Sequence
  Description of Artificial Sequence: Synthetic oligonucleotide
  Target: ATXN1; (+) strand; PAM type: YTN; PAM sequence: TTA
ctcagaaataagtaaacagt

SEQ ID NO: 271827 - DNA, 20 bp, Artificial Sequence
  Description of Artificial Sequence: Synthetic oligonucleotide
  Target: ATXN1; (+) strand; PAM type: YTN; PAM sequence: CTC
agaaataagtaaacagtatg

SEQ ID NO: 271828 - DNA, 20 bp, Artificial Sequence
  Description of Artificial Sequence: Synthetic oligonucleotide
  Target: ATXN1; (+) strand; PAM type: YTN; PAM sequence: CTT
attaggtgggctcagggtgc

SEQ ID NO: 271829 - DNA, 20 bp, Artificial Sequence
  Description of Artificial Sequence: Synthetic oligonucleotide
  Target: ATXN1; (+) strand; PAM type: YTN; PAM sequence: TTA
ttaggtgggctcagggtgct

SEQ ID NO: 271830 - DNA, 20 bp, Artificial Sequence
  Description of Artificial Sequence: Synthetic oligonucleotide
  Target: ATXN1; (+) strand; PAM type: YTN; PAM sequence: TTA
ggtgggctcagggtgctggt

SEQ ID NO: 271831 - DNA, 20 bp, Artificial Sequence
  Description of Artificial Sequence: Synthetic oligonucleotide
  Target: ATXN1; (+) strand; PAM type: YTN; PAM sequence: CTC
agggtgctggtatcaggact

SEQ ID NO: 271832 - DNA, 20 bp, Artificial Sequence
  Description of Artificial Sequence: Synthetic oligonucleotide
  Target: ATXN1; (+) strand; PAM type: YTN; PAM sequence: CTG
gtatcaggactatttttgca

SEQ ID NO: 271833 - DNA, 20 bp, Artificial Sequence
  Description of Artificial Sequence: Synthetic oligonucleotide
  Target: ATXN1; (+) strand; PAM type: YTN; PAM sequence: CTA
tttttgcatattctatcatt

SEQ ID NO: 271834 - DNA, 20 bp, Artificial Sequence
  Description of Artificial Sequence: Synthetic oligonucleotide
  Target: ATXN1; (+) strand; PAM type: YTN; PAM sequence: TTT
ttgcatattctatcattagg

SEQ ID NO: 271835 - DNA, 20 bp, Artificial Sequence
  Description of Artificial Sequence: Synthetic oligonucleotide
  Target: ATXN1; (+) strand; PAM type: YTN; PAM sequence: TTT
tgcatattctatcattaggt

SEQ ID NO: 271836 - DNA, 20 bp, Artificial Sequence
  Description of Artificial Sequence: Synthetic oligonucleotide
  Target: ATXN1; (+) strand; PAM type: YTN; PAM sequence: TTT
gcatattctatcattaggtc

SEQ ID NO: 271837 - DNA, 20 bp, Artificial Sequence
  Description of Artificial Sequence: Synthetic oligonucleotide
  Target: ATXN1; (+) strand; PAM type: YTN; PAM sequence: TTG
catattctatcattaggtca

SEQ ID NO: 271838 - DNA, 20 bp, Artificial Sequence
  Description of Artificial Sequence: Synthetic oligonucleotide
  Target: ATXN1; (+) strand; PAM type: YTN; PAM sequence: TTC
tatcattaggtcaggctgac

SEQ ID NO: 271839 - DNA, 20 bp, Artificial Sequence
  Description of Artificial Sequence: Synthetic oligonucleotide
  Target: ATXN1; (+) strand; PAM type: YTN; PAM sequence: CTA
tcattaggtcaggctgacat

SEQ ID NO: 271840 - DNA, 20 bp, Artificial Sequence
  Description of Artificial Sequence: Synthetic oligonucleotide
  Target: ATXN1; (+) strand; PAM type: YTN; PAM sequence: TTA
ggtcaggctgacatcccaaa

SEQ ID NO: 271841 - DNA, 20 bp, Artificial Sequence
  Description of Artificial Sequence: Synthetic oligonucleotide
  Target: ATXN1; (+) strand; PAM type: YTN; PAM sequence: CTG
acatcccaaaccttaaaaag

SEQ ID NO: 271842 - DNA, 20 bp, Artificial Sequence
  Description of Artificial Sequence: Synthetic oligonucleotide
  Target: ATXN1; (+) strand; PAM type: YTN; PAM sequence: CTT
aaaaagttaataagggaaag

SEQ ID NO: 271843 - DNA, 20 bp, Artificial Sequence
  Description of Artificial Sequence: Synthetic oligonucleotide
  Target: ATXN1; (+) strand; PAM type: YTN; PAM sequence: TTA
aaaagttaataagggaaaga

SEQ ID NO: 271844 - DNA, 20 bp, Artificial Sequence
  Description of Artificial Sequence: Synthetic oligonucleotide
  Target: ATXN1; (+) strand; PAM type: YTN; PAM sequence: TTA
ataagggaaagaacgcataa

SEQ ID NO: 271845 - DNA, 20 bp, Artificial Sequence
  Description of Artificial Sequence: Synthetic oligonucleotide
  Target: ATXN1; (+) strand; PAM type: YTN; PAM sequence: CTT
tatatggaaggttaagtgca

SEQ ID NO: 271846 - DNA, 20 bp, Artificial Sequence
  Description of Artificial Sequence: Synthetic oligonucleotide
  Target: ATXN1; (+) strand; PAM type: YTN; PAM sequence: TTT
atatggaaggttaagtgcac

SEQ ID NO: 271847 - DNA, 20 bp, Artificial Sequence
  Description of Artificial Sequence: Synthetic oligonucleotide
  Target: ATXN1; (+) strand; PAM type: YTN; PAM sequence: TTA
tatggaaggttaagtgcact

SEQ ID NO: 271848 - DNA, 20 bp, Artificial Sequence
  Description of Artificial Sequence: Synthetic oligonucleotide
  Target: ATXN1; (+) strand; PAM type: YTN; PAM sequence: TTA
agtgcactggcagcctacta

SEQ ID NO: 271849 - DNA, 20 bp, Artificial Sequence
  Description of Artificial Sequence: Synthetic oligonucleotide
  Target: ATXN1; (+) strand; PAM type: YTN; PAM sequence: CTG
gcagcctactaaaatagaaa

SEQ ID NO: 271850 - DNA, 20 bp, Artificial Sequence
  Description of Artificial Sequence: Synthetic oligonucleotide
  Target: ATXN1; (+) strand; PAM type: YTN; PAM sequence: CTA
ctaaaatagaaagttaaata

SEQ ID NO: 271851 - DNA, 20 bp, Artificial Sequence
  Description of Artificial Sequence: Synthetic oligonucleotide
  Target: ATXN1; (+) strand; PAM type: YTN; PAM sequence: CTA
aaatagaaagttaaatacag

SEQ ID NO: 271852 - DNA, 20 bp, Artificial Sequence
  Description of Artificial Sequence: Synthetic oligonucleotide
  Target: ATXN1; (+) strand; PAM type: YTN; PAM sequence: TTA
aatacagcaatgagattttg

SEQ ID NO: 271853 - DNA, 20 bp, Artificial Sequence
  Description of Artificial Sequence: Synthetic oligonucleotide
  Target: ATXN1; (+) strand; PAM type: YTN; PAM sequence: TTT
tgaaatttccccttgcaata

SEQ ID NO: 271854 - DNA, 20 bp, Artificial Sequence
  Description of Artificial Sequence: Synthetic oligonucleotide
  Target: ATXN1; (+) strand; PAM type: YTN; PAM sequence: TTT
gaaatttccccttgcaataa

SEQ ID NO: 271855 - DNA, 20 bp, Artificial Sequence
  Description of Artificial Sequence: Synthetic oligonucleotide
  Target: ATXN1; (+) strand; PAM type: YTN; PAM sequence: TTG
aaatttccccttgcaataaa

SEQ ID NO: 271856 - DNA, 20 bp, Artificial Sequence
  Description of Artificial Sequence: Synthetic oligonucleotide
  Target: ATXN1; (+) strand; PAM type: YTN; PAM sequence: TTT
ccccttgcaataaaaaagaa

SEQ ID NO: 271857 - DNA, 20 bp, Artificial Sequence
  Description of Artificial Sequence: Synthetic oligonucleotide
  Target: ATXN1; (+) strand; PAM type: YTN; PAM sequence: TTC
cccttgcaataaaaaagaag

SEQ ID NO: 271858 - DNA, 20 bp, Artificial Sequence
  Description of Artificial Sequence: Synthetic oligonucleotide
  Target: ATXN1; (+) strand; PAM type: YTN; PAM sequence: CTT
gcaataaaaaagaaggggcc

SEQ ID NO: 271859 - DNA, 20 bp, Artificial Sequence
  Description of Artificial Sequence: Synthetic oligonucleotide
  Target: ATXN1; (+) strand; PAM type: YTN; PAM sequence: TTG
caataaaaaagaaggggcct

SEQ ID NO: 271860 - DNA, 20 bp, Artificial Sequence
  Description of Artificial Sequence: Synthetic oligonucleotide
  Target: ATXN1; (+) strand; PAM type: YTN; PAM sequence: CTT
aataggaacacaagccaggc

SEQ ID NO: 271861 - DNA, 20 bp, Artificial Sequence
  Description of Artificial Sequence: Synthetic oligonucleotide
  Target: ATXN1; (+) strand; PAM type: YTN; PAM sequence: TTA
ataggaacacaagccaggct

SEQ ID NO: 271862 - DNA, 20 bp, Artificial Sequence
  Description of Artificial Sequence: Synthetic oligonucleotide
  Target: ATXN1; (+) strand; PAM type: YTN; PAM sequence: CTT
gctggaaaagcagtctttgt

SEQ ID NO: 271863 - DNA, 20 bp, Artificial Sequence
  Description of Artificial Sequence: Synthetic oligonucleotide
  Target: ATXN1; (+) strand; PAM type: YTN; PAM sequence: TTG
ctggaaaagcagtctttgtt

SEQ ID NO: 271864 - DNA, 20 bp, Artificial Sequence
  Description of Artificial Sequence: Synthetic oligonucleotide
  Target: ATXN1; (+) strand; PAM type: YTN; PAM sequence: CTG
gaaaagcagtctttgttcct

SEQ ID NO: 271865 - DNA, 20 bp, Artificial Sequence
  Description of Artificial Sequence: Synthetic oligonucleotide
  Target: ATXN1; (+) strand; PAM type: YTN; PAM sequence: CTT
tgttccttaaaacaacctgc

SEQ ID NO: 271866 - DNA, 20 bp, Artificial Sequence
  Description of Artificial Sequence: Synthetic oligonucleotide
  Target: ATXN1; (+) strand; PAM type: YTN; PAM sequence: TTT
gttccttaaaacaacctgca

SEQ ID NO: 271867 - DNA, 20 bp, Artificial Sequence
  Description of Artificial Sequence: Synthetic oligonucleotide
  Target: ATXN1; (+) strand; PAM type: YTN; PAM sequence: TTG
ttccttaaaacaacctgcaa

SEQ ID NO: 271868 - DNA, 20 bp, Artificial Sequence
  Description of Artificial Sequence: Synthetic oligonucleotide
  Target: ATXN1; (+) strand; PAM type: YTN; PAM sequence: TTC
cttaaaacaacctgcaattg

SEQ ID NO: 271869 - DNA, 20 bp, Artificial Sequence
  Description of Artificial Sequence: Synthetic oligonucleotide
  Target: ATXN1; (+) strand; PAM type: YTN; PAM sequence: CTT
aaaacaacctgcaattgact

SEQ ID NO: 271870 - DNA, 20 bp, Artificial Sequence
  Description of Artificial Sequence: Synthetic oligonucleotide
  Target: ATXN1; (+) strand; PAM type: YTN; PAM sequence: TTA
aaacaacctgcaattgacta

SEQ ID NO: 271871 - DNA, 20 bp, Artificial Sequence
  Description of Artificial Sequence: Synthetic oligonucleotide
  Target: ATXN1; (+) strand; PAM type: YTN; PAM sequence: CTG
caattgactacttatggagg

SEQ ID NO: 271872 - DNA, 20 bp, Artificial Sequence
  Description of Artificial Sequence: Synthetic oligonucleotide
  Target: ATXN1; (+) strand; PAM type: YTN; PAM sequence: TTG
actacttatggaggacttaa

SEQ ID NO: 271873 - DNA, 20 bp, Artificial Sequence
  Description of Artificial Sequence: Synthetic oligonucleotide
  Target: ATXN1; (+) strand; PAM type: YTN; PAM sequence: CTA
cttatggaggacttaaattt

SEQ ID NO: 271874 - DNA, 20 bp, Artificial Sequence
  Description of Artificial Sequence: Synthetic oligonucleotide
  Target: ATXN1; (+) strand; PAM type: YTN; PAM sequence: CTT
atggaggacttaaatttccg

SEQ ID NO: 271875 - DNA, 20 bp, Artificial Sequence
  Description of Artificial Sequence: Synthetic oligonucleotide
  Target: ATXN1; (+) strand; PAM type: YTN; PAM sequence: TTA
tggaggacttaaatttccgg

SEQ ID NO: 271876 - DNA, 20 bp, Artificial Sequence
  Description of Artificial Sequence: Synthetic oligonucleotide
  Target: ATXN1; (+) strand; PAM type: YTN; PAM sequence: CTT
aaatttccggaaatattgta

SEQ ID NO: 271877 - DNA, 20 bp, Artificial Sequence
  Description of Artificial Sequence: Synthetic oligonucleotide
  Target: ATXN1; (+) strand; PAM type: YTN; PAM sequence: TTA
aatttccggaaatattgtac

SEQ ID NO: 271878 - DNA, 20 bp, Artificial Sequence
  Description of Artificial Sequence: Synthetic oligonucleotide
  Target: ATXN1; (+) strand; PAM type: YTN; PAM sequence: TTT
ccggaaatattgtaccatca

SEQ ID NO: 271879 - DNA, 20 bp, Artificial Sequence
  Description of Artificial Sequence: Synthetic oligonucleotide
  Target: ATXN1; (+) strand; PAM type: YTN; PAM sequence: TTC
cggaaatattgtaccatcac

SEQ ID NO: 271880 - DNA, 20 bp, Artificial Sequence
  Description of Artificial Sequence: Synthetic oligonucleotide
  Target: ATXN1; (+) strand; PAM type: YTN; PAM sequence: TTG
taccatcactgacccgtgta

SEQ ID NO: 271881 - DNA, 20 bp, Artificial Sequence
  Description of Artificial Sequence: Synthetic oligonucleotide
  Target: ATXN1; (+) strand; PAM type: YTN; PAM sequence: CTG
acccgtgtacacggttatga

SEQ ID NO: 271882 - DNA, 20 bp, Artificial Sequence
  Description of Artificial Sequence: Synthetic oligonucleotide
  Target: ATXN1; (+) strand; PAM type: YTN; PAM sequence: TTA
tgaggctccgataacaatag

SEQ ID NO: 271883 - DNA, 20 bp, Artificial Sequence
  Description of Artificial Sequence: Synthetic oligonucleotide
  Target: ATXN1; (+) strand; PAM type: YTN; PAM sequence: CTC
cgataacaatagcactctca

SEQ ID NO: 271884 - DNA, 20 bp, Artificial Sequence
  Description of Artificial Sequence: Synthetic oligonucleotide
  Target: ATXN1; (+) strand; PAM type: YTN; PAM sequence: CTC
tcagggagaaccgacagttt

SEQ ID NO: 271885 - DNA, 20 bp, Artificial Sequence
  Description of Artificial Sequence: Synthetic oligonucleotide
  Target: ATXN1; (+) strand; PAM type: YTN; PAM sequence: CTC
agggagaaccgacagtttaa

SEQ ID NO: 271886 - DNA, 20 bp, Artificial Sequence
  Description of Artificial Sequence: Synthetic oligonucleotide
  Target: ATXN1; (+) strand; PAM type: YTN; PAM sequence: TTT
aacgaaagcaaattagggtc

SEQ ID NO: 271887 - DNA, 20 bp, Artificial Sequence
  Description of Artificial Sequence: Synthetic oligonucleotide
  Target: ATXN1; (+) strand; PAM type: YTN; PAM sequence: TTA
acgaaagcaaattagggtct

SEQ ID NO: 271888 - DNA, 20 bp, Artificial Sequence
  Description of Artificial Sequence: Synthetic oligonucleotide
  Target: ATXN1; (+) strand; PAM type: YTN; PAM sequence: TTA
gggtctcagtaataagatga

SEQ ID NO: 271889 - DNA, 20 bp, Artificial Sequence
  Description of Artificial Sequence: Synthetic oligonucleotide
  Target: ATXN1; (+) strand; PAM type: YTN; PAM sequence: CTC
agtaataagatgactgagaa

SEQ ID NO: 271890 - DNA, 20 bp, Artificial Sequence
  Description of Artificial Sequence: Synthetic oligonucleotide
  Target: ATXN1; (+) strand; PAM type: YTN; PAM sequence: CTG
agaacataaactactatgcg

SEQ ID NO: 271891 - DNA, 20 bp, Artificial Sequence
  Description of Artificial Sequence: Synthetic oligonucleotide
  Target: ATXN1; (+) strand; PAM type: YTN; PAM sequence: CTA
ctatgcgtctatcttttaaa

SEQ ID NO: 271892 - DNA, 20 bp, Artificial Sequence
  Description of Artificial Sequence: Synthetic oligonucleotide
  Target: ATXN1; (+) strand; PAM type: YTN; PAM sequence: CTA
tgcgtctatcttttaaacac

SEQ ID NO: 271893 - DNA, 20 bp, Artificial Sequence
  Description of Artificial Sequence: Synthetic oligonucleotide
  Target: ATXN1; (+) strand; PAM type: YTN; PAM sequence: CTA
tcttttaaacacttaagtaa

SEQ ID NO: 271894 - DNA, 20 bp, Artificial Sequence
  Description of Artificial Sequence: Synthetic oligonucleotide
  Target: ATXN1; (+) strand; PAM type: YTN; PAM sequence: CTT
ttaaacacttaagtaatttt

SEQ ID NO: 271895 - DNA, 20 bp, Artificial Sequence
  Description of Artificial Sequence: Synthetic oligonucleotide
  Target: ATXN1; (+) strand; PAM type: YTN; PAM sequence: TTT
taaacacttaagtaatttta

SEQ ID NO: 271896 - DNA, 20 bp, Artificial Sequence
  Description of Artificial Sequence: Synthetic oligonucleotide
  Target: ATXN1; (+) strand; PAM type: YTN; PAM sequence: TTT
aaacacttaagtaattttag

SEQ ID NO: 271897 - DNA, 20 bp, Artificial Sequence
  Description of Artificial Sequence: Synthetic oligonucleotide
  Target: ATXN1; (+) strand; PAM type: YTN; PAM sequence: TTA
aacacttaagtaattttagt

SEQ ID NO: 271898 - DNA, 20 bp, Artificial Sequence
  Description of Artificial Sequence: Synthetic oligonucleotide
  Target: ATXN1; (+) strand; PAM type: YTN; PAM sequence: CTT
aagtaattttagtgttgctt

SEQ ID NO: 271899 - DNA, 20 bp, Artificial Sequence
  Description of Artificial Sequence: Synthetic oligonucleotide
  Target: ATXN1; (+) strand; PAM type: YTN; PAM sequence: TTA
agtaattttagtgttgcttc

SEQ ID NO: 271900 - DNA, 20 bp, Artificial Sequence
  Description of Artificial Sequence: Synthetic oligonucleotide
  Target: ATXN1; (+) strand; PAM type: YTN; PAM sequence: TTT
tagtgttgcttcacttgcca

SEQ ID NO: 271901 - DNA, 20 bp, Artificial Sequence
  Description of Artificial Sequence: Synthetic oligonucleotide
  Target: ATXN1; (+) strand; PAM type: YTN; PAM sequence: TTT
agtgttgcttcacttgccag

SEQ ID NO: 271902 - DNA, 20 bp, Artificial Sequence
  Description of Artificial Sequence: Synthetic oligonucleotide
  Target: ATXN1; (+) strand; PAM type: YTN; PAM sequence: TTA
gtgttgcttcacttgccaga

SEQ ID NO: 271903 - DNA, 20 bp, Artificial Sequence
  Description of Artificial Sequence: Synthetic oligonucleotide
  Target: ATXN1; (+) strand; PAM type: YTN; PAM sequence: TTG
cttcacttgccagagtaaat

SEQ ID NO: 271904 - DNA, 20 bp, Artificial Sequence
  Description of Artificial Sequence: Synthetic oligonucleotide
  Target: ATXN1; (+) strand; PAM type: YTN; PAM sequence: CTT
cacttgccagagtaaatgag

SEQ ID NO: 271905 - DNA, 20 bp, Artificial Sequence
  Description of Artificial Sequence: Synthetic oligonucleotide
  Target: ATXN1; (+) strand; PAM type: YTN; PAM sequence: TTC
acttgccagagtaaatgagt

SEQ ID NO: 271906 - DNA, 20 bp, Artificial Sequence
  Description of Artificial Sequence: Synthetic oligonucleotide
  Target: ATXN1; (+) strand; PAM type: YTN; PAM sequence: CTT
gccagagtaaatgagttata

SEQ ID NO: 271907 - DNA, 20 bp, Artificial Sequence
  Description of Artificial Sequence: Synthetic oligonucleotide
  Target: ATXN1; (+) strand; PAM type: YTN; PAM sequence: TTG
ccagagtaaatgagttataa

SEQ ID NO: 271908 - DNA, 20 bp, Artificial Sequence
  Description of Artificial Sequence: Synthetic oligonucleotide
  Target: ATXN1; (+) strand; PAM type: YTN; PAM sequence: TTA
taaaaacctctgctttctca

SEQ ID NO: 271909 - DNA, 20 bp, Artificial Sequence
  Description of Artificial Sequence: Synthetic oligonucleotide
  Target: ATXN1; (+) strand; PAM type: YTN; PAM sequence: CTC
tgctttctcataaaagcctc

SEQ ID NO: 271910 - DNA, 20 bp, Artificial Sequence
  Description of Artificial Sequence: Synthetic oligonucleotide
  Target: ATXN1; (+) strand; PAM type: YTN; PAM sequence: CTG
ctttctcataaaagcctcca

SEQ ID NO: 271911 - DNA, 20 bp, Artificial Sequence
  Description of Artificial Sequence: Synthetic oligonucleotide
  Target: ATXN1; (+) strand; PAM type: YTN; PAM sequence: CTT
tctcataaaagcctccatat

SEQ ID NO: 271912 - DNA, 20 bp, Artificial Sequence
  Description of Artificial Sequence: Synthetic oligonucleotide
  Target: ATXN1; (+) strand; PAM type: YTN; PAM sequence: TTT
ctcataaaagcctccatata

SEQ ID NO: 271913 - DNA, 20 bp, Artificial Sequence
  Description of Artificial Sequence: Synthetic oligonucleotide
  Target: ATXN1; (+) strand; PAM type: YTN; PAM sequence: TTC
tcataaaagcctccatatac

SEQ ID NO: 271914 - DNA, 20 bp, Artificial Sequence
  Description of Artificial Sequence: Synthetic oligonucleotide
  Target: ATXN1; (+) strand; PAM type: YTN; PAM sequence: CTC
ataaaagcctccatataccc

SEQ ID NO: 271915 - DNA, 20 bp, Artificial Sequence
  Description of Artificial Sequence: Synthetic oligonucleotide
  Target: ATXN1; (+) strand; PAM type: YTN; PAM sequence: CTC
catatacccaacgaatggcg

SEQ ID NO: 271916 - DNA, 20 bp, Artificial Sequence
  Description of Artificial Sequence: Synthetic oligonucleotide
  Target: ATXN1; (+) strand; PAM type: YTN; PAM sequence: TTA
caataagcagcacgtgtccc

SEQ ID NO: 271917 - DNA, 20 bp, Artificial Sequence
  Description of Artificial Sequence: Synthetic oligonucleotide
  Target: ATXN1; (+) strand; PAM type: YTN; PAM sequence: TTT
cctcccataaggaataatcc

SEQ ID NO: 271918 - DNA, 20 bp, Artificial Sequence
  Description of Artificial Sequence: Synthetic oligonucleotide
  Target: ATXN1; (+) strand; PAM type: YTN; PAM sequence: TTC
ctcccataaggaataatcct

SEQ ID NO: 271919 - DNA, 20 bp, Artificial Sequence
  Description of Artificial Sequence: Synthetic oligonucleotide
  Target: ATXN1; (+) strand; PAM type: YTN; PAM sequence: CTC
ccataaggaataatcctctt

SEQ ID NO: 271920 - DNA, 20 bp, Artificial Sequence
  Description of Artificial Sequence: Synthetic oligonucleotide
  Target: ATXN1; (+) strand; PAM type: YTN; PAM sequence: CTC
tttttgtgattctccttttc

SEQ ID NO: 271921 - DNA, 20 bp, Artificial Sequence
  Description of Artificial Sequence: Synthetic oligonucleotide
  Target: ATXN1; (+) strand; PAM type: YTN; PAM sequence: CTT
tttgtgattctccttttcac

SEQ ID NO: 271922 - DNA, 20 bp, Artificial Sequence
  Description of Artificial Sequence: Synthetic oligonucleotide
  Target: ATXN1; (+) strand; PAM type: YTN; PAM sequence: TTT
ttgtgattctccttttcact

SEQ ID NO: 271923 - DNA, 20 bp, Artificial Sequence
  Description of Artificial Sequence: Synthetic oligonucleotide
  Target: ATXN1; (+) strand; PAM type: YTN; PAM sequence: TTT
tgtgattctccttttcactt

SEQ ID NO: 271924 - DNA, 20 bp, Artificial Sequence
  Description of Artificial Sequence: Synthetic oligonucleotide
  Target: ATXN1; (+) strand; PAM type: YTN; PAM sequence: TTT
gtgattctccttttcacttc

SEQ ID NO: 271925 - DNA, 20 bp, Artificial Sequence
  Description of Artificial Sequence: Synthetic oligonucleotide
  Target: ATXN1; (+) strand; PAM type: YTN; PAM sequence: TTG
tgattctccttttcacttca

SEQ ID NO: 271926 - DNA, 20 bp, Artificial Sequence
  Description of Artificial Sequence: Synthetic oligonucleotide
  Target: ATXN1; (+) strand; PAM type: YTN; PAM sequence: TTC
tccttttcacttcatctgga

SEQ ID NO: 271927 - DNA, 20 bp, Artificial Sequence
  Description of Artificial Sequence: Synthetic oligonucleotide
  Target: ATXN1; (+) strand; PAM type: YTN; PAM sequence: CTC
cttttcacttcatctggagg

SEQ ID NO: 271928 - DNA, 20 bp, Artificial Sequence
  Description of Artificial Sequence: Synthetic oligonucleotide
  Target: ATXN1; (+) strand; PAM type: YTN; PAM sequence: CTT
ttcacttcatctggagggca

SEQ ID NO: 271929 - DNA, 20 bp, Artificial Sequence
  Description of Artificial Sequence: Synthetic oligonucleotide
  Target: ATXN1; (+) strand; PAM type: YTN; PAM sequence: TTT
tcacttcatctggagggcag

SEQ ID NO: 271930 - DNA, 20 bp, Artificial Sequence
  Description of Artificial Sequence: Synthetic oligonucleotide
  Target: ATXN1; (+) strand; PAM type: YTN; PAM sequence: TTT
cacttcatctggagggcagt

SEQ ID NO: 271931 - DNA, 20 bp, Artificial Sequence
  Description of Artificial Sequence: Synthetic oligonucleotide
  Target: ATXN1; (+) strand; PAM type: YTN; PAM sequence: TTC
acttcatctggagggcagtg

SEQ ID NO: 271932 - DNA, 20 bp, Artificial Sequence
  Description of Artificial Sequence: Synthetic oligonucleotide
  Target: ATXN1; (+) strand; PAM type: YTN; PAM sequence: CTT
catctggagggcagtgtctt

SEQ ID NO: 271933 - DNA, 20 bp, Artificial Sequence
  Description of Artificial Sequence: Synthetic oligonucleotide
  Target: ATXN1; (+) strand; PAM type: YTN; PAM sequence: TTC
atctggagggcagtgtcttc

SEQ ID NO: 271934 - DNA, 20 bp, Artificial Sequence
  Description of Artificial Sequence: Synthetic oligonucleotide
  Target: ATXN1; (+) strand; PAM type: YTN; PAM sequence: CTG
gagggcagtgtcttccctcc

SEQ ID NO: 271935 - DNA, 20 bp, Artificial Sequence
  Description of Artificial Sequence: Synthetic oligonucleotide
  Target: ATXN1; (+) strand; PAM type: YTN; PAM sequence: CTT
ccctcctagaagagaggccc

SEQ ID NO: 271936 - DNA, 20 bp, Artificial Sequence
  Description of Artificial Sequence: Synthetic oligonucleotide
  Target: ATXN1; (+) strand; PAM type: YTN; PAM sequence: TTC
cctcctagaagagaggccca

SEQ ID NO: 271937 - DNA, 20 bp, Artificial Sequence
  Description of Artificial Sequence: Synthetic oligonucleotide
  Target: ATXN1; (+) strand; PAM type: YTN; PAM sequence: CTC
ctagaagagaggcccaggct

SEQ ID NO: 271938 - DNA, 20 bp, Artificial Sequence
  Description of Artificial Sequence: Synthetic oligonucleotide
  Target: ATXN1; (+) strand; PAM type: YTN; PAM sequence: CTA
gaagagaggcccaggctgag

SEQ ID NO: 271939 - DNA, 20 bp, Artificial Sequence
  Description of Artificial Sequence: Synthetic oligonucleotide
  Target: ATXN1; (+) strand; PAM type: YTN; PAM sequence: CTG
agagcatcatggttttggca

SEQ ID NO: 271940 - DNA, 20 bp, Artificial Sequence
  Description of Artificial Sequence: Synthetic oligonucleotide
  Target: ATXN1; (+) strand; PAM type: YTN; PAM sequence: TTT
tggcagggaactcagaaaat

SEQ ID NO: 271941 - DNA, 20 bp, Artificial Sequence
  Description of Artificial Sequence: Synthetic oligonucleotide
  Target: ATXN1; (+) strand; PAM type: YTN; PAM sequence: TTT
ggcagggaactcagaaaatc

SEQ ID NO: 271942 - DNA, 20 bp, Artificial Sequence
  Description of Artificial Sequence: Synthetic oligonucleotide
  Target: ATXN1; (+) strand; PAM type: YTN; PAM sequence: TTG
gcagggaactcagaaaatct

SEQ ID NO: 271943 - DNA, 20 bp, Artificial Sequence
  Description of Artificial Sequence: Synthetic oligonucleotide
  Target: ATXN1; (+) strand; PAM type: YTN; PAM sequence: CTC
agaaaatcttggcatcaggg

SEQ ID NO: 271944 - DNA, 20 bp, Artificial Sequence
  Description of Artificial Sequence: Synthetic oligonucleotide
  Target: ATXN1; (+) strand; PAM type: YTN; PAM sequence: CTT
ggcatcagggcttactataa

SEQ ID NO: 271945 - DNA, 20 bp, Artificial Sequence
  Description of Artificial Sequence: Synthetic oligonucleotide
  Target: ATXN1; (+) strand; PAM type: YTN; PAM sequence: TTG
gcatcagggcttactataag

SEQ ID NO: 271946 - DNA, 20 bp, Artificial Sequence
  Description of Artificial Sequence: Synthetic oligonucleotide
  Target: ATXN1; (+) strand; PAM type: YTN; PAM sequence: CTT
actataagctgagttaaaca

SEQ ID NO: 271947 - DNA, 20 bp, Artificial Sequence
  Description of Artificial Sequence: Synthetic oligonucleotide
  Target: ATXN1; (+) strand; PAM type: YTN; PAM sequence: TTA
ctataagctgagttaaacag

SEQ ID NO: 271948 - DNA, 20 bp, Artificial Sequence
  Description of Artificial Sequence: Synthetic oligonucleotide
  Target: ATXN1; (+) strand; PAM type: YTN; PAM sequence: CTA
taagctgagttaaacaggaa

SEQ ID NO: 271949 - DNA, 20 bp, Artificial Sequence
  Description of Artificial Sequence: Synthetic oligonucleotide
  Target: ATXN1; (+) strand; PAM type: YTN; PAM sequence: CTG
agttaaacaggaatggaaga

SEQ ID NO: 271950 - DNA, 20 bp, Artificial Sequence
  Description of Artificial Sequence: Synthetic oligonucleotide
  Target: ATXN1; (+) strand; PAM type: YTN; PAM sequence: TTA
aacaggaatggaagatcatt

SEQ ID NO: 271951 - DNA, 20 bp, Artificial Sequence
  Description of Artificial Sequence: Synthetic oligonucleotide
  Target: ATXN1; (+) strand; PAM type: YTN; PAM sequence: TTG
gaagccctggaaaaatagaa

SEQ ID NO: 271952 - DNA, 20 bp, Artificial Sequence
  Description of Artificial Sequence: Synthetic oligonucleotide
  Target: ATXN1; (+) strand; PAM type: YTN; PAM sequence: CTG
gaaaaatagaaaatatttct

SEQ ID NO: 271953 - DNA, 20 bp, Artificial Sequence
  Description of Artificial Sequence: Synthetic oligonucleotide
  Target: ATXN1; (+) strand; PAM type: YTN; PAM sequence: TTT
ctagggtagcacagaagttt

SEQ ID NO: 271954 - DNA, 20 bp, Artificial Sequence
  Description of Artificial Sequence: Synthetic oligonucleotide
  Target: ATXN1; (+) strand; PAM type: YTN; PAM sequence: TTC
tagggtagcacagaagtttg

SEQ ID NO: 271955 - DNA, 20 bp, Artificial Sequence
  Description of Artificial Sequence: Synthetic oligonucleotide
  Target: ATXN1; (+) strand; PAM type: YTN; PAM sequence: CTA
gggtagcacagaagtttggc

SEQ ID NO: 271956 - DNA, 20 bp, Artificial Sequence
  Description of Artificial Sequence: Synthetic oligonucleotide
  Target: ATXN1; (+) strand; PAM type: YTN; PAM sequence: TTT
ggccttttcgctggtgattt

SEQ ID NO: 271957 - DNA, 20 bp, Artificial Sequence
  Description of Artificial Sequence: Synthetic oligonucleotide
  Target: ATXN1; (+) strand; PAM type: YTN; PAM sequence: TTG
gccttttcgctggtgattta

SEQ ID NO: 271958 - DNA, 20 bp, Artificial Sequence
  Description of Artificial Sequence: Synthetic oligonucleotide
  Target: ATXN1; (+) strand; PAM type: YTN; PAM sequence: CTT
ttcgctggtgatttatttcc

SEQ ID NO: 271959 - DNA, 20 bp, Artificial Sequence
  Description of Artificial Sequence: Synthetic oligonucleotide
  Target: ATXN1; (+) strand; PAM type: YTN; PAM sequence: TTT
tcgctggtgatttatttcca

SEQ ID NO: 271960 - DNA, 20 bp, Artificial Sequence
  Description of Artificial Sequence: Synthetic oligonucleotide
  Target: ATXN1; (+) strand; PAM type: YTN; PAM sequence: TTT
cgctggtgatttatttccat

SEQ ID NO: 271961 - DNA, 20 bp, Artificial Sequence
  Description of Artificial Sequence: Synthetic oligonucleotide
  Target: ATXN1; (+) strand; PAM type: YTN; PAM sequence: TTC
gctggtgatttatttccatt

SEQ ID NO: 271962 - DNA, 20 bp, Artificial Sequence
  Description of Artificial Sequence: Synthetic oligonucleotide
  Target: ATXN1; (+) strand; PAM type: YTN; PAM sequence: CTG
gtgatttatttccatttgtt

SEQ ID NO: 271963 - DNA, 20 bp, Artificial Sequence
  Description of Artificial Sequence: Synthetic oligonucleotide
  Target: ATXN1; (+) strand; PAM type: YTN; PAM sequence: TTT
atttccatttgttcacatga

SEQ ID NO: 271964 - DNA, 20 bp, Artificial Sequence
  Description of Artificial Sequence: Synthetic oligonucleotide
  Target: ATXN1; (+) strand; PAM type: YTN; PAM sequence: TTA
tttccatttgttcacatgat

SEQ ID NO: 271965 - DNA, 20 bp, Artificial Sequence
  Description of Artificial Sequence: Synthetic oligonucleotide
  Target: ATXN1; (+) strand; PAM type: YTN; PAM sequence: TTT
ccatttgttcacatgatgtg

SEQ ID NO: 271966 - DNA, 20 bp, Artificial Sequence
  Description of Artificial Sequence: Synthetic oligonucleotide
  Target: ATXN1; (+) strand; PAM type: YTN; PAM sequence: TTC
catttgttcacatgatgtga

SEQ ID NO: 271967 - DNA, 20 bp, Artificial Sequence
  Description of Artificial Sequence: Synthetic oligonucleotide
  Target: ATXN1; (+) strand; PAM type: YTN; PAM sequence: TTT
gttcacatgatgtgactcat

SEQ ID NO: 271968 - DNA, 20 bp, Artificial Sequence
  Description of Artificial Sequence: Synthetic oligonucleotide
  Target: ATXN1; (+) strand; PAM type: YTN; PAM sequence: TTG
ttcacatgatgtgactcatc

SEQ ID NO: 271969 - DNA, 20 bp, Artificial Sequence
  Description of Artificial Sequence: Synthetic oligonucleotide
  Target: ATXN1; (+) strand; PAM type: YTN; PAM sequence: TTC
acatgatgtgactcatcatt

SEQ ID NO: 271970 - DNA, 20 bp, Artificial Sequence
  Description of Artificial Sequence: Synthetic oligonucleotide
  Target: ATXN1; (+) strand; PAM type: YTN; PAM sequence: CTC
atcatttgggtgacatggag

SEQ ID NO: 271971 - DNA, 20 bp, Artificial Sequence
  Description of Artificial Sequence: Synthetic oligonucleotide
  Target: ATXN1; (+) strand; PAM type: YTN; PAM sequence: TTT
gggtgacatggagcaggcag

SEQ ID NO: 271972 - DNA, 20 bp, Artificial Sequence
  Description of Artificial Sequence: Synthetic oligonucleotide
  Target: ATXN1; (+) strand; PAM type: YTN; PAM sequence: TTG
ggtgacatggagcaggcagc

SEQ ID NO: 271973 - DNA, 20 bp, Artificial Sequence
  Description of Artificial Sequence: Synthetic oligonucleotide
  Target: ATXN1; (+) strand; PAM type: YTN; PAM sequence: TTT
caagttcatcattttattaa

SEQ ID NO: 271974 - DNA, 20 bp, Artificial Sequence
  Description of Artificial Sequence: Synthetic oligonucleotide
  Target: ATXN1; (+) strand; PAM type: YTN; PAM sequence: TTC
aagttcatcattttattaag

SEQ ID NO: 271975 - DNA, 20 bp, Artificial Sequence
  Description of Artificial Sequence: Synthetic oligonucleotide
  Target: ATXN1; (+) strand; PAM type: YTN; PAM sequence: TTC
atcattttattaagcaatga

SEQ ID NO: 271976 - DNA, 20 bp, Artificial Sequence
  Description of Artificial Sequence: Synthetic oligonucleotide
  Target: ATXN1; (+) strand; PAM type: YTN; PAM sequence: TTT
tattaagcaatgagtcaaat

SEQ ID NO: 271977 - DNA, 20 bp, Artificial Sequence
  Description of Artificial Sequence: Synthetic oligonucleotide
  Target: ATXN1; (+) strand; PAM type: YTN; PAM sequence: TTT
attaagcaatgagtcaaatg

SEQ ID NO: 271978 - DNA, 20 bp, Artificial Sequence
  Description of Artificial Sequence: Synthetic oligonucleotide
  Target: ATXN1; (+) strand; PAM type: YTN; PAM sequence: TTA
ttaagcaatgagtcaaatga

SEQ ID NO: 271979 - DNA, 20 bp, Artificial Sequence
  Description of Artificial Sequence: Synthetic oligonucleotide
  Target: ATXN1; (+) strand; PAM type: YTN; PAM sequence: TTA
agcaatgagtcaaatgaaga

SEQ ID NO: 271980 - DNA, 20 bp, Artificial Sequence
  Description of Artificial Sequence: Synthetic oligonucleotide
  Target: ATXN1; (+) strand; PAM type: YTN; PAM sequence: TTT
aagggaaatggtcattttct

SEQ ID NO: 271981 - DNA, 20 bp, Artificial Sequence
  Description of Artificial Sequence: Synthetic oligonucleotide
  Target: ATXN1; (+) strand; PAM type: YTN; PAM sequence: TTA
agggaaatggtcattttcta

SEQ ID NO: 271982 - DNA, 20 bp, Artificial Sequence
  Description of Artificial Sequence: Synthetic oligonucleotide
  Target: ATXN1; (+) strand; PAM type: YTN; PAM sequence: TTT
tctaatgatttttctctagt

SEQ ID NO: 271983 - DNA, 20 bp, Artificial Sequence
  Description of Artificial Sequence: Synthetic oligonucleotide
  Target: ATXN1; (+) strand; PAM type: YTN; PAM sequence: TTT
ctaatgatttttctctagta

SEQ ID NO: 271984 - DNA, 20 bp, Artificial Sequence
  Description of Artificial Sequence: Synthetic oligonucleotide
  Target: ATXN1; (+) strand; PAM type: YTN; PAM sequence: TTC
taatgatttttctctagtat

SEQ ID NO: 271985 - DNA, 20 bp, Artificial Sequence
  Description of Artificial Sequence: Synthetic oligonucleotide
  Target: ATXN1; (+) strand; PAM type: YTN; PAM sequence: CTA
atgatttttctctagtatga

SEQ ID NO: 271986 - DNA, 20 bp, Artificial Sequence
  Description of Artificial Sequence: Synthetic oligonucleotide
  Target: ATXN1; (+) strand; PAM type: YTN; PAM sequence: TTT
ttctctagtatgattttatt

SEQ ID NO: 271987 - DNA, 20 bp, Artificial Sequence
  Description of Artificial Sequence: Synthetic oligonucleotide
  Target: ATXN1; (+) strand; PAM type: YTN; PAM sequence: TTT
tctctagtatgattttattt

SEQ ID NO: 271988 - DNA, 20 bp, Artificial Sequence
  Description of Artificial Sequence: Synthetic oligonucleotide
  Target: ATXN1; (+) strand; PAM type: YTN; PAM sequence: TTT
ctctagtatgattttattta

SEQ ID NO: 271989 - DNA, 20 bp, Artificial Sequence
  Description of Artificial Sequence: Synthetic oligonucleotide
  Target: ATXN1; (+) strand; PAM type: YTN; PAM sequence: TTC
tctagtatgattttatttaa

SEQ ID NO: 271990 - DNA, 20 bp, Artificial Sequence
  Description of Artificial Sequence: Synthetic oligonucleotide
  Target: ATXN1; (+) strand; PAM type: YTN; PAM sequence: CTC
tagtatgattttatttaata

SEQ ID NO: 271991 - DNA, 20 bp, Artificial Sequence
  Description of Artificial Sequence: Synthetic oligonucleotide
  Target: ATXN1; (+) strand; PAM type: YTN; PAM sequence: CTA
gtatgattttatttaatagt

SEQ ID NO: 271992 - DNA, 20 bp, Artificial Sequence
  Description of Artificial Sequence: Synthetic oligonucleotide
  Target: ATXN1; (+) strand; PAM type: YTN; PAM sequence: TTT
tatttaatagttttacataa

SEQ ID NO: 271993 - DNA, 20 bp, Artificial Sequence
  Description of Artificial Sequence: Synthetic oligonucleotide
  Target: ATXN1; (+) strand; PAM type: YTN; PAM sequence: TTT
atttaatagttttacataag

SEQ ID NO: 271994 - DNA, 20 bp, Artificial Sequence
  Description of Artificial Sequence: Synthetic oligonucleotide
  Target: ATXN1; (+) strand; PAM type: YTN; PAM sequence: TTA
tttaatagttttacataagc

SEQ ID NO: 271995 - DNA, 20 bp, Artificial Sequence
  Description of Artificial Sequence: Synthetic oligonucleotide
  Target: ATXN1; (+) strand; PAM type: YTN; PAM sequence: TTT
aatagttttacataagcaaa

SEQ ID NO: 271996 - DNA, 20 bp, Artificial Sequence
  Description of Artificial Sequence: Synthetic oligonucleotide
  Target: ATXN1; (+) strand; PAM type: YTN; PAM sequence: TTA
atagttttacataagcaaag

SEQ ID NO: 271997 - DNA, 20 bp, Artificial Sequence
  Description of Artificial Sequence: Synthetic oligonucleotide
  Target: ATXN1; (+) strand; PAM type: YTN; PAM sequence: TTT
tacataagcaaagctgatgt

SEQ ID NO: 271998 - DNA, 20 bp, Artificial Sequence
  Description of Artificial Sequence: Synthetic oligonucleotide
  Target: ATXN1; (+) strand; PAM type: YTN; PAM sequence: TTT
acataagcaaagctgatgtc

SEQ ID NO: 271999 - DNA, 20 bp, Artificial Sequence
  Description of Artificial Sequence: Synthetic oligonucleotide
  Target: ATXN1; (+) strand; PAM type: YTN; PAM sequence: TTA
cataagcaaagctgatgtct

SEQ ID NO: 272000 - DNA, 20 bp, Artificial Sequence
  Description of Artificial Sequence: Synthetic oligonucleotide
  Target: ATXN1; (+) strand; PAM type: YTN; PAM sequence: CTG
atgtctcctctgacctcccc

SEQ ID NO: 272001 - DNA, 20 bp, Artificial Sequence
  Description of Artificial Sequence: Synthetic oligonucleotide
  Target: ATXN1; (+) strand; PAM type: YTN; PAM sequence: CTC
ctctgacctcccccttttaa

SEQ ID NO: 272002 - DNA, 20 bp, Artificial Sequence
  Description of Artificial Sequence: Synthetic oligonucleotide
  Target: ATXN1; (+) strand; PAM type: YTN; PAM sequence: CTC
tgacctcccccttttaaaat

SEQ ID NO: 272003 - DNA, 20 bp, Artificial Sequence
  Description of Artificial Sequence: Synthetic oligonucleotide
  Target: ATXN1; (+) strand; PAM type: YTN; PAM sequence: CTG
acctcccccttttaaaattt

SEQ ID NO: 272004 - DNA, 20 bp, Artificial Sequence
  Description of Artificial Sequence: Synthetic oligonucleotide
  Target: ATXN1; (+) strand; PAM type: YTN; PAM sequence: CTC
ccccttttaaaatttccaga

SEQ ID NO: 272005 - DNA, 20 bp, Artificial Sequence
  Description of Artificial Sequence: Synthetic oligonucleotide
  Target: ATXN1; (+) strand; PAM type: YTN; PAM sequence: CTT
ttaaaatttccagaaaataa

SEQ ID NO: 272006 - DNA, 20 bp, Artificial Sequence
  Description of Artificial Sequence: Synthetic oligonucleotide
  Target: ATXN1; (+) strand; PAM type: YTN; PAM sequence: TTT
taaaatttccagaaaataag

SEQ ID NO: 272007 - DNA, 20 bp, Artificial Sequence
  Description of Artificial Sequence: Synthetic oligonucleotide
  Target: ATXN1; (+) strand; PAM type: YTN; PAM sequence: TTT
aaaatttccagaaaataaga

SEQ ID NO: 272008 - DNA, 20 bp, Artificial Sequence
  Description of Artificial Sequence: Synthetic oligonucleotide
  Target: ATXN1; (+) strand; PAM type: YTN; PAM sequence: TTA
aaatttccagaaaataagac

SEQ ID NO: 272009 - DNA, 20 bp, Artificial Sequence
  Description of Artificial Sequence: Synthetic oligonucleotide
  Target: ATXN1; (+) strand; PAM type: YTN; PAM sequence: TTT
ccagaaaataagacattctg

SEQ ID NO: 272010 - DNA, 20 bp, Artificial Sequence
  Description of Artificial Sequence: Synthetic oligonucleotide
  Target: ATXN1; (+) strand; PAM type: YTN; PAM sequence: TTC
cagaaaataagacattctga

SEQ ID NO: 272011 - DNA, 20 bp, Artificial Sequence
  Description of Artificial Sequence: Synthetic oligonucleotide
  Target: ATXN1; (+) strand; PAM type: YTN; PAM sequence: TTC
tgatggagatcaggccacaa

SEQ ID NO: 272012 - DNA, 20 bp, Artificial Sequence
  Description of Artificial Sequence: Synthetic oligonucleotide
  Target: ATXN1; (+) strand; PAM type: YTN; PAM sequence: CTG
atggagatcaggccacaaga

SEQ ID NO: 272013 - DNA, 20 bp, Artificial Sequence
  Description of Artificial Sequence: Synthetic oligonucleotide
  Target: ATXN1; (+) strand; PAM type: YTN; PAM sequence: TTC
agaaaagggtaatttttgtt

SEQ ID NO: 272014 - DNA, 20 bp, Artificial Sequence
  Description of Artificial Sequence: Synthetic oligonucleotide
  Target: ATXN1; (+) strand; PAM type: YTN; PAM sequence: TTT
ttgttttaatttttctcctc

SEQ ID NO: 272015 - DNA, 20 bp, Artificial Sequence
  Description of Artificial Sequence: Synthetic oligonucleotide
  Target: ATXN1; (+) strand; PAM type: YTN; PAM sequence: TTT
tgttttaatttttctcctca

SEQ ID NO: 272016 - DNA, 20 bp, Artificial Sequence
  Description of Artificial Sequence: Synthetic oligonucleotide
  Target: ATXN1; (+) strand; PAM type: YTN; PAM sequence: TTT
gttttaatttttctcctcac

SEQ ID NO: 272017 - DNA, 20 bp, Artificial Sequence
  Description of Artificial Sequence: Synthetic oligonucleotide
  Target: ATXN1; (+) strand; PAM type: YTN; PAM sequence: TTG
ttttaatttttctcctcact

SEQ ID NO: 272018 - DNA, 20 bp, Artificial Sequence
  Description of Artificial Sequence: Synthetic oligonucleotide
  Target: ATXN1; (+) strand; PAM type: YTN; PAM sequence: TTT
taatttttctcctcactccc

SEQ ID NO: 272019 - DNA, 20 bp, Artificial Sequence
  Description of Artificial Sequence: Synthetic oligonucleotide
  Target: ATXN1; (+) strand; PAM type: YTN; PAM sequence: TTT
aatttttctcctcactccct

SEQ ID NO: 272020 - DNA, 20 bp, Artificial Sequence
  Description of Artificial Sequence: Synthetic oligonucleotide
  Target: ATXN1; (+) strand; PAM type: YTN; PAM sequence: TTA
atttttctcctcactcccta

SEQ ID NO: 272021 - DNA, 20 bp, Artificial Sequence
  Description of Artificial Sequence: Synthetic oligonucleotide
  Target: ATXN1; (+) strand; PAM type: YTN; PAM sequence: TTT
ttctcctcactccctatgta

SEQ ID NO: 272022 - DNA, 20 bp, Artificial Sequence
  Description of Artificial Sequence: Synthetic oligonucleotide
  Target: ATXN1; (+) strand; PAM type: YTN; PAM sequence: TTT
tctcctcactccctatgtaa

SEQ ID NO: 272023 - DNA, 20 bp, Artificial Sequence
  Description of Artificial Sequence: Synthetic oligonucleotide
  Target: ATXN1; (+) strand; PAM type: YTN; PAM sequence: TTT
ctcctcactccctatgtaat

SEQ ID NO: 272024 - DNA, 20 bp, Artificial Sequence
  Description of Artificial Sequence: Synthetic oligonucleotide
  Target: ATXN1; (+) strand; PAM type: YTN; PAM sequence: TTC
tcctcactccctatgtaatt

SEQ ID NO: 272025 - DNA, 20 bp, Artificial Sequence
  Description of Artificial Sequence: Synthetic oligonucleotide
  Target: ATXN1; (+) strand; PAM type: YTN; PAM sequence: CTC
ctcactccctatgtaattgg

SEQ ID NO: 272026 - DNA, 20 bp, Artificial Sequence
  Description of Artificial Sequence: Synthetic oligonucleotide
  Target: ATXN1; (+) strand; PAM type: YTN; PAM sequence: CTC
actccctatgtaattggtgg

SEQ ID NO: 272027 - DNA, 20 bp, Artificial Sequence
  Description of Artificial Sequence: Synthetic oligonucleotide
  Target: ATXN1; (+) strand; PAM type: YTN; PAM sequence: CTC
cctatgtaattggtggccag

SEQ ID NO: 272028 - DNA, 20 bp, Artificial Sequence
  Description of Artificial Sequence: Synthetic oligonucleotide
  Target: ATXN1; (+) strand; PAM type: YTN; PAM sequence: CTA
tgtaattggtggccaggata

SEQ ID NO: 272029 - DNA, 20 bp, Artificial Sequence
  Description of Artificial Sequence: Synthetic oligonucleotide
  Target: ATXN1; (+) strand; PAM type: YTN; PAM sequence: TTG
gtggccaggatattgaaatt

SEQ ID NO: 272030 - DNA, 20 bp, Artificial Sequence
  Description of Artificial Sequence: Synthetic oligonucleotide
  Target: ATXN1; (+) strand; PAM type: YTN; PAM sequence: TTG
aaattctctggaaaacacag

SEQ ID NO: 272031 - DNA, 20 bp, Artificial Sequence
  Description of Artificial Sequence: Synthetic oligonucleotide
  Target: ATXN1; (+) strand; PAM type: YTN; PAM sequence: TTC
tctggaaaacacagaatcca

SEQ ID NO: 272032 - DNA, 20 bp, Artificial Sequence
  Description of Artificial Sequence: Synthetic oligonucleotide
  Target: ATXN1; (+) strand; PAM type: YTN; PAM sequence: CTC
tggaaaacacagaatccatt

SEQ ID NO: 272033 - DNA, 20 bp, Artificial Sequence
  Description of Artificial Sequence: Synthetic oligonucleotide
  Target: ATXN1; (+) strand; PAM type: YTN; PAM sequence: CTG
gaaaacacagaatccattta

SEQ ID NO: 272034 - DNA, 20 bp, Artificial Sequence
  Description of Artificial Sequence: Synthetic oligonucleotide
  Target: ATXN1; (+) strand; PAM type: YTN; PAM sequence: TTT
acatgatgaattcaatgata

SEQ ID NO: 272035 - DNA, 20 bp, Artificial Sequence
  Description of Artificial Sequence: Synthetic oligonucleotide
  Target: ATXN1; (+) strand; PAM type: YTN; PAM sequence: TTA
catgatgaattcaatgatat

SEQ ID NO: 272036 - DNA, 20 bp, Artificial Sequence
  Description of Artificial Sequence: Synthetic oligonucleotide
  Target: ATXN1; (+) strand; PAM type: YTN; PAM sequence: TTC
aatgatatattataatgtct

SEQ ID NO: 272037 - DNA, 20 bp, Artificial Sequence
  Description of Artificial Sequence: Synthetic oligonucleotide
  Target: ATXN1; (+) strand; PAM type: YTN; PAM sequence: TTA
taatgtcttgttcagaagtg

SEQ ID NO: 272038 - DNA, 20 bp, Artificial Sequence
  Description of Artificial Sequence: Synthetic oligonucleotide
  Target: ATXN1; (+) strand; PAM type: YTN; PAM sequence: CTT
gttcagaagtgttaggagaa

SEQ ID NO: 272039 - DNA, 20 bp, Artificial Sequence
  Description of Artificial Sequence: Synthetic oligonucleotide
  Target: ATXN1; (+) strand; PAM type: YTN; PAM sequence: TTG
ttcagaagtgttaggagaat

SEQ ID NO: 272040 - DNA, 20 bp, Artificial Sequence
  Description of Artificial Sequence: Synthetic oligonucleotide
  Target: ATXN1; (+) strand; PAM type: YTN; PAM sequence: TTC
agaagtgttaggagaattga

SEQ ID NO: 272041 - DNA, 20 bp, Artificial Sequence
  Description of Artificial Sequence: Synthetic oligonucleotide
  Target: ATXN1; (+) strand; PAM type: YTN; PAM sequence: TTA
ggagaattgatgagttaatg

SEQ ID NO: 272042 - DNA, 20 bp, Artificial Sequence
  Description of Artificial Sequence: Synthetic oligonucleotide
  Target: ATXN1; (+) strand; PAM type: YTN; PAM sequence: TTG
atgagttaatgttggtaaat

SEQ ID NO: 272043 - DNA, 20 bp, Artificial Sequence
  Description of Artificial Sequence: Synthetic oligonucleotide
  Target: ATXN1; (+) strand; PAM type: YTN; PAM sequence: TTA
atgttggtaaatcactctgc

SEQ ID NO: 272044 - DNA, 20 bp, Artificial Sequence
  Description of Artificial Sequence: Synthetic oligonucleotide
  Target: ATXN1; (+) strand; PAM type: YTN; PAM sequence: TTG
gtaaatcactctgcaattcc

SEQ ID NO: 272045 - DNA, 20 bp, Artificial Sequence
  Description of Artificial Sequence: Synthetic oligonucleotide
  Target: ATXN1; (+) strand; PAM type: YTN; PAM sequence: CTC
tgcaattcccaggtcaaaga

SEQ ID NO: 272046 - DNA, 20 bp, Artificial Sequence
  Description of Artificial Sequence: Synthetic oligonucleotide
  Target: ATXN1; (+) strand; PAM type: YTN; PAM sequence: CTG
caattcccaggtcaaagatg

SEQ ID NO: 272047 - DNA, 20 bp, Artificial Sequence
  Description of Artificial Sequence: Synthetic oligonucleotide
  Target: ATXN1; (+) strand; PAM type: YTN; PAM sequence: TTC
ccaggtcaaagatgtgaaat

SEQ ID NO: 272048 - DNA, 20 bp, Artificial Sequence
  Description of Artificial Sequence: Synthetic oligonucleotide
  Target: ATXN1; (+) strand; PAM type: YTN; PAM sequence: TTA
tcattatttgtttcagtgga

SEQ ID NO: 272049 - DNA, 20 bp, Artificial Sequence
  Description of Artificial Sequence: Synthetic oligonucleotide
  Target: ATXN1; (+) strand; PAM type: YTN; PAM sequence: TTA
tttgtttcagtggaggctca

SEQ ID NO: 272050 - DNA, 20 bp, Artificial Sequence
  Description of Artificial Sequence: Synthetic oligonucleotide
  Target: ATXN1; (+) strand; PAM type: YTN; PAM sequence: TTT
gtttcagtggaggctcactg

SEQ ID NO: 272051 - DNA, 20 bp, Artificial Sequence
  Description of Artificial Sequence: Synthetic oligonucleotide
  Target: ATXN1; (+) strand; PAM type: YTN; PAM sequence: TTG
tttcagtggaggctcactgg

SEQ ID NO: 272052 - DNA, 20 bp, Artificial Sequence
  Description of Artificial Sequence: Synthetic oligonucleotide
  Target: ATXN1; (+) strand; PAM type: YTN; PAM sequence: TTT
cagtggaggctcactggcaa

SEQ ID NO: 272053 - DNA, 20 bp, Artificial Sequence
  Description of Artificial Sequence: Synthetic oligonucleotide
  Target: ATXN1; (+) strand; PAM type: YTN; PAM sequence: TTC
agtggaggctcactggcaaa

SEQ ID NO: 272054 - DNA, 20 bp, Artificial Sequence
  Description of Artificial Sequence: Synthetic oligonucleotide
  Target: ATXN1; (+) strand; PAM type: YTN; PAM sequence: CTC
actggcaaaatgtggtctag

SEQ ID NO: 272055 - DNA, 20 bp, Artificial Sequence
  Description of Artificial Sequence: Synthetic oligonucleotide
  Target: ATXN1; (+) strand; PAM type: YTN; PAM sequence: CTG
gcaaaatgtggtctagtggg

SEQ ID NO: 272056 - DNA, 20 bp, Artificial Sequence
  Description of Artificial Sequence: Synthetic oligonucleotide
  Target: ATXN1; (+) strand; PAM type: YTN; PAM sequence: CTA
gtgggcctgattaggaaaca

SEQ ID NO: 272057 - DNA, 20 bp, Artificial Sequence
  Description of Artificial Sequence: Synthetic oligonucleotide
  Target: ATXN1; (+) strand; PAM type: YTN; PAM sequence: CTG
attaggaaacaaaagcttat

SEQ ID NO: 272058 - DNA, 20 bp, Artificial Sequence
  Description of Artificial Sequence: Synthetic oligonucleotide
  Target: ATXN1; (+) strand; PAM type: YTN; PAM sequence: TTA
ggaaacaaaagcttataact

SEQ ID NO: 272059 - DNA, 20 bp, Artificial Sequence
  Description of Artificial Sequence: Synthetic oligonucleotide
  Target: ATXN1; (+) strand; PAM type: YTN; PAM sequence: CTT
ataactttgcagcaagaggg

SEQ ID NO: 272060 - DNA, 20 bp, Artificial Sequence
  Description of Artificial Sequence: Synthetic oligonucleotide
  Target: ATXN1; (+) strand; PAM type: YTN; PAM sequence: TTA
taactttgcagcaagagggg

SEQ ID NO: 272061 - DNA, 20 bp, Artificial Sequence
  Description of Artificial Sequence: Synthetic oligonucleotide
  Target: ATXN1; (+) strand; PAM type: YTN; PAM sequence: CTT
tgcagcaagaggggaaaaca

SEQ ID NO: 272062 - DNA, 20 bp, Artificial Sequence
  Description of Artificial Sequence: Synthetic oligonucleotide
  Target: ATXN1; (+) strand; PAM type: YTN; PAM sequence: TTT
gcagcaagaggggaaaacat

SEQ ID NO: 272063 - DNA, 20 bp, Artificial Sequence
  Description of Artificial Sequence: Synthetic oligonucleotide
  Target: ATXN1; (+) strand; PAM type: YTN; PAM sequence: TTG
cagcaagaggggaaaacatt

SEQ ID NO: 272064 - DNA, 20 bp, Artificial Sequence
  Description of Artificial Sequence: Synthetic oligonucleotide
  Target: ATXN1; (+) strand; PAM type: YTN; PAM sequence: TTT
tttcagtactaccttttacc

SEQ ID NO: 272065 - DNA, 20 bp, Artificial Sequence
  Description of Artificial Sequence: Synthetic oligonucleotide
  Target: ATXN1; (+) strand; PAM type: YTN; PAM sequence: TTT
ttcagtactaccttttacct

SEQ ID NO: 272066 - DNA, 20 bp, Artificial Sequence
  Description of Artificial Sequence: Synthetic oligonucleotide
  Target: ATXN1; (+) strand; PAM type: YTN; PAM sequence: TTT
tcagtactaccttttaccta

SEQ ID NO: 272067 - DNA, 20 bp, Artificial Sequence
  Description of Artificial Sequence: Synthetic oligonucleotide
  Target: ATXN1; (+) strand; PAM type: YTN; PAM sequence: TTT
cagtactaccttttacctaa

SEQ ID NO: 272068 - DNA, 20 bp, Artificial Sequence
  Description of Artificial Sequence: Synthetic oligonucleotide
  Target: ATXN1; (+) strand; PAM type: YTN; PAM sequence: TTC
agtactaccttttacctaat

SEQ ID NO: 272069 - DNA, 20 bp, Artificial Sequence
  Description of Artificial Sequence: Synthetic oligonucleotide
  Target: ATXN1; (+) strand; PAM type: YTN; PAM sequence: CTA
ccttttacctaattctcttc

SEQ ID NO: 272070 - DNA, 20 bp, Artificial Sequence
  Description of Artificial Sequence: Synthetic oligonucleotide
  Target: ATXN1; (+) strand; PAM type: YTN; PAM sequence: CTT
ttacctaattctcttctacc

SEQ ID NO: 272071 - DNA, 20 bp, Artificial Sequence
  Description of Artificial Sequence: Synthetic oligonucleotide
  Target: ATXN1; (+) strand; PAM type: YTN; PAM sequence: TTT
tacctaattctcttctaccc

SEQ ID NO: 272072 - DNA, 20 bp, Artificial Sequence
  Description of Artificial Sequence: Synthetic oligonucleotide
  Target: ATXN1; (+) strand; PAM type: YTN; PAM sequence: TTT
acctaattctcttctaccct

SEQ ID NO: 272073 - DNA, 20 bp, Artificial Sequence
  Description of Artificial Sequence: Synthetic oligonucleotide
  Target: ATXN1; (+) strand; PAM type: YTN; PAM sequence: TTA
cctaattctcttctacccta

SEQ ID NO: 272074 - DNA, 20 bp, Artificial Sequence
  Description of Artificial Sequence: Synthetic oligonucleotide
  Target: ATXN1; (+) strand; PAM type: YTN; PAM sequence: CTA
attctcttctaccctaaggg

SEQ ID NO: 272075 - DNA, 20 bp, Artificial Sequence
  Description of Artificial Sequence: Synthetic oligonucleotide
  Target: ATXN1; (+) strand; PAM type: YTN; PAM sequence: TTC
tcttctaccctaagggagta

SEQ ID NO: 272076 - DNA, 20 bp, Artificial Sequence
  Description of Artificial Sequence: Synthetic oligonucleotide
  Target: ATXN1; (+) strand; PAM type: YTN; PAM sequence: CTC
ttctaccctaagggagtaaa

SEQ ID NO: 272077 - DNA, 20 bp, Artificial Sequence
  Description of Artificial Sequence: Synthetic oligonucleotide
  Target: ATXN1; (+) strand; PAM type: YTN; PAM sequence: CTT
ctaccctaagggagtaaagg

SEQ ID NO: 272078 - DNA, 20 bp, Artificial Sequence
  Description of Artificial Sequence: Synthetic oligonucleotide
  Target: ATXN1; (+) strand; PAM type: YTN; PAM sequence: TTC
taccctaagggagtaaaggg

SEQ ID NO: 272079 - DNA, 20 bp, Artificial Sequence
  Description of Artificial Sequence: Synthetic oligonucleotide
  Target: ATXN1; (+) strand; PAM type: YTN; PAM sequence: CTA
ccctaagggagtaaagggca

SEQ ID NO: 272080 - DNA, 20 bp, Artificial Sequence
  Description of Artificial Sequence: Synthetic oligonucleotide
  Target: ATXN1; (+) strand; PAM type: YTN; PAM sequence: CTA
agggagtaaagggcatgcca

SEQ ID NO: 272081 - DNA, 20 bp, Artificial Sequence
  Description of Artificial Sequence: Synthetic oligonucleotide
  Target: ATXN1; (+) strand; PAM type: YTN; PAM sequence: TTA
ttgataacatcattcaacgc

SEQ ID NO: 272082 - DNA, 20 bp, Artificial Sequence
  Description of Artificial Sequence: Synthetic oligonucleotide
  Target: ATXN1; (+) strand; PAM type: YTN; PAM sequence: TTG
ataacatcattcaacgccat

SEQ ID NO: 272083 - DNA, 20 bp, Artificial Sequence
  Description of Artificial Sequence: Synthetic oligonucleotide
  Target: ATXN1; (+) strand; PAM type: YTN; PAM sequence: TTC
aacgccatgtaatgagttga

SEQ ID NO: 272084 - DNA, 20 bp, Artificial Sequence
  Description of Artificial Sequence: Synthetic oligonucleotide
  Target: ATXN1; (+) strand; PAM type: YTN; PAM sequence: TTG
acaccactgaaataaaccaa

SEQ ID NO: 272085 - DNA, 20 bp, Artificial Sequence
  Description of Artificial Sequence: Synthetic oligonucleotide
  Target: ATXN1; (+) strand; PAM type: YTN; PAM sequence: CTG
aaataaaccaaaggatgtag

SEQ ID NO: 272086 - DNA, 20 bp, Artificial Sequence
  Description of Artificial Sequence: Synthetic oligonucleotide
  Target: ATXN1; (+) strand; PAM type: YTN; PAM sequence: CTG
gatggatgaatggacagatg

SEQ ID NO: 272087 - DNA, 20 bp, Artificial Sequence
  Description of Artificial Sequence: Synthetic oligonucleotide
  Target: ATXN1; (+) strand; PAM type: YTN; PAM sequence: CTC
ctccgtgttatatattaagg

SEQ ID NO: 272088 - DNA, 20 bp, Artificial Sequence
  Description of Artificial Sequence: Synthetic oligonucleotide
  Target: ATXN1; (+) strand; PAM type: YTN; PAM sequence: CTC
cgtgttatatattaaggctg

SEQ ID NO: 272089 - DNA, 20 bp, Artificial Sequence
  Description of Artificial Sequence: Synthetic oligonucleotide
  Target: ATXN1; (+) strand; PAM type: YTN; PAM sequence: TTA
tatattaaggctgctttttt

SEQ ID NO: 272090 - DNA, 20 bp, Artificial Sequence
  Description of Artificial Sequence: Synthetic oligonucleotide
  Target: ATXN1; (+) strand; PAM type: YTN; PAM sequence: TTA
aggctgcttttttagaacac

SEQ ID NO: 272091 - DNA, 20 bp, Artificial Sequence
  Description of Artificial Sequence: Synthetic oligonucleotide
  Target: ATXN1; (+) strand; PAM type: YTN; PAM sequence: CTG
cttttttagaacactgtcct

SEQ ID NO: 272092 - DNA, 20 bp, Artificial Sequence
  Description of Artificial Sequence: Synthetic oligonucleotide
  Target: ATXN1; (+) strand; PAM type: YTN; PAM sequence: CTT
ttttagaacactgtccttct

SEQ ID NO: 272093 - DNA, 20 bp, Artificial Sequence
  Description of Artificial Sequence: Synthetic oligonucleotide
  Target: ATXN1; (+) strand; PAM type: YTN; PAM sequence: TTT
tttagaacactgtccttctt

SEQ ID NO: 272094 - DNA, 20 bp, Artificial Sequence
  Description of Artificial Sequence: Synthetic oligonucleotide
  Target: ATXN1; (+) strand; PAM type: YTN; PAM sequence: TTT
ttagaacactgtccttctta

SEQ ID NO: 272095 - DNA, 20 bp, Artificial Sequence
  Description of Artificial Sequence: Synthetic oligonucleotide
  Target: ATXN1; (+) strand; PAM type: YTN; PAM sequence: TTT
tagaacactgtccttcttac

SEQ ID NO: 272096 - DNA, 20 bp, Artificial Sequence
  Description of Artificial Sequence: Synthetic oligonucleotide
  Target: ATXN1; (+) strand; PAM type: YTN; PAM sequence: TTT
agaacactgtccttcttacc

SEQ ID NO: 272097 - DNA, 20 bp, Artificial Sequence
  Description of Artificial Sequence: Synthetic oligonucleotide
  Target: ATXN1; (+) strand; PAM type: YTN; PAM sequence: TTA
gaacactgtccttcttaccc

SEQ ID NO: 272098 - DNA, 20 bp, Artificial Sequence
  Description of Artificial Sequence: Synthetic oligonucleotide
  Target: ATXN1; (+) strand; PAM type: YTN; PAM sequence: CTG
tccttcttacccaaattatc

SEQ ID NO: 272099 - DNA, 20 bp, Artificial Sequence
  Description of Artificial Sequence: Synthetic oligonucleotide
  Target: ATXN1; (+) strand; PAM type: YTN; PAM sequence: CTT
cttacccaaattatcactgt

SEQ ID NO: 272100 - DNA, 20 bp, Artificial Sequence
  Description of Artificial Sequence: Synthetic oligonucleotide
  Target: ATXN1; (+) strand; PAM type: YTN; PAM sequence: TTC
ttacccaaattatcactgta

SEQ ID NO: 272101 - DNA, 20 bp, Artificial Sequence
  Description of Artificial Sequence: Synthetic oligonucleotide
  Target: ATXN1; (+) strand; PAM type: YTN; PAM sequence: CTT
acccaaattatcactgtaga

SEQ ID NO: 272102 - DNA, 20 bp, Artificial Sequence
  Description of Artificial Sequence: Synthetic oligonucleotide
  Target: ATXN1; (+) strand; PAM type: YTN; PAM sequence: TTA
cccaaattatcactgtagaa

SEQ ID NO: 272103 - DNA, 20 bp, Artificial Sequence
  Description of Artificial Sequence: Synthetic oligonucleotide
  Target: ATXN1; (+) strand; PAM type: YTN; PAM sequence: TTA
tcactgtagaagcagatcat

SEQ ID NO: 272104 - DNA, 20 bp, Artificial Sequence
  Description of Artificial Sequence: Synthetic oligonucleotide
  Target: ATXN1; (+) strand; PAM type: YTN; PAM sequence: CTG
tagaagcagatcatcatgct

SEQ ID NO: 272105 - DNA, 20 bp, Artificial Sequence
  Description of Artificial Sequence: Synthetic oligonucleotide
  Target: ATXN1; (+) strand; PAM type: YTN; PAM sequence: CTT
taagccttagaatatgatgg

SEQ ID NO: 272106 - DNA, 20 bp, Artificial Sequence
  Description of Artificial Sequence: Synthetic oligonucleotide
  Target: ATXN1; (+) strand; PAM type: YTN; PAM sequence: TTT
aagccttagaatatgatgga

SEQ ID NO: 272107 - DNA, 20 bp, Artificial Sequence
  Description of Artificial Sequence: Synthetic oligonucleotide
  Target: ATXN1; (+) strand; PAM type: YTN; PAM sequence: TTA
agccttagaatatgatggat

SEQ ID NO: 272108 - DNA, 20 bp, Artificial Sequence
  Description of Artificial Sequence: Synthetic oligonucleotide
  Target: ATXN1; (+) strand; PAM type: YTN; PAM sequence: CTT
agaatatgatggatttcaat

SEQ ID NO: 272109 - DNA, 20 bp, Artificial Sequence
  Description of Artificial Sequence: Synthetic oligonucleotide
  Target: ATXN1; (+) strand; PAM type: YTN; PAM sequence: TTA
gaatatgatggatttcaatt

SEQ ID NO: 272110 - DNA, 20 bp, Artificial Sequence
  Description of Artificial Sequence: Synthetic oligonucleotide
  Target: ATXN1; (+) strand; PAM type: YTN; PAM sequence: TTT
caattactgcatcatatctg

SEQ ID NO: 272111 - DNA, 20 bp, Artificial Sequence
  Description of Artificial Sequence: Synthetic oligonucleotide
  Target: ATXN1; (+) strand; PAM type: YTN; PAM sequence: TTC
aattactgcatcatatctgt

SEQ ID NO: 272112 - DNA, 20 bp, Artificial Sequence
  Description of Artificial Sequence: Synthetic oligonucleotide
  Target: ATXN1; (+) strand; PAM type: YTN; PAM sequence: TTA
ctgcatcatatctgtgagat

SEQ ID NO: 272113 - DNA, 20 bp, Artificial Sequence
  Description of Artificial Sequence: Synthetic oligonucleotide
  Target: ATXN1; (+) strand; PAM type: YTN; PAM sequence: CTG
catcatatctgtgagatttt

SEQ ID NO: 272114 - DNA, 20 bp, Artificial Sequence
  Description of Artificial Sequence: Synthetic oligonucleotide
  Target: ATXN1; (+) strand; PAM type: YTN; PAM sequence: CTG
tgagatttttggttaggaac

SEQ ID NO: 272115 - DNA, 20 bp, Artificial Sequence
  Description of Artificial Sequence: Synthetic oligonucleotide
  Target: ATXN1; (+) strand; PAM type: YTN; PAM sequence: TTT
ttggttaggaacttttaata

SEQ ID NO: 272116 - DNA, 20 bp, Artificial Sequence
  Description of Artificial Sequence: Synthetic oligonucleotide
  Target: ATXN1; (+) strand; PAM type: YTN; PAM sequence: TTT
tggttaggaacttttaatat

SEQ ID NO: 272117 - DNA, 20 bp, Artificial Sequence
  Description of Artificial Sequence: Synthetic oligonucleotide
  Target: ATXN1; (+) strand; PAM type: YTN; PAM sequence: TTT
ggttaggaacttttaatatg

SEQ ID NO: 272118 - DNA, 20 bp, Artificial Sequence
  Description of Artificial Sequence: Synthetic oligonucleotide
  Target: ATXN1; (+) strand; PAM type: YTN; PAM sequence: TTG
gttaggaacttttaatatga

SEQ ID NO: 272119 - DNA, 20 bp, Artificial Sequence
  Description of Artificial Sequence: Synthetic oligonucleotide
  Target: ATXN1; (+) strand; PAM type: YTN; PAM sequence: TTA
ggaacttttaatatgaattt

SEQ ID NO: 272120 - DNA, 20 bp, Artificial Sequence
  Description of Artificial Sequence: Synthetic oligonucleotide
  Target: ATXN1; (+) strand; PAM type: YTN; PAM sequence: CTT
ttaatatgaatttgtccaat

SEQ ID NO: 272121 - DNA, 20 bp, Artificial Sequence
  Description of Artificial Sequence: Synthetic oligonucleotide
  Target: ATXN1; (+) strand; PAM type: YTN; PAM sequence: TTT
taatatgaatttgtccaatt

SEQ ID NO: 272122 - DNA, 20 bp, Artificial Sequence
  Description of Artificial Sequence: Synthetic oligonucleotide
  Target: ATXN1; (+) strand; PAM type: YTN; PAM sequence: TTT
aatatgaatttgtccaattt

SEQ ID NO: 272123 - DNA, 20 bp, Artificial Sequence
  Description of Artificial Sequence: Synthetic oligonucleotide
  Target: ATXN1; (+) strand; PAM type: YTN; PAM sequence: TTA
atatgaatttgtccaatttt

SEQ ID NO: 272124 - DNA, 20 bp, Artificial Sequence
  Description of Artificial Sequence: Synthetic oligonucleotide
  Target: ATXN1; (+) strand; PAM type: YTN; PAM sequence: TTT
gtccaattttttcagtaatg

SEQ ID NO: 272125 - DNA, 20 bp, Artificial Sequence
  Description of Artificial Sequence: Synthetic oligonucleotide
  Target: ATXN1; (+) strand; PAM type: YTN; PAM sequence: TTG
tccaattttttcagtaatgc

SEQ ID NO: 272126 - DNA, 20 bp, Artificial Sequence
  Description of Artificial Sequence: Synthetic oligonucleotide
  Target: ATXN1; (+) strand; PAM type: YTN; PAM sequence: TTT
tttcagtaatgcaaaacttt

SEQ ID NO: 272127 - DNA, 20 bp, Artificial Sequence
  Description of Artificial Sequence: Synthetic oligonucleotide
  Target: ATXN1; (+) strand; PAM type: YTN; PAM sequence: TTT
ttcagtaatgcaaaactttt

SEQ ID NO: 272128 - DNA, 20 bp, Artificial Sequence
  Description of Artificial Sequence: Synthetic oligonucleotide
  Target: ATXN1; (+) strand; PAM type: YTN; PAM sequence: TTT
tcagtaatgcaaaacttttt

SEQ ID NO: 272129 - DNA, 20 bp, Artificial Sequence
  Description of Artificial Sequence: Synthetic oligonucleotide
  Target: ATXN1; (+) strand; PAM type: YTN; PAM sequence: TTT
cagtaatgcaaaactttttg

SEQ ID NO: 272130 - DNA, 20 bp, Artificial Sequence
  Description of Artificial Sequence: Synthetic oligonucleotide
  Target: ATXN1; (+) strand; PAM type: YTN; PAM sequence: TTC
agtaatgcaaaactttttgg

SEQ ID NO: 272131 - DNA, 20 bp, Artificial Sequence
  Description of Artificial Sequence: Synthetic oligonucleotide
  Target: ATXN1; (+) strand; PAM type: YTN; PAM sequence: CTT
tttggtttaatatctgttgt

SEQ ID NO: 272132 - DNA, 20 bp, Artificial Sequence
  Description of Artificial Sequence: Synthetic oligonucleotide
  Target: ATXN1; (+) strand; PAM type: YTN; PAM sequence: TTT
ttggtttaatatctgttgtt

SEQ ID NO: 272133 - DNA, 20 bp, Artificial Sequence
  Description of Artificial Sequence: Synthetic oligonucleotide
  Target: ATXN1; (+) strand; PAM type: YTN; PAM sequence: TTT
tggtttaatatctgttgtta

SEQ ID NO: 272134 - DNA, 20 bp, Artificial Sequence
  Description of Artificial Sequence: Synthetic oligonucleotide
  Target: ATXN1; (+) strand; PAM type: YTN; PAM sequence: TTT
ggtttaatatctgttgttat

SEQ ID NO: 272135 - DNA, 20 bp, Artificial Sequence
  Description of Artificial Sequence: Synthetic oligonucleotide
  Target: ATXN1; (+) strand; PAM type: YTN; PAM sequence: TTG
gtttaatatctgttgttatt

SEQ ID NO: 272136 - DNA, 20 bp, Artificial Sequence
  Description of Artificial Sequence: Synthetic oligonucleotide
  Target: ATXN1; (+) strand; PAM type: YTN; PAM sequence: TTT
aatatctgttgttattccta

SEQ ID NO: 272137 - DNA, 20 bp, Artificial Sequence
  Description of Artificial Sequence: Synthetic oligonucleotide
  Target: ATXN1; (+) strand; PAM type: YTN; PAM sequence: TTA
atatctgttgttattcctac

SEQ ID NO: 272138 - DNA, 20 bp, Artificial Sequence
  Description of Artificial Sequence: Synthetic oligonucleotide
  Target: ATXN1; (+) strand; PAM type: YTN; PAM sequence: CTG
ttgttattcctacccttgtc

SEQ ID NO: 272139 - DNA, 20 bp, Artificial Sequence
  Description of Artificial Sequence: Synthetic oligonucleotide
  Target: ATXN1; (+) strand; PAM type: YTN; PAM sequence: TTG
ttattcctacccttgtcagc

SEQ ID NO: 272140 - DNA, 20 bp, Artificial Sequence
  Description of Artificial Sequence: Synthetic oligonucleotide
  Target: ATXN1; (+) strand; PAM type: YTN; PAM sequence: TTA
ttcctacccttgtcagccaa

SEQ ID NO: 272141 - DNA, 20 bp, Artificial Sequence
  Description of Artificial Sequence: Synthetic oligonucleotide
  Target: ATXN1; (+) strand; PAM type: YTN; PAM sequence: TTC
ctacccttgtcagccaaact

SEQ ID NO: 272142 - DNA, 20 bp, Artificial Sequence
  Description of Artificial Sequence: Synthetic oligonucleotide
  Target: ATXN1; (+) strand; PAM type: YTN; PAM sequence: CTA
cccttgtcagccaaactcat

SEQ ID NO: 272143 - DNA, 20 bp, Artificial Sequence
  Description of Artificial Sequence: Synthetic oligonucleotide
  Target: ATXN1; (+) strand; PAM type: YTN; PAM sequence: CTT
gtcagccaaactcataaaat

SEQ ID NO: 272144 - DNA, 20 bp, Artificial Sequence
  Description of Artificial Sequence: Synthetic oligonucleotide
  Target: ATXN1; (+) strand; PAM type: YTN; PAM sequence: TTG
tcagccaaactcataaaata

SEQ ID NO: 272145 - DNA, 20 bp, Artificial Sequence
  Description of Artificial Sequence: Synthetic oligonucleotide
  Target: ATXN1; (+) strand; PAM type: YTN; PAM sequence: CTC
ataaaataaagattttctaa

SEQ ID NO: 272146 - DNA, 20 bp, Artificial Sequence
  Description of Artificial Sequence: Synthetic oligonucleotide
  Target: ATXN1; (+) strand; PAM type: YTN; PAM sequence: TTT
tctaatatatggtatttaga

SEQ ID NO: 272147 - DNA, 20 bp, Artificial Sequence
  Description of Artificial Sequence: Synthetic oligonucleotide
  Target: ATXN1; (+) strand; PAM type: YTN; PAM sequence: TTT
ctaatatatggtatttagaa

SEQ ID NO: 272148 - DNA, 20 bp, Artificial Sequence
  Description of Artificial Sequence: Synthetic oligonucleotide
  Target: ATXN1; (+) strand; PAM type: YTN; PAM sequence: TTC
taatatatggtatttagaaa

SEQ ID NO: 272149 - DNA, 20 bp, Artificial Sequence
  Description of Artificial Sequence: Synthetic oligonucleotide
  Target: ATXN1; (+) strand; PAM type: YTN; PAM sequence: CTA
atatatggtatttagaaatt

SEQ ID NO: 272150 - DNA, 20 bp, Artificial Sequence
  Description of Artificial Sequence: Synthetic oligonucleotide
  Target: ATXN1; (+) strand; PAM type: YTN; PAM sequence: TTT
agaaattctctgcactatag

SEQ ID NO: 272151 - DNA, 20 bp, Artificial Sequence
  Description of Artificial Sequence: Synthetic oligonucleotide
  Target: ATXN1; (+) strand; PAM type: YTN; PAM sequence: TTA
gaaattctctgcactataga

SEQ ID NO: 272152 - DNA, 20 bp, Artificial Sequence
  Description of Artificial Sequence: Synthetic oligonucleotide
  Target: ATXN1; (+) strand; PAM type: YTN; PAM sequence: TTC
tctgcactatagaaggtgtt

SEQ ID NO: 272153 - DNA, 20 bp, Artificial Sequence
  Description of Artificial Sequence: Synthetic oligonucleotide
  Target: ATXN1; (+) strand; PAM type: YTN; PAM sequence: CTC
tgcactatagaaggtgtttg

SEQ ID NO: 272154 - DNA, 20 bp, Artificial Sequence
  Description of Artificial Sequence: Synthetic oligonucleotide
  Target: ATXN1; (+) strand; PAM type: YTN; PAM sequence: CTG
cactatagaaggtgtttgaa

SEQ ID NO: 272155 - DNA, 20 bp, Artificial Sequence
  Description of Artificial Sequence: Synthetic oligonucleotide
  Target: ATXN1; (+) strand; PAM type: YTN; PAM sequence: CTA
tagaaggtgtttgaagttaa

SEQ ID NO: 272156 - DNA, 20 bp, Artificial Sequence
  Description of Artificial Sequence: Synthetic oligonucleotide
  Target: ATXN1; (+) strand; PAM type: YTN; PAM sequence: TTT
gaagttaatgaataaataaa

SEQ ID NO: 272157 - DNA, 20 bp, Artificial Sequence
  Description of Artificial Sequence: Synthetic oligonucleotide
  Target: ATXN1; (+) strand; PAM type: YTN; PAM sequence: TTG
aagttaatgaataaataaat

SEQ ID NO: 272158 - DNA, 20 bp, Artificial Sequence
  Description of Artificial Sequence: Synthetic oligonucleotide
  Target: ATXN1; (+) strand; PAM type: YTN; PAM sequence: TTA
atgaataaataaatggataa

SEQ ID NO: 272159 - DNA, 20 bp, Artificial Sequence
  Description of Artificial Sequence: Synthetic oligonucleotide
  Target: ATXN1; (+) strand; PAM type: YTN; PAM sequence: CTG
caatgtccgaaggaactctg

SEQ ID NO: 272160 - DNA, 20 bp, Artificial Sequence
  Description of Artificial Sequence: Synthetic oligonucleotide
  Target: ATXN1; (+) strand; PAM type: YTN; PAM sequence: CTC
tgaaacgttcctcatgcctc

SEQ ID NO: 272161 - DNA, 20 bp, Artificial Sequence
  Description of Artificial Sequence: Synthetic oligonucleotide
  Target: ATXN1; (+) strand; PAM type: YTN; PAM sequence: CTG
aaacgttcctcatgcctcta

SEQ ID NO: 272162 - DNA, 20 bp, Artificial Sequence
  Description of Artificial Sequence: Synthetic oligonucleotide
  Target: ATXN1; (+) strand; PAM type: YTN; PAM sequence: TTC
ctcatgcctctaggaaagac

SEQ ID NO: 272163 - DNA, 20 bp, Artificial Sequence
  Description of Artificial Sequence: Synthetic oligonucleotide
  Target: ATXN1; (+) strand; PAM type: YTN; PAM sequence: CTC
atgcctctaggaaagactga

SEQ ID NO: 272164 - DNA, 20 bp, Artificial Sequence
  Description of Artificial Sequence: Synthetic oligonucleotide
  Target: ATXN1; (+) strand; PAM type: YTN; PAM sequence: CTC
taggaaagactgacctttga

SEQ ID NO: 272165 - DNA, 20 bp, Artificial Sequence
  Description of Artificial Sequence: Synthetic oligonucleotide
  Target: ATXN1; (+) strand; PAM type: YTN; PAM sequence: CTA
ggaaagactgacctttgaat

SEQ ID NO: 272166 - DNA, 20 bp, Artificial Sequence
  Description of Artificial Sequence: Synthetic oligonucleotide
  Target: ATXN1; (+) strand; PAM type: YTN; PAM sequence: CTG
acctttgaatacgccagaca

SEQ ID NO: 272167 - DNA, 20 bp, Artificial Sequence
  Description of Artificial Sequence: Synthetic oligonucleotide
  Target: ATXN1; (+) strand; PAM type: YTN; PAM sequence: CTT
tgaatacgccagacaagtat

SEQ ID NO: 272168 - DNA, 20 bp, Artificial Sequence
  Description of Artificial Sequence: Synthetic oligonucleotide
  Target: ATXN1; (+) strand; PAM type: YTN; PAM sequence: TTT
gaatacgccagacaagtatt

SEQ ID NO: 272169 - DNA, 20 bp, Artificial Sequence
  Description of Artificial Sequence: Synthetic oligonucleotide
  Target: ATXN1; (+) strand; PAM type: YTN; PAM sequence: TTG
aatacgccagacaagtattt

SEQ ID NO: 272170 - DNA, 20 bp, Artificial Sequence
  Description of Artificial Sequence: Synthetic oligonucleotide
  Target: ATXN1; (+) strand; PAM type: YTN; PAM sequence: TTT
ttcttagcaaacatttatga

SEQ ID NO: 272171 - DNA, 20 bp, Artificial Sequence
  Description of Artificial Sequence: Synthetic oligonucleotide
  Target: ATXN1; (+) strand; PAM type: YTN; PAM sequence: TTT
tcttagcaaacatttatgag

SEQ ID NO: 272172 - DNA, 20 bp, Artificial Sequence
  Description of Artificial Sequence: Synthetic oligonucleotide
  Target: ATXN1; (+) strand; PAM type: YTN; PAM sequence: TTT
cttagcaaacatttatgagc

SEQ ID NO: 272173 - DNA, 20 bp, Artificial Sequence
  Description of Artificial Sequence: Synthetic oligonucleotide
  Target: ATXN1; (+) strand; PAM type: YTN; PAM sequence: TTC
ttagcaaacatttatgagca

SEQ ID NO: 272174 - DNA, 20 bp, Artificial Sequence
  Description of Artificial Sequence: Synthetic oligonucleotide
  Target: ATXN1; (+) strand; PAM type: YTN; PAM sequence: CTT
agcaaacatttatgagcaat

SEQ ID NO: 272175 - DNA, 20 bp, Artificial Sequence
  Description of Artificial Sequence: Synthetic oligonucleotide
  Target: ATXN1; (+) strand; PAM type: YTN; PAM sequence: TTA
gcaaacatttatgagcaatg

SEQ ID NO: 272176 - DNA, 20 bp, Artificial Sequence
  Description of Artificial Sequence: Synthetic oligonucleotide
  Target: ATXN1; (+) strand; PAM type: YTN; PAM sequence: TTT
atgagcaatgggctcaatca

SEQ ID NO: 272177 - DNA, 20 bp, Artificial Sequence
  Description of Artificial Sequence: Synthetic oligonucleotide
  Target: ATXN1; (+) strand; PAM type: YTN; PAM sequence: TTA
tgagcaatgggctcaatcac

SEQ ID NO: 272178 - DNA, 20 bp, Artificial Sequence
  Description of Artificial Sequence: Synthetic oligonucleotide
  Target: ATXN1; (+) strand; PAM type: YTN; PAM sequence: CTC
aatcactatattagtgttta

SEQ ID NO: 272179 - DNA, 20 bp, Artificial Sequence
  Description of Artificial Sequence: Synthetic oligonucleotide
  Target: ATXN1; (+) strand; PAM type: YTN; PAM sequence: CTA
tattagtgtttaagggcttt

SEQ ID NO: 272180 - DNA, 20 bp, Artificial Sequence
  Description of Artificial Sequence: Synthetic oligonucleotide
  Target: ATXN1; (+) strand; PAM type: YTN; PAM sequence: TTA
gtgtttaagggcttttcctg

SEQ ID NO: 272181 - DNA, 20 bp, Artificial Sequence
  Description of Artificial Sequence: Synthetic oligonucleotide
  Target: ATXN1; (+) strand; PAM type: YTN; PAM sequence: TTT
aagggcttttcctgtataga

SEQ ID NO: 272182 - DNA, 20 bp, Artificial Sequence
  Description of Artificial Sequence: Synthetic oligonucleotide
  Target: ATXN1; (+) strand; PAM type: YTN; PAM sequence: TTA
agggcttttcctgtatagaa

SEQ ID NO: 272183 - DNA, 20 bp, Artificial Sequence
  Description of Artificial Sequence: Synthetic oligonucleotide
  Target: ATXN1; (+) strand; PAM type: YTN; PAM sequence: CTT
ttcctgtatagaagctcttt

SEQ ID NO: 272184 - DNA, 20 bp, Artificial Sequence
  Description of Artificial Sequence: Synthetic oligonucleotide
  Target: ATXN1; (+) strand; PAM type: YTN; PAM sequence: TTT
tcctgtatagaagctctttc

SEQ ID NO: 272185 - DNA, 20 bp, Artificial Sequence
  Description of Artificial Sequence: Synthetic oligonucleotide
  Target: ATXN1; (+) strand; PAM type: YTN; PAM sequence: TTT
cctgtatagaagctctttct

SEQ ID NO: 272186 - DNA, 20 bp, Artificial Sequence
  Description of Artificial Sequence: Synthetic oligonucleotide
  Target: ATXN1; (+) strand; PAM type: YTN; PAM sequence: TTC
ctgtatagaagctctttctt

SEQ ID NO: 272187 - DNA, 20 bp, Artificial Sequence
  Description of Artificial Sequence: Synthetic oligonucleotide
  Target: ATXN1; (+) strand; PAM type: YTN; PAM sequence: CTG
tatagaagctctttctttga

SEQ ID NO: 272188 - DNA, 20 bp, Artificial Sequence
  Description of Artificial Sequence: Synthetic oligonucleotide
  Target: ATXN1; (+) strand; PAM type: YTN; PAM sequence: CTC
tttctttgactgaagtctcc

SEQ ID NO: 272189 - DNA, 20 bp, Artificial Sequence
  Description of Artificial Sequence: Synthetic oligonucleotide
  Target: ATXN1; (+) strand; PAM type: YTN; PAM sequence: CTT
tctttgactgaagtctccaa

SEQ ID NO: 272190 - DNA, 20 bp, Artificial Sequence
  Description of Artificial Sequence: Synthetic oligonucleotide
  Target: ATXN1; (+) strand; PAM type: YTN; PAM sequence: TTT
ctttgactgaagtctccaaa

SEQ ID NO: 272191 - DNA, 20 bp, Artificial Sequence
  Description of Artificial Sequence: Synthetic oligonucleotide
  Target: ATXN1; (+) strand; PAM type: YTN; PAM sequence: TTC
tttgactgaagtctccaaag

SEQ ID NO: 272192 - DNA, 20 bp, Artificial Sequence
  Description of Artificial Sequence: Synthetic oligonucleotide
  Target: ATXN1; (+) strand; PAM type: YTN; PAM sequence: CTT
tgactgaagtctccaaagcc

SEQ ID NO: 272193 - DNA, 20 bp, Artificial Sequence
  Description of Artificial Sequence: Synthetic oligonucleotide
  Target: ATXN1; (+) strand; PAM type: YTN; PAM sequence: TTT
gactgaagtctccaaagcca

SEQ ID NO: 272194 - DNA, 20 bp, Artificial Sequence
  Description of Artificial Sequence: Synthetic oligonucleotide
  Target: ATXN1; (+) strand; PAM type: YTN; PAM sequence: TTG
actgaagtctccaaagccaa

SEQ ID NO: 272195 - DNA, 20 bp, Artificial Sequence
  Description of Artificial Sequence: Synthetic oligonucleotide
  Target: ATXN1; (+) strand; PAM type: YTN; PAM sequence: CTG
aagtctccaaagccaaattt

SEQ ID NO: 272196 - DNA, 20 bp, Artificial Sequence
  Description of Artificial Sequence: Synthetic oligonucleotide
  Target: ATXN1; (+) strand; PAM type: YTN; PAM sequence: CTC
caaagccaaatttacaatta

SEQ ID NO: 272197 - DNA, 20 bp, Artificial Sequence
  Description of Artificial Sequence: Synthetic oligonucleotide
  Target: ATXN1; (+) strand; PAM type: YTN; PAM sequence: TTT
acaattattatgtatgcctg

SEQ ID NO: 272198 - DNA, 20 bp, Artificial Sequence
  Description of Artificial Sequence: Synthetic oligonucleotide
  Target: ATXN1; (+) strand; PAM type: YTN; PAM sequence: TTA
caattattatgtatgcctga

SEQ ID NO: 272199 - DNA, 20 bp, Artificial Sequence
  Description of Artificial Sequence: Synthetic oligonucleotide
  Target: ATXN1; (+) strand; PAM type: YTN; PAM sequence: TTA
ttatgtatgcctgaataaaa

SEQ ID NO: 272200 - DNA, 20 bp, Artificial Sequence
  Description of Artificial Sequence: Synthetic oligonucleotide
  Target: ATXN1; (+) strand; PAM type: YTN; PAM sequence: TTA
tgtatgcctgaataaaaggt

SEQ ID NO: 272201 - DNA, 20 bp, Artificial Sequence
  Description of Artificial Sequence: Synthetic oligonucleotide
  Target: ATXN1; (+) strand; PAM type: YTN; PAM sequence: CTG
aataaaaggtaatataatat

SEQ ID NO: 272202 - DNA, 20 bp, Artificial Sequence
  Description of Artificial Sequence: Synthetic oligonucleotide
  Target: ATXN1; (+) strand; PAM type: YTN; PAM sequence: TTT
ttctccaaagaaagccctca

SEQ ID NO: 272203 - DNA, 20 bp, Artificial Sequence
  Description of Artificial Sequence: Synthetic oligonucleotide
  Target: ATXN1; (+) strand; PAM type: YTN; PAM sequence: TTT
tctccaaagaaagccctcag

SEQ ID NO: 272204 - DNA, 20 bp, Artificial Sequence
  Description of Artificial Sequence: Synthetic oligonucleotide
  Target: ATXN1; (+) strand; PAM type: YTN; PAM sequence: TTT
ctccaaagaaagccctcaga

SEQ ID NO: 272205 - DNA, 20 bp, Artificial Sequence
  Description of Artificial Sequence: Synthetic oligonucleotide
  Target: ATXN1; (+) strand; PAM type: YTN; PAM sequence: TTC
tccaaagaaagccctcagaa

SEQ ID NO: 272206 - DNA, 20 bp, Artificial Sequence
  Description of Artificial Sequence: Synthetic oligonucleotide
  Target: ATXN1; (+) strand; PAM type: YTN; PAM sequence: CTC
caaagaaagccctcagaaaa

SEQ ID NO: 272207 - DNA, 20 bp, Artificial Sequence
  Description of Artificial Sequence: Synthetic oligonucleotide
  Target: ATXN1; (+) strand; PAM type: YTN; PAM sequence: CTC
agaaaagcctaagtaccctt

SEQ ID NO: 272208 - DNA, 20 bp, Artificial Sequence
  Description of Artificial Sequence: Synthetic oligonucleotide
  Target: ATXN1; (+) strand; PAM type: YTN; PAM sequence: CTA
agtacccttaatttttgagt

SEQ ID NO: 272209 - DNA, 20 bp, Artificial Sequence
  Description of Artificial Sequence: Synthetic oligonucleotide
  Target: ATXN1; (+) strand; PAM type: YTN; PAM sequence: CTT
aatttttgagttcttacaaa

SEQ ID NO: 272210 - DNA, 20 bp, Artificial Sequence
  Description of Artificial Sequence: Synthetic oligonucleotide
  Target: ATXN1; (+) strand; PAM type: YTN; PAM sequence: TTA
atttttgagttcttacaaag

SEQ ID NO: 272211 - DNA, 20 bp, Artificial Sequence
  Description of Artificial Sequence: Synthetic oligonucleotide
  Target: ATXN1; (+) strand; PAM type: YTN; PAM sequence: TTT
ttgagttcttacaaagttta

SEQ ID NO: 272212 - DNA, 20 bp, Artificial Sequence
  Description of Artificial Sequence: Synthetic oligonucleotide
  Target: ATXN1; (+) strand; PAM type: YTN; PAM sequence: TTT
tgagttcttacaaagtttat

SEQ ID NO: 272213 - DNA, 20 bp, Artificial Sequence
  Description of Artificial Sequence: Synthetic oligonucleotide
  Target: ATXN1; (+) strand; PAM type: YTN; PAM sequence: TTT
gagttcttacaaagtttatt

SEQ ID NO: 272214 - DNA, 20 bp, Artificial Sequence
  Description of Artificial Sequence: Synthetic oligonucleotide
  Target: ATXN1; (+) strand; PAM type: YTN; PAM sequence: TTG
agttcttacaaagtttattg

SEQ ID NO: 272215 - DNA, 20 bp, Artificial Sequence
  Description of Artificial Sequence: Synthetic oligonucleotide
  Target: ATXN1; (+) strand; PAM type: YTN; PAM sequence: TTC
ttacaaagtttattgtatct

SEQ ID NO: 272216 - DNA, 20 bp, Artificial Sequence
  Description of Artificial Sequence: Synthetic oligonucleotide
  Target: ATXN1; (+) strand; PAM type: YTN; PAM sequence: CTT
acaaagtttattgtatctat

SEQ ID NO: 272217 - DNA, 20 bp, Artificial Sequence
  Description of Artificial Sequence: Synthetic oligonucleotide
  Target: ATXN1; (+) strand; PAM type: YTN; PAM sequence: TTA
caaagtttattgtatctatt

SEQ ID NO: 272218 - DNA, 20 bp, Artificial Sequence
  Description of Artificial Sequence: Synthetic oligonucleotide
  Target: ATXN1; (+) strand; PAM type: YTN; PAM sequence: TTT
attgtatctattggtctctt

SEQ ID NO: 272219 - DNA, 20 bp, Artificial Sequence
  Description of Artificial Sequence: Synthetic oligonucleotide
  Target: ATXN1; (+) strand; PAM type: YTN; PAM sequence: TTA
ttgtatctattggtctctta

SEQ ID NO: 272220 - DNA, 20 bp, Artificial Sequence
  Description of Artificial Sequence: Synthetic oligonucleotide
  Target: ATXN1; (+) strand; PAM type: YTN; PAM sequence: TTG
tatctattggtctcttaaat

SEQ ID NO: 272221 - DNA, 20 bp, Artificial Sequence
  Description of Artificial Sequence: Synthetic oligonucleotide
  Target: ATXN1; (+) strand; PAM type: YTN; PAM sequence: CTA
ttggtctcttaaataaagta

SEQ ID NO: 272222 - DNA, 20 bp, Artificial Sequence
  Description of Artificial Sequence: Synthetic oligonucleotide
  Target: ATXN1; (+) strand; PAM type: YTN; PAM sequence: TTG
gtctcttaaataaagtagtc

SEQ ID NO: 272223 - DNA, 20 bp, Artificial Sequence
  Description of Artificial Sequence: Synthetic oligonucleotide
  Target: ATXN1; (+) strand; PAM type: YTN; PAM sequence: CTC
ttaaataaagtagtctttat

SEQ ID NO: 272224 - DNA, 20 bp, Artificial Sequence
  Description of Artificial Sequence: Synthetic oligonucleotide
  Target: ATXN1; (+) strand; PAM type: YTN; PAM sequence: CTT
aaataaagtagtctttatgg

SEQ ID NO: 272225 - DNA, 20 bp, Artificial Sequence
  Description of Artificial Sequence: Synthetic oligonucleotide
  Target: ATXN1; (+) strand; PAM type: YTN; PAM sequence: TTA
aataaagtagtctttatgga

SEQ ID NO: 272226 - DNA, 20 bp, Artificial Sequence
  Description of Artificial Sequence: Synthetic oligonucleotide
  Target: ATXN1; (+) strand; PAM type: YTN; PAM sequence: CTT
tatggaagacatattacctt

SEQ ID NO: 272227 - DNA, 20 bp, Artificial Sequence
  Description of Artificial Sequence: Synthetic oligonucleotide
  Target: ATXN1; (+) strand; PAM type: YTN; PAM sequence: TTT
atggaagacatattacctta

SEQ ID NO: 272228 - DNA, 20 bp, Artificial Sequence
  Description of Artificial Sequence: Synthetic oligonucleotide
  Target: ATXN1; (+) strand; PAM type: YTN; PAM sequence: TTA
tggaagacatattaccttaa

SEQ ID NO: 272229 - DNA, 20 bp, Artificial Sequence
  Description of Artificial Sequence: Synthetic oligonucleotide
  Target: ATXN1; (+) strand; PAM type: YTN; PAM sequence: TTA
ccttaaaactaccttgataa

SEQ ID NO: 272230 - DNA, 20 bp, Artificial Sequence
  Description of Artificial Sequence: Synthetic oligonucleotide
  Target: ATXN1; (+) strand; PAM type: YTN; PAM sequence: CTT
aaaactaccttgataaatgc

SEQ ID NO: 272231 - DNA, 20 bp, Artificial Sequence
  Description of Artificial Sequence: Synthetic oligonucleotide
  Target: ATXN1; (+) strand; PAM type: YTN; PAM sequence: TTA
aaactaccttgataaatgct

SEQ ID NO: 272232 - DNA, 20 bp, Artificial Sequence
  Description of Artificial Sequence: Synthetic oligonucleotide
  Target: ATXN1; (+) strand; PAM type: YTN; PAM sequence: CTA
ccttgataaatgctagtttg

SEQ ID NO: 272233 - DNA, 20 bp, Artificial Sequence
  Description of Artificial Sequence: Synthetic oligonucleotide
  Target: ATXN1; (+) strand; PAM type: YTN; PAM sequence: CTT
gataaatgctagtttggcat

SEQ ID NO: 272234 - DNA, 20 bp, Artificial Sequence
  Description of Artificial Sequence: Synthetic oligonucleotide
  Target: ATXN1; (+) strand; PAM type: YTN; PAM sequence: TTG
ataaatgctagtttggcatg

SEQ ID NO: 272235 - DNA, 20 bp, Artificial Sequence
  Description of Artificial Sequence: Synthetic oligonucleotide
  Target: ATXN1; (+) strand; PAM type: YTN; PAM sequence: CTA
gtttggcatgtttatataac

SEQ ID NO: 272236 - DNA, 20 bp, Artificial Sequence
  Description of Artificial Sequence: Synthetic oligonucleotide
  Target: ATXN1; (+) strand; PAM type: YTN; PAM sequence: TTT
ggcatgtttatataacagcc

SEQ ID NO: 272237 - DNA, 20 bp, Artificial Sequence
  Description of Artificial Sequence: Synthetic oligonucleotide
  Target: ATXN1; (+) strand; PAM type: YTN; PAM sequence: TTG
gcatgtttatataacagcca

SEQ ID NO: 272238 - DNA, 20 bp, Artificial Sequence
  Description of Artificial Sequence: Synthetic oligonucleotide
  Target: ATXN1; (+) strand; PAM type: YTN; PAM sequence: TTT
atataacagccacctaacag

SEQ ID NO: 272239 - DNA, 20 bp, Artificial Sequence
  Description of Artificial Sequence: Synthetic oligonucleotide
  Target: ATXN1; (+) strand; PAM type: YTN; PAM sequence: TTA
tataacagccacctaacaga

SEQ ID NO: 272240 - DNA, 20 bp, Artificial Sequence
  Description of Artificial Sequence: Synthetic oligonucleotide
  Target: ATXN1; (+) strand; PAM type: YTN; PAM sequence: CTA
acagaactgtttttcctttt

SEQ ID NO: 272241 - DNA, 20 bp, Artificial Sequence
  Description of Artificial Sequence: Synthetic oligonucleotide
  Target: ATXN1; (+) strand; PAM type: YTN; PAM sequence: CTG
tttttccttttgttttttaa

SEQ ID NO: 272242 - DNA, 20 bp, Artificial Sequence
  Description of Artificial Sequence: Synthetic oligonucleotide
  Target: ATXN1; (+) strand; PAM type: YTN; PAM sequence: TTT
ttccttttgttttttaatgg

SEQ ID NO: 272243 - DNA, 20 bp, Artificial Sequence
  Description of Artificial Sequence: Synthetic oligonucleotide
  Target: ATXN1; (+) strand; PAM type: YTN; PAM sequence: TTT
tccttttgttttttaatgga

SEQ ID NO: 272244 - DNA, 20 bp, Artificial Sequence
  Description of Artificial Sequence: Synthetic oligonucleotide
  Target: ATXN1; (+) strand; PAM type: YTN; PAM sequence: TTT
ccttttgttttttaatggaa

SEQ ID NO: 272245 - DNA, 20 bp, Artificial Sequence
  Description of Artificial Sequence: Synthetic oligonucleotide
  Target: ATXN1; (+) strand; PAM type: YTN; PAM sequence: TTC
cttttgttttttaatggaag

SEQ ID NO: 272246 - DNA, 20 bp, Artificial Sequence
  Description of Artificial Sequence: Synthetic oligonucleotide
  Target: ATXN1; (+) strand; PAM type: YTN; PAM sequence: CTT
ttgttttttaatggaagaaa

SEQ ID NO: 272247 - DNA, 20 bp, Artificial Sequence
  Description of Artificial Sequence: Synthetic oligonucleotide
  Target: ATXN1; (+) strand; PAM type: YTN; PAM sequence: TTT
tgttttttaatggaagaaaa

SEQ ID NO: 272248 - DNA, 20 bp, Artificial Sequence
  Description of Artificial Sequence: Synthetic oligonucleotide
  Target: ATXN1; (+) strand; PAM type: YTN; PAM sequence: TTT
gttttttaatggaagaaaac

SEQ ID NO: 272249 - DNA, 20 bp, Artificial Sequence
  Description of Artificial Sequence: Synthetic oligonucleotide
  Target: ATXN1; (+) strand; PAM type: YTN; PAM sequence: TTG
ttttttaatggaagaaaaca

SEQ ID NO: 272250 - DNA, 20 bp, Artificial Sequence
  Description of Artificial Sequence: Synthetic oligonucleotide
  Target: ATXN1; (+) strand; PAM type: YTN; PAM sequence: TTT
tttaatggaagaaaacaaat

SEQ ID NO: 272251 - DNA, 20 bp, Artificial Sequence
  Description of Artificial Sequence: Synthetic oligonucleotide
  Target: ATXN1; (+) strand; PAM type: YTN; PAM sequence: TTT
ttaatggaagaaaacaaatt

SEQ ID NO: 272252 - DNA, 20 bp, Artificial Sequence
  Description of Artificial Sequence: Synthetic oligonucleotide
  Target: ATXN1; (+) strand; PAM type: YTN; PAM sequence: TTT
taatggaagaaaacaaattt

SEQ ID NO: 272253 - DNA, 20 bp, Artificial Sequence
  Description of Artificial Sequence: Synthetic oligonucleotide
  Target: ATXN1; (+) strand; PAM type: YTN; PAM sequence: TTT
aatggaagaaaacaaatttg

SEQ ID NO: 272254 - DNA, 20 bp, Artificial Sequence
  Description of Artificial Sequence: Synthetic oligonucleotide
  Target: ATXN1; (+) strand; PAM type: YTN; PAM sequence: TTA
atggaagaaaacaaatttga

SEQ ID NO: 272255 - DNA, 20 bp, Artificial Sequence
  Description of Artificial Sequence: Synthetic oligonucleotide
  Target: ATXN1; (+) strand; PAM type: YTN; PAM sequence: TTT
gactagtaattattcttgga

SEQ ID NO: 272256 - DNA, 20 bp, Artificial Sequence
  Description of Artificial Sequence: Synthetic oligonucleotide
  Target: ATXN1; (+) strand; PAM type: YTN; PAM sequence: TTG
actagtaattattcttggaa

SEQ ID NO: 272257 - DNA, 20 bp, Artificial Sequence
  Description of Artificial Sequence: Synthetic oligonucleotide
  Target: ATXN1; (+) strand; PAM type: YTN; PAM sequence: CTA
gtaattattcttggaagtat

SEQ ID NO: 272258 - DNA, 20 bp, Artificial Sequence
  Description of Artificial Sequence: Synthetic oligonucleotide
  Target: ATXN1; (+) strand; PAM type: YTN; PAM sequence: TTA
ttcttggaagtatgactttc

SEQ ID NO: 272259 - DNA, 20 bp, Artificial Sequence
  Description of Artificial Sequence: Synthetic oligonucleotide
  Target: ATXN1; (+) strand; PAM type: YTN; PAM sequence: TTC
ttggaagtatgactttccta

SEQ ID NO: 272260 - DNA, 20 bp, Artificial Sequence
  Description of Artificial Sequence: Synthetic oligonucleotide
  Target: ATXN1; (+) strand; PAM type: YTN; PAM sequence: CTT
ggaagtatgactttcctagt

SEQ ID NO: 272261 - DNA, 20 bp, Artificial Sequence
  Description of Artificial Sequence: Synthetic oligonucleotide
  Target: ATXN1; (+) strand; PAM type: YTN; PAM sequence: TTG
gaagtatgactttcctagtt

SEQ ID NO: 272262 - DNA, 20 bp, Artificial Sequence
  Description of Artificial Sequence: Synthetic oligonucleotide
  Target: ATXN1; (+) strand; PAM type: YTN; PAM sequence: CTT
tcctagttgcaagcactgga

SEQ ID NO: 272263 - DNA, 20 bp, Artificial Sequence
  Description of Artificial Sequence: Synthetic oligonucleotide
  Target: ATXN1; (+) strand; PAM type: YTN; PAM sequence: TTT
cctagttgcaagcactggat

SEQ ID NO: 272264 - DNA, 20 bp, Artificial Sequence
  Description of Artificial Sequence: Synthetic oligonucleotide
  Target: ATXN1; (+) strand; PAM type: YTN; PAM sequence: TTC
ctagttgcaagcactggatg

SEQ ID NO: 272265 - DNA, 20 bp, Artificial Sequence
  Description of Artificial Sequence: Synthetic oligonucleotide
  Target: ATXN1; (+) strand; PAM type: YTN; PAM sequence: CTA
gttgcaagcactggatgtca

SEQ ID NO: 272266 - DNA, 20 bp, Artificial Sequence
  Description of Artificial Sequence: Synthetic oligonucleotide
  Target: ATXN1; (+) strand; PAM type: YTN; PAM sequence: TTG
caagcactggatgtcactat

SEQ ID NO: 272267 - DNA, 20 bp, Artificial Sequence
  Description of Artificial Sequence: Synthetic oligonucleotide
  Target: ATXN1; (+) strand; PAM type: YTN; PAM sequence: CTG
gatgtcactataaataaaaa

SEQ ID NO: 272268 - DNA, 20 bp, Artificial Sequence
  Description of Artificial Sequence: Synthetic oligonucleotide
  Target: ATXN1; (+) strand; PAM type: YTN; PAM sequence: CTA
taaataaaaaagcattttaa

SEQ ID NO: 272269 - DNA, 20 bp, Artificial Sequence
  Description of Artificial Sequence: Synthetic oligonucleotide
  Target: ATXN1; (+) strand; PAM type: YTN; PAM sequence: TTT
taaagattacttttaaaagc

SEQ ID NO: 272270 - DNA, 20 bp, Artificial Sequence
  Description of Artificial Sequence: Synthetic oligonucleotide
  Target: ATXN1; (+) strand; PAM type: YTN; PAM sequence: TTT
aaagattacttttaaaagca

SEQ ID NO: 272271 - DNA, 20 bp, Artificial Sequence
  Description of Artificial Sequence: Synthetic oligonucleotide
  Target: ATXN1; (+) strand; PAM type: YTN; PAM sequence: TTA
aagattacttttaaaagcaa

SEQ ID NO: 272272 - DNA, 20 bp, Artificial Sequence
  Description of Artificial Sequence: Synthetic oligonucleotide
  Target: ATXN1; (+) strand; PAM type: YTN; PAM sequence: TTA
cttttaaaagcaacacagta

SEQ ID NO: 272273 - DNA, 20 bp, Artificial Sequence
  Description of Artificial Sequence: Synthetic oligonucleotide
  Target: ATXN1; (+) strand; PAM type: YTN; PAM sequence: CTT
ttaaaagcaacacagtaagt

SEQ ID NO: 272274 - DNA, 20 bp, Artificial Sequence
  Description of Artificial Sequence: Synthetic oligonucleotide
  Target: ATXN1; (+) strand; PAM type: YTN; PAM sequence: TTT
taaaagcaacacagtaagtg

SEQ ID NO: 272275 - DNA, 20 bp, Artificial Sequence
  Description of Artificial Sequence: Synthetic oligonucleotide
  Target: ATXN1; (+) strand; PAM type: YTN; PAM sequence: TTT
aaaagcaacacagtaagtgg

SEQ ID NO: 272276 - DNA, 20 bp, Artificial Sequence
  Description of Artificial Sequence: Synthetic oligonucleotide
  Target: ATXN1; (+) strand; PAM type: YTN; PAM sequence: TTA
aaagcaacacagtaagtggt

SEQ ID NO: 272277 - DNA, 20 bp, Artificial Sequence
  Description of Artificial Sequence: Synthetic oligonucleotide
  Target: ATXN1; (+) strand; PAM type: YTN; PAM sequence: TTA
agttgcagagttcatcaaaa

SEQ ID NO: 272278 - DNA, 20 bp, Artificial Sequence
  Description of Artificial Sequence: Synthetic oligonucleotide
  Target: ATXN1; (+) strand; PAM type: YTN; PAM sequence: TTG
cagagttcatcaaaatacac

SEQ ID NO: 272279 - DNA, 20 bp, Artificial Sequence
  Description of Artificial Sequence: Synthetic oligonucleotide
  Target: ATXN1; (+) strand; PAM type: YTN; PAM sequence: TTC
atcaaaatacactcacagga

SEQ ID NO: 272280 - DNA, 20 bp, Artificial Sequence
  Description of Artificial Sequence: Synthetic oligonucleotide
  Target: ATXN1; (+) strand; PAM type: YTN; PAM sequence: CTC
acaggaagaatgaagaaaaa

SEQ ID NO: 272281 - DNA, 20 bp, Artificial Sequence
  Description of Artificial Sequence: Synthetic oligonucleotide
  Target: ATXN1; (+) strand; PAM type: YTN; PAM sequence: CTC
ttaataatatggtttaggat

SEQ ID NO: 272282 - DNA, 20 bp, Artificial Sequence
  Description of Artificial Sequence: Synthetic oligonucleotide
  Target: ATXN1; (+) strand; PAM type: YTN; PAM sequence: CTT
aataatatggtttaggatat

SEQ ID NO: 272283 - DNA, 20 bp, Artificial Sequence
  Description of Artificial Sequence: Synthetic oligonucleotide
  Target: ATXN1; (+) strand; PAM type: YTN; PAM sequence: TTA
ataatatggtttaggatatt

SEQ ID NO: 272284 - DNA, 20 bp, Artificial Sequence
  Description of Artificial Sequence: Synthetic oligonucleotide
  Target: ATXN1; (+) strand; PAM type: YTN; PAM sequence: TTT
aggatattgtgacaataatg

SEQ ID NO: 272285 - DNA, 20 bp, Artificial Sequence
  Description of Artificial Sequence: Synthetic oligonucleotide
  Target: ATXN1; (+) strand; PAM type: YTN; PAM sequence: TTA
ggatattgtgacaataatgg

SEQ ID NO: 272286 - DNA, 20 bp, Artificial Sequence
  Description of Artificial Sequence: Synthetic oligonucleotide
  Target: ATXN1; (+) strand; PAM type: YTN; PAM sequence: TTG
tgacaataatggtccccaat

SEQ ID NO: 272287 - DNA, 20 bp, Artificial Sequence
  Description of Artificial Sequence: Synthetic oligonucleotide
  Target: ATXN1; (+) strand; PAM type: YTN; PAM sequence: CTC
cctatagccatgctcacatt

SEQ ID NO: 272288 - DNA, 20 bp, Artificial Sequence
  Description of Artificial Sequence: Synthetic oligonucleotide
  Target: ATXN1; (+) strand; PAM type: YTN; PAM sequence: CTA
tagccatgctcacattaact

SEQ ID NO: 272289 - DNA, 20 bp, Artificial Sequence
  Description of Artificial Sequence: Synthetic oligonucleotide
  Target: ATXN1; (+) strand; PAM type: YTN; PAM sequence: CTC
acattaactgtgggcttggc

SEQ ID NO: 272290 - DNA, 20 bp, Artificial Sequence
  Description of Artificial Sequence: Synthetic oligonucleotide
  Target: ATXN1; (+) strand; PAM type: YTN; PAM sequence: TTA
actgtgggcttggctatatg

SEQ ID NO: 272291 - DNA, 20 bp, Artificial Sequence
  Description of Artificial Sequence: Synthetic oligonucleotide
  Target: ATXN1; (+) strand; PAM type: YTN; PAM sequence: CTG
tgggcttggctatatgtctt

SEQ ID NO: 272292 - DNA, 20 bp, Artificial Sequence
  Description of Artificial Sequence: Synthetic oligonucleotide
  Target: ATXN1; (+) strand; PAM type: YTN; PAM sequence: CTT
ggctatatgtctttttttgg

SEQ ID NO: 272293 - DNA, 20 bp, Artificial Sequence
  Description of Artificial Sequence: Synthetic oligonucleotide
  Target: ATXN1; (+) strand; PAM type: YTN; PAM sequence: TTG
gctatatgtctttttttggc

SEQ ID NO: 272294 - DNA, 20 bp, Artificial Sequence
  Description of Artificial Sequence: Synthetic oligonucleotide
  Target: ATXN1; (+) strand; PAM type: YTN; PAM sequence: CTA
tatgtctttttttggccaat

SEQ ID NO: 272295 - DNA, 20 bp, Artificial Sequence
  Description of Artificial Sequence: Synthetic oligonucleotide
  Target: ATXN1; (+) strand; PAM type: YTN; PAM sequence: CTT
tttttggccaatggggtctc

SEQ ID NO: 272296 - DNA, 20 bp, Artificial Sequence
  Description of Artificial Sequence: Synthetic oligonucleotide
  Target: ATXN1; (+) strand; PAM type: YTN; PAM sequence: TTT
ttttggccaatggggtctca

SEQ ID NO: 272297 - DNA, 20 bp, Artificial Sequence
  Description of Artificial Sequence: Synthetic oligonucleotide
  Target: ATXN1; (+) strand; PAM type: YTN; PAM sequence: TTT
tttggccaatggggtctcaa

SEQ ID NO: 272298 - DNA, 20 bp, Artificial Sequence
  Description of Artificial Sequence: Synthetic oligonucleotide
  Target: ATXN1; (+) strand; PAM type: YTN; PAM sequence: TTT
ttggccaatggggtctcaac

SEQ ID NO: 272299 - DNA, 20 bp, Artificial Sequence
  Description of Artificial Sequence: Synthetic oligonucleotide
  Target: ATXN1; (+) strand; PAM type: YTN; PAM sequence: TTT
tggccaatggggtctcaaca

SEQ ID NO: 272300 - DNA, 20 bp, Artificial Sequence
  Description of Artificial Sequence: Synthetic oligonucleotide
  Target: ATXN1; (+) strand; PAM type: YTN; PAM sequence: TTT
ggccaatggggtctcaacaa

SEQ ID NO: 272301 - DNA, 20 bp, Artificial Sequence
  Description of Artificial Sequence: Synthetic oligonucleotide
  Target: ATXN1; (+) strand; PAM type: YTN; PAM sequence: TTG
gccaatggggtctcaacaaa

SEQ ID NO: 272302 - DNA, 20 bp, Artificial Sequence
  Description of Artificial Sequence: Synthetic oligonucleotide
  Target: ATXN1; (+) strand; PAM type: YTN; PAM sequence: CTC
aacaaatgtaaccaacgaat

SEQ ID NO: 272303 - DNA, 20 bp, Artificial Sequence
  Description of Artificial Sequence: Synthetic oligonucleotide
  Target: ATXN1; (+) strand; PAM type: YTN; PAM sequence: CTT
gcggcttaggatgaaatttc

SEQ ID NO: 272304 - DNA, 20 bp, Artificial Sequence
  Description of Artificial Sequence: Synthetic oligonucleotide
  Target: ATXN1; (+) strand; PAM type: YTN; PAM sequence: TTG
cggcttaggatgaaatttct

SEQ ID NO: 272305 - DNA, 20 bp, Artificial Sequence
  Description of Artificial Sequence: Synthetic oligonucleotide
  Target: ATXN1; (+) strand; PAM type: YTN; PAM sequence: CTT
aggatgaaatttctggtaat

SEQ ID NO: 272306 - DNA, 20 bp, Artificial Sequence
  Description of Artificial Sequence: Synthetic oligonucleotide
  Target: ATXN1; (+) strand; PAM type: YTN; PAM sequence: TTA
ggatgaaatttctggtaata

SEQ ID NO: 272307 - DNA, 20 bp, Artificial Sequence
  Description of Artificial Sequence: Synthetic oligonucleotide
  Target: ATXN1; (+) strand; PAM type: YTN; PAM sequence: TTT
ctggtaatagcatcaaacac

SEQ ID NO: 272308 - DNA, 20 bp, Artificial Sequence
  Description of Artificial Sequence: Synthetic oligonucleotide
  Target: ATXN1; (+) strand; PAM type: YTN; PAM sequence: TTC
tggtaatagcatcaaacaca

SEQ ID NO: 272309 - DNA, 20 bp, Artificial Sequence
  Description of Artificial Sequence: Synthetic oligonucleotide
  Target: ATXN1; (+) strand; PAM type: YTN; PAM sequence: CTG
gtaatagcatcaaacacaga

SEQ ID NO: 272310 - DNA, 20 bp, Artificial Sequence
  Description of Artificial Sequence: Synthetic oligonucleotide
  Target: ATXN1; (+) strand; PAM type: YTN; PAM sequence: CTT
tggaaaacgatactacatga

SEQ ID NO: 272311 - DNA, 20 bp, Artificial Sequence
  Description of Artificial Sequence: Synthetic oligonucleotide
  Target: ATXN1; (+) strand; PAM type: YTN; PAM sequence: TTT
ggaaaacgatactacatgac

SEQ ID NO: 272312 - DNA, 20 bp, Artificial Sequence
  Description of Artificial Sequence: Synthetic oligonucleotide
  Target: ATXN1; (+) strand; PAM type: YTN; PAM sequence: TTG
gaaaacgatactacatgacc

SEQ ID NO: 272313 - DNA, 20 bp, Artificial Sequence
  Description of Artificial Sequence: Synthetic oligonucleotide
  Target: ATXN1; (+) strand; PAM type: YTN; PAM sequence: CTA
catgacctgccatgtagttc

SEQ ID NO: 272314 - DNA, 20 bp, Artificial Sequence
  Description of Artificial Sequence: Synthetic oligonucleotide
  Target: ATXN1; (+) strand; PAM type: YTN; PAM sequence: CTG
ccatgtagttcaaaacgtga

SEQ ID NO: 272315 - DNA, 20 bp, Artificial Sequence
  Description of Artificial Sequence: Synthetic oligonucleotide
  Target: ATXN1; (+) strand; PAM type: YTN; PAM sequence: TTC
aaaacgtgaggaagatactg

SEQ ID NO: 272316 - DNA, 20 bp, Artificial Sequence
  Description of Artificial Sequence: Synthetic oligonucleotide
  Target: ATXN1; (+) strand; PAM type: YTN; PAM sequence: CTG
atatagtagataaaagttgt

SEQ ID NO: 272317 - DNA, 20 bp, Artificial Sequence
  Description of Artificial Sequence: Synthetic oligonucleotide
  Target: ATXN1; (+) strand; PAM type: YTN; PAM sequence: TTG
taagtaaaattatttcatat

SEQ ID NO: 272318 - DNA, 20 bp, Artificial Sequence
  Description of Artificial Sequence: Synthetic oligonucleotide
  Target: ATXN1; (+) strand; PAM type: YTN; PAM sequence: TTA
tttcatataatatgaaagtg

SEQ ID NO: 272319 - DNA, 20 bp, Artificial Sequence
  Description of Artificial Sequence: Synthetic oligonucleotide
  Target: ATXN1; (+) strand; PAM type: YTN; PAM sequence: TTT
catataatatgaaagtggaa

SEQ ID NO: 272320 - DNA, 20 bp, Artificial Sequence
  Description of Artificial Sequence: Synthetic oligonucleotide
  Target: ATXN1; (+) strand; PAM type: YTN; PAM sequence: TTC
atataatatgaaagtggaag

SEQ ID NO: 272321 - DNA, 20 bp, Artificial Sequence
  Description of Artificial Sequence: Synthetic oligonucleotide
  Target: ATXN1; (+) strand; PAM type: YTN; PAM sequence: CTA
aattaatgtatatattattt

SEQ ID NO: 272322 - DNA, 20 bp, Artificial Sequence
  Description of Artificial Sequence: Synthetic oligonucleotide
  Target: ATXN1; (+) strand; PAM type: YTN; PAM sequence: TTA
atgtatatattatttaaaat

SEQ ID NO: 272323 - DNA, 20 bp, Artificial Sequence
  Description of Artificial Sequence: Synthetic oligonucleotide
  Target: ATXN1; (+) strand; PAM type: YTN; PAM sequence: TTA
tttaaaatgtctttgagatt

SEQ ID NO: 272324 - DNA, 20 bp, Artificial Sequence
  Description of Artificial Sequence: Synthetic oligonucleotide
  Target: ATXN1; (+) strand; PAM type: YTN; PAM sequence: TTT
aaaatgtctttgagattaaa

SEQ ID NO: 272325 - DNA, 20 bp, Artificial Sequence
  Description of Artificial Sequence: Synthetic oligonucleotide
  Target: ATXN1; (+) strand; PAM type: YTN; PAM sequence: TTA
aaatgtctttgagattaaat

SEQ ID NO: 272326 - DNA, 20 bp, Artificial Sequence
  Description of Artificial Sequence: Synthetic oligonucleotide
  Target: ATXN1; (+) strand; PAM type: YTN; PAM sequence: CTT
tgagattaaataatttaagc

SEQ ID NO: 272327 - DNA, 20 bp, Artificial Sequence
  Description of Artificial Sequence: Synthetic oligonucleotide
  Target: ATXN1; (+) strand; PAM type: YTN; PAM sequence: TTT
gagattaaataatttaagca

SEQ ID NO: 272328 - DNA, 20 bp, Artificial Sequence
  Description of Artificial Sequence: Synthetic oligonucleotide
  Target: ATXN1; (+) strand; PAM type: YTN; PAM sequence: TTG
agattaaataatttaagcac

SEQ ID NO: 272329 - DNA, 20 bp, Artificial Sequence
  Description of Artificial Sequence: Synthetic oligonucleotide
  Target: ATXN1; (+) strand; PAM type: YTN; PAM sequence: TTA
aataatttaagcacaaatct

SEQ ID NO: 272330 - DNA, 20 bp, Artificial Sequence
  Description of Artificial Sequence: Synthetic oligonucleotide
  Target: ATXN1; (+) strand; PAM type: YTN; PAM sequence: TTT
aagcacaaatctgatggttt

SEQ ID NO: 272331 - DNA, 20 bp, Artificial Sequence
  Description of Artificial Sequence: Synthetic oligonucleotide
  Target: ATXN1; (+) strand; PAM type: YTN; PAM sequence: TTA
agcacaaatctgatggttta

SEQ ID NO: 272332 - DNA, 20 bp, Artificial Sequence
  Description of Artificial Sequence: Synthetic oligonucleotide
  Target: ATXN1; (+) strand; PAM type: YTN; PAM sequence: CTG
atggtttaatagaaatctct

SEQ ID NO: 272333 - DNA, 20 bp, Artificial Sequence
  Description of Artificial Sequence: Synthetic oligonucleotide
  Target: ATXN1; (+) strand; PAM type: YTN; PAM sequence: TTT
aatagaaatctctaaatcct

SEQ ID NO: 272334 - DNA, 20 bp, Artificial Sequence
  Description of Artificial Sequence: Synthetic oligonucleotide
  Target: ATXN1; (+) strand; PAM type: YTN; PAM sequence: TTA
atagaaatctctaaatcctt

SEQ ID NO: 272335 - DNA, 20 bp, Artificial Sequence
  Description of Artificial Sequence: Synthetic oligonucleotide
  Target: ATXN1; (+) strand; PAM type: YTN; PAM sequence: CTC
taaatccttaaatgcttata

SEQ ID NO: 272336 - DNA, 20 bp, Artificial Sequence
  Description of Artificial Sequence: Synthetic oligonucleotide
  Target: ATXN1; (+) strand; PAM type: YTN; PAM sequence: CTA
aatccttaaatgcttataga

SEQ ID NO: 272337 - DNA, 20 bp, Artificial Sequence
  Description of Artificial Sequence: Synthetic oligonucleotide
  Target: ATXN1; (+) strand; PAM type: YTN; PAM sequence: CTT
aaatgcttatagacaaactg

SEQ ID NO: 272338 - DNA, 20 bp, Artificial Sequence
  Description of Artificial Sequence: Synthetic oligonucleotide
  Target: ATXN1; (+) strand; PAM type: YTN; PAM sequence: TTA
aatgcttatagacaaactgg

SEQ ID NO: 272339 - DNA, 20 bp, Artificial Sequence
  Description of Artificial Sequence: Synthetic oligonucleotide
  Target: ATXN1; (+) strand; PAM type: YTN; PAM sequence: CTT
atagacaaactggccaaaaa

SEQ ID NO: 272340 - DNA, 20 bp, Artificial Sequence
  Description of Artificial Sequence: Synthetic oligonucleotide
  Target: ATXN1; (+) strand; PAM type: YTN; PAM sequence: TTA
tagacaaactggccaaaaaa

SEQ ID NO: 272341 - DNA, 20 bp, Artificial Sequence
  Description of Artificial Sequence: Synthetic oligonucleotide
  Target: ATXN1; (+) strand; PAM type: YTN; PAM sequence: CTG
gccaaaaaattcattgaaag

SEQ ID NO: 272342 - DNA, 20 bp, Artificial Sequence
  Description of Artificial Sequence: Synthetic oligonucleotide
  Target: ATXN1; (+) strand; PAM type: YTN; PAM sequence: TTC
attgaaaggataaaggatgg

SEQ ID NO: 272343 - DNA, 20 bp, Artificial Sequence
  Description of Artificial Sequence: Synthetic oligonucleotide
  Target: ATXN1; (+) strand; PAM type: YTN; PAM sequence: TTG
aaaggataaaggatggcata

SEQ ID NO: 272344 - DNA, 20 bp, Artificial Sequence
  Description of Artificial Sequence: Synthetic oligonucleotide
  Target: ATXN1; (+) strand; PAM type: YTN; PAM sequence: CTT
ctatggtataatgcaggccc

SEQ ID NO: 272345 - DNA, 20 bp, Artificial Sequence
  Description of Artificial Sequence: Synthetic oligonucleotide
  Target: ATXN1; (+) strand; PAM type: YTN; PAM sequence: TTC
tatggtataatgcaggccca

SEQ ID NO: 272346 - DNA, 20 bp, Artificial Sequence
  Description of Artificial Sequence: Synthetic oligonucleotide
  Target: ATXN1; (+) strand; PAM type: YTN; PAM sequence: CTA
tggtataatgcaggcccaga

SEQ ID NO: 272347 - DNA, 20 bp, Artificial Sequence
  Description of Artificial Sequence: Synthetic oligonucleotide
  Target: ATXN1; (+) strand; PAM type: YTN; PAM sequence: CTT
cttgagctgcaggcctgaag

SEQ ID NO: 272348 - DNA, 20 bp, Artificial Sequence
  Description of Artificial Sequence: Synthetic oligonucleotide
  Target: ATXN1; (+) strand; PAM type: YTN; PAM sequence: TTC
ttgagctgcaggcctgaaga

SEQ ID NO: 272349 - DNA, 20 bp, Artificial Sequence
  Description of Artificial Sequence: Synthetic oligonucleotide
  Target: ATXN1; (+) strand; PAM type: YTN; PAM sequence: CTT
gagctgcaggcctgaagact

SEQ ID NO: 272350 - DNA, 20 bp, Artificial Sequence
  Description of Artificial Sequence: Synthetic oligonucleotide
  Target: ATXN1; (+) strand; PAM type: YTN; PAM sequence: TTG
agctgcaggcctgaagactc

SEQ ID NO: 272351 - DNA, 20 bp, Artificial Sequence
  Description of Artificial Sequence: Synthetic oligonucleotide
  Target: ATXN1; (+) strand; PAM type: YTN; PAM sequence: CTG
caggcctgaagactcaactg

SEQ ID NO: 272352 - DNA, 20 bp, Artificial Sequence
  Description of Artificial Sequence: Synthetic oligonucleotide
  Target: ATXN1; (+) strand; PAM type: YTN; PAM sequence: CTG
aagactcaactgtctatctg

SEQ ID NO: 272353 - DNA, 20 bp, Artificial Sequence
  Description of Artificial Sequence: Synthetic oligonucleotide
  Target: ATXN1; (+) strand; PAM type: YTN; PAM sequence: CTC
aactgtctatctgaaatatc

SEQ ID NO: 272354 - DNA, 20 bp, Artificial Sequence
  Description of Artificial Sequence: Synthetic oligonucleotide
  Target: ATXN1; (+) strand; PAM type: YTN; PAM sequence: CTG
tctatctgaaatatccccta

SEQ ID NO: 272355 - DNA, 20 bp, Artificial Sequence
  Description of Artificial Sequence: Synthetic oligonucleotide
  Target: ATXN1; (+) strand; PAM type: YTN; PAM sequence: CTA
tctgaaatatcccctaaaaa

SEQ ID NO: 272356 - DNA, 20 bp, Artificial Sequence
  Description of Artificial Sequence: Synthetic oligonucleotide
  Target: ATXN1; (+) strand; PAM type: YTN; PAM sequence: CTG
aaatatcccctaaaaaaagg

SEQ ID NO: 272357 - DNA, 20 bp, Artificial Sequence
  Description of Artificial Sequence: Synthetic oligonucleotide
  Target: ATXN1; (+) strand; PAM type: YTN; PAM sequence: CTA
aaaaaaggtctcaaacctcc

SEQ ID NO: 272358 - DNA, 20 bp, Artificial Sequence
  Description of Artificial Sequence: Synthetic oligonucleotide
  Target: ATXN1; (+) strand; PAM type: YTN; PAM sequence: CTC
aaacctccaacctattagga

SEQ ID NO: 272359 - DNA, 20 bp, Artificial Sequence
  Description of Artificial Sequence: Synthetic oligonucleotide
  Target: ATXN1; (+) strand; PAM type: YTN; PAM sequence: CTC
caacctattaggatggctac

SEQ ID NO: 272360 - DNA, 20 bp, Artificial Sequence
  Description of Artificial Sequence: Synthetic oligonucleotide
  Target: ATXN1; (+) strand; PAM type: YTN; PAM sequence: CTA
ttaggatggctactatcaaa

SEQ ID NO: 272361 - DNA, 20 bp, Artificial Sequence
  Description of Artificial Sequence: Synthetic oligonucleotide
  Target: ATXN1; (+) strand; PAM type: YTN; PAM sequence: TTA
ggatggctactatcaaatac

SEQ ID NO: 272362 - DNA, 20 bp, Artificial Sequence
  Description of Artificial Sequence: Synthetic oligonucleotide
  Target: ATXN1; (+) strand; PAM type: YTN; PAM sequence: CTA
ctatcaaatacattttttta

SEQ ID NO: 272363 - DNA, 20 bp, Artificial Sequence
  Description of Artificial Sequence: Synthetic oligonucleotide
  Target: ATXN1; (+) strand; PAM type: YTN; PAM sequence: CTA
tcaaatacatttttttaacc

SEQ ID NO: 272364 - DNA, 20 bp, Artificial Sequence
  Description of Artificial Sequence: Synthetic oligonucleotide
  Target: ATXN1; (+) strand; PAM type: YTN; PAM sequence: TTT
ttttaaccagaaaataacaa

SEQ ID NO: 272365 - DNA, 20 bp, Artificial Sequence
  Description of Artificial Sequence: Synthetic oligonucleotide
  Target: ATXN1; (+) strand; PAM type: YTN; PAM sequence: TTT
tttaaccagaaaataacaac

SEQ ID NO: 272366 - DNA, 20 bp, Artificial Sequence
  Description of Artificial Sequence: Synthetic oligonucleotide
  Target: ATXN1; (+) strand; PAM type: YTN; PAM sequence: TTT
ttaaccagaaaataacaact

SEQ ID NO: 272367 - DNA, 20 bp, Artificial Sequence
  Description of Artificial Sequence: Synthetic oligonucleotide
  Target: ATXN1; (+) strand; PAM type: YTN; PAM sequence: TTT
taaccagaaaataacaactg

SEQ ID NO: 272368 - DNA, 20 bp, Artificial Sequence
  Description of Artificial Sequence: Synthetic oligonucleotide
  Target: ATXN1; (+) strand; PAM type: YTN; PAM sequence: TTT
aaccagaaaataacaactgt

SEQ ID NO: 272369 - DNA, 20 bp, Artificial Sequence
  Description of Artificial Sequence: Synthetic oligonucleotide
  Target: ATXN1; (+) strand; PAM type: YTN; PAM sequence: TTA
accagaaaataacaactgtt

SEQ ID NO: 272370 - DNA, 20 bp, Artificial Sequence
  Description of Artificial Sequence: Synthetic oligonucleotide
  Target: ATXN1; (+) strand; PAM type: YTN; PAM sequence: CTG
ttggtgaggacatagagaaa

SEQ ID NO: 272371 - DNA, 20 bp, Artificial Sequence
  Description of Artificial Sequence: Synthetic oligonucleotide
  Target: ATXN1; (+) strand; PAM type: YTN; PAM sequence: TTG
gtgaggacatagagaaactg

SEQ ID NO: 272372 - DNA, 20 bp, Artificial Sequence
  Description of Artificial Sequence: Synthetic oligonucleotide
  Target: ATXN1; (+) strand; PAM type: YTN; PAM sequence: CTG
gaacccttgtgcactgttgg

SEQ ID NO: 272373 - DNA, 20 bp, Artificial Sequence
  Description of Artificial Sequence: Synthetic oligonucleotide
  Target: ATXN1; (+) strand; PAM type: YTN; PAM sequence: CTT
gtgcactgttggtagaaatg

SEQ ID NO: 272374 - DNA, 20 bp, Artificial Sequence
  Description of Artificial Sequence: Synthetic oligonucleotide
  Target: ATXN1; (+) strand; PAM type: YTN; PAM sequence: TTG
tgcactgttggtagaaatgc

SEQ ID NO: 272375 - DNA, 20 bp, Artificial Sequence
  Description of Artificial Sequence: Synthetic oligonucleotide
  Target: ATXN1; (+) strand; PAM type: YTN; PAM sequence: CTG
ttggtagaaatgcaaagtgg

SEQ ID NO: 272376 - DNA, 20 bp, Artificial Sequence
  Description of Artificial Sequence: Synthetic oligonucleotide
  Target: ATXN1; (+) strand; PAM type: YTN; PAM sequence: TTG
gtagaaatgcaaagtggtgc

SEQ ID NO: 272377 - DNA, 20 bp, Artificial Sequence
  Description of Artificial Sequence: Synthetic oligonucleotide
  Target: ATXN1; (+) strand; PAM type: YTN; PAM sequence: CTG
tggaaaacgatacagcagtt

SEQ ID NO: 272378 - DNA, 20 bp, Artificial Sequence
  Description of Artificial Sequence: Synthetic oligonucleotide
  Target: ATXN1; (+) strand; PAM type: YTN; PAM sequence: TTC
ataaaaaatttaaaaataga

SEQ ID NO: 272379 - DNA, 20 bp, Artificial Sequence
  Description of Artificial Sequence: Synthetic oligonucleotide
  Target: ATXN1; (+) strand; PAM type: YTN; PAM sequence: TTT
aaaaatagaattgccacgtg

SEQ ID NO: 272380 - DNA, 20 bp, Artificial Sequence
  Description of Artificial Sequence: Synthetic oligonucleotide
  Target: ATXN1; (+) strand; PAM type: YTN; PAM sequence: TTA
aaaatagaattgccacgtga

SEQ ID NO: 272381 - DNA, 20 bp, Artificial Sequence
  Description of Artificial Sequence: Synthetic oligonucleotide
  Target: ATXN1; (+) strand; PAM type: YTN; PAM sequence: TTG
ccacgtgatccagcaattcc

SEQ ID NO: 272382 - DNA, 20 bp, Artificial Sequence
  Description of Artificial Sequence: Synthetic oligonucleotide
  Target: ATXN1; (+) strand; PAM type: YTN; PAM sequence: TTC
catttccaggtatataccca

SEQ ID NO: 272383 - DNA, 20 bp, Artificial Sequence
  Description of Artificial Sequence: Synthetic oligonucleotide
  Target: ATXN1; (+) strand; PAM type: YTN; PAM sequence: TTT
ccaggtatatacccaaaaga

SEQ ID NO: 272384 - DNA, 20 bp, Artificial Sequence
  Description of Artificial Sequence: Synthetic oligonucleotide
  Target: ATXN1; (+) strand; PAM type: YTN; PAM sequence: TTC
caggtatatacccaaaagaa

SEQ ID NO: 272385 - DNA, 20 bp, Artificial Sequence
  Description of Artificial Sequence: Synthetic oligonucleotide
  Target: ATXN1; (+) strand; PAM type: YTN; PAM sequence: CTG
aaaggagaacctcaaatttg

SEQ ID NO: 272386 - DNA, 20 bp, Artificial Sequence
  Description of Artificial Sequence: Synthetic oligonucleotide
  Target: ATXN1; (+) strand; PAM type: YTN; PAM sequence: CTC
aaatttgtacacccacattc

SEQ ID NO: 272387 - DNA, 20 bp, Artificial Sequence
  Description of Artificial Sequence: Synthetic oligonucleotide
  Target: ATXN1; (+) strand; PAM type: YTN; PAM sequence: TTT
gtacacccacattcatagca

SEQ ID NO: 272388 - DNA, 20 bp, Artificial Sequence
  Description of Artificial Sequence: Synthetic oligonucleotide
  Target: ATXN1; (+) strand; PAM type: YTN; PAM sequence: TTG
tacacccacattcatagcag

SEQ ID NO: 272389 - DNA, 20 bp, Artificial Sequence
  Description of Artificial Sequence: Synthetic oligonucleotide
  Target: ATXN1; (+) strand; PAM type: YTN; PAM sequence: TTC
atagcagcattattcacagt

SEQ ID NO: 272390 - DNA, 20 bp, Artificial Sequence
  Description of Artificial Sequence: Synthetic oligonucleotide
  Target: ATXN1; (+) strand; PAM type: YTN; PAM sequence: TTA
ttcacagtaaccaaaaggtg

SEQ ID NO: 272391 - DNA, 20 bp, Artificial Sequence
  Description of Artificial Sequence: Synthetic oligonucleotide
  Target: ATXN1; (+) strand; PAM type: YTN; PAM sequence: TTC
acagtaaccaaaaggtggaa

SEQ ID NO: 272392 - DNA, 20 bp, Artificial Sequence
  Description of Artificial Sequence: Synthetic oligonucleotide
  Target: ATXN1; (+) strand; PAM type: YTN; PAM sequence: TTT
atggacagatgaatgaataa

SEQ ID NO: 272393 - DNA, 20 bp, Artificial Sequence
  Description of Artificial Sequence: Synthetic oligonucleotide
  Target: ATXN1; (+) strand; PAM type: YTN; PAM sequence: TTA
tggacagatgaatgaataaa

SEQ ID NO: 272394 - DNA, 20 bp, Artificial Sequence
  Description of Artificial Sequence: Synthetic oligonucleotide
  Target: ATXN1; (+) strand; PAM type: YTN; PAM sequence: TTC
atcagccttaaaaaaagaaa

SEQ ID NO: 272395 - DNA, 20 bp, Artificial Sequence
  Description of Artificial Sequence: Synthetic oligonucleotide
  Target: ATXN1; (+) strand; PAM type: YTN; PAM sequence: CTT
aaaaaaagaaattctgacac

SEQ ID NO: 272396 - DNA, 20 bp, Artificial Sequence
  Description of Artificial Sequence: Synthetic oligonucleotide
  Target: ATXN1; (+) strand; PAM type: YTN; PAM sequence: TTA
aaaaaagaaattctgacaca

SEQ ID NO: 272397 - DNA, 20 bp, Artificial Sequence
  Description of Artificial Sequence: Synthetic oligonucleotide
  Target: ATXN1; (+) strand; PAM type: YTN; PAM sequence: TTC
tgacacatgttacaacatgg

SEQ ID NO: 272398 - DNA, 20 bp, Artificial Sequence
  Description of Artificial Sequence: Synthetic oligonucleotide
  Target: ATXN1; (+) strand; PAM type: YTN; PAM sequence: CTG
acacatgttacaacatggat

SEQ ID NO: 272399 - DNA, 20 bp, Artificial Sequence
  Description of Artificial Sequence: Synthetic oligonucleotide
  Target: ATXN1; (+) strand; PAM type: YTN; PAM sequence: TTA
caacatggatgaccttgagg

SEQ ID NO: 272400 - DNA, 20 bp, Artificial Sequence
  Description of Artificial Sequence: Synthetic oligonucleotide
  Target: ATXN1; (+) strand; PAM type: YTN; PAM sequence: CTT
gaggacattatgctaaacaa

SEQ ID NO: 272401 - DNA, 20 bp, Artificial Sequence
  Description of Artificial Sequence: Synthetic oligonucleotide
  Target: ATXN1; (+) strand; PAM type: YTN; PAM sequence: TTG
aggacattatgctaaacaaa

SEQ ID NO: 272402 - DNA, 20 bp, Artificial Sequence
  Description of Artificial Sequence: Synthetic oligonucleotide
  Target: ATXN1; (+) strand; PAM type: YTN; PAM sequence: TTA
tgctaaacaaaaagtcacaa

SEQ ID NO: 272403 - DNA, 20 bp, Artificial Sequence
  Description of Artificial Sequence: Synthetic oligonucleotide
  Target: ATXN1; (+) strand; PAM type: YTN; PAM sequence: CTA
aacaaaaagtcacaaaagga

SEQ ID NO: 272404 - DNA, 20 bp, Artificial Sequence
  Description of Artificial Sequence: Synthetic oligonucleotide
  Target: ATXN1; (+) strand; PAM type: YTN; PAM sequence: CTG
tgtgattctactcataggag

SEQ ID NO: 272405 - DNA, 20 bp, Artificial Sequence
  Description of Artificial Sequence: Synthetic oligonucleotide
  Target: ATXN1; (+) strand; PAM type: YTN; PAM sequence: TTC
tactcataggaggtccctag

SEQ ID NO: 272406 - DNA, 20 bp, Artificial Sequence
  Description of Artificial Sequence: Synthetic oligonucleotide
  Target: ATXN1; (+) strand; PAM type: YTN; PAM sequence: CTA
ctcataggaggtccctagag

SEQ ID NO: 272407 - DNA, 20 bp, Artificial Sequence
  Description of Artificial Sequence: Synthetic oligonucleotide
  Target: ATXN1; (+) strand; PAM type: YTN; PAM sequence: CTC
ataggaggtccctagagcag

SEQ ID NO: 272408 - DNA, 20 bp, Artificial Sequence
  Description of Artificial Sequence: Synthetic oligonucleotide
  Target: ATXN1; (+) strand; PAM type: YTN; PAM sequence: CTA
gagcagtcaaattcatagag

SEQ ID NO: 272409 - DNA, 20 bp, Artificial Sequence
  Description of Artificial Sequence: Synthetic oligonucleotide
  Target: ATXN1; (+) strand; PAM type: YTN; PAM sequence: TTC
atagaggcagaaagtagaat

SEQ ID NO: 272410 - DNA, 20 bp, Artificial Sequence
  Description of Artificial Sequence: Synthetic oligonucleotide
  Target: ATXN1; (+) strand; PAM type: YTN; PAM sequence: TTA
ccaggagggagggggaaggg

SEQ ID NO: 272411 - DNA, 20 bp, Artificial Sequence
  Description of Artificial Sequence: Synthetic oligonucleotide
  Target: ATXN1; (+) strand; PAM type: YTN; PAM sequence: TTT
attgtctaatgggtacagag

SEQ ID NO: 272412 - DNA, 20 bp, Artificial Sequence
  Description of Artificial Sequence: Synthetic oligonucleotide
  Target: ATXN1; (+) strand; PAM type: YTN; PAM sequence: TTA
ttgtctaatgggtacagagt

SEQ ID NO: 272413 - DNA, 20 bp, Artificial Sequence
  Description of Artificial Sequence: Synthetic oligonucleotide
  Target: ATXN1; (+) strand; PAM type: YTN; PAM sequence: TTG
tctaatgggtacagagtttt

SEQ ID NO: 272414 - DNA, 20 bp, Artificial Sequence
  Description of Artificial Sequence: Synthetic oligonucleotide
  Target: ATXN1; (+) strand; PAM type: YTN; PAM sequence: CTA
atgggtacagagttttgcaa

SEQ ID NO: 272415 - DNA, 20 bp, Artificial Sequence
  Description of Artificial Sequence: Synthetic oligonucleotide
  Target: ATXN1; (+) strand; PAM type: YTN; PAM sequence: TTT
tgcaagacacaaacagctga

SEQ ID NO: 272416 - DNA, 20 bp, Artificial Sequence
  Description of Artificial Sequence: Synthetic oligonucleotide
  Target: ATXN1; (+) strand; PAM type: YTN; PAM sequence: TTT
gcaagacacaaacagctgag

SEQ ID NO: 272417 - DNA, 20 bp, Artificial Sequence
  Description of Artificial Sequence: Synthetic oligonucleotide
  Target: ATXN1; (+) strand; PAM type: YTN; PAM sequence: TTG
caagacacaaacagctgaga

SEQ ID NO: 272418 - DNA, 20 bp, Artificial Sequence
  Description of Artificial Sequence: Synthetic oligonucleotide
  Target: ATXN1; (+) strand; PAM type: YTN; PAM sequence: CTG
agactggatgcacaacgaga

SEQ ID NO: 272419 - DNA, 20 bp, Artificial Sequence
  Description of Artificial Sequence: Synthetic oligonucleotide
  Target: ATXN1; (+) strand; PAM type: YTN; PAM sequence: CTG
gatgcacaacgagaatatac

SEQ ID NO: 272420 - DNA, 20 bp, Artificial Sequence
  Description of Artificial Sequence: Synthetic oligonucleotide
  Target: ATXN1; (+) strand; PAM type: YTN; PAM sequence: CTG
gatactatcaggctgtatct

SEQ ID NO: 272421 - DNA, 20 bp, Artificial Sequence
  Description of Artificial Sequence: Synthetic oligonucleotide
  Target: ATXN1; (+) strand; PAM type: YTN; PAM sequence: CTA
tcaggctgtatcttgaaccc

SEQ ID NO: 272422 - DNA, 20 bp, Artificial Sequence
  Description of Artificial Sequence: Synthetic oligonucleotide
  Target: ATXN1; (+) strand; PAM type: YTN; PAM sequence: CTG
tatcttgaacccagctacct

SEQ ID NO: 272423 - DNA, 20 bp, Artificial Sequence
  Description of Artificial Sequence: Synthetic oligonucleotide
  Target: ATXN1; (+) strand; PAM type: YTN; PAM sequence: CTT
gaacccagctacctctctct

SEQ ID NO: 272424 - DNA, 20 bp, Artificial Sequence
  Description of Artificial Sequence: Synthetic oligonucleotide
  Target: ATXN1; (+) strand; PAM type: YTN; PAM sequence: TTG
aacccagctacctctctctg

SEQ ID NO: 272425 - DNA, 20 bp, Artificial Sequence
  Description of Artificial Sequence: Synthetic oligonucleotide
  Target: ATXN1; (+) strand; PAM type: YTN; PAM sequence: CTA
cctctctctgatgccactgc

SEQ ID NO: 272426 - DNA, 20 bp, Artificial Sequence
  Description of Artificial Sequence: Synthetic oligonucleotide
  Target: ATXN1; (+) strand; PAM type: YTN; PAM sequence: CTC
tctctgatgccactgccacc

SEQ ID NO: 272427 - DNA, 20 bp, Artificial Sequence
  Description of Artificial Sequence: Synthetic oligonucleotide
  Target: ATXN1; (+) strand; PAM type: YTN; PAM sequence: CTC
tctgatgccactgccaccat

SEQ ID NO: 272428 - DNA, 20 bp, Artificial Sequence
  Description of Artificial Sequence: Synthetic oligonucleotide
  Target: ATXN1; (+) strand; PAM type: YTN; PAM sequence: CTC
tgatgccactgccaccattc

SEQ ID NO: 272429 - DNA, 20 bp, Artificial Sequence
  Description of Artificial Sequence: Synthetic oligonucleotide
  Target: ATXN1; (+) strand; PAM type: YTN; PAM sequence: CTG
atgccactgccaccattcaa

SEQ ID NO: 272430 - DNA, 20 bp, Artificial Sequence
  Description of Artificial Sequence: Synthetic oligonucleotide
  Target: ATXN1; (+) strand; PAM type: YTN; PAM sequence: CTG
ccaccattcaagcccaagcc

SEQ ID NO: 272431 - DNA, 20 bp, Artificial Sequence
  Description of Artificial Sequence: Synthetic oligonucleotide
  Target: ATXN1; (+) strand; PAM type: YTN; PAM sequence: TTC
aagcccaagccactgtcatt

SEQ ID NO: 272432 - DNA, 20 bp, Artificial Sequence
  Description of Artificial Sequence: Synthetic oligonucleotide
  Target: ATXN1; (+) strand; PAM type: YTN; PAM sequence: CTG
tcattttctatcctgtcaac

SEQ ID NO: 272433 - DNA, 20 bp, Artificial Sequence
  Description of Artificial Sequence: Synthetic oligonucleotide
  Target: ATXN1; (+) strand; PAM type: YTN; PAM sequence: TTT
tctatcctgtcaactacagg

SEQ ID NO: 272434 - DNA, 20 bp, Artificial Sequence
  Description of Artificial Sequence: Synthetic oligonucleotide
  Target: ATXN1; (+) strand; PAM type: YTN; PAM sequence: TTT
ctatcctgtcaactacaggt

SEQ ID NO: 272435 - DNA, 20 bp, Artificial Sequence
  Description of Artificial Sequence: Synthetic oligonucleotide
  Target: ATXN1; (+) strand; PAM type: YTN; PAM sequence: TTC
tatcctgtcaactacaggtt

SEQ ID NO: 272436 - DNA, 20 bp, Artificial Sequence
  Description of Artificial Sequence: Synthetic oligonucleotide
  Target: ATXN1; (+) strand; PAM type: YTN; PAM sequence: CTA
tcctgtcaactacaggtttc

SEQ ID NO: 272437 - DNA, 20 bp, Artificial Sequence
  Description of Artificial Sequence: Synthetic oligonucleotide
  Target: ATXN1; (+) strand; PAM type: YTN; PAM sequence: CTG
tcaactacaggtttcttacc

SEQ ID NO: 272438 - DNA, 20 bp, Artificial Sequence
  Description of Artificial Sequence: Synthetic oligonucleotide
  Target: ATXN1; (+) strand; PAM type: YTN; PAM sequence: CTA
caggtttcttacctggcctc

SEQ ID NO: 272439 - DNA, 20 bp, Artificial Sequence
  Description of Artificial Sequence: Synthetic oligonucleotide
  Target: ATXN1; (+) strand; PAM type: YTN; PAM sequence: TTT
cttacctggcctccctgttt

SEQ ID NO: 272440 - DNA, 20 bp, Artificial Sequence
  Description of Artificial Sequence: Synthetic oligonucleotide
  Target: ATXN1; (+) strand; PAM type: YTN; PAM sequence: TTC
ttacctggcctccctgtttt

SEQ ID NO: 272441 - DNA, 20 bp, Artificial Sequence
  Description of Artificial Sequence: Synthetic oligonucleotide
  Target: ATXN1; (+) strand; PAM type: YTN; PAM sequence: CTT
acctggcctccctgtttttc

SEQ ID NO: 272442 - DNA, 20 bp, Artificial Sequence
  Description of Artificial Sequence: Synthetic oligonucleotide
  Target: ATXN1; (+) strand; PAM type: YTN; PAM sequence: TTA
cctggcctccctgtttttct

SEQ ID NO: 272443 - DNA, 20 bp, Artificial Sequence
  Description of Artificial Sequence: Synthetic oligonucleotide
  Target: ATXN1; (+) strand; PAM type: YTN; PAM sequence: CTG
gcctccctgtttttcttgcc

SEQ ID NO: 272444 - DNA, 20 bp, Artificial Sequence
  Description of Artificial Sequence: Synthetic oligonucleotide
  Target: ATXN1; (+) strand; PAM type: YTN; PAM sequence: CTC
cctgtttttcttgccatcct

SEQ ID NO: 272445 - DNA, 20 bp, Artificial Sequence
  Description of Artificial Sequence: Synthetic oligonucleotide
  Target: ATXN1; (+) strand; PAM type: YTN; PAM sequence: CTG
tttttcttgccatcctttta

SEQ ID NO: 272446 - DNA, 20 bp, Artificial Sequence
  Description of Artificial Sequence: Synthetic oligonucleotide
  Target: ATXN1; (+) strand; PAM type: YTN; PAM sequence: TTT
ttcttgccatccttttaatg

SEQ ID NO: 272447 - DNA, 20 bp, Artificial Sequence
  Description of Artificial Sequence: Synthetic oligonucleotide
  Target: ATXN1; (+) strand; PAM type: YTN; PAM sequence: TTT
tcttgccatccttttaatgt

SEQ ID NO: 272448 - DNA, 20 bp, Artificial Sequence
  Description of Artificial Sequence: Synthetic oligonucleotide
  Target: ATXN1; (+) strand; PAM type: YTN; PAM sequence: TTT
cttgccatccttttaatgtc

SEQ ID NO: 272449 - DNA, 20 bp, Artificial Sequence
  Description of Artificial Sequence: Synthetic oligonucleotide
  Target: ATXN1; (+) strand; PAM type: YTN; PAM sequence: TTC
ttgccatccttttaatgtca

SEQ ID NO: 272450 - DNA, 20 bp, Artificial Sequence
  Description of Artificial Sequence: Synthetic oligonucleotide
  Target: ATXN1; (+) strand; PAM type: YTN; PAM sequence: CTT
gccatccttttaatgtcaca

SEQ ID NO: 272451 - DNA, 20 bp, Artificial Sequence
  Description of Artificial Sequence: Synthetic oligonucleotide
  Target: ATXN1; (+) strand; PAM type: YTN; PAM sequence: TTG
ccatccttttaatgtcacag

SEQ ID NO: 272452 - DNA, 20 bp, Artificial Sequence
  Description of Artificial Sequence: Synthetic oligonucleotide
  Target: ATXN1; (+) strand; PAM type: YTN; PAM sequence: CTT
ttaatgtcacagtaaaaagt

SEQ ID NO: 272453 - DNA, 20 bp, Artificial Sequence
  Description of Artificial Sequence: Synthetic oligonucleotide
  Target: ATXN1; (+) strand; PAM type: YTN; PAM sequence: TTT
taatgtcacagtaaaaagtg

SEQ ID NO: 272454 - DNA, 20 bp, Artificial Sequence
  Description of Artificial Sequence: Synthetic oligonucleotide
  Target: ATXN1; (+) strand; PAM type: YTN; PAM sequence: TTT
aatgtcacagtaaaaagtgt

SEQ ID NO: 272455 - DNA, 20 bp, Artificial Sequence
  Description of Artificial Sequence: Synthetic oligonucleotide
  Target: ATXN1; (+) strand; PAM type: YTN; PAM sequence: TTA
atgtcacagtaaaaagtgtc

SEQ ID NO: 272456 - DNA, 20 bp, Artificial Sequence
  Description of Artificial Sequence: Synthetic oligonucleotide
  Target: ATXN1; (+) strand; PAM type: YTN; PAM sequence: CTA
tgttagataggatggacaag

SEQ ID NO: 272457 - DNA, 20 bp, Artificial Sequence
  Description of Artificial Sequence: Synthetic oligonucleotide
  Target: ATXN1; (+) strand; PAM type: YTN; PAM sequence: TTA
gataggatggacaaggaagg

SEQ ID NO: 272458 - DNA, 20 bp, Artificial Sequence
  Description of Artificial Sequence: Synthetic oligonucleotide
  Target: ATXN1; (+) strand; PAM type: YTN; PAM sequence: CTC
ttggaggtgacatttgtgca

SEQ ID NO: 272459 - DNA, 20 bp, Artificial Sequence
  Description of Artificial Sequence: Synthetic oligonucleotide
  Target: ATXN1; (+) strand; PAM type: YTN; PAM sequence: CTT
ggaggtgacatttgtgcact

SEQ ID NO: 272460 - DNA, 20 bp, Artificial Sequence
  Description of Artificial Sequence: Synthetic oligonucleotide
  Target: ATXN1; (+) strand; PAM type: YTN; PAM sequence: TTG
gaggtgacatttgtgcactc

SEQ ID NO: 272461 - DNA, 20 bp, Artificial Sequence
  Description of Artificial Sequence: Synthetic oligonucleotide
  Target: ATXN1; (+) strand; PAM type: YTN; PAM sequence: TTT
gtgcactcattcaggtcatt

SEQ ID NO: 272462 - DNA, 20 bp, Artificial Sequence
  Description of Artificial Sequence: Synthetic oligonucleotide
  Target: ATXN1; (+) strand; PAM type: YTN; PAM sequence: TTG
tgcactcattcaggtcattt

SEQ ID NO: 272463 - DNA, 20 bp, Artificial Sequence
  Description of Artificial Sequence: Synthetic oligonucleotide
  Target: ATXN1; (+) strand; PAM type: YTN; PAM sequence: CTC
attcaggtcatttttccatt

SEQ ID NO: 272464 - DNA, 20 bp, Artificial Sequence
  Description of Artificial Sequence: Synthetic oligonucleotide
  Target: ATXN1; (+) strand; PAM type: YTN; PAM sequence: TTC
aggtcatttttccattcaaa

SEQ ID NO: 272465 - DNA, 20 bp, Artificial Sequence
  Description of Artificial Sequence: Synthetic oligonucleotide
  Target: ATXN1; (+) strand; PAM type: YTN; PAM sequence: TTT
ttccattcaaaagcattcga

SEQ ID NO: 272466 - DNA, 20 bp, Artificial Sequence
  Description of Artificial Sequence: Synthetic oligonucleotide
  Target: ATXN1; (+) strand; PAM type: YTN; PAM sequence: TTT
tccattcaaaagcattcgat

SEQ ID NO: 272467 - DNA, 20 bp, Artificial Sequence
  Description of Artificial Sequence: Synthetic oligonucleotide
  Target: ATXN1; (+) strand; PAM type: YTN; PAM sequence: TTT
ccattcaaaagcattcgata

SEQ ID NO: 272468 - DNA, 20 bp, Artificial Sequence
  Description of Artificial Sequence: Synthetic oligonucleotide
  Target: ATXN1; (+) strand; PAM type: YTN; PAM sequence: TTC
cattcaaaagcattcgatag

SEQ ID NO: 272469 - DNA, 20 bp, Artificial Sequence
  Description of Artificial Sequence: Synthetic oligonucleotide
  Target: ATXN1; (+) strand; PAM type: YTN; PAM sequence: TTC
aaaagcattcgatagctcat

SEQ ID NO: 272470 - DNA, 20 bp, Artificial Sequence
  Description of Artificial Sequence: Synthetic oligonucleotide
  Target: ATXN1; (+) strand; PAM type: YTN; PAM sequence: TTC
gatagctcattctgactgtc

SEQ ID NO: 272471 - DNA, 20 bp, Artificial Sequence
  Description of Artificial Sequence: Synthetic oligonucleotide
  Target: ATXN1; (+) strand; PAM type: YTN; PAM sequence: CTC
attctgactgtcctatttat

SEQ ID NO: 272472 - DNA, 20 bp, Artificial Sequence
  Description of Artificial Sequence: Synthetic oligonucleotide
  Target: ATXN1; (+) strand; PAM type: YTN; PAM sequence: TTC
tgactgtcctatttatggta

SEQ ID NO: 272473 - DNA, 20 bp, Artificial Sequence
  Description of Artificial Sequence: Synthetic oligonucleotide
  Target: ATXN1; (+) strand; PAM type: YTN; PAM sequence: CTG
actgtcctatttatggtaat

SEQ ID NO: 272474 - DNA, 20 bp, Artificial Sequence
  Description of Artificial Sequence: Synthetic oligonucleotide
  Target: ATXN1; (+) strand; PAM type: YTN; PAM sequence: CTG
tcctatttatggtaattctg

SEQ ID NO: 272475 - DNA, 20 bp, Artificial Sequence
  Description of Artificial Sequence: Synthetic oligonucleotide
  Target: ATXN1; (+) strand; PAM type: YTN; PAM sequence: CTA
tttatggtaattctgtagcc

SEQ ID NO: 272476 - DNA, 20 bp, Artificial Sequence
  Description of Artificial Sequence: Synthetic oligonucleotide
  Target: ATXN1; (+) strand; PAM type: YTN; PAM sequence: TTT
atggtaattctgtagccatt

SEQ ID NO: 272477 - DNA, 20 bp, Artificial Sequence
  Description of Artificial Sequence: Synthetic oligonucleotide
  Target: ATXN1; (+) strand; PAM type: YTN; PAM sequence: TTA
tggtaattctgtagccattc

SEQ ID NO: 272478 - DNA, 20 bp, Artificial Sequence
  Description of Artificial Sequence: Synthetic oligonucleotide
  Target: ATXN1; (+) strand; PAM type: YTN; PAM sequence: TTC
tgtagccattcaggactgaa

SEQ ID NO: 272479 - DNA, 20 bp, Artificial Sequence
  Description of Artificial Sequence: Synthetic oligonucleotide
  Target: ATXN1; (+) strand; PAM type: YTN; PAM sequence: CTG
tagccattcaggactgaaac

SEQ ID NO: 272480 - DNA, 20 bp, Artificial Sequence
  Description of Artificial Sequence: Synthetic oligonucleotide
  Target: ATXN1; (+) strand; PAM type: YTN; PAM sequence: TTC
aggactgaaactctgacagc

SEQ ID NO: 272481 - DNA, 20 bp, Artificial Sequence
  Description of Artificial Sequence: Synthetic oligonucleotide
  Target: ATXN1; (+) strand; PAM type: YTN; PAM sequence: CTG
aaactctgacagcccctgga

SEQ ID NO: 272482 - DNA, 20 bp, Artificial Sequence
  Description of Artificial Sequence: Synthetic oligonucleotide
  Target: ATXN1; (+) strand; PAM type: YTN; PAM sequence: CTC
tgacagcccctggacacctt

SEQ ID NO: 272483 - DNA, 20 bp, Artificial Sequence
  Description of Artificial Sequence: Synthetic oligonucleotide
  Target: ATXN1; (+) strand; PAM type: YTN; PAM sequence: CTG
acagcccctggacaccttct

SEQ ID NO: 272484 - DNA, 20 bp, Artificial Sequence
  Description of Artificial Sequence: Synthetic oligonucleotide
  Target: ATXN1; (+) strand; PAM type: YTN; PAM sequence: CTG
gacaccttctgatccttctc

SEQ ID NO: 272485 - DNA, 20 bp, Artificial Sequence
  Description of Artificial Sequence: Synthetic oligonucleotide
  Target: ATXN1; (+) strand; PAM type: YTN; PAM sequence: CTT
ctgatccttctctctctgta

SEQ ID NO: 272486 - DNA, 20 bp, Artificial Sequence
  Description of Artificial Sequence: Synthetic oligonucleotide
  Target: ATXN1; (+) strand; PAM type: YTN; PAM sequence: TTC
tgatccttctctctctgtat

SEQ ID NO: 272487 - DNA, 20 bp, Artificial Sequence
  Description of Artificial Sequence: Synthetic oligonucleotide
  Target: ATXN1; (+) strand; PAM type: YTN; PAM sequence: CTG
atccttctctctctgtatcg

SEQ ID NO: 272488 - DNA, 20 bp, Artificial Sequence
  Description of Artificial Sequence: Synthetic oligonucleotide
  Target: ATXN1; (+) strand; PAM type: YTN; PAM sequence: CTT
ctctctctgtatcgcatcta

SEQ ID NO: 272489 - DNA, 20 bp, Artificial Sequence
  Description of Artificial Sequence: Synthetic oligonucleotide
  Target: ATXN1; (+) strand; PAM type: YTN; PAM sequence: TTC
tctctctgtatcgcatctag

SEQ ID NO: 272490 - DNA, 20 bp, Artificial Sequence
  Description of Artificial Sequence: Synthetic oligonucleotide
  Target: ATXN1; (+) strand; PAM type: YTN; PAM sequence: CTC
tctctgtatcgcatctagtc

SEQ ID NO: 272491 - DNA, 20 bp, Artificial Sequence
  Description of Artificial Sequence: Synthetic oligonucleotide
  Target: ATXN1; (+) strand; PAM type: YTN; PAM sequence: CTC
tctgtatcgcatctagtctc

SEQ ID NO: 272492 - DNA, 20 bp, Artificial Sequence
  Description of Artificial Sequence: Synthetic oligonucleotide
  Target: ATXN1; (+) strand; PAM type: YTN; PAM sequence: CTC
tgtatcgcatctagtctcta

SEQ ID NO: 272493 - DNA, 20 bp, Artificial Sequence
  Description of Artificial Sequence: Synthetic oligonucleotide
  Target: ATXN1; (+) strand; PAM type: YTN; PAM sequence: CTG
tatcgcatctagtctctatt

SEQ ID NO: 272494 - DNA, 20 bp, Artificial Sequence
  Description of Artificial Sequence: Synthetic oligonucleotide
  Target: ATXN1; (+) strand; PAM type: YTN; PAM sequence: CTA
gtctctattttccccattgc

SEQ ID NO: 272495 - DNA, 20 bp, Artificial Sequence
  Description of Artificial Sequence: Synthetic oligonucleotide
  Target: ATXN1; (+) strand; PAM type: YTN; PAM sequence: CTC
tattttccccattgctaaga

SEQ ID NO: 272496 - DNA, 20 bp, Artificial Sequence
  Description of Artificial Sequence: Synthetic oligonucleotide
  Target: ATXN1; (+) strand; PAM type: YTN; PAM sequence: CTA
ttttccccattgctaagagt

SEQ ID NO: 272497 - DNA, 20 bp, Artificial Sequence
  Description of Artificial Sequence: Synthetic oligonucleotide
  Target: ATXN1; (+) strand; PAM type: YTN; PAM sequence: TTT
tccccattgctaagagtaat

SEQ ID NO: 272498 - DNA, 20 bp, Artificial Sequence
  Description of Artificial Sequence: Synthetic oligonucleotide
  Target: ATXN1; (+) strand; PAM type: YTN; PAM sequence: TTT
ccccattgctaagagtaatc

SEQ ID NO: 272499 - DNA, 20 bp, Artificial Sequence
  Description of Artificial Sequence: Synthetic oligonucleotide
  Target: ATXN1; (+) strand; PAM type: YTN; PAM sequence: TTC
cccattgctaagagtaatca

SEQ ID NO: 272500 - DNA, 20 bp, Artificial Sequence
  Description of Artificial Sequence: Synthetic oligonucleotide
  Target: ATXN1; (+) strand; PAM type: YTN; PAM sequence: TTG
ctaagagtaatcatgctatc

SEQ ID NO: 272501 - DNA, 20 bp, Artificial Sequence
  Description of Artificial Sequence: Synthetic oligonucleotide
  Target: ATXN1; (+) strand; PAM type: YTN; PAM sequence: CTA
agagtaatcatgctatctgt

SEQ ID NO: 272502 - DNA, 20 bp, Artificial Sequence
  Description of Artificial Sequence: Synthetic oligonucleotide
  Target: ATXN1; (+) strand; PAM type: YTN; PAM sequence: CTA
tctgtcctatctactactcc

SEQ ID NO: 272503 - DNA, 20 bp, Artificial Sequence
  Description of Artificial Sequence: Synthetic oligonucleotide
  Target: ATXN1; (+) strand; PAM type: YTN; PAM sequence: CTG
tcctatctactactccttct

SEQ ID NO: 272504 - DNA, 20 bp, Artificial Sequence
  Description of Artificial Sequence: Synthetic oligonucleotide
  Target: ATXN1; (+) strand; PAM type: YTN; PAM sequence: CTA
tctactactccttctcttgg

SEQ ID NO: 272505 - DNA, 20 bp, Artificial Sequence
  Description of Artificial Sequence: Synthetic oligonucleotide
  Target: ATXN1; (+) strand; PAM type: YTN; PAM sequence: CTA
ctactccttctcttggaatg

SEQ ID NO: 272506 - DNA, 20 bp, Artificial Sequence
  Description of Artificial Sequence: Synthetic oligonucleotide
  Target: ATXN1; (+) strand; PAM type: YTN; PAM sequence: CTA
ctccttctcttggaatgggc

SEQ ID NO: 272507 - DNA, 20 bp, Artificial Sequence
  Description of Artificial Sequence: Synthetic oligonucleotide
  Target: ATXN1; (+) strand; PAM type: YTN; PAM sequence: CTC
cttctcttggaatgggctgt

SEQ ID NO: 272508 - DNA, 20 bp, Artificial Sequence
  Description of Artificial Sequence: Synthetic oligonucleotide
  Target: ATXN1; (+) strand; PAM type: YTN; PAM sequence: CTT
ctcttggaatgggctgtcac

SEQ ID NO: 272509 - DNA, 20 bp, Artificial Sequence
  Description of Artificial Sequence: Synthetic oligonucleotide
  Target: ATXN1; (+) strand; PAM type: YTN; PAM sequence: TTC
tcttggaatgggctgtcact

SEQ ID NO: 272510 - DNA, 20 bp, Artificial Sequence
  Description of Artificial Sequence: Synthetic oligonucleotide
  Target: ATXN1; (+) strand; PAM type: YTN; PAM sequence: CTC
ttggaatgggctgtcactcc

SEQ ID NO: 272511 - DNA, 20 bp, Artificial Sequence
  Description of Artificial Sequence: Synthetic oligonucleotide
  Target: ATXN1; (+) strand; PAM type: YTN; PAM sequence: CTT
ggaatgggctgtcactcccc

SEQ ID NO: 272512 - DNA, 20 bp, Artificial Sequence
  Description of Artificial Sequence: Synthetic oligonucleotide
  Target: ATXN1; (+) strand; PAM type: YTN; PAM sequence: TTG
gaatgggctgtcactcccca

SEQ ID NO: 272513 - DNA, 20 bp, Artificial Sequence
  Description of Artificial Sequence: Synthetic oligonucleotide
  Target: ATXN1; (+) strand; PAM type: YTN; PAM sequence: CTG
tcactccccactcccgtcta

SEQ ID NO: 272514 - DNA, 20 bp, Artificial Sequence
  Description of Artificial Sequence: Synthetic oligonucleotide
  Target: ATXN1; (+) strand; PAM type: YTN; PAM sequence: CTC
cccactcccgtctatcctac

SEQ ID NO: 272515 - DNA, 20 bp, Artificial Sequence
  Description of Artificial Sequence: Synthetic oligonucleotide
  Target: ATXN1; (+) strand; PAM type: YTN; PAM sequence: CTC
ccgtctatcctacatataca

SEQ ID NO: 272516 - DNA, 20 bp, Artificial Sequence
  Description of Artificial Sequence: Synthetic oligonucleotide
  Target: ATXN1; (+) strand; PAM type: YTN; PAM sequence: CTA
tcctacatatacatgccaga

SEQ ID NO: 272517 - DNA, 20 bp, Artificial Sequence
  Description of Artificial Sequence: Synthetic oligonucleotide
  Target: ATXN1; (+) strand; PAM type: YTN; PAM sequence: CTA
catatacatgccagatgaat

SEQ ID NO: 272518 - DNA, 20 bp, Artificial Sequence
  Description of Artificial Sequence: Synthetic oligonucleotide
  Target: ATXN1; (+) strand; PAM type: YTN; PAM sequence: CTT
tctaaactgcagtttcaatc

SEQ ID NO: 272519 - DNA, 20 bp, Artificial Sequence
  Description of Artificial Sequence: Synthetic oligonucleotide
  Target: ATXN1; (+) strand; PAM type: YTN; PAM sequence: TTT
ctaaactgcagtttcaatct

SEQ ID NO: 272520 - DNA, 20 bp, Artificial Sequence
  Description of Artificial Sequence: Synthetic oligonucleotide
  Target: ATXN1; (+) strand; PAM type: YTN; PAM sequence: TTC
taaactgcagtttcaatctt

SEQ ID NO: 272521 - DNA, 20 bp, Artificial Sequence
  Description of Artificial Sequence: Synthetic oligonucleotide
  Target: ATXN1; (+) strand; PAM type: YTN; PAM sequence: CTA
aactgcagtttcaatcttct

SEQ ID NO: 272522 - DNA, 20 bp, Artificial Sequence
  Description of Artificial Sequence: Synthetic oligonucleotide
  Target: ATXN1; (+) strand; PAM type: YTN; PAM sequence: CTG
cagtttcaatcttctttctc

SEQ ID NO: 272523 - DNA, 20 bp, Artificial Sequence
  Description of Artificial Sequence: Synthetic oligonucleotide
  Target: ATXN1; (+) strand; PAM type: YTN; PAM sequence: TTT
caatcttctttctcgtttca

SEQ ID NO: 272524 - DNA, 20 bp, Artificial Sequence
  Description of Artificial Sequence: Synthetic oligonucleotide
  Target: ATXN1; (+) strand; PAM type: YTN; PAM sequence: TTC
aatcttctttctcgtttcaa

SEQ ID NO: 272525 - DNA, 20 bp, Artificial Sequence
  Description of Artificial Sequence: Synthetic oligonucleotide
  Target: ATXN1; (+) strand; PAM type: YTN; PAM sequence: CTT
ctttctcgtttcaaaatctc

SEQ ID NO: 272526 - DNA, 20 bp, Artificial Sequence
  Description of Artificial Sequence: Synthetic oligonucleotide
  Target: ATXN1; (+) strand; PAM type: YTN; PAM sequence: TTC
tttctcgtttcaaaatctct

SEQ ID NO: 272527 - DNA, 20 bp, Artificial Sequence
  Description of Artificial Sequence: Synthetic oligonucleotide
  Target: ATXN1; (+) strand; PAM type: YTN; PAM sequence: CTT
tctcgtttcaaaatctcttg

SEQ ID NO: 272528 - DNA, 20 bp, Artificial Sequence
  Description of Artificial Sequence: Synthetic oligonucleotide
  Target: ATXN1; (+) strand; PAM type: YTN; PAM sequence: TTT
ctcgtttcaaaatctcttgt

SEQ ID NO: 272529 - DNA, 20 bp, Artificial Sequence
  Description of Artificial Sequence: Synthetic oligonucleotide
  Target: ATXN1; (+) strand; PAM type: YTN; PAM sequence: TTC
tcgtttcaaaatctcttgtt

SEQ ID NO: 272530 - DNA, 20 bp, Artificial Sequence
  Description of Artificial Sequence: Synthetic oligonucleotide
  Target: ATXN1; (+) strand; PAM type: YTN; PAM sequence: CTC
gtttcaaaatctcttgttgc

SEQ ID NO: 272531 - DNA, 20 bp, Artificial Sequence
  Description of Artificial Sequence: Synthetic oligonucleotide
  Target: ATXN1; (+) strand; PAM type: YTN; PAM sequence: TTT
caaaatctcttgttgctggt

SEQ ID NO: 272532 - DNA, 20 bp, Artificial Sequence
  Description of Artificial Sequence: Synthetic oligonucleotide
  Target: ATXN1; (+) strand; PAM type: YTN; PAM sequence: TTC
aaaatctcttgttgctggtt

SEQ ID NO: 272533 - DNA, 20 bp, Artificial Sequence
  Description of Artificial Sequence: Synthetic oligonucleotide
  Target: ATXN1; (+) strand; PAM type: YTN; PAM sequence: CTC
ttgttgctggttcctcttcg

SEQ ID NO: 272534 - DNA, 20 bp, Artificial Sequence
  Description of Artificial Sequence: Synthetic oligonucleotide
  Target: ATXN1; (+) strand; PAM type: YTN; PAM sequence: CTT
gttgctggttcctcttcgct

SEQ ID NO: 272535 - DNA, 20 bp, Artificial Sequence
  Description of Artificial Sequence: Synthetic oligonucleotide
  Target: ATXN1; (+) strand; PAM type: YTN; PAM sequence: TTG
ttgctggttcctcttcgctt

SEQ ID NO: 272536 - DNA, 20 bp, Artificial Sequence
  Description of Artificial Sequence: Synthetic oligonucleotide
  Target: ATXN1; (+) strand; PAM type: YTN; PAM sequence: TTG
ctggttcctcttcgcttcct

SEQ ID NO: 272537 - DNA, 20 bp, Artificial Sequence
  Description of Artificial Sequence: Synthetic oligonucleotide
  Target: ATXN1; (+) strand; PAM type: YTN; PAM sequence: CTG
gttcctcttcgcttcctgaa

SEQ ID NO: 272538 - DNA, 20 bp, Artificial Sequence
  Description of Artificial Sequence: Synthetic oligonucleotide
  Target: ATXN1; (+) strand; PAM type: YTN; PAM sequence: TTC
ctcttcgcttcctgaattaa

SEQ ID NO: 272539 - DNA, 20 bp, Artificial Sequence
  Description of Artificial Sequence: Synthetic oligonucleotide
  Target: ATXN1; (+) strand; PAM type: YTN; PAM sequence: CTC
ttcgcttcctgaattaagtc

SEQ ID NO: 272540 - DNA, 20 bp, Artificial Sequence
  Description of Artificial Sequence: Synthetic oligonucleotide
  Target: ATXN1; (+) strand; PAM type: YTN; PAM sequence: CTT
cgcttcctgaattaagtcca

SEQ ID NO: 272541 - DNA, 20 bp, Artificial Sequence
  Description of Artificial Sequence: Synthetic oligonucleotide
  Target: ATXN1; (+) strand; PAM type: YTN; PAM sequence: TTC
gcttcctgaattaagtccag

SEQ ID NO: 272542 - DNA, 20 bp, Artificial Sequence
  Description of Artificial Sequence: Synthetic oligonucleotide
  Target: ATXN1; (+) strand; PAM type: YTN; PAM sequence: CTT
cctgaattaagtccagagtt

SEQ ID NO: 272543 - DNA, 20 bp, Artificial Sequence
  Description of Artificial Sequence: Synthetic oligonucleotide
  Target: ATXN1; (+) strand; PAM type: YTN; PAM sequence: TTC
ctgaattaagtccagagttt

SEQ ID NO: 272544 - DNA, 20 bp, Artificial Sequence
  Description of Artificial Sequence: Synthetic oligonucleotide
  Target: ATXN1; (+) strand; PAM type: YTN; PAM sequence: CTG
aattaagtccagagtttcca

SEQ ID NO: 272545 - DNA, 20 bp, Artificial Sequence
  Description of Artificial Sequence: Synthetic oligonucleotide
  Target: ATXN1; (+) strand; PAM type: YTN; PAM sequence: TTA
agtccagagtttccatccca

SEQ ID NO: 272546 - DNA, 20 bp, Artificial Sequence
  Description of Artificial Sequence: Synthetic oligonucleotide
  Target: ATXN1; (+) strand; PAM type: YTN; PAM sequence: TTT
ccatcccagactgtctgaca

SEQ ID NO: 272547 - DNA, 20 bp, Artificial Sequence
  Description of Artificial Sequence: Synthetic oligonucleotide
  Target: ATXN1; (+) strand; PAM type: YTN; PAM sequence: TTC
catcccagactgtctgacag

SEQ ID NO: 272548 - DNA, 20 bp, Artificial Sequence
  Description of Artificial Sequence: Synthetic oligonucleotide
  Target: ATXN1; (+) strand; PAM type: YTN; PAM sequence: CTG
tctgacagtctacaatatgg

SEQ ID NO: 272549 - DNA, 20 bp, Artificial Sequence
  Description of Artificial Sequence: Synthetic oligonucleotide
  Target: ATXN1; (+) strand; PAM type: YTN; PAM sequence: CTG
acagtctacaatatggcttc

SEQ ID NO: 272550 - DNA, 20 bp, Artificial Sequence
  Description of Artificial Sequence: Synthetic oligonucleotide
  Target: ATXN1; (+) strand; PAM type: YTN; PAM sequence: CTA
caatatggcttccacttacc

SEQ ID NO: 272551 - DNA, 20 bp, Artificial Sequence
  Description of Artificial Sequence: Synthetic oligonucleotide
  Target: ATXN1; (+) strand; PAM type: YTN; PAM sequence: CTT
ccacttaccttcccaactgt

SEQ ID NO: 272552 - DNA, 20 bp, Artificial Sequence
  Description of Artificial Sequence: Synthetic oligonucleotide
  Target: ATXN1; (+) strand; PAM type: YTN; PAM sequence: TTC
cacttaccttcccaactgtt

SEQ ID NO: 272553 - DNA, 20 bp, Artificial Sequence
  Description of Artificial Sequence: Synthetic oligonucleotide
  Target: ATXN1; (+) strand; PAM type: YTN; PAM sequence: CTT
accttcccaactgttatctc

SEQ ID NO: 272554 - DNA, 20 bp, Artificial Sequence
  Description of Artificial Sequence: Synthetic oligonucleotide
  Target: ATXN1; (+) strand; PAM type: YTN; PAM sequence: TTA
ccttcccaactgttatctcc

SEQ ID NO: 272555 - DNA, 20 bp, Artificial Sequence
  Description of Artificial Sequence: Synthetic oligonucleotide
  Target: ATXN1; (+) strand; PAM type: YTN; PAM sequence: CTT
cccaactgttatctcccact

SEQ ID NO: 272556 - DNA, 20 bp, Artificial Sequence
  Description of Artificial Sequence: Synthetic oligonucleotide
  Target: ATXN1; (+) strand; PAM type: YTN; PAM sequence: TTC
ccaactgttatctcccactt

SEQ ID NO: 272557 - DNA, 20 bp, Artificial Sequence
  Description of Artificial Sequence: Synthetic oligonucleotide
  Target: ATXN1; (+) strand; PAM type: YTN; PAM sequence: CTG
ttatctcccacttttcccca

SEQ ID NO: 272558 - DNA, 20 bp, Artificial Sequence
  Description of Artificial Sequence: Synthetic oligonucleotide
  Target: ATXN1; (+) strand; PAM type: YTN; PAM sequence: TTA
tctcccacttttccccatca

SEQ ID NO: 272559 - DNA, 20 bp, Artificial Sequence
  Description of Artificial Sequence: Synthetic oligonucleotide
  Target: ATXN1; (+) strand; PAM type: YTN; PAM sequence: CTC
ccacttttccccatcacagg

SEQ ID NO: 272560 - DNA, 20 bp, Artificial Sequence
  Description of Artificial Sequence: Synthetic oligonucleotide
  Target: ATXN1; (+) strand; PAM type: YTN; PAM sequence: CTT
ttccccatcacaggcatacg

SEQ ID NO: 272561 - DNA, 20 bp, Artificial Sequence
  Description of Artificial Sequence: Synthetic oligonucleotide
  Target: ATXN1; (+) strand; PAM type: YTN; PAM sequence: TTT
tccccatcacaggcatacgg

SEQ ID NO: 272562 - DNA, 20 bp, Artificial Sequence
  Description of Artificial Sequence: Synthetic oligonucleotide
  Target: ATXN1; (+) strand; PAM type: YTN; PAM sequence: TTT
ccccatcacaggcatacggg

SEQ ID NO: 272563 - DNA, 20 bp, Artificial Sequence
  Description of Artificial Sequence: Synthetic oligonucleotide
  Target: ATXN1; (+) strand; PAM type: YTN; PAM sequence: TTC
cccatcacaggcatacgggt

SEQ ID NO: 272564 - DNA, 20 bp, Artificial Sequence
  Description of Artificial Sequence: Synthetic oligonucleotide
  Target: ATXN1; (+) strand; PAM type: YTN; PAM sequence: CTT
gttccagaacgtactcttca

SEQ ID NO: 272565 - DNA, 20 bp, Artificial Sequence
  Description of Artificial Sequence: Synthetic oligonucleotide
  Target: ATXN1; (+) strand; PAM type: YTN; PAM sequence: TTG
ttccagaacgtactcttcac

SEQ ID NO: 272566 - DNA, 20 bp, Artificial Sequence
  Description of Artificial Sequence: Synthetic oligonucleotide
  Target: ATXN1; (+) strand; PAM type: YTN; PAM sequence: TTC
cagaacgtactcttcacttt

SEQ ID NO: 272567 - DNA, 20 bp, Artificial Sequence
  Description of Artificial Sequence: Synthetic oligonucleotide
  Target: ATXN1; (+) strand; PAM type: YTN; PAM sequence: CTC
ttcactttccagaatctgcg

SEQ ID NO: 272568 - DNA, 20 bp, Artificial Sequence
  Description of Artificial Sequence: Synthetic oligonucleotide
  Target: ATXN1; (+) strand; PAM type: YTN; PAM sequence: CTT
cactttccagaatctgcgtc

SEQ ID NO: 272569 - DNA, 20 bp, Artificial Sequence
  Description of Artificial Sequence: Synthetic oligonucleotide
  Target: ATXN1; (+) strand; PAM type: YTN; PAM sequence: TTC
actttccagaatctgcgtct

SEQ ID NO: 272570 - DNA, 20 bp, Artificial Sequence
  Description of Artificial Sequence: Synthetic oligonucleotide
  Target: ATXN1; (+) strand; PAM type: YTN; PAM sequence: CTT
tccagaatctgcgtctctgg

SEQ ID NO: 272571 - DNA, 20 bp, Artificial Sequence
  Description of Artificial Sequence: Synthetic oligonucleotide
  Target: ATXN1; (+) strand; PAM type: YTN; PAM sequence: TTT
ccagaatctgcgtctctggt

SEQ ID NO: 272572 - DNA, 20 bp, Artificial Sequence
  Description of Artificial Sequence: Synthetic oligonucleotide
  Target: ATXN1; (+) strand; PAM type: YTN; PAM sequence: TTC
cagaatctgcgtctctggtc

SEQ ID NO: 272573 - DNA, 20 bp, Artificial Sequence
  Description of Artificial Sequence: Synthetic oligonucleotide
  Target: ATXN1; (+) strand; PAM type: YTN; PAM sequence: CTG
cgtctctggtctcaatggcc

SEQ ID NO: 272574 - DNA, 20 bp, Artificial Sequence
  Description of Artificial Sequence: Synthetic oligonucleotide
  Target: ATXN1; (+) strand; PAM type: YTN; PAM sequence: CTC
tggtctcaatggccctcgca

SEQ ID NO: 272575 - DNA, 20 bp, Artificial Sequence
  Description of Artificial Sequence: Synthetic oligonucleotide
  Target: ATXN1; (+) strand; PAM type: YTN; PAM sequence: CTG
gtctcaatggccctcgcacg

SEQ ID NO: 272576 - DNA, 20 bp, Artificial Sequence
  Description of Artificial Sequence: Synthetic oligonucleotide
  Target: ATXN1; (+) strand; PAM type: YTN; PAM sequence: CTC
aatggccctcgcacgcctcc

SEQ ID NO: 272577 - DNA, 20 bp, Artificial Sequence
  Description of Artificial Sequence: Synthetic oligonucleotide
  Target: ATXN1; (+) strand; PAM type: YTN; PAM sequence: CTC
gcacgcctccccgcaatccc

SEQ ID NO: 272578 - DNA, 20 bp, Artificial Sequence
  Description of Artificial Sequence: Synthetic oligonucleotide
  Target: ATXN1; (+) strand; PAM type: YTN; PAM sequence: CTC
cccgcaatccctgttgcaaa

SEQ ID NO: 272579 - DNA, 20 bp, Artificial Sequence
  Description of Artificial Sequence: Synthetic oligonucleotide
  Target: ATXN1; (+) strand; PAM type: YTN; PAM sequence: CTG
ttgcaaactaaaatcccatt

SEQ ID NO: 272580 - DNA, 20 bp, Artificial Sequence
  Description of Artificial Sequence: Synthetic oligonucleotide
  Target: ATXN1; (+) strand; PAM type: YTN; PAM sequence: TTG
caaactaaaatcccattccc

SEQ ID NO: 272581 - DNA, 20 bp, Artificial Sequence
  Description of Artificial Sequence: Synthetic oligonucleotide
  Target: ATXN1; (+) strand; PAM type: YTN; PAM sequence: CTA
aaatcccattcccaaatcac

SEQ ID NO: 272582 - DNA, 20 bp, Artificial Sequence
  Description of Artificial Sequence: Synthetic oligonucleotide
  Target: ATXN1; (+) strand; PAM type: YTN; PAM sequence: TTC
ccaaatcaccttctctgtgg

SEQ ID NO: 272583 - DNA, 20 bp, Artificial Sequence
  Description of Artificial Sequence: Synthetic oligonucleotide
  Target: ATXN1; (+) strand; PAM type: YTN; PAM sequence: CTT
ctctgtggaaattggcctga

SEQ ID NO: 272584 - DNA, 20 bp, Artificial Sequence
  Description of Artificial Sequence: Synthetic oligonucleotide
  Target: ATXN1; (+) strand; PAM type: YTN; PAM sequence: TTC
tctgtggaaattggcctgat

SEQ ID NO: 272585 - DNA, 20 bp, Artificial Sequence
  Description of Artificial Sequence: Synthetic oligonucleotide
  Target: ATXN1; (+) strand; PAM type: YTN; PAM sequence: CTC
tgtggaaattggcctgatct

SEQ ID NO: 272586 - DNA, 20 bp, Artificial Sequence
  Description of Artificial Sequence: Synthetic oligonucleotide
  Target: ATXN1; (+) strand; PAM type: YTN; PAM sequence: CTG
tggaaattggcctgatcttc

SEQ ID NO: 272587 - DNA, 20 bp, Artificial Sequence
  Description of Artificial Sequence: Synthetic oligonucleotide
  Target: ATXN1; (+) strand; PAM type: YTN; PAM sequence: TTG
gcctgatcttcccaatcaga

SEQ ID NO: 272588 - DNA, 20 bp, Artificial Sequence
  Description of Artificial Sequence: Synthetic oligonucleotide
  Target: ATXN1; (+) strand; PAM type: YTN; PAM sequence: CTG
atcttcccaatcagaagtga

SEQ ID NO: 272589 - DNA, 20 bp, Artificial Sequence
  Description of Artificial Sequence: Synthetic oligonucleotide
  Target: ATXN1; (+) strand; PAM type: YTN; PAM sequence: CTT
cccaatcagaagtgatcact

SEQ ID NO: 272590 - DNA, 20 bp, Artificial Sequence
  Description of Artificial Sequence: Synthetic oligonucleotide
  Target: ATXN1; (+) strand; PAM type: YTN; PAM sequence: TTC
ccaatcagaagtgatcactt

SEQ ID NO: 272591 - DNA, 20 bp, Artificial Sequence
  Description of Artificial Sequence: Synthetic oligonucleotide
  Target: ATXN1; (+) strand; PAM type: YTN; PAM sequence: CTT
ctatctttaaccctctgaag

SEQ ID NO: 272592 - DNA, 20 bp, Artificial Sequence
  Description of Artificial Sequence: Synthetic oligonucleotide
  Target: ATXN1; (+) strand; PAM type: YTN; PAM sequence: TTC
tatctttaaccctctgaagc

SEQ ID NO: 272593 - DNA, 20 bp, Artificial Sequence
  Description of Artificial Sequence: Synthetic oligonucleotide
  Target: ATXN1; (+) strand; PAM type: YTN; PAM sequence: CTA
tctttaaccctctgaagcgt

SEQ ID NO: 272594 - DNA, 20 bp, Artificial Sequence
  Description of Artificial Sequence: Synthetic oligonucleotide
  Target: ATXN1; (+) strand; PAM type: YTN; PAM sequence: CTT
taaccctctgaagcgtgttt

SEQ ID NO: 272595 - DNA, 20 bp, Artificial Sequence
  Description of Artificial Sequence: Synthetic oligonucleotide
  Target: ATXN1; (+) strand; PAM type: YTN; PAM sequence: TTT
aaccctctgaagcgtgtttt

SEQ ID NO: 272596 - DNA, 20 bp, Artificial Sequence
  Description of Artificial Sequence: Synthetic oligonucleotide
  Target: ATXN1; (+) strand; PAM type: YTN; PAM sequence: TTA
accctctgaagcgtgttttt

SEQ ID NO: 272597 - DNA, 20 bp, Artificial Sequence
  Description of Artificial Sequence: Synthetic oligonucleotide
  Target: ATXN1; (+) strand; PAM type: YTN; PAM sequence: CTC
tgaagcgtgtttttactttt

SEQ ID NO: 272598 - DNA, 20 bp, Artificial Sequence
  Description of Artificial Sequence: Synthetic oligonucleotide
  Target: ATXN1; (+) strand; PAM type: YTN; PAM sequence: CTG
aagcgtgtttttacttttat

SEQ ID NO: 272599 - DNA, 20 bp, Artificial Sequence
  Description of Artificial Sequence: Synthetic oligonucleotide
  Target: ATXN1; (+) strand; PAM type: YTN; PAM sequence: TTT
ttacttttatatacagttta

SEQ ID NO: 272600 - DNA, 20 bp, Artificial Sequence
  Description of Artificial Sequence: Synthetic oligonucleotide
  Target: ATXN1; (+) strand; PAM type: YTN; PAM sequence: TTT
tacttttatatacagtttat

SEQ ID NO: 272601 - DNA, 20 bp, Artificial Sequence
  Description of Artificial Sequence: Synthetic oligonucleotide
  Target: ATXN1; (+) strand; PAM type: YTN; PAM sequence: TTT
acttttatatacagtttatc

SEQ ID NO: 272602 - DNA, 20 bp, Artificial Sequence
  Description of Artificial Sequence: Synthetic oligonucleotide
  Target: ATXN1; (+) strand; PAM type: YTN; PAM sequence: TTA
cttttatatacagtttatca

SEQ ID NO: 272603 - DNA, 20 bp, Artificial Sequence
  Description of Artificial Sequence: Synthetic oligonucleotide
  Target: ATXN1; (+) strand; PAM type: YTN; PAM sequence: CTT
ttatatacagtttatcacct

SEQ ID NO: 272604 - DNA, 20 bp, Artificial Sequence
  Description of Artificial Sequence: Synthetic oligonucleotide
  Target: ATXN1; (+) strand; PAM type: YTN; PAM sequence: TTT
tatatacagtttatcacctt

SEQ ID NO: 272605 - DNA, 20 bp, Artificial Sequence
  Description of Artificial Sequence: Synthetic oligonucleotide
  Target: ATXN1; (+) strand; PAM type: YTN; PAM sequence: TTT
atatacagtttatcaccttc

SEQ ID NO: 272606 - DNA, 20 bp, Artificial Sequence
  Description of Artificial Sequence: Synthetic oligonucleotide
  Target: ATXN1; (+) strand; PAM type: YTN; PAM sequence: TTA
tatacagtttatcaccttct

SEQ ID NO: 272607 - DNA, 20 bp, Artificial Sequence
  Description of Artificial Sequence: Synthetic oligonucleotide
  Target: ATXN1; (+) strand; PAM type: YTN; PAM sequence: TTT
atcaccttctgtcttatgcc

SEQ ID NO: 272608 - DNA, 20 bp, Artificial Sequence
  Description of Artificial Sequence: Synthetic oligonucleotide
  Target: ATXN1; (+) strand; PAM type: YTN; PAM sequence: TTA
tcaccttctgtcttatgcca

SEQ ID NO: 272609 - DNA, 20 bp, Artificial Sequence
  Description of Artificial Sequence: Synthetic oligonucleotide
  Target: ATXN1; (+) strand; PAM type: YTN; PAM sequence: CTT
ctgtcttatgccatacttat

SEQ ID NO: 272610 - DNA, 20 bp, Artificial Sequence
  Description of Artificial Sequence: Synthetic oligonucleotide
  Target: ATXN1; (+) strand; PAM type: YTN; PAM sequence: TTC
tgtcttatgccatacttatt

SEQ ID NO: 272611 - DNA, 20 bp, Artificial Sequence
  Description of Artificial Sequence: Synthetic oligonucleotide
  Target: ATXN1; (+) strand; PAM type: YTN; PAM sequence: CTG
tcttatgccatacttatttg

SEQ ID NO: 272612 - DNA, 20 bp, Artificial Sequence
  Description of Artificial Sequence: Synthetic oligonucleotide
  Target: ATXN1; (+) strand; PAM type: YTN; PAM sequence: CTT
atgccatacttatttgtata

SEQ ID NO: 272613 - DNA, 20 bp, Artificial Sequence
  Description of Artificial Sequence: Synthetic oligonucleotide
  Target: ATXN1; (+) strand; PAM type: YTN; PAM sequence: TTA
tgccatacttatttgtatac

SEQ ID NO: 272614 - DNA, 20 bp, Artificial Sequence
  Description of Artificial Sequence: Synthetic oligonucleotide
  Target: ATXN1; (+) strand; PAM type: YTN; PAM sequence: CTT
atttgtatacttctcctagt

SEQ ID NO: 272615 - DNA, 20 bp, Artificial Sequence
  Description of Artificial Sequence: Synthetic oligonucleotide
  Target: ATXN1; (+) strand; PAM type: YTN; PAM sequence: TTA
tttgtatacttctcctagtt

SEQ ID NO: 272616 - DNA, 20 bp, Artificial Sequence
  Description of Artificial Sequence: Synthetic oligonucleotide
  Target: ATXN1; (+) strand; PAM type: YTN; PAM sequence: TTT
gtatacttctcctagttcct

SEQ ID NO: 272617 - DNA, 20 bp, Artificial Sequence
  Description of Artificial Sequence: Synthetic oligonucleotide
  Target: ATXN1; (+) strand; PAM type: YTN; PAM sequence: TTG
tatacttctcctagttcctt

SEQ ID NO: 272618 - DNA, 20 bp, Artificial Sequence
  Description of Artificial Sequence: Synthetic oligonucleotide
  Target: ATXN1; (+) strand; PAM type: YTN; PAM sequence: CTT
ctcctagttccttttcagat

SEQ ID NO: 272619 - DNA, 20 bp, Artificial Sequence
  Description of Artificial Sequence: Synthetic oligonucleotide
  Target: ATXN1; (+) strand; PAM type: YTN; PAM sequence: TTC
tcctagttccttttcagatc

SEQ ID NO: 272620 - DNA, 20 bp, Artificial Sequence
  Description of Artificial Sequence: Synthetic oligonucleotide
  Target: ATXN1; (+) strand; PAM type: YTN; PAM sequence: CTC
ctagttccttttcagatcat

SEQ ID NO: 272621 - DNA, 20 bp, Artificial Sequence
  Description of Artificial Sequence: Synthetic oligonucleotide
  Target: ATXN1; (+) strand; PAM type: YTN; PAM sequence: CTA
gttccttttcagatcatagg

SEQ ID NO: 272622 - DNA, 20 bp, Artificial Sequence
  Description of Artificial Sequence: Synthetic oligonucleotide
  Target: ATXN1; (+) strand; PAM type: YTN; PAM sequence: TTC
cttttcagatcataggattt

SEQ ID NO: 272623 - DNA, 20 bp, Artificial Sequence
  Description of Artificial Sequence: Synthetic oligonucleotide
  Target: ATXN1; (+) strand; PAM type: YTN; PAM sequence: CTT
ttcagatcataggatttttg

SEQ ID NO: 272624 - DNA, 20 bp, Artificial Sequence
  Description of Artificial Sequence: Synthetic oligonucleotide
  Target: ATXN1; (+) strand; PAM type: YTN; PAM sequence: TTT
tcagatcataggatttttga

SEQ ID NO: 272625 - DNA, 20 bp, Artificial Sequence
  Description of Artificial Sequence: Synthetic oligonucleotide
  Target: ATXN1; (+) strand; PAM type: YTN; PAM sequence: TTT
cagatcataggatttttgaa

SEQ ID NO: 272626 - DNA, 20 bp, Artificial Sequence
  Description of Artificial Sequence: Synthetic oligonucleotide
  Target: ATXN1; (+) strand; PAM type: YTN; PAM sequence: TTC
agatcataggatttttgaaa

SEQ ID NO: 272627 - DNA, 20 bp, Artificial Sequence
  Description of Artificial Sequence: Synthetic oligonucleotide
  Target: ATXN1; (+) strand; PAM type: YTN; PAM sequence: TTT
ttgaaaatcaaatatggctt

SEQ ID NO: 272628 - DNA, 20 bp, Artificial Sequence
  Description of Artificial Sequence: Synthetic oligonucleotide
  Target: ATXN1; (+) strand; PAM type: YTN; PAM sequence: TTT
tgaaaatcaaatatggcttc

SEQ ID NO: 272629 - DNA, 20 bp, Artificial Sequence
  Description of Artificial Sequence: Synthetic oligonucleotide
  Target: ATXN1; (+) strand; PAM type: YTN; PAM sequence: TTT
gaaaatcaaatatggcttct

SEQ ID NO: 272630 - DNA, 20 bp, Artificial Sequence
  Description of Artificial Sequence: Synthetic oligonucleotide
  Target: ATXN1; (+) strand; PAM type: YTN; PAM sequence: TTG
aaaatcaaatatggcttctg

SEQ ID NO: 272631 - DNA, 20 bp, Artificial Sequence
  Description of Artificial Sequence: Synthetic oligonucleotide
  Target: ATXN1; (+) strand; PAM type: YTN; PAM sequence: CTT
ctgtcttctgcatcacctag

SEQ ID NO: 272632 - DNA, 20 bp, Artificial Sequence
  Description of Artificial Sequence: Synthetic oligonucleotide
  Target: ATXN1; (+) strand; PAM type: YTN; PAM sequence: TTC
tgtcttctgcatcacctagc

SEQ ID NO: 272633 - DNA, 20 bp, Artificial Sequence
  Description of Artificial Sequence: Synthetic oligonucleotide
  Target: ATXN1; (+) strand; PAM type: YTN; PAM sequence: CTG
tcttctgcatcacctagcaa

SEQ ID NO: 272634 - DNA, 20 bp, Artificial Sequence
  Description of Artificial Sequence: Synthetic oligonucleotide
  Target: ATXN1; (+) strand; PAM type: YTN; PAM sequence: CTT
ctgcatcacctagcaacttg

SEQ ID NO: 272635 - DNA, 20 bp, Artificial Sequence
  Description of Artificial Sequence: Synthetic oligonucleotide
  Target: ATXN1; (+) strand; PAM type: YTN; PAM sequence: TTC
tgcatcacctagcaacttgt

SEQ ID NO: 272636 - DNA, 20 bp, Artificial Sequence
  Description of Artificial Sequence: Synthetic oligonucleotide
  Target: ATXN1; (+) strand; PAM type: YTN; PAM sequence: CTG
catcacctagcaacttgttc

SEQ ID NO: 272637 - DNA, 20 bp, Artificial Sequence
  Description of Artificial Sequence: Synthetic oligonucleotide
  Target: ATXN1; (+) strand; PAM type: YTN; PAM sequence: CTA
gcaacttgttcctcaaagtg

SEQ ID NO: 272638 - DNA, 20 bp, Artificial Sequence
  Description of Artificial Sequence: Synthetic oligonucleotide
  Target: ATXN1; (+) strand; PAM type: YTN; PAM sequence: CTT
gttcctcaaagtgtcttcct

SEQ ID NO: 272639 - DNA, 20 bp, Artificial Sequence
  Description of Artificial Sequence: Synthetic oligonucleotide
  Target: ATXN1; (+) strand; PAM type: YTN; PAM sequence: TTG
ttcctcaaagtgtcttcctg

SEQ ID NO: 272640 - DNA, 20 bp, Artificial Sequence
  Description of Artificial Sequence: Synthetic oligonucleotide
  Target: ATXN1; (+) strand; PAM type: YTN; PAM sequence: TTC
ctcaaagtgtcttcctggga

SEQ ID NO: 272641 - DNA, 20 bp, Artificial Sequence
  Description of Artificial Sequence: Synthetic oligonucleotide
  Target: ATXN1; (+) strand; PAM type: YTN; PAM sequence: CTC
aaagtgtcttcctgggacca

SEQ ID NO: 272642 - DNA, 20 bp, Artificial Sequence
  Description of Artificial Sequence: Synthetic oligonucleotide
  Target: ATXN1; (+) strand; PAM type: YTN; PAM sequence: CTT
cctgggaccagcagcatctc

SEQ ID NO: 272643 - DNA, 20 bp, Artificial Sequence
  Description of Artificial Sequence: Synthetic oligonucleotide
  Target: ATXN1; (+) strand; PAM type: YTN; PAM sequence: TTC
ctgggaccagcagcatctca

SEQ ID NO: 272644 - DNA, 20 bp, Artificial Sequence
  Description of Artificial Sequence: Synthetic oligonucleotide
  Target: ATXN1; (+) strand; PAM type: YTN; PAM sequence: CTG
ggaccagcagcatctcaggc

SEQ ID NO: 272645 - DNA, 20 bp, Artificial Sequence
  Description of Artificial Sequence: Synthetic oligonucleotide
  Target: ATXN1; (+) strand; PAM type: YTN; PAM sequence: CTC
aggccctatctcagaccgac

SEQ ID NO: 272646 - DNA, 20 bp, Artificial Sequence
  Description of Artificial Sequence: Synthetic oligonucleotide
  Target: ATXN1; (+) strand; PAM type: YTN; PAM sequence: CTA
tctcagaccgacaggatcag

SEQ ID NO: 272647 - DNA, 20 bp, Artificial Sequence
  Description of Artificial Sequence: Synthetic oligonucleotide
  Target: ATXN1; (+) strand; PAM type: YTN; PAM sequence: CTC
agaccgacaggatcagaacc

SEQ ID NO: 272648 - DNA, 20 bp, Artificial Sequence
  Description of Artificial Sequence: Synthetic oligonucleotide
  Target: ATXN1; (+) strand; PAM type: YTN; PAM sequence: CTG
cattttaacaatattcccag

SEQ ID NO: 272649 - DNA, 20 bp, Artificial Sequence
  Description of Artificial Sequence: Synthetic oligonucleotide
  Target: ATXN1; (+) strand; PAM type: YTN; PAM sequence: TTT
taacaatattcccaggggat

SEQ ID NO: 272650 - DNA, 20 bp, Artificial Sequence
  Description of Artificial Sequence: Synthetic oligonucleotide
  Target: ATXN1; (+) strand; PAM type: YTN; PAM sequence: TTT
aacaatattcccaggggatt

SEQ ID NO: 272651 - DNA, 20 bp, Artificial Sequence
  Description of Artificial Sequence: Synthetic oligonucleotide
  Target: ATXN1; (+) strand; PAM type: YTN; PAM sequence: TTA
acaatattcccaggggattc

SEQ ID NO: 272652 - DNA, 20 bp, Artificial Sequence
  Description of Artificial Sequence: Synthetic oligonucleotide
  Target: ATXN1; (+) strand; PAM type: YTN; PAM sequence: TTC
ccaggggattccgacccact

SEQ ID NO: 272653 - DNA, 20 bp, Artificial Sequence
  Description of Artificial Sequence: Synthetic oligonucleotide
  Target: ATXN1; (+) strand; PAM type: YTN; PAM sequence: TTC
cgacccacttgatcaagctc

SEQ ID NO: 272654 - DNA, 20 bp, Artificial Sequence
  Description of Artificial Sequence: Synthetic oligonucleotide
  Target: ATXN1; (+) strand; PAM type: YTN; PAM sequence: CTT
gatcaagctcacagcagcca

SEQ ID NO: 272655 - DNA, 20 bp, Artificial Sequence
  Description of Artificial Sequence: Synthetic oligonucleotide
  Target: ATXN1; (+) strand; PAM type: YTN; PAM sequence: TTG
atcaagctcacagcagccac

SEQ ID NO: 272656 - DNA, 20 bp, Artificial Sequence
  Description of Artificial Sequence: Synthetic oligonucleotide
  Target: ATXN1; (+) strand; PAM type: YTN; PAM sequence: CTC
acagcagccactcatctcat

SEQ ID NO: 272657 - DNA, 20 bp, Artificial Sequence
  Description of Artificial Sequence: Synthetic oligonucleotide
  Target: ATXN1; (+) strand; PAM type: YTN; PAM sequence: CTC
atctcatacttgactggttg

SEQ ID NO: 272658 - DNA, 20 bp, Artificial Sequence
  Description of Artificial Sequence: Synthetic oligonucleotide
  Target: ATXN1; (+) strand; PAM type: YTN; PAM sequence: CTC
atacttgactggttgaactg

SEQ ID NO: 272659 - DNA, 20 bp, Artificial Sequence
  Description of Artificial Sequence: Synthetic oligonucleotide
  Target: ATXN1; (+) strand; PAM type: YTN; PAM sequence: CTT
gactggttgaactgactagg

SEQ ID NO: 272660 - DNA, 20 bp, Artificial Sequence
  Description of Artificial Sequence: Synthetic oligonucleotide
  Target: ATXN1; (+) strand; PAM type: YTN; PAM sequence: TTG
actggttgaactgactagga

SEQ ID NO: 272661 - DNA, 20 bp, Artificial Sequence
  Description of Artificial Sequence: Synthetic oligonucleotide
  Target: ATXN1; (+) strand; PAM type: YTN; PAM sequence: CTG
gttgaactgactaggaaaac

SEQ ID NO: 272662 - DNA, 20 bp, Artificial Sequence
  Description of Artificial Sequence: Synthetic oligonucleotide
  Target: ATXN1; (+) strand; PAM type: YTN; PAM sequence: TTG
aactgactaggaaaacaaag

SEQ ID NO: 272663 - DNA, 20 bp, Artificial Sequence
  Description of Artificial Sequence: Synthetic oligonucleotide
  Target: ATXN1; (+) strand; PAM type: YTN; PAM sequence: CTG
actaggaaaacaaagtagga

SEQ ID NO: 272664 - DNA, 20 bp, Artificial Sequence
  Description of Artificial Sequence: Synthetic oligonucleotide
  Target: ATXN1; (+) strand; PAM type: YTN; PAM sequence: CTA
ggaaaacaaagtaggagaaa

SEQ ID NO: 272665 - DNA, 20 bp, Artificial Sequence
  Description of Artificial Sequence: Synthetic oligonucleotide
  Target: ATXN1; (+) strand; PAM type: YTN; PAM sequence: CTT
acataactcattcaaagatc

SEQ ID NO: 272666 - DNA, 20 bp, Artificial Sequence
  Description of Artificial Sequence: Synthetic oligonucleotide
  Target: ATXN1; (+) strand; PAM type: YTN; PAM sequence: TTA
cataactcattcaaagatca

SEQ ID NO: 272667 - DNA, 20 bp, Artificial Sequence
  Description of Artificial Sequence: Synthetic oligonucleotide
  Target: ATXN1; (+) strand; PAM type: YTN; PAM sequence: CTC
attcaaagatcattgtgagt

SEQ ID NO: 272668 - DNA, 20 bp, Artificial Sequence
  Description of Artificial Sequence: Synthetic oligonucleotide
  Target: ATXN1; (+) strand; PAM type: YTN; PAM sequence: TTC
aaagatcattgtgagtgact

SEQ ID NO: 272669 - DNA, 20 bp, Artificial Sequence
  Description of Artificial Sequence: Synthetic oligonucleotide
  Target: ATXN1; (+) strand; PAM type: YTN; PAM sequence: TTG
tgagtgactaatgctttacc

SEQ ID NO: 272670 - DNA, 20 bp, Artificial Sequence
  Description of Artificial Sequence: Synthetic oligonucleotide
  Target: ATXN1; (+) strand; PAM type: YTN; PAM sequence: CTA
atgctttacctatataaaac

SEQ ID NO: 272671 - DNA, 20 bp, Artificial Sequence
  Description of Artificial Sequence: Synthetic oligonucleotide
  Target: ATXN1; (+) strand; PAM type: YTN; PAM sequence: CTT
tacctatataaaactagggc

SEQ ID NO: 272672 - DNA, 20 bp, Artificial Sequence
  Description of Artificial Sequence: Synthetic oligonucleotide
  Target: ATXN1; (+) strand; PAM type: YTN; PAM sequence: TTT
acctatataaaactagggcc

SEQ ID NO: 272673 - DNA, 20 bp, Artificial Sequence
  Description of Artificial Sequence: Synthetic oligonucleotide
  Target: ATXN1; (+) strand; PAM type: YTN; PAM sequence: TTA
cctatataaaactagggcca

SEQ ID NO: 272674 - DNA, 20 bp, Artificial Sequence
  Description of Artificial Sequence: Synthetic oligonucleotide
  Target: ATXN1; (+) strand; PAM type: YTN; PAM sequence: CTA
tataaaactagggccaggca

SEQ ID NO: 272675 - DNA, 20 bp, Artificial Sequence
  Description of Artificial Sequence: Synthetic oligonucleotide
  Target: ATXN1; (+) strand; PAM type: YTN; PAM sequence: CTA
gggccaggcacagtggctta

SEQ ID NO: 272676 - DNA, 20 bp, Artificial Sequence
  Description of Artificial Sequence: Synthetic oligonucleotide
  Target: ATXN1; (+) strand; PAM type: YTN; PAM sequence: CTT
atacctagcactgtgggagg

SEQ ID NO: 272677 - DNA, 20 bp, Artificial Sequence
  Description of Artificial Sequence: Synthetic oligonucleotide
  Target: ATXN1; (+) strand; PAM type: YTN; PAM sequence: TTA
tacctagcactgtgggaggc

SEQ ID NO: 272678 - DNA, 20 bp, Artificial Sequence
  Description of Artificial Sequence: Synthetic oligonucleotide
  Target: ATXN1; (+) strand; PAM type: YTN; PAM sequence: CTA
gcactgtgggaggcagaggt

SEQ ID NO: 272679 - DNA, 20 bp, Artificial Sequence
  Description of Artificial Sequence: Synthetic oligonucleotide
  Target: ATXN1; (+) strand; PAM type: YTN; PAM sequence: CTG
tgggaggcagaggtgggaga

SEQ ID NO: 272680 - DNA, 20 bp, Artificial Sequence
  Description of Artificial Sequence: Synthetic oligonucleotide
  Target: ATXN1; (+) strand; PAM type: YTN; PAM sequence: CTT
gagtccaggagttcaagacc

SEQ ID NO: 272681 - DNA, 20 bp, Artificial Sequence
  Description of Artificial Sequence: Synthetic oligonucleotide
  Target: ATXN1; (+) strand; PAM type: YTN; PAM sequence: TTG
agtccaggagttcaagacca

SEQ ID NO: 272682 - DNA, 20 bp, Artificial Sequence
  Description of Artificial Sequence: Synthetic oligonucleotide
  Target: ATXN1; (+) strand; PAM type: YTN; PAM sequence: TTC
aagaccaaccagaggagcac

SEQ ID NO: 272683 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatacaaaaatta

SEQ ID NO: 272684 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatacaaaaattagc

SEQ ID NO: 272685 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcacaca

SEQ ID NO: 272686 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcacacacctg

SEQ ID NO: 272687 - DNA, 20 bp, Artificial Sequence
  Description of Artificial Sequence: Synthetic oligonucleotide
  Target: ATXN1; (+) strand; PAM type: YTN; PAM sequence: CTG
tagtcccaagctacttggga

SEQ ID NO: 272688 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctaaggtggga

SEQ ID NO: 272689 - DNA, 20 bp, Artificial Sequence
  Description of Artificial Sequence: Synthetic oligonucleotide
  Target: ATXN1; (+) strand; PAM type: YTN; PAM sequence: CTT
gggaggctaaggtgggagga

SEQ ID NO: 272690 - DNA, 20 bp, Artificial Sequence
  Description of Artificial Sequence: Synthetic oligonucleotide
  Target: ATXN1; (+) strand; PAM type: YTN; PAM sequence: TTG
ggaggctaaggtgggaggac

SEQ ID NO: 272691 - DNA, 20 bp, Artificial Sequence
  Description of Artificial Sequence: Synthetic oligonucleotide
  Target: ATXN1; (+) strand; PAM type: YTN; PAM sequence: CTA
aggtgggaggactgcttgaa

SEQ ID NO: 272692 - DNA, 20 bp, Artificial Sequence
  Description of Artificial Sequence: Synthetic oligonucleotide
  Target: ATXN1; (+) strand; PAM type: YTN; PAM sequence: CTG
cttgaaccccaggaggttga

SEQ ID NO: 272693 - DNA, 20 bp, Artificial Sequence
  Description of Artificial Sequence: Synthetic oligonucleotide
  Target: ATXN1; (+) strand; PAM type: YTN; PAM sequence: CTT
gaaccccaggaggttgaggc

SEQ ID NO: 272694 - DNA, 20 bp, Artificial Sequence
  Description of Artificial Sequence: Synthetic oligonucleotide
  Target: ATXN1; (+) strand; PAM type: YTN; PAM sequence: TTG
aaccccaggaggttgaggct

SEQ ID NO: 272695 - DNA, 20 bp, Artificial Sequence
  Description of Artificial Sequence: Synthetic oligonucleotide
  Target: ATXN1; (+) strand; PAM type: YTN; PAM sequence: TTG
aggctgcaatgagctgtgag

SEQ ID NO: 272696 - DNA, 20 bp, Artificial Sequence
  Description of Artificial Sequence: Synthetic oligonucleotide
  Target: ATXN1; (+) strand; PAM type: YTN; PAM sequence: CTG
caatgagctgtgagtgcacc

SEQ ID NO: 272697 - DNA, 20 bp, Artificial Sequence
  Description of Artificial Sequence: Synthetic oligonucleotide
  Target: ATXN1; (+) strand; PAM type: YTN; PAM sequence: CTG
tgagtgcaccactgcactcc

SEQ ID NO: 272698 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 272699 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagtga

SEQ ID NO: 272700 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtgaggccctg

SEQ ID NO: 272701 - DNA, 20 bp, Artificial Sequence
  Description of Artificial Sequence: Synthetic oligonucleotide
  Target: ATXN1; (+) strand; PAM type: YTN; PAM sequence: CTG
tctcataaataaataaataa

SEQ ID NO: 272702 - DNA, 20 bp, Artificial Sequence
  Description of Artificial Sequence: Synthetic oligonucleotide
  Target: ATXN1; (+) strand; PAM type: YTN; PAM sequence: CTC
ataaataaataaataaatag

SEQ ID NO: 272703 - DNA, 20 bp, Artificial Sequence
  Description of Artificial Sequence: Synthetic oligonucleotide
  Target: ATXN1; (+) strand; PAM type: YTN; PAM sequence: TTA
attttaccaaccttctgagg

SEQ ID NO: 272704 - DNA, 20 bp, Artificial Sequence
  Description of Artificial Sequence: Synthetic oligonucleotide
  Target: ATXN1; (+) strand; PAM type: YTN; PAM sequence: TTT
taccaaccttctgagggagg

SEQ ID NO: 272705 - DNA, 20 bp, Artificial Sequence
  Description of Artificial Sequence: Synthetic oligonucleotide
  Target: ATXN1; (+) strand; PAM type: YTN; PAM sequence: TTT
accaaccttctgagggagga

SEQ ID NO: 272706 - DNA, 20 bp, Artificial Sequence
  Description of Artificial Sequence: Synthetic oligonucleotide
  Target: ATXN1; (+) strand; PAM type: YTN; PAM sequence: TTA
ccaaccttctgagggaggaa

SEQ ID NO: 272707 - DNA, 20 bp, Artificial Sequence
  Description of Artificial Sequence: Synthetic oligonucleotide
  Target: ATXN1; (+) strand; PAM type: YTN; PAM sequence: CTT
ctgagggaggaagacaaatg

SEQ ID NO: 272708 - DNA, 20 bp, Artificial Sequence
  Description of Artificial Sequence: Synthetic oligonucleotide
  Target: ATXN1; (+) strand; PAM type: YTN; PAM sequence: TTC
tgagggaggaagacaaatgt

SEQ ID NO: 272709 - DNA, 20 bp, Artificial Sequence
  Description of Artificial Sequence: Synthetic oligonucleotide
  Target: ATXN1; (+) strand; PAM type: YTN; PAM sequence: CTG
agggaggaagacaaatgtca

SEQ ID NO: 272710 - DNA, 20 bp, Artificial Sequence
  Description of Artificial Sequence: Synthetic oligonucleotide
  Target: ATXN1; (+) strand; PAM type: YTN; PAM sequence: CTT
ggccaaccaaatagatctgg

SEQ ID NO: 272711 - DNA, 20 bp, Artificial Sequence
  Description of Artificial Sequence: Synthetic oligonucleotide
  Target: ATXN1; (+) strand; PAM type: YTN; PAM sequence: TTG
gccaaccaaatagatctggg

SEQ ID NO: 272712 - DNA, 20 bp, Artificial Sequence
  Description of Artificial Sequence: Synthetic oligonucleotide
  Target: ATXN1; (+) strand; PAM type: YTN; PAM sequence: CTG
ggaagattttgtctttttat

SEQ ID NO: 272713 - DNA, 20 bp, Artificial Sequence
  Description of Artificial Sequence: Synthetic oligonucleotide
  Target: ATXN1; (+) strand; PAM type: YTN; PAM sequence: TTT
tgtctttttataaagcttgt

SEQ ID NO: 272714 - DNA, 20 bp, Artificial Sequence
  Description of Artificial Sequence: Synthetic oligonucleotide
  Target: ATXN1; (+) strand; PAM type: YTN; PAM sequence: TTT
gtctttttataaagcttgtc

SEQ ID NO: 272715 - DNA, 20 bp, Artificial Sequence
  Description of Artificial Sequence: Synthetic oligonucleotide
  Target: ATXN1; (+) strand; PAM type: YTN; PAM sequence: TTG
tctttttataaagcttgtct

SEQ ID NO: 272716 - DNA, 20 bp, Artificial Sequence
  Description of Artificial Sequence: Synthetic oligonucleotide
  Target: ATXN1; (+) strand; PAM type: YTN; PAM sequence: CTT
tttataaagcttgtctattt

SEQ ID NO: 272717 - DNA, 20 bp, Artificial Sequence
  Description of Artificial Sequence: Synthetic oligonucleotide
  Target: ATXN1; (+) strand; PAM type: YTN; PAM sequence: TTT
ttataaagcttgtctattta

SEQ ID NO: 272718 - DNA, 20 bp, Artificial Sequence
  Description of Artificial Sequence: Synthetic oligonucleotide
  Target: ATXN1; (+) strand; PAM type: YTN; PAM sequence: TTT
tataaagcttgtctatttaa

SEQ ID NO: 272719 - DNA, 20 bp, Artificial Sequence
  Description of Artificial Sequence: Synthetic oligonucleotide
  Target: ATXN1; (+) strand; PAM type: YTN; PAM sequence: TTT
ataaagcttgtctatttaag

SEQ ID NO: 272720 - DNA, 20 bp, Artificial Sequence
  Description of Artificial Sequence: Synthetic oligonucleotide
  Target: ATXN1; (+) strand; PAM type: YTN; PAM sequence: TTA
taaagcttgtctatttaagg

SEQ ID NO: 272721 - DNA, 20 bp, Artificial Sequence
  Description of Artificial Sequence: Synthetic oligonucleotide
  Target: ATXN1; (+) strand; PAM type: YTN; PAM sequence: CTT
gtctatttaagggtgggaag

SEQ ID NO: 272722 - DNA, 20 bp, Artificial Sequence
  Description of Artificial Sequence: Synthetic oligonucleotide
  Target: ATXN1; (+) strand; PAM type: YTN; PAM sequence: TTG
tctatttaagggtgggaagt

SEQ ID NO: 272723 - DNA, 20 bp, Artificial Sequence
  Description of Artificial Sequence: Synthetic oligonucleotide
  Target: ATXN1; (+) strand; PAM type: YTN; PAM sequence: CTA
tttaagggtgggaagtcagc

SEQ ID NO: 272724 - DNA, 20 bp, Artificial Sequence
  Description of Artificial Sequence: Synthetic oligonucleotide
  Target: ATXN1; (+) strand; PAM type: YTN; PAM sequence: TTT
aagggtgggaagtcagcaga

SEQ ID NO: 272725 - DNA, 20 bp, Artificial Sequence
  Description of Artificial Sequence: Synthetic oligonucleotide
  Target: ATXN1; (+) strand; PAM type: YTN; PAM sequence: TTA
agggtgggaagtcagcagaa

SEQ ID NO: 272726 - DNA, 20 bp, Artificial Sequence
  Description of Artificial Sequence: Synthetic oligonucleotide
  Target: ATXN1; (+) strand; PAM type: YTN; PAM sequence: CTG
cttgccaatagtacacttct

SEQ ID NO: 272727 - DNA, 20 bp, Artificial Sequence
  Description of Artificial Sequence: Synthetic oligonucleotide
  Target: ATXN1; (+) strand; PAM type: YTN; PAM sequence: CTT
gccaatagtacacttctccc

SEQ ID NO: 272728 - DNA, 20 bp, Artificial Sequence
  Description of Artificial Sequence: Synthetic oligonucleotide
  Target: ATXN1; (+) strand; PAM type: YTN; PAM sequence: TTG
ccaatagtacacttctccca

SEQ ID NO: 272729 - DNA, 20 bp, Artificial Sequence
  Description of Artificial Sequence: Synthetic oligonucleotide
  Target: ATXN1; (+) strand; PAM type: YTN; PAM sequence: CTT
ctcccactttaatgaaatcg

SEQ ID NO: 272730 - DNA, 20 bp, Artificial Sequence
  Description of Artificial Sequence: Synthetic oligonucleotide
  Target: ATXN1; (+) strand; PAM type: YTN; PAM sequence: TTC
tcccactttaatgaaatcgg

SEQ ID NO: 272731 - DNA, 20 bp, Artificial Sequence
  Description of Artificial Sequence: Synthetic oligonucleotide
  Target: ATXN1; (+) strand; PAM type: YTN; PAM sequence: CTC
ccactttaatgaaatcggtt

SEQ ID NO: 272732 - DNA, 20 bp, Artificial Sequence
  Description of Artificial Sequence: Synthetic oligonucleotide
  Target: ATXN1; (+) strand; PAM type: YTN; PAM sequence: CTT
taatgaaatcggttggctgt

SEQ ID NO: 272733 - DNA, 20 bp, Artificial Sequence
  Description of Artificial Sequence: Synthetic oligonucleotide
  Target: ATXN1; (+) strand; PAM type: YTN; PAM sequence: TTT
aatgaaatcggttggctgtg

SEQ ID NO: 272734 - DNA, 20 bp, Artificial Sequence
  Description of Artificial Sequence: Synthetic oligonucleotide
  Target: ATXN1; (+) strand; PAM type: YTN; PAM sequence: TTA
atgaaatcggttggctgtga

SEQ ID NO: 272735 - DNA, 20 bp, Artificial Sequence
  Description of Artificial Sequence: Synthetic oligonucleotide
  Target: ATXN1; (+) strand; PAM type: YTN; PAM sequence: TTG
gctgtgaaaatatgtgcatc

SEQ ID NO: 272736 - DNA, 20 bp, Artificial Sequence
  Description of Artificial Sequence: Synthetic oligonucleotide
  Target: ATXN1; (+) strand; PAM type: YTN; PAM sequence: CTG
tgaaaatatgtgcatcaaag

SEQ ID NO: 272737 - DNA, 20 bp, Artificial Sequence
  Description of Artificial Sequence: Synthetic oligonucleotide
  Target: ATXN1; (+) strand; PAM type: YTN; PAM sequence: TTT
taaagagttttctgtcacat

SEQ ID NO: 272738 - DNA, 20 bp, Artificial Sequence
  Description of Artificial Sequence: Synthetic oligonucleotide
  Target: ATXN1; (+) strand; PAM type: YTN; PAM sequence: TTT
aaagagttttctgtcacatc

SEQ ID NO: 272739 - DNA, 20 bp, Artificial Sequence
  Description of Artificial Sequence: Synthetic oligonucleotide
  Target: ATXN1; (+) strand; PAM type: YTN; PAM sequence: TTA
aagagttttctgtcacatcc

SEQ ID NO: 272740 - DNA, 20 bp, Artificial Sequence
  Description of Artificial Sequence: Synthetic oligonucleotide
  Target: ATXN1; (+) strand; PAM type: YTN; PAM sequence: TTT
tctgtcacatccagtagact

SEQ ID NO: 272741 - DNA, 20 bp, Artificial Sequence
  Description of Artificial Sequence: Synthetic oligonucleotide
  Target: ATXN1; (+) strand; PAM type: YTN; PAM sequence: TTT
ctgtcacatccagtagactt

SEQ ID NO: 272742 - DNA, 20 bp, Artificial Sequence
  Description of Artificial Sequence: Synthetic oligonucleotide
  Target: ATXN1; (+) strand; PAM type: YTN; PAM sequence: TTC
tgtcacatccagtagactta

SEQ ID NO: 272743 - DNA, 20 bp, Artificial Sequence
  Description of Artificial Sequence: Synthetic oligonucleotide
  Target: ATXN1; (+) strand; PAM type: YTN; PAM sequence: CTG
tcacatccagtagacttata

SEQ ID NO: 272744 - DNA, 20 bp, Artificial Sequence
  Description of Artificial Sequence: Synthetic oligonucleotide
  Target: ATXN1; (+) strand; PAM type: YTN; PAM sequence: CTT
ataatacagattgctacaga

SEQ ID NO: 272745 - DNA, 20 bp, Artificial Sequence
  Description of Artificial Sequence: Synthetic oligonucleotide
  Target: ATXN1; (+) strand; PAM type: YTN; PAM sequence: TTA
taatacagattgctacagat

SEQ ID NO: 272746 - DNA, 20 bp, Artificial Sequence
  Description of Artificial Sequence: Synthetic oligonucleotide
  Target: ATXN1; (+) strand; PAM type: YTN; PAM sequence: TTG
ctacagatggaagatttatc

SEQ ID NO: 272747 - DNA, 20 bp, Artificial Sequence
  Description of Artificial Sequence: Synthetic oligonucleotide
  Target: ATXN1; (+) strand; PAM type: YTN; PAM sequence: CTA
cagatggaagatttatcctc

SEQ ID NO: 272748 - DNA, 20 bp, Artificial Sequence
  Description of Artificial Sequence: Synthetic oligonucleotide
  Target: ATXN1; (+) strand; PAM type: YTN; PAM sequence: TTT
atcctcacttgatgtagcaa

SEQ ID NO: 272749 - DNA, 20 bp, Artificial Sequence
  Description of Artificial Sequence: Synthetic oligonucleotide
  Target: ATXN1; (+) strand; PAM type: YTN; PAM sequence: TTA
tcctcacttgatgtagcaac

SEQ ID NO: 272750 - DNA, 20 bp, Artificial Sequence
  Description of Artificial Sequence: Synthetic oligonucleotide
  Target: ATXN1; (+) strand; PAM type: YTN; PAM sequence: CTC
acttgatgtagcaacagcac

SEQ ID NO: 272751 - DNA, 20 bp, Artificial Sequence
  Description of Artificial Sequence: Synthetic oligonucleotide
  Target: ATXN1; (+) strand; PAM type: YTN; PAM sequence: CTT
gatgtagcaacagcactacg

SEQ ID NO: 272752 - DNA, 20 bp, Artificial Sequence
  Description of Artificial Sequence: Synthetic oligonucleotide
  Target: ATXN1; (+) strand; PAM type: YTN; PAM sequence: TTG
atgtagcaacagcactacgt

SEQ ID NO: 272753 - DNA, 20 bp, Artificial Sequence
  Description of Artificial Sequence: Synthetic oligonucleotide
  Target: ATXN1; (+) strand; PAM type: YTN; PAM sequence: CTA
cgttctttgaactgtaacaa

SEQ ID NO: 272754 - DNA, 20 bp, Artificial Sequence
  Description of Artificial Sequence: Synthetic oligonucleotide
  Target: ATXN1; (+) strand; PAM type: YTN; PAM sequence: TTC
tttgaactgtaacaaagctt

SEQ ID NO: 272755 - DNA, 20 bp, Artificial Sequence
  Description of Artificial Sequence: Synthetic oligonucleotide
  Target: ATXN1; (+) strand; PAM type: YTN; PAM sequence: CTT
tgaactgtaacaaagctttt

SEQ ID NO: 272756 - DNA, 20 bp, Artificial Sequence
  Description of Artificial Sequence: Synthetic oligonucleotide
  Target: ATXN1; (+) strand; PAM type: YTN; PAM sequence: TTT
gaactgtaacaaagcttttg

SEQ ID NO: 272757 - DNA, 20 bp, Artificial Sequence
  Description of Artificial Sequence: Synthetic oligonucleotide
  Target: ATXN1; (+) strand; PAM type: YTN; PAM sequence: TTG
aactgtaacaaagcttttga

SEQ ID NO: 272758 - DNA, 20 bp, Artificial Sequence
  Description of Artificial Sequence: Synthetic oligonucleotide
  Target: ATXN1; (+) strand; PAM type: YTN; PAM sequence: CTG
taacaaagcttttgattttt

SEQ ID NO: 272759 - DNA, 20 bp, Artificial Sequence
  Description of Artificial Sequence: Synthetic oligonucleotide
  Target: ATXN1; (+) strand; PAM type: YTN; PAM sequence: CTT
ttgattttttttttcccacg

SEQ ID NO: 272760 - DNA, 20 bp, Artificial Sequence
  Description of Artificial Sequence: Synthetic oligonucleotide
  Target: ATXN1; (+) strand; PAM type: YTN; PAM sequence: TTT
tgattttttttttcccacgt

SEQ ID NO: 272761 - DNA, 20 bp, Artificial Sequence
  Description of Artificial Sequence: Synthetic oligonucleotide
  Target: ATXN1; (+) strand; PAM type: YTN; PAM sequence: TTT
gattttttttttcccacgtg

SEQ ID NO: 272762 - DNA, 20 bp, Artificial Sequence
  Description of Artificial Sequence: Synthetic oligonucleotide
  Target: ATXN1; (+) strand; PAM type: YTN; PAM sequence: TTG
attttttttttcccacgtgg

SEQ ID NO: 272763 - DNA, 20 bp, Artificial Sequence
  Description of Artificial Sequence: Synthetic oligonucleotide
  Target: ATXN1; (+) strand; PAM type: YTN; PAM sequence: TTT
tttttttcccacgtggtaga

SEQ ID NO: 272764 - DNA, 20 bp, Artificial Sequence
  Description of Artificial Sequence: Synthetic oligonucleotide
  Target: ATXN1; (+) strand; PAM type: YTN; PAM sequence: TTT
ttttttcccacgtggtagat

SEQ ID NO: 272765 - DNA, 20 bp, Artificial Sequence
  Description of Artificial Sequence: Synthetic oligonucleotide
  Target: ATXN1; (+) strand; PAM type: YTN; PAM sequence: TTT
tttttcccacgtggtagatg

SEQ ID NO: 272766 - DNA, 20 bp, Artificial Sequence
  Description of Artificial Sequence: Synthetic oligonucleotide
  Target: ATXN1; (+) strand; PAM type: YTN; PAM sequence: TTT
ttttcccacgtggtagatga

SEQ ID NO: 272767 - DNA, 20 bp, Artificial Sequence
  Description of Artificial Sequence: Synthetic oligonucleotide
  Target: ATXN1; (+) strand; PAM type: YTN; PAM sequence: TTT
tttcccacgtggtagatgaa

SEQ ID NO: 272768 - DNA, 20 bp, Artificial Sequence
  Description of Artificial Sequence: Synthetic oligonucleotide
  Target: ATXN1; (+) strand; PAM type: YTN; PAM sequence: TTT
ttcccacgtggtagatgaat

SEQ ID NO: 272769 - DNA, 20 bp, Artificial Sequence
  Description of Artificial Sequence: Synthetic oligonucleotide
  Target: ATXN1; (+) strand; PAM type: YTN; PAM sequence: TTT
tcccacgtggtagatgaatc

SEQ ID NO: 272770 - DNA, 20 bp, Artificial Sequence
  Description of Artificial Sequence: Synthetic oligonucleotide
  Target: ATXN1; (+) strand; PAM type: YTN; PAM sequence: TTT
cccacgtggtagatgaatct

SEQ ID NO: 272771 - DNA, 20 bp, Artificial Sequence
  Description of Artificial Sequence: Synthetic oligonucleotide
  Target: ATXN1; (+) strand; PAM type: YTN; PAM sequence: TTC
ccacgtggtagatgaatctt

SEQ ID NO: 272772 - DNA, 20 bp, Artificial Sequence
  Description of Artificial Sequence: Synthetic oligonucleotide
  Target: ATXN1; (+) strand; PAM type: YTN; PAM sequence: CTT
agtaagaaaatacagacttg

SEQ ID NO: 272773 - DNA, 20 bp, Artificial Sequence
  Description of Artificial Sequence: Synthetic oligonucleotide
  Target: ATXN1; (+) strand; PAM type: YTN; PAM sequence: TTA
gtaagaaaatacagacttga

SEQ ID NO: 272774 - DNA, 20 bp, Artificial Sequence
  Description of Artificial Sequence: Synthetic oligonucleotide
  Target: ATXN1; (+) strand; PAM type: YTN; PAM sequence: CTT
gatatgacacatactcaact

SEQ ID NO: 272775 - DNA, 20 bp, Artificial Sequence
  Description of Artificial Sequence: Synthetic oligonucleotide
  Target: ATXN1; (+) strand; PAM type: YTN; PAM sequence: TTG
atatgacacatactcaacta

SEQ ID NO: 272776 - DNA, 20 bp, Artificial Sequence
  Description of Artificial Sequence: Synthetic oligonucleotide
  Target: ATXN1; (+) strand; PAM type: YTN; PAM sequence: CTC
aactactgtaaagtgggtgc

SEQ ID NO: 272777 - DNA, 20 bp, Artificial Sequence
  Description of Artificial Sequence: Synthetic oligonucleotide
  Target: ATXN1; (+) strand; PAM type: YTN; PAM sequence: CTA
ctgtaaagtgggtgcttaat

SEQ ID NO: 272778 - DNA, 20 bp, Artificial Sequence
  Description of Artificial Sequence: Synthetic oligonucleotide
  Target: ATXN1; (+) strand; PAM type: YTN; PAM sequence: CTG
taaagtgggtgcttaattta

SEQ ID NO: 272779 - DNA, 20 bp, Artificial Sequence
  Description of Artificial Sequence: Synthetic oligonucleotide
  Target: ATXN1; (+) strand; PAM type: YTN; PAM sequence: CTT
aatttagttagggagaggaa

SEQ ID NO: 272780 - DNA, 20 bp, Artificial Sequence
  Description of Artificial Sequence: Synthetic oligonucleotide
  Target: ATXN1; (+) strand; PAM type: YTN; PAM sequence: TTA
atttagttagggagaggaag

SEQ ID NO: 272781 - DNA, 20 bp, Artificial Sequence
  Description of Artificial Sequence: Synthetic oligonucleotide
  Target: ATXN1; (+) strand; PAM type: YTN; PAM sequence: TTT
agttagggagaggaaggggt

SEQ ID NO: 272782 - DNA, 20 bp, Artificial Sequence
  Description of Artificial Sequence: Synthetic oligonucleotide
  Target: ATXN1; (+) strand; PAM type: YTN; PAM sequence: TTA
gttagggagaggaaggggtg

SEQ ID NO: 272783 - DNA, 20 bp, Artificial Sequence
  Description of Artificial Sequence: Synthetic oligonucleotide
  Target: ATXN1; (+) strand; PAM type: YTN; PAM sequence: TTA
gggagaggaaggggtggaag

SEQ ID NO: 272784 - DNA, 20 bp, Artificial Sequence
  Description of Artificial Sequence: Synthetic oligonucleotide
  Target: ATXN1; (+) strand; PAM type: YTN; PAM sequence: CTG
gggaaagtcctgcttagagg

SEQ ID NO: 272785 - DNA, 20 bp, Artificial Sequence
  Description of Artificial Sequence: Synthetic oligonucleotide
  Target: ATXN1; (+) strand; PAM type: YTN; PAM sequence: CTG
cttagagggcacctcactag

SEQ ID NO: 272786 - DNA, 20 bp, Artificial Sequence
  Description of Artificial Sequence: Synthetic oligonucleotide
  Target: ATXN1; (+) strand; PAM type: YTN; PAM sequence: CTT
agagggcacctcactagcca

SEQ ID NO: 272787 - DNA, 20 bp, Artificial Sequence
  Description of Artificial Sequence: Synthetic oligonucleotide
  Target: ATXN1; (+) strand; PAM type: YTN; PAM sequence: TTA
gagggcacctcactagccac

SEQ ID NO: 272788 - DNA, 20 bp, Artificial Sequence
  Description of Artificial Sequence: Synthetic oligonucleotide
  Target: ATXN1; (+) strand; PAM type: YTN; PAM sequence: CTC
actagccactagagggcatt

SEQ ID NO: 272789 - DNA, 20 bp, Artificial Sequence
  Description of Artificial Sequence: Synthetic oligonucleotide
  Target: ATXN1; (+) strand; PAM type: YTN; PAM sequence: CTA
gccactagagggcattaaca

SEQ ID NO: 272790 - DNA, 20 bp, Artificial Sequence
  Description of Artificial Sequence: Synthetic oligonucleotide
  Target: ATXN1; (+) strand; PAM type: YTN; PAM sequence: CTA
gagggcattaacatgtgaat

SEQ ID NO: 272791 - DNA, 20 bp, Artificial Sequence
  Description of Artificial Sequence: Synthetic oligonucleotide
  Target: ATXN1; (+) strand; PAM type: YTN; PAM sequence: TTA
acatgtgaataaaatcatcc

SEQ ID NO: 272792 - DNA, 20 bp, Artificial Sequence
  Description of Artificial Sequence: Synthetic oligonucleotide
  Target: ATXN1; (+) strand; PAM type: YTN; PAM sequence: CTG
atttccaggattcaaacagc

SEQ ID NO: 272793 - DNA, 20 bp, Artificial Sequence
  Description of Artificial Sequence: Synthetic oligonucleotide
  Target: ATXN1; (+) strand; PAM type: YTN; PAM sequence: TTT
ccaggattcaaacagcagac

SEQ ID NO: 272794 - DNA, 20 bp, Artificial Sequence
  Description of Artificial Sequence: Synthetic oligonucleotide
  Target: ATXN1; (+) strand; PAM type: YTN; PAM sequence: TTC
caggattcaaacagcagaca

SEQ ID NO: 272795 - DNA, 20 bp, Artificial Sequence
  Description of Artificial Sequence: Synthetic oligonucleotide
  Target: ATXN1; (+) strand; PAM type: YTN; PAM sequence: TTC
aaacagcagacaccatgcat

SEQ ID NO: 272796 - DNA, 20 bp, Artificial Sequence
  Description of Artificial Sequence: Synthetic oligonucleotide
  Target: ATXN1; (+) strand; PAM type: YTN; PAM sequence: TTA
atggggctctgcttcactct

SEQ ID NO: 272797 - DNA, 20 bp, Artificial Sequence
  Description of Artificial Sequence: Synthetic oligonucleotide
  Target: ATXN1; (+) strand; PAM type: YTN; PAM sequence: CTC
tgcttcactcttcctttccc

SEQ ID NO: 272798 - DNA, 20 bp, Artificial Sequence
  Description of Artificial Sequence: Synthetic oligonucleotide
  Target: ATXN1; (+) strand; PAM type: YTN; PAM sequence: CTG
cttcactcttcctttccctt

SEQ ID NO: 272799 - DNA, 20 bp, Artificial Sequence
  Description of Artificial Sequence: Synthetic oligonucleotide
  Target: ATXN1; (+) strand; PAM type: YTN; PAM sequence: CTT
cactcttcctttccctttat

SEQ ID NO: 272800 - DNA, 20 bp, Artificial Sequence
  Description of Artificial Sequence: Synthetic oligonucleotide
  Target: ATXN1; (+) strand; PAM type: YTN; PAM sequence: TTC
actcttcctttccctttata

SEQ ID NO: 272801 - DNA, 20 bp, Artificial Sequence
  Description of Artificial Sequence: Synthetic oligonucleotide
  Target: ATXN1; (+) strand; PAM type: YTN; PAM sequence: CTC
ttcctttccctttataaatg

SEQ ID NO: 272802 - DNA, 20 bp, Artificial Sequence
  Description of Artificial Sequence: Synthetic oligonucleotide
  Target: ATXN1; (+) strand; PAM type: YTN; PAM sequence: CTT
cctttccctttataaatgtc

SEQ ID NO: 272803 - DNA, 20 bp, Artificial Sequence
  Description of Artificial Sequence: Synthetic oligonucleotide
  Target: ATXN1; (+) strand; PAM type: YTN; PAM sequence: TTC
ctttccctttataaatgtcc

SEQ ID NO: 272804 - DNA, 20 bp, Artificial Sequence
  Description of Artificial Sequence: Synthetic oligonucleotide
  Target: ATXN1; (+) strand; PAM type: YTN; PAM sequence: CTT
tccctttataaatgtccaga

SEQ ID NO: 272805 - DNA, 20 bp, Artificial Sequence
  Description of Artificial Sequence: Synthetic oligonucleotide
  Target: ATXN1; (+) strand; PAM type: YTN; PAM sequence: TTT
ccctttataaatgtccagag

SEQ ID NO: 272806 - DNA, 20 bp, Artificial Sequence
  Description of Artificial Sequence: Synthetic oligonucleotide
  Target: ATXN1; (+) strand; PAM type: YTN; PAM sequence: TTC
cctttataaatgtccagaga

SEQ ID NO: 272807 - DNA, 20 bp, Artificial Sequence
  Description of Artificial Sequence: Synthetic oligonucleotide
  Target: ATXN1; (+) strand; PAM type: YTN; PAM sequence: CTT
tataaatgtccagagagcta

SEQ ID NO: 272808 - DNA, 20 bp, Artificial Sequence
  Description of Artificial Sequence: Synthetic oligonucleotide
  Target: ATXN1; (+) strand; PAM type: YTN; PAM sequence: TTT
ataaatgtccagagagctaa

SEQ ID NO: 272809 - DNA, 20 bp, Artificial Sequence
  Description of Artificial Sequence: Synthetic oligonucleotide
  Target: ATXN1; (+) strand; PAM type: YTN; PAM sequence: TTA
taaatgtccagagagctaac

SEQ ID NO: 272810 - DNA, 20 bp, Artificial Sequence
  Description of Artificial Sequence: Synthetic oligonucleotide
  Target: ATXN1; (+) strand; PAM type: YTN; PAM sequence: CTA
acaactgcaaagatgtggaa

SEQ ID NO: 272811 - DNA, 20 bp, Artificial Sequence
  Description of Artificial Sequence: Synthetic oligonucleotide
  Target: ATXN1; (+) strand; PAM type: YTN; PAM sequence: CTG
caaagatgtggaagtatatc

SEQ ID NO: 272812 - DNA, 20 bp, Artificial Sequence
  Description of Artificial Sequence: Synthetic oligonucleotide
  Target: ATXN1; (+) strand; PAM type: YTN; PAM sequence: CTA
aactctttttatgttttaac

SEQ ID NO: 272813 - DNA, 20 bp, Artificial Sequence
  Description of Artificial Sequence: Synthetic oligonucleotide
  Target: ATXN1; (+) strand; PAM type: YTN; PAM sequence: CTC
tttttatgttttaacacaat

SEQ ID NO: 272814 - DNA, 20 bp, Artificial Sequence
  Description of Artificial Sequence: Synthetic oligonucleotide
  Target: ATXN1; (+) strand; PAM type: YTN; PAM sequence: CTT
tttatgttttaacacaatag

SEQ ID NO: 272815 - DNA, 20 bp, Artificial Sequence
  Description of Artificial Sequence: Synthetic oligonucleotide
  Target: ATXN1; (+) strand; PAM type: YTN; PAM sequence: TTT
ttatgttttaacacaataga

SEQ ID NO: 272816 - DNA, 20 bp, Artificial Sequence
  Description of Artificial Sequence: Synthetic oligonucleotide
  Target: ATXN1; (+) strand; PAM type: YTN; PAM sequence: TTT
tatgttttaacacaatagac

SEQ ID NO: 272817 - DNA, 20 bp, Artificial Sequence
  Description of Artificial Sequence: Synthetic oligonucleotide
  Target: ATXN1; (+) strand; PAM type: YTN; PAM sequence: TTT
atgttttaacacaatagaca

SEQ ID NO: 272818 - DNA, 20 bp, Artificial Sequence
  Description of Artificial Sequence: Synthetic oligonucleotide
  Target: ATXN1; (+) strand; PAM type: YTN; PAM sequence: TTA
tgttttaacacaatagacat

SEQ ID NO: 272819 - DNA, 20 bp, Artificial Sequence
  Description of Artificial Sequence: Synthetic oligonucleotide
  Target: ATXN1; (+) strand; PAM type: YTN; PAM sequence: TTT
taacacaatagacatttaag

SEQ ID NO: 272820 - DNA, 20 bp, Artificial Sequence
  Description of Artificial Sequence: Synthetic oligonucleotide
  Target: ATXN1; (+) strand; PAM type: YTN; PAM sequence: TTT
aacacaatagacatttaagg

SEQ ID NO: 272821 - DNA, 20 bp, Artificial Sequence
  Description of Artificial Sequence: Synthetic oligonucleotide
  Target: ATXN1; (+) strand; PAM type: YTN; PAM sequence: TTA
acacaatagacatttaaggg

SEQ ID NO: 272822 - DNA, 20 bp, Artificial Sequence
  Description of Artificial Sequence: Synthetic oligonucleotide
  Target: ATXN1; (+) strand; PAM type: YTN; PAM sequence: TTT
aagggaataaacttgagcca

SEQ ID NO: 272823 - DNA, 20 bp, Artificial Sequence
  Description of Artificial Sequence: Synthetic oligonucleotide
  Target: ATXN1; (+) strand; PAM type: YTN; PAM sequence: TTA
agggaataaacttgagccat

SEQ ID NO: 272824 - DNA, 20 bp, Artificial Sequence
  Description of Artificial Sequence: Synthetic oligonucleotide
  Target: ATXN1; (+) strand; PAM type: YTN; PAM sequence: CTT
gagccatgctagctccagga

SEQ ID NO: 272825 - DNA, 20 bp, Artificial Sequence
  Description of Artificial Sequence: Synthetic oligonucleotide
  Target: ATXN1; (+) strand; PAM type: YTN; PAM sequence: TTG
agccatgctagctccaggac

SEQ ID NO: 272826 - DNA, 20 bp, Artificial Sequence
  Description of Artificial Sequence: Synthetic oligonucleotide
  Target: ATXN1; (+) strand; PAM type: YTN; PAM sequence: CTA
gctccaggactaggattgac

SEQ ID NO: 272827 - DNA, 20 bp, Artificial Sequence
  Description of Artificial Sequence: Synthetic oligonucleotide
  Target: ATXN1; (+) strand; PAM type: YTN; PAM sequence: CTC
caggactaggattgacatat

SEQ ID NO: 272828 - DNA, 20 bp, Artificial Sequence
  Description of Artificial Sequence: Synthetic oligonucleotide
  Target: ATXN1; (+) strand; PAM type: YTN; PAM sequence: CTA
ggattgacatatgtttcctt

SEQ ID NO: 272829 - DNA, 20 bp, Artificial Sequence
  Description of Artificial Sequence: Synthetic oligonucleotide
  Target: ATXN1; (+) strand; PAM type: YTN; PAM sequence: TTG
acatatgtttccttcagggt

SEQ ID NO: 272830 - DNA, 20 bp, Artificial Sequence
  Description of Artificial Sequence: Synthetic oligonucleotide
  Target: ATXN1; (+) strand; PAM type: YTN; PAM sequence: TTT
ccttcagggtgcccgatttc

SEQ ID NO: 272831 - DNA, 20 bp, Artificial Sequence
  Description of Artificial Sequence: Synthetic oligonucleotide
  Target: ATXN1; (+) strand; PAM type: YTN; PAM sequence: TTC
cttcagggtgcccgatttcc

SEQ ID NO: 272832 - DNA, 20 bp, Artificial Sequence
  Description of Artificial Sequence: Synthetic oligonucleotide
  Target: ATXN1; (+) strand; PAM type: YTN; PAM sequence: CTT
cagggtgcccgatttccatt

SEQ ID NO: 272833 - DNA, 20 bp, Artificial Sequence
  Description of Artificial Sequence: Synthetic oligonucleotide
  Target: ATXN1; (+) strand; PAM type: YTN; PAM sequence: TTC
agggtgcccgatttccattc

SEQ ID NO: 272834 - DNA, 20 bp, Artificial Sequence
  Description of Artificial Sequence: Synthetic oligonucleotide
  Target: ATXN1; (+) strand; PAM type: YTN; PAM sequence: TTT
ccattcttcagaagtccaca

SEQ ID NO: 272835 - DNA, 20 bp, Artificial Sequence
  Description of Artificial Sequence: Synthetic oligonucleotide
  Target: ATXN1; (+) strand; PAM type: YTN; PAM sequence: TTC
cattcttcagaagtccacaa

SEQ ID NO: 272836 - DNA, 20 bp, Artificial Sequence
  Description of Artificial Sequence: Synthetic oligonucleotide
  Target: ATXN1; (+) strand; PAM type: YTN; PAM sequence: TTC
ttcagaagtccacaaccttc

SEQ ID NO: 272837 - DNA, 20 bp, Artificial Sequence
  Description of Artificial Sequence: Synthetic oligonucleotide
  Target: ATXN1; (+) strand; PAM type: YTN; PAM sequence: CTT
cagaagtccacaaccttctg

SEQ ID NO: 272838 - DNA, 20 bp, Artificial Sequence
  Description of Artificial Sequence: Synthetic oligonucleotide
  Target: ATXN1; (+) strand; PAM type: YTN; PAM sequence: TTC
agaagtccacaaccttctga

SEQ ID NO: 272839 - DNA, 20 bp, Artificial Sequence
  Description of Artificial Sequence: Synthetic oligonucleotide
  Target: ATXN1; (+) strand; PAM type: YTN; PAM sequence: CTT
ctgaataacagaggtctttt

SEQ ID NO: 272840 - DNA, 20 bp, Artificial Sequence
  Description of Artificial Sequence: Synthetic oligonucleotide
  Target: ATXN1; (+) strand; PAM type: YTN; PAM sequence: TTC
tgaataacagaggtcttttc

SEQ ID NO: 272841 - DNA, 20 bp, Artificial Sequence
  Description of Artificial Sequence: Synthetic oligonucleotide
  Target: ATXN1; (+) strand; PAM type: YTN; PAM sequence: CTG
aataacagaggtcttttctc

SEQ ID NO: 272842 - DNA, 20 bp, Artificial Sequence
  Description of Artificial Sequence: Synthetic oligonucleotide
  Target: ATXN1; (+) strand; PAM type: YTN; PAM sequence: CTT
ttctccctcagaatcaacct

SEQ ID NO: 272843 - DNA, 20 bp, Artificial Sequence
  Description of Artificial Sequence: Synthetic oligonucleotide
  Target: ATXN1; (+) strand; PAM type: YTN; PAM sequence: TTT
tctccctcagaatcaaccta

SEQ ID NO: 272844 - DNA, 20 bp, Artificial Sequence
  Description of Artificial Sequence: Synthetic oligonucleotide
  Target: ATXN1; (+) strand; PAM type: YTN; PAM sequence: TTT
ctccctcagaatcaacctag

SEQ ID NO: 272845 - DNA, 20 bp, Artificial Sequence
  Description of Artificial Sequence: Synthetic oligonucleotide
  Target: ATXN1; (+) strand; PAM type: YTN; PAM sequence: TTC
tccctcagaatcaacctagc

SEQ ID NO: 272846 - DNA, 20 bp, Artificial Sequence
  Description of Artificial Sequence: Synthetic oligonucleotide
  Target: ATXN1; (+) strand; PAM type: YTN; PAM sequence: CTC
cctcagaatcaacctagcaa

SEQ ID NO: 272847 - DNA, 20 bp, Artificial Sequence
  Description of Artificial Sequence: Synthetic oligonucleotide
  Target: ATXN1; (+) strand; PAM type: YTN; PAM sequence: CTC
agaatcaacctagcaacaag

SEQ ID NO: 272848 - DNA, 20 bp, Artificial Sequence
  Description of Artificial Sequence: Synthetic oligonucleotide
  Target: ATXN1; (+) strand; PAM type: YTN; PAM sequence: CTA
gcaacaagtccgaaacctcc

SEQ ID NO: 272849 - DNA, 20 bp, Artificial Sequence
  Description of Artificial Sequence: Synthetic oligonucleotide
  Target: ATXN1; (+) strand; PAM type: YTN; PAM sequence: CTC
caaaaacttctcatacctgt

SEQ ID NO: 272850 - DNA, 20 bp, Artificial Sequence
  Description of Artificial Sequence: Synthetic oligonucleotide
  Target: ATXN1; (+) strand; PAM type: YTN; PAM sequence: CTT
ctcatacctgtaatcctagc

SEQ ID NO: 272851 - DNA, 20 bp, Artificial Sequence
  Description of Artificial Sequence: Synthetic oligonucleotide
  Target: ATXN1; (+) strand; PAM type: YTN; PAM sequence: TTC
tcatacctgtaatcctagca

SEQ ID NO: 272852 - DNA, 20 bp, Artificial Sequence
  Description of Artificial Sequence: Synthetic oligonucleotide
  Target: ATXN1; (+) strand; PAM type: YTN; PAM sequence: CTC
atacctgtaatcctagcact

SEQ ID NO: 272853 - DNA, 20 bp, Artificial Sequence
  Description of Artificial Sequence: Synthetic oligonucleotide
  Target: ATXN1; (+) strand; PAM type: YTN; PAM sequence: CTG
taatcctagcactttgggaa

SEQ ID NO: 272854 - DNA, 20 bp, Artificial Sequence
  Description of Artificial Sequence: Synthetic oligonucleotide
  Target: ATXN1; (+) strand; PAM type: YTN; PAM sequence: CTA
gcactttgggaagccaaagt

SEQ ID NO: 272855 - DNA, 20 bp, Artificial Sequence
  Description of Artificial Sequence: Synthetic oligonucleotide
  Target: ATXN1; (+) strand; PAM type: YTN; PAM sequence: CTT
tgggaagccaaagtgagagg

SEQ ID NO: 272856 - DNA, 20 bp, Artificial Sequence
  Description of Artificial Sequence: Synthetic oligonucleotide
  Target: ATXN1; (+) strand; PAM type: YTN; PAM sequence: TTT
gggaagccaaagtgagagga

SEQ ID NO: 272857 - DNA, 20 bp, Artificial Sequence
  Description of Artificial Sequence: Synthetic oligonucleotide
  Target: ATXN1; (+) strand; PAM type: YTN; PAM sequence: TTG
ggaagccaaagtgagaggat

SEQ ID NO: 272858 - DNA, 20 bp, Artificial Sequence
  Description of Artificial Sequence: Synthetic oligonucleotide
  Target: ATXN1; (+) strand; PAM type: YTN; PAM sequence: TTG
cttgagcccaggaattcaag

SEQ ID NO: 272859 - DNA, 20 bp, Artificial Sequence
  Description of Artificial Sequence: Synthetic oligonucleotide
  Target: ATXN1; (+) strand; PAM type: YTN; PAM sequence: CTT
gagcccaggaattcaagacc

SEQ ID NO: 272860 - DNA, 20 bp, Artificial Sequence
  Description of Artificial Sequence: Synthetic oligonucleotide
  Target: ATXN1; (+) strand; PAM type: YTN; PAM sequence: TTG
agcccaggaattcaagacca

SEQ ID NO: 272861 - DNA, 20 bp, Artificial Sequence
  Description of Artificial Sequence: Synthetic oligonucleotide
  Target: ATXN1; (+) strand; PAM type: YTN; PAM sequence: TTC
aagaccagccatgtctccaa

SEQ ID NO: 272862 - DNA, 20 bp, Artificial Sequence
  Description of Artificial Sequence: Synthetic oligonucleotide
  Target: ATXN1; (+) strand; PAM type: YTN; PAM sequence: CTC
caaaacttccaaaaacttct

SEQ ID NO: 272863 - DNA, 20 bp, Artificial Sequence
  Description of Artificial Sequence: Synthetic oligonucleotide
  Target: ATXN1; (+) strand; PAM type: YTN; PAM sequence: CTT
ccaaaaacttctccagcctg

SEQ ID NO: 272864 - DNA, 20 bp, Artificial Sequence
  Description of Artificial Sequence: Synthetic oligonucleotide
  Target: ATXN1; (+) strand; PAM type: YTN; PAM sequence: TTC
caaaaacttctccagcctgc

SEQ ID NO: 272865 - DNA, 20 bp, Artificial Sequence
  Description of Artificial Sequence: Synthetic oligonucleotide
  Target: ATXN1; (+) strand; PAM type: YTN; PAM sequence: CTT
ctccagcctgcttgctaaaa

SEQ ID NO: 272866 - DNA, 20 bp, Artificial Sequence
  Description of Artificial Sequence: Synthetic oligonucleotide
  Target: ATXN1; (+) strand; PAM type: YTN; PAM sequence: TTC
tccagcctgcttgctaaaaa

SEQ ID NO: 272867 - DNA, 20 bp, Artificial Sequence
  Description of Artificial Sequence: Synthetic oligonucleotide
  Target: ATXN1; (+) strand; PAM type: YTN; PAM sequence: CTC
cagcctgcttgctaaaaatt

SEQ ID NO: 272868 - DNA, 20 bp, Artificial Sequence
  Description of Artificial Sequence: Synthetic oligonucleotide
  Target: ATXN1; (+) strand; PAM type: YTN; PAM sequence: CTG
cttgctaaaaattcaagttg

SEQ ID NO: 272869 - DNA, 20 bp, Artificial Sequence
  Description of Artificial Sequence: Synthetic oligonucleotide
  Target: ATXN1; (+) strand; PAM type: YTN; PAM sequence: CTT
gctaaaaattcaagttgata

SEQ ID NO: 272870 - DNA, 20 bp, Artificial Sequence
  Description of Artificial Sequence: Synthetic oligonucleotide
  Target: ATXN1; (+) strand; PAM type: YTN; PAM sequence: TTG
ctaaaaattcaagttgatag

SEQ ID NO: 272871 - DNA, 20 bp, Artificial Sequence
  Description of Artificial Sequence: Synthetic oligonucleotide
  Target: ATXN1; (+) strand; PAM type: YTN; PAM sequence: CTA
aaaattcaagttgatagtcc

SEQ ID NO: 272872 - DNA, 20 bp, Artificial Sequence
  Description of Artificial Sequence: Synthetic oligonucleotide
  Target: ATXN1; (+) strand; PAM type: YTN; PAM sequence: TTC
aagttgatagtccacccatt

SEQ ID NO: 272873 - DNA, 20 bp, Artificial Sequence
  Description of Artificial Sequence: Synthetic oligonucleotide
  Target: ATXN1; (+) strand; PAM type: YTN; PAM sequence: TTG
atagtccacccattgcaaaa

SEQ ID NO: 272874 - DNA, 20 bp, Artificial Sequence
  Description of Artificial Sequence: Synthetic oligonucleotide
  Target: ATXN1; (+) strand; PAM type: YTN; PAM sequence: TTG
caaaaggatatttccttcag

SEQ ID NO: 272875 - DNA, 20 bp, Artificial Sequence
  Description of Artificial Sequence: Synthetic oligonucleotide
  Target: ATXN1; (+) strand; PAM type: YTN; PAM sequence: TTT
ccttcaggaagcaggaggaa

SEQ ID NO: 272876 - DNA, 20 bp, Artificial Sequence
  Description of Artificial Sequence: Synthetic oligonucleotide
  Target: ATXN1; (+) strand; PAM type: YTN; PAM sequence: TTC
cttcaggaagcaggaggaag

SEQ ID NO: 272877 - DNA, 20 bp, Artificial Sequence
  Description of Artificial Sequence: Synthetic oligonucleotide
  Target: ATXN1; (+) strand; PAM type: YTN; PAM sequence: CTT
caggaagcaggaggaagata

SEQ ID NO: 272878 - DNA, 20 bp, Artificial Sequence
  Description of Artificial Sequence: Synthetic oligonucleotide
  Target: ATXN1; (+) strand; PAM type: YTN; PAM sequence: TTC
aggaagcaggaggaagataa

SEQ ID NO: 272879 - DNA, 20 bp, Artificial Sequence
  Description of Artificial Sequence: Synthetic oligonucleotide
  Target: ATXN1; (+) strand; PAM type: YTN; PAM sequence: CTG
gggaagactgaagacaacag

SEQ ID NO: 272880 - DNA, 20 bp, Artificial Sequence
  Description of Artificial Sequence: Synthetic oligonucleotide
  Target: ATXN1; (+) strand; PAM type: YTN; PAM sequence: CTG
aagacaacagtcctcagttc

SEQ ID NO: 272881 - DNA, 20 bp, Artificial Sequence
  Description of Artificial Sequence: Synthetic oligonucleotide
  Target: ATXN1; (+) strand; PAM type: YTN; PAM sequence: CTC
agttctgaggagaatgagcg

SEQ ID NO: 272882 - DNA, 20 bp, Artificial Sequence
  Description of Artificial Sequence: Synthetic oligonucleotide
  Target: ATXN1; (+) strand; PAM type: YTN; PAM sequence: TTC
tgaggagaatgagcgggaag

SEQ ID NO: 272883 - DNA, 20 bp, Artificial Sequence
  Description of Artificial Sequence: Synthetic oligonucleotide
  Target: ATXN1; (+) strand; PAM type: YTN; PAM sequence: CTG
aggagaatgagcgggaagtg

SEQ ID NO: 272884 - DNA, 20 bp, Artificial Sequence
  Description of Artificial Sequence: Synthetic oligonucleotide
  Target: ATXN1; (+) strand; PAM type: YTN; PAM sequence: TTG
atggtcagtcccaggccacc

SEQ ID NO: 272885 - DNA, 20 bp, Artificial Sequence
  Description of Artificial Sequence: Synthetic oligonucleotide
  Target: ATXN1; (+) strand; PAM type: YTN; PAM sequence: CTG
ccttagtgggtgtctttgcc

SEQ ID NO: 272886 - DNA, 20 bp, Artificial Sequence
  Description of Artificial Sequence: Synthetic oligonucleotide
  Target: ATXN1; (+) strand; PAM type: YTN; PAM sequence: CTT
agtgggtgtctttgccacga

SEQ ID NO: 272887 - DNA, 20 bp, Artificial Sequence
  Description of Artificial Sequence: Synthetic oligonucleotide
  Target: ATXN1; (+) strand; PAM type: YTN; PAM sequence: TTA
gtgggtgtctttgccacgag

SEQ ID NO: 272888 - DNA, 20 bp, Artificial Sequence
  Description of Artificial Sequence: Synthetic oligonucleotide
  Target: ATXN1; (+) strand; PAM type: YTN; PAM sequence: CTT
tgccacgaggtggccttcca

SEQ ID NO: 272889 - DNA, 20 bp, Artificial Sequence
  Description of Artificial Sequence: Synthetic oligonucleotide
  Target: ATXN1; (+) strand; PAM type: YTN; PAM sequence: TTT
gccacgaggtggccttccag

SEQ ID NO: 272890 - DNA, 20 bp, Artificial Sequence
  Description of Artificial Sequence: Synthetic oligonucleotide
  Target: ATXN1; (+) strand; PAM type: YTN; PAM sequence: TTG
ccacgaggtggccttccagg

SEQ ID NO: 272891 - DNA, 20 bp, Artificial Sequence
  Description of Artificial Sequence: Synthetic oligonucleotide
  Target: ATXN1; (+) strand; PAM type: YTN; PAM sequence: CTT
ccaggtagcttggcttcctt

SEQ ID NO: 272892 - DNA, 20 bp, Artificial Sequence
  Description of Artificial Sequence: Synthetic oligonucleotide
  Target: ATXN1; (+) strand; PAM type: YTN; PAM sequence: TTC
caggtagcttggcttccttc

SEQ ID NO: 272893 - DNA, 20 bp, Artificial Sequence
  Description of Artificial Sequence: Synthetic oligonucleotide
  Target: ATXN1; (+) strand; PAM type: YTN; PAM sequence: CTT
ggcttccttctgcacctaag

SEQ ID NO: 272894 - DNA, 20 bp, Artificial Sequence
  Description of Artificial Sequence: Synthetic oligonucleotide
  Target: ATXN1; (+) strand; PAM type: YTN; PAM sequence: TTG
gcttccttctgcacctaagc

SEQ ID NO: 272895 - DNA, 20 bp, Artificial Sequence
  Description of Artificial Sequence: Synthetic oligonucleotide
  Target: ATXN1; (+) strand; PAM type: YTN; PAM sequence: CTT
ccttctgcacctaagcttat

SEQ ID NO: 272896 - DNA, 20 bp, Artificial Sequence
  Description of Artificial Sequence: Synthetic oligonucleotide
  Target: ATXN1; (+) strand; PAM type: YTN; PAM sequence: TTC
cttctgcacctaagcttata

SEQ ID NO: 272897 - DNA, 20 bp, Artificial Sequence
  Description of Artificial Sequence: Synthetic oligonucleotide
  Target: ATXN1; (+) strand; PAM type: YTN; PAM sequence: CTT
ctgcacctaagcttataatg

SEQ ID NO: 272898 - DNA, 20 bp, Artificial Sequence
  Description of Artificial Sequence: Synthetic oligonucleotide
  Target: ATXN1; (+) strand; PAM type: YTN; PAM sequence: TTC
tgcacctaagcttataatgg

SEQ ID NO: 272899 - DNA, 20 bp, Artificial Sequence
  Description of Artificial Sequence: Synthetic oligonucleotide
  Target: ATXN1; (+) strand; PAM type: YTN; PAM sequence: CTG
cacctaagcttataatggca

SEQ ID NO: 272900 - DNA, 20 bp, Artificial Sequence
  Description of Artificial Sequence: Synthetic oligonucleotide
  Target: ATXN1; (+) strand; PAM type: YTN; PAM sequence: CTA
agcttataatggcaagacta

SEQ ID NO: 272901 - DNA, 20 bp, Artificial Sequence
  Description of Artificial Sequence: Synthetic oligonucleotide
  Target: ATXN1; (+) strand; PAM type: YTN; PAM sequence: CTT
ataatggcaagactaacctt

SEQ ID NO: 272902 - DNA, 20 bp, Artificial Sequence
  Description of Artificial Sequence: Synthetic oligonucleotide
  Target: ATXN1; (+) strand; PAM type: YTN; PAM sequence: TTA
taatggcaagactaaccttg

SEQ ID NO: 272903 - DNA, 20 bp, Artificial Sequence
  Description of Artificial Sequence: Synthetic oligonucleotide
  Target: ATXN1; (+) strand; PAM type: YTN; PAM sequence: CTA
accttgcctctccagccccc

SEQ ID NO: 272904 - DNA, 20 bp, Artificial Sequence
  Description of Artificial Sequence: Synthetic oligonucleotide
  Target: ATXN1; (+) strand; PAM type: YTN; PAM sequence: CTT
gcctctccagcccccatctt

SEQ ID NO: 272905 - DNA, 20 bp, Artificial Sequence
  Description of Artificial Sequence: Synthetic oligonucleotide
  Target: ATXN1; (+) strand; PAM type: YTN; PAM sequence: TTG
cctctccagcccccatcttt

SEQ ID NO: 272906 - DNA, 20 bp, Artificial Sequence
  Description of Artificial Sequence: Synthetic oligonucleotide
  Target: ATXN1; (+) strand; PAM type: YTN; PAM sequence: CTC
tccagcccccatctttctcc

SEQ ID NO: 272907 - DNA, 20 bp, Artificial Sequence
  Description of Artificial Sequence: Synthetic oligonucleotide
  Target: ATXN1; (+) strand; PAM type: YTN; PAM sequence: CTC
cagcccccatctttctcctc

SEQ ID NO: 272908 - DNA, 20 bp, Artificial Sequence
  Description of Artificial Sequence: Synthetic oligonucleotide
  Target: ATXN1; (+) strand; PAM type: YTN; PAM sequence: CTT
tctcctcaaacggtccctct

SEQ ID NO: 272909 - DNA, 20 bp, Artificial Sequence
  Description of Artificial Sequence: Synthetic oligonucleotide
  Target: ATXN1; (+) strand; PAM type: YTN; PAM sequence: TTT
ctcctcaaacggtccctcta

SEQ ID NO: 272910 - DNA, 20 bp, Artificial Sequence
  Description of Artificial Sequence: Synthetic oligonucleotide
  Target: ATXN1; (+) strand; PAM type: YTN; PAM sequence: TTC
tcctcaaacggtccctctaa

SEQ ID NO: 272911 - DNA, 20 bp, Artificial Sequence
  Description of Artificial Sequence: Synthetic oligonucleotide
  Target: ATXN1; (+) strand; PAM type: YTN; PAM sequence: CTC
ctcaaacggtccctctaatc

SEQ ID NO: 272912 - DNA, 20 bp, Artificial Sequence
  Description of Artificial Sequence: Synthetic oligonucleotide
  Target: ATXN1; (+) strand; PAM type: YTN; PAM sequence: CTC
aaacggtccctctaatcttt

SEQ ID NO: 272913 - DNA, 20 bp, Artificial Sequence
  Description of Artificial Sequence: Synthetic oligonucleotide
  Target: ATXN1; (+) strand; PAM type: YTN; PAM sequence: CTC
taatctttgtacatactcat

SEQ ID NO: 272914 - DNA, 20 bp, Artificial Sequence
  Description of Artificial Sequence: Synthetic oligonucleotide
  Target: ATXN1; (+) strand; PAM type: YTN; PAM sequence: CTA
atctttgtacatactcatgg

SEQ ID NO: 272915 - DNA, 20 bp, Artificial Sequence
  Description of Artificial Sequence: Synthetic oligonucleotide
  Target: ATXN1; (+) strand; PAM type: YTN; PAM sequence: CTT
tgtacatactcatgggttca

SEQ ID NO: 272916 - DNA, 20 bp, Artificial Sequence
  Description of Artificial Sequence: Synthetic oligonucleotide
  Target: ATXN1; (+) strand; PAM type: YTN; PAM sequence: TTT
gtacatactcatgggttcaa

SEQ ID NO: 272917 - DNA, 20 bp, Artificial Sequence
  Description of Artificial Sequence: Synthetic oligonucleotide
  Target: ATXN1; (+) strand; PAM type: YTN; PAM sequence: TTG
tacatactcatgggttcaat

SEQ ID NO: 272918 - DNA, 20 bp, Artificial Sequence
  Description of Artificial Sequence: Synthetic oligonucleotide
  Target: ATXN1; (+) strand; PAM type: YTN; PAM sequence: CTC
atgggttcaattaccaggca

SEQ ID NO: 272919 - DNA, 20 bp, Artificial Sequence
  Description of Artificial Sequence: Synthetic oligonucleotide
  Target: ATXN1; (+) strand; PAM type: YTN; PAM sequence: TTC
aattaccaggcaggatgccc

SEQ ID NO: 272920 - DNA, 20 bp, Artificial Sequence
  Description of Artificial Sequence: Synthetic oligonucleotide
  Target: ATXN1; (+) strand; PAM type: YTN; PAM sequence: TTA
ccaggcaggatgccctgagg

SEQ ID NO: 272921 - DNA, 20 bp, Artificial Sequence
  Description of Artificial Sequence: Synthetic oligonucleotide
  Target: ATXN1; (+) strand; PAM type: YTN; PAM sequence: CTG
aggcagccaggtgttagttg

SEQ ID NO: 272922 - DNA, 20 bp, Artificial Sequence
  Description of Artificial Sequence: Synthetic oligonucleotide
  Target: ATXN1; (+) strand; PAM type: YTN; PAM sequence: TTA
gttggcaacagaacacacaa

SEQ ID NO: 272923 - DNA, 20 bp, Artificial Sequence
  Description of Artificial Sequence: Synthetic oligonucleotide
  Target: ATXN1; (+) strand; PAM type: YTN; PAM sequence: TTG
gcaacagaacacacaaaggc

SEQ ID NO: 272924 - DNA, 20 bp, Artificial Sequence
  Description of Artificial Sequence: Synthetic oligonucleotide
  Target: ATXN1; (+) strand; PAM type: YTN; PAM sequence: CTC
cccgcctccattcagcgtca

SEQ ID NO: 272925 - DNA, 20 bp, Artificial Sequence
  Description of Artificial Sequence: Synthetic oligonucleotide
  Target: ATXN1; (+) strand; PAM type: YTN; PAM sequence: CTC
cattcagcgtcagggtgata

SEQ ID NO: 272926 - DNA, 20 bp, Artificial Sequence
  Description of Artificial Sequence: Synthetic oligonucleotide
  Target: ATXN1; (+) strand; PAM type: YTN; PAM sequence: TTC
agcgtcagggtgataaagat

SEQ ID NO: 272927 - DNA, 20 bp, Artificial Sequence
  Description of Artificial Sequence: Synthetic oligonucleotide
  Target: ATXN1; (+) strand; PAM type: YTN; PAM sequence: TTA
ccctcaaagccagctcctca

SEQ ID NO: 272928 - DNA, 20 bp, Artificial Sequence
  Description of Artificial Sequence: Synthetic oligonucleotide
  Target: ATXN1; (+) strand; PAM type: YTN; PAM sequence: CTC
aaagccagctcctcagaagt

SEQ ID NO: 272929 - DNA, 20 bp, Artificial Sequence
  Description of Artificial Sequence: Synthetic oligonucleotide
  Target: ATXN1; (+) strand; PAM type: YTN; PAM sequence: CTC
ctcagaagttctgccaccac

SEQ ID NO: 272930 - DNA, 20 bp, Artificial Sequence
  Description of Artificial Sequence: Synthetic oligonucleotide
  Target: ATXN1; (+) strand; PAM type: YTN; PAM sequence: CTC
agaagttctgccaccacggc

SEQ ID NO: 272931 - DNA, 20 bp, Artificial Sequence
  Description of Artificial Sequence: Synthetic oligonucleotide
  Target: ATXN1; (+) strand; PAM type: YTN; PAM sequence: TTC
tgccaccacggcagatatga

SEQ ID NO: 272932 - DNA, 20 bp, Artificial Sequence
  Description of Artificial Sequence: Synthetic oligonucleotide
  Target: ATXN1; (+) strand; PAM type: YTN; PAM sequence: CTG
ccaccacggcagatatgaaa

SEQ ID NO: 272933 - DNA, 20 bp, Artificial Sequence
  Description of Artificial Sequence: Synthetic oligonucleotide
  Target: ATXN1; (+) strand; PAM type: YTN; PAM sequence: CTT
taccacatagttttcataca

SEQ ID NO: 272934 - DNA, 20 bp, Artificial Sequence
  Description of Artificial Sequence: Synthetic oligonucleotide
  Target: ATXN1; (+) strand; PAM type: YTN; PAM sequence: TTT
accacatagttttcatacac

SEQ ID NO: 272935 - DNA, 20 bp, Artificial Sequence
  Description of Artificial Sequence: Synthetic oligonucleotide
  Target: ATXN1; (+) strand; PAM type: YTN; PAM sequence: TTA
ccacatagttttcatacaca

SEQ ID NO: 272936 - DNA, 20 bp, Artificial Sequence
  Description of Artificial Sequence: Synthetic oligonucleotide
  Target: ATXN1; (+) strand; PAM type: YTN; PAM sequence: TTT
tcatacacagttcttcttcc

SEQ ID NO: 272937 - DNA, 20 bp, Artificial Sequence
  Description of Artificial Sequence: Synthetic oligonucleotide
  Target: ATXN1; (+) strand; PAM type: YTN; PAM sequence: TTT
catacacagttcttcttcct

SEQ ID NO: 272938 - DNA, 20 bp, Artificial Sequence
  Description of Artificial Sequence: Synthetic oligonucleotide
  Target: ATXN1; (+) strand; PAM type: YTN; PAM sequence: TTC
atacacagttcttcttcctc

SEQ ID NO: 272939 - DNA, 20 bp, Artificial Sequence
  Description of Artificial Sequence: Synthetic oligonucleotide
  Target: ATXN1; (+) strand; PAM type: YTN; PAM sequence: TTC
ttcttcctcagaaagcacca

SEQ ID NO: 272940 - DNA, 20 bp, Artificial Sequence
  Description of Artificial Sequence: Synthetic oligonucleotide
  Target: ATXN1; (+) strand; PAM type: YTN; PAM sequence: CTT
cttcctcagaaagcaccatt

SEQ ID NO: 272941 - DNA, 20 bp, Artificial Sequence
  Description of Artificial Sequence: Synthetic oligonucleotide
  Target: ATXN1; (+) strand; PAM type: YTN; PAM sequence: TTC
ttcctcagaaagcaccattt

SEQ ID NO: 272942 - DNA, 20 bp, Artificial Sequence
  Description of Artificial Sequence: Synthetic oligonucleotide
  Target: ATXN1; (+) strand; PAM type: YTN; PAM sequence: CTT
cctcagaaagcaccatttgt

SEQ ID NO: 272943 - DNA, 20 bp, Artificial Sequence
  Description of Artificial Sequence: Synthetic oligonucleotide
  Target: ATXN1; (+) strand; PAM type: YTN; PAM sequence: TTC
ctcagaaagcaccatttgtt

SEQ ID NO: 272944 - DNA, 20 bp, Artificial Sequence
  Description of Artificial Sequence: Synthetic oligonucleotide
  Target: ATXN1; (+) strand; PAM type: YTN; PAM sequence: CTC
agaaagcaccatttgtttga

SEQ ID NO: 272945 - DNA, 20 bp, Artificial Sequence
  Description of Artificial Sequence: Synthetic oligonucleotide
  Target: ATXN1; (+) strand; PAM type: YTN; PAM sequence: TTT
gtttgagtatccgtaaataa

SEQ ID NO: 272946 - DNA, 20 bp, Artificial Sequence
  Description of Artificial Sequence: Synthetic oligonucleotide
  Target: ATXN1; (+) strand; PAM type: YTN; PAM sequence: TTG
tttgagtatccgtaaataac

SEQ ID NO: 272947 - DNA, 20 bp, Artificial Sequence
  Description of Artificial Sequence: Synthetic oligonucleotide
  Target: ATXN1; (+) strand; PAM type: YTN; PAM sequence: TTT
gagtatccgtaaataactcc

SEQ ID NO: 272948 - DNA, 20 bp, Artificial Sequence
  Description of Artificial Sequence: Synthetic oligonucleotide
  Target: ATXN1; (+) strand; PAM type: YTN; PAM sequence: TTG
agtatccgtaaataactcct

SEQ ID NO: 272949 - DNA, 20 bp, Artificial Sequence
  Description of Artificial Sequence: Synthetic oligonucleotide
  Target: ATXN1; (+) strand; PAM type: YTN; PAM sequence: CTC
ctacagaagacacaatttgc

SEQ ID NO: 272950 - DNA, 20 bp, Artificial Sequence
  Description of Artificial Sequence: Synthetic oligonucleotide
  Target: ATXN1; (+) strand; PAM type: YTN; PAM sequence: CTA
cagaagacacaatttgctct

SEQ ID NO: 272951 - DNA, 20 bp, Artificial Sequence
  Description of Artificial Sequence: Synthetic oligonucleotide
  Target: ATXN1; (+) strand; PAM type: YTN; PAM sequence: TTT
gctctaatgttttggagcta

SEQ ID NO: 272952 - DNA, 20 bp, Artificial Sequence
  Description of Artificial Sequence: Synthetic oligonucleotide
  Target: ATXN1; (+) strand; PAM type: YTN; PAM sequence: TTG
ctctaatgttttggagctat

SEQ ID NO: 272953 - DNA, 20 bp, Artificial Sequence
  Description of Artificial Sequence: Synthetic oligonucleotide
  Target: ATXN1; (+) strand; PAM type: YTN; PAM sequence: CTC
taatgttttggagctatgga

SEQ ID NO: 272954 - DNA, 20 bp, Artificial Sequence
  Description of Artificial Sequence: Synthetic oligonucleotide
  Target: ATXN1; (+) strand; PAM type: YTN; PAM sequence: CTA
atgttttggagctatggaat

SEQ ID NO: 272955 - DNA, 20 bp, Artificial Sequence
  Description of Artificial Sequence: Synthetic oligonucleotide
  Target: ATXN1; (+) strand; PAM type: YTN; PAM sequence: TTT
tggagctatggaatttatta

SEQ ID NO: 272956 - DNA, 20 bp, Artificial Sequence
  Description of Artificial Sequence: Synthetic oligonucleotide
  Target: ATXN1; (+) strand; PAM type: YTN; PAM sequence: TTT
ggagctatggaatttattat

SEQ ID NO: 272957 - DNA, 20 bp, Artificial Sequence
  Description of Artificial Sequence: Synthetic oligonucleotide
  Target: ATXN1; (+) strand; PAM type: YTN; PAM sequence: TTG
gagctatggaatttattatg

SEQ ID NO: 272958 - DNA, 20 bp, Artificial Sequence
  Description of Artificial Sequence: Synthetic oligonucleotide
  Target: ATXN1; (+) strand; PAM type: YTN; PAM sequence: CTA
tggaatttattatgatcaca

SEQ ID NO: 272959 - DNA, 20 bp, Artificial Sequence
  Description of Artificial Sequence: Synthetic oligonucleotide
  Target: ATXN1; (+) strand; PAM type: YTN; PAM sequence: TTT
attatgatcacagaaccagg

SEQ ID NO: 272960 - DNA, 20 bp, Artificial Sequence
  Description of Artificial Sequence: Synthetic oligonucleotide
  Target: ATXN1; (+) strand; PAM type: YTN; PAM sequence: TTA
ttatgatcacagaaccagga

SEQ ID NO: 272961 - DNA, 20 bp, Artificial Sequence
  Description of Artificial Sequence: Synthetic oligonucleotide
  Target: ATXN1; (+) strand; PAM type: YTN; PAM sequence: TTA
tgatcacagaaccaggaaat

SEQ ID NO: 272962 - DNA, 20 bp, Artificial Sequence
  Description of Artificial Sequence: Synthetic oligonucleotide
  Target: ATXN1; (+) strand; PAM type: YTN; PAM sequence: CTG
aatgtgaaaacaggaacatc

SEQ ID NO: 272963 - DNA, 20 bp, Artificial Sequence
  Description of Artificial Sequence: Synthetic oligonucleotide
  Target: ATXN1; (+) strand; PAM type: YTN; PAM sequence: CTC
aaatcacccctcagctctaa

SEQ ID NO: 272964 - DNA, 20 bp, Artificial Sequence
  Description of Artificial Sequence: Synthetic oligonucleotide
  Target: ATXN1; (+) strand; PAM type: YTN; PAM sequence: CTC
agctctaagaagagtaacgc

SEQ ID NO: 272965 - DNA, 20 bp, Artificial Sequence
  Description of Artificial Sequence: Synthetic oligonucleotide
  Target: ATXN1; (+) strand; PAM type: YTN; PAM sequence: CTC
taagaagagtaacgcatttc

SEQ ID NO: 272966 - DNA, 20 bp, Artificial Sequence
  Description of Artificial Sequence: Synthetic oligonucleotide
  Target: ATXN1; (+) strand; PAM type: YTN; PAM sequence: CTA
agaagagtaacgcatttcaa

SEQ ID NO: 272967 - DNA, 20 bp, Artificial Sequence
  Description of Artificial Sequence: Synthetic oligonucleotide
  Target: ATXN1; (+) strand; PAM type: YTN; PAM sequence: TTT
caaattaaaagcaaagtcat

SEQ ID NO: 272968 - DNA, 20 bp, Artificial Sequence
  Description of Artificial Sequence: Synthetic oligonucleotide
  Target: ATXN1; (+) strand; PAM type: YTN; PAM sequence: TTC
aaattaaaagcaaagtcatt

SEQ ID NO: 272969 - DNA, 20 bp, Artificial Sequence
  Description of Artificial Sequence: Synthetic oligonucleotide
  Target: ATXN1; (+) strand; PAM type: YTN; PAM sequence: TTA
aaagcaaagtcattgctgtg

SEQ ID NO: 272970 - DNA, 20 bp, Artificial Sequence
  Description of Artificial Sequence: Synthetic oligonucleotide
  Target: ATXN1; (+) strand; PAM type: YTN; PAM sequence: TTG
ctgtgtttactgttctctct

SEQ ID NO: 272971 - DNA, 20 bp, Artificial Sequence
  Description of Artificial Sequence: Synthetic oligonucleotide
  Target: ATXN1; (+) strand; PAM type: YTN; PAM sequence: CTG
tgtttactgttctctctcaa

SEQ ID NO: 272972 - DNA, 20 bp, Artificial Sequence
  Description of Artificial Sequence: Synthetic oligonucleotide
  Target: ATXN1; (+) strand; PAM type: YTN; PAM sequence: TTT
actgttctctctcaatgagg

SEQ ID NO: 272973 - DNA, 20 bp, Artificial Sequence
  Description of Artificial Sequence: Synthetic oligonucleotide
  Target: ATXN1; (+) strand; PAM type: YTN; PAM sequence: TTA
ctgttctctctcaatgaggg

SEQ ID NO: 272974 - DNA, 20 bp, Artificial Sequence
  Description of Artificial Sequence: Synthetic oligonucleotide
  Target: ATXN1; (+) strand; PAM type: YTN; PAM sequence: CTG
ttctctctcaatgaggggcc

SEQ ID NO: 272975 - DNA, 20 bp, Artificial Sequence
  Description of Artificial Sequence: Synthetic oligonucleotide
  Target: ATXN1; (+) strand; PAM type: YTN; PAM sequence: TTC
tctctcaatgaggggcctgc

SEQ ID NO: 272976 - DNA, 20 bp, Artificial Sequence
  Description of Artificial Sequence: Synthetic oligonucleotide
  Target: ATXN1; (+) strand; PAM type: YTN; PAM sequence: CTC
tctcaatgaggggcctgcac

SEQ ID NO: 272977 - DNA, 20 bp, Artificial Sequence
  Description of Artificial Sequence: Synthetic oligonucleotide
  Target: ATXN1; (+) strand; PAM type: YTN; PAM sequence: CTC
tcaatgaggggcctgcactc

SEQ ID NO: 272978 - DNA, 20 bp, Artificial Sequence
  Description of Artificial Sequence: Synthetic oligonucleotide
  Target: ATXN1; (+) strand; PAM type: YTN; PAM sequence: CTC
aatgaggggcctgcactccc

SEQ ID NO: 272979 - DNA, 20 bp, Artificial Sequence
  Description of Artificial Sequence: Synthetic oligonucleotide
  Target: ATXN1; (+) strand; PAM type: YTN; PAM sequence: CTG
cactcccaggacagtgtcag

SEQ ID NO: 272980 - DNA, 20 bp, Artificial Sequence
  Description of Artificial Sequence: Synthetic oligonucleotide
  Target: ATXN1; (+) strand; PAM type: YTN; PAM sequence: CTC
ccaggacagtgtcagcatac

SEQ ID NO: 272981 - DNA, 20 bp, Artificial Sequence
  Description of Artificial Sequence: Synthetic oligonucleotide
  Target: ATXN1; (+) strand; PAM type: YTN; PAM sequence: CTT
agcttttcaaatactaaata

SEQ ID NO: 272982 - DNA, 20 bp, Artificial Sequence
  Description of Artificial Sequence: Synthetic oligonucleotide
  Target: ATXN1; (+) strand; PAM type: YTN; PAM sequence: TTA
gcttttcaaatactaaataa

SEQ ID NO: 272983 - DNA, 20 bp, Artificial Sequence
  Description of Artificial Sequence: Synthetic oligonucleotide
  Target: ATXN1; (+) strand; PAM type: YTN; PAM sequence: CTT
ttcaaatactaaataaaaac

SEQ ID NO: 272984 - DNA, 20 bp, Artificial Sequence
  Description of Artificial Sequence: Synthetic oligonucleotide
  Target: ATXN1; (+) strand; PAM type: YTN; PAM sequence: TTT
tcaaatactaaataaaaaca

SEQ ID NO: 272985 - DNA, 20 bp, Artificial Sequence
  Description of Artificial Sequence: Synthetic oligonucleotide
  Target: ATXN1; (+) strand; PAM type: YTN; PAM sequence: TTT
caaatactaaataaaaacaa

SEQ ID NO: 272986 - DNA, 20 bp, Artificial Sequence
  Description of Artificial Sequence: Synthetic oligonucleotide
  Target: ATXN1; (+) strand; PAM type: YTN; PAM sequence: TTC
aaatactaaataaaaacaac

SEQ ID NO: 272987 - DNA, 20 bp, Artificial Sequence
  Description of Artificial Sequence: Synthetic oligonucleotide
  Target: ATXN1; (+) strand; PAM type: YTN; PAM sequence: CTA
aataaaaacaacagcatctc

SEQ ID NO: 272988 - DNA, 20 bp, Artificial Sequence
  Description of Artificial Sequence: Synthetic oligonucleotide
  Target: ATXN1; (+) strand; PAM type: YTN; PAM sequence: CTC
caagttctaagcatttataa

SEQ ID NO: 272989 - DNA, 20 bp, Artificial Sequence
  Description of Artificial Sequence: Synthetic oligonucleotide
  Target: ATXN1; (+) strand; PAM type: YTN; PAM sequence: TTC
taagcatttataaaaggtat

SEQ ID NO: 272990 - DNA, 20 bp, Artificial Sequence
  Description of Artificial Sequence: Synthetic oligonucleotide
  Target: ATXN1; (+) strand; PAM type: YTN; PAM sequence: CTA
agcatttataaaaggtattc

SEQ ID NO: 272991 - DNA, 20 bp, Artificial Sequence
  Description of Artificial Sequence: Synthetic oligonucleotide
  Target: ATXN1; (+) strand; PAM type: YTN; PAM sequence: TTT
ataaaaggtattctctttta

SEQ ID NO: 272992 - DNA, 20 bp, Artificial Sequence
  Description of Artificial Sequence: Synthetic oligonucleotide
  Target: ATXN1; (+) strand; PAM type: YTN; PAM sequence: TTA
taaaaggtattctcttttaa

SEQ ID NO: 272993 - DNA, 20 bp, Artificial Sequence
  Description of Artificial Sequence: Synthetic oligonucleotide
  Target: ATXN1; (+) strand; PAM type: YTN; PAM sequence: TTC
tcttttaaagataaagacaa

SEQ ID NO: 272994 - DNA, 20 bp, Artificial Sequence
  Description of Artificial Sequence: Synthetic oligonucleotide
  Target: ATXN1; (+) strand; PAM type: YTN; PAM sequence: CTC
ttttaaagataaagacaagt

SEQ ID NO: 272995 - DNA, 20 bp, Artificial Sequence
  Description of Artificial Sequence: Synthetic oligonucleotide
  Target: ATXN1; (+) strand; PAM type: YTN; PAM sequence: CTT
ttaaagataaagacaagttt

SEQ ID NO: 272996 - DNA, 20 bp, Artificial Sequence
  Description of Artificial Sequence: Synthetic oligonucleotide
  Target: ATXN1; (+) strand; PAM type: YTN; PAM sequence: TTT
taaagataaagacaagttta

SEQ ID NO: 272997 - DNA, 20 bp, Artificial Sequence
  Description of Artificial Sequence: Synthetic oligonucleotide
  Target: ATXN1; (+) strand; PAM type: YTN; PAM sequence: TTT
aaagataaagacaagtttag

SEQ ID NO: 272998 - DNA, 20 bp, Artificial Sequence
  Description of Artificial Sequence: Synthetic oligonucleotide
  Target: ATXN1; (+) strand; PAM type: YTN; PAM sequence: TTA
aagataaagacaagtttaga

SEQ ID NO: 272999 - DNA, 20 bp, Artificial Sequence
  Description of Artificial Sequence: Synthetic oligonucleotide
  Target: ATXN1; (+) strand; PAM type: YTN; PAM sequence: TTT
agaaggcaggcccctttttt

SEQ ID NO: 273000 - DNA, 20 bp, Artificial Sequence
  Description of Artificial Sequence: Synthetic oligonucleotide
  Target: ATXN1; (+) strand; PAM type: YTN; PAM sequence: TTA
gaaggcaggccccttttttt

SEQ ID NO: 273001 - DNA, 20 bp, Artificial Sequence
  Description of Artificial Sequence: Synthetic oligonucleotide
  Target: ATXN1; (+) strand; PAM type: YTN; PAM sequence: CTT
tttttgtcgcaatcggttaa

SEQ ID NO: 273002 - DNA, 20 bp, Artificial Sequence
  Description of Artificial Sequence: Synthetic oligonucleotide
  Target: ATXN1; (+) strand; PAM type: YTN; PAM sequence: TTT
ttttgtcgcaatcggttaaa

SEQ ID NO: 273003 - DNA, 20 bp, Artificial Sequence
  Description of Artificial Sequence: Synthetic oligonucleotide
  Target: ATXN1; (+) strand; PAM type: YTN; PAM sequence: TTT
tttgtcgcaatcggttaaaa

SEQ ID NO: 273004 - DNA, 20 bp, Artificial Sequence
  Description of Artificial Sequence: Synthetic oligonucleotide
  Target: ATXN1; (+) strand; PAM type: YTN; PAM sequence: TTT
ttgtcgcaatcggttaaaaa

SEQ ID NO: 273005 - DNA, 20 bp, Artificial Sequence
  Description of Artificial Sequence: Synthetic oligonucleotide
  Target: ATXN1; (+) strand; PAM type: YTN; PAM sequence: TTT
tgtcgcaatcggttaaaaag

SEQ ID NO: 273006 - DNA, 20 bp, Artificial Sequence
  Description of Artificial Sequence: Synthetic oligonucleotide
  Target: ATXN1; (+) strand; PAM type: YTN; PAM sequence: TTT
gtcgcaatcggttaaaaagt

SEQ ID NO: 273007 - DNA, 20 bp, Artificial Sequence
  Description of Artificial Sequence: Synthetic oligonucleotide
  Target: ATXN1; (+) strand; PAM type: YTN; PAM sequence: TTG
tcgcaatcggttaaaaagtg

SEQ ID NO: 273008 - DNA, 20 bp, Artificial Sequence
  Description of Artificial Sequence: Synthetic oligonucleotide
  Target: ATXN1; (+) strand; PAM type: YTN; PAM sequence: TTA
aaaagtgaagagaaatagaa

SEQ ID NO: 273009 - DNA, 20 bp, Artificial Sequence
  Description of Artificial Sequence: Synthetic oligonucleotide
  Target: ATXN1; (+) strand; PAM type: YTN; PAM sequence: CTG
aacaaaatatatagcaggct

SEQ ID NO: 273010 - DNA, 20 bp, Artificial Sequence
  Description of Artificial Sequence: Synthetic oligonucleotide
  Target: ATXN1; (+) strand; PAM type: YTN; PAM sequence: CTC
tgtggtctgctttttctaaa

SEQ ID NO: 273011 - DNA, 20 bp, Artificial Sequence
  Description of Artificial Sequence: Synthetic oligonucleotide
  Target: ATXN1; (+) strand; PAM type: YTN; PAM sequence: CTG
tggtctgctttttctaaaag

SEQ ID NO: 273012 - DNA, 20 bp, Artificial Sequence
  Description of Artificial Sequence: Synthetic oligonucleotide
  Target: ATXN1; (+) strand; PAM type: YTN; PAM sequence: CTG
ctttttctaaaagttctgcc

SEQ ID NO: 273013 - DNA, 20 bp, Artificial Sequence
  Description of Artificial Sequence: Synthetic oligonucleotide
  Target: ATXN1; (+) strand; PAM type: YTN; PAM sequence: CTT
tttctaaaagttctgcccac

SEQ ID NO: 273014 - DNA, 20 bp, Artificial Sequence
  Description of Artificial Sequence: Synthetic oligonucleotide
  Target: ATXN1; (+) strand; PAM type: YTN; PAM sequence: TTT
ttctaaaagttctgcccaca

SEQ ID NO: 273015 - DNA, 20 bp, Artificial Sequence
  Description of Artificial Sequence: Synthetic oligonucleotide
  Target: ATXN1; (+) strand; PAM type: YTN; PAM sequence: TTT
tctaaaagttctgcccacag

SEQ ID NO: 273016 - DNA, 20 bp, Artificial Sequence
  Description of Artificial Sequence: Synthetic oligonucleotide
  Target: ATXN1; (+) strand; PAM type: YTN; PAM sequence: TTT
ctaaaagttctgcccacaga

SEQ ID NO: 273017 - DNA, 20 bp, Artificial Sequence
  Description of Artificial Sequence: Synthetic oligonucleotide
  Target: ATXN1; (+) strand; PAM type: YTN; PAM sequence: TTC
taaaagttctgcccacagat

SEQ ID NO: 273018 - DNA, 20 bp, Artificial Sequence
  Description of Artificial Sequence: Synthetic oligonucleotide
  Target: ATXN1; (+) strand; PAM type: YTN; PAM sequence: CTA
aaagttctgcccacagattt

SEQ ID NO: 273019 - DNA, 20 bp, Artificial Sequence
  Description of Artificial Sequence: Synthetic oligonucleotide
  Target: ATXN1; (+) strand; PAM type: YTN; PAM sequence: TTC
tgcccacagattttcagaca

SEQ ID NO: 273020 - DNA, 20 bp, Artificial Sequence
  Description of Artificial Sequence: Synthetic oligonucleotide
  Target: ATXN1; (+) strand; PAM type: YTN; PAM sequence: CTG
cccacagattttcagacacc

SEQ ID NO: 273021 - DNA, 20 bp, Artificial Sequence
  Description of Artificial Sequence: Synthetic oligonucleotide
  Target: ATXN1; (+) strand; PAM type: YTN; PAM sequence: TTT
tcagacaccaacagcaacaa

SEQ ID NO: 273022 - DNA, 20 bp, Artificial Sequence
  Description of Artificial Sequence: Synthetic oligonucleotide
  Target: ATXN1; (+) strand; PAM type: YTN; PAM sequence: TTT
cagacaccaacagcaacaaa

SEQ ID NO: 273023 - DNA, 20 bp, Artificial Sequence
  Description of Artificial Sequence: Synthetic oligonucleotide
  Target: ATXN1; (+) strand; PAM type: YTN; PAM sequence: TTC
agacaccaacagcaacaaac

SEQ ID NO: 273024 - DNA, 20 bp, Artificial Sequence
  Description of Artificial Sequence: Synthetic oligonucleotide
  Target: ATXN1; (+) strand; PAM type: YTN; PAM sequence: TTC
cctccctcctgcaagtgagg

SEQ ID NO: 273025 - DNA, 20 bp, Artificial Sequence
  Description of Artificial Sequence: Synthetic oligonucleotide
  Target: ATXN1; (+) strand; PAM type: YTN; PAM sequence: CTC
cctcctgcaagtgagggtga

SEQ ID NO: 273026 - DNA, 20 bp, Artificial Sequence
  Description of Artificial Sequence: Synthetic oligonucleotide
  Target: ATXN1; (+) strand; PAM type: YTN; PAM sequence: CTC
ctgcaagtgagggtgacagc

SEQ ID NO: 273027 - DNA, 20 bp, Artificial Sequence
  Description of Artificial Sequence: Synthetic oligonucleotide
  Target: ATXN1; (+) strand; PAM type: YTN; PAM sequence: CTG
caagtgagggtgacagccaa

SEQ ID NO: 273028 - DNA, 20 bp, Artificial Sequence
  Description of Artificial Sequence: Synthetic oligonucleotide
  Target: ATXN1; (+) strand; PAM type: YTN; PAM sequence: CTA
cagcaacagaagaatgtact

SEQ ID NO: 273029 - DNA, 20 bp, Artificial Sequence
  Description of Artificial Sequence: Synthetic oligonucleotide
  Target: ATXN1; (+) strand; PAM type: YTN; PAM sequence: CTT
taaaagagagacaggagaat

SEQ ID NO: 273030 - DNA, 20 bp, Artificial Sequence
  Description of Artificial Sequence: Synthetic oligonucleotide
  Target: ATXN1; (+) strand; PAM type: YTN; PAM sequence: TTT
aaaagagagacaggagaatg

SEQ ID NO: 273031 - DNA, 20 bp, Artificial Sequence
  Description of Artificial Sequence: Synthetic oligonucleotide
  Target: ATXN1; (+) strand; PAM type: YTN; PAM sequence: TTA
aaagagagacaggagaatgg

SEQ ID NO: 273032 - DNA, 20 bp, Artificial Sequence
  Description of Artificial Sequence: Synthetic oligonucleotide
  Target: ATXN1; (+) strand; PAM type: YTN; PAM sequence: CTT
agaccctctacctgccatca

SEQ ID NO: 273033 - DNA, 20 bp, Artificial Sequence
  Description of Artificial Sequence: Synthetic oligonucleotide
  Target: ATXN1; (+) strand; PAM type: YTN; PAM sequence: TTA
gaccctctacctgccatcac

SEQ ID NO: 273034 - DNA, 20 bp, Artificial Sequence
  Description of Artificial Sequence: Synthetic oligonucleotide
  Target: ATXN1; (+) strand; PAM type: YTN; PAM sequence: CTC
tacctgccatcaccatcacc

SEQ ID NO: 273035 - DNA, 20 bp, Artificial Sequence
  Description of Artificial Sequence: Synthetic oligonucleotide
  Target: ATXN1; (+) strand; PAM type: YTN; PAM sequence: CTA
cctgccatcaccatcacctc

SEQ ID NO: 273036 - DNA, 20 bp, Artificial Sequence
  Description of Artificial Sequence: Synthetic oligonucleotide
  Target: ATXN1; (+) strand; PAM type: YTN; PAM sequence: CTG
ccatcaccatcacctcctaa

SEQ ID NO: 273037 - DNA, 20 bp, Artificial Sequence
  Description of Artificial Sequence: Synthetic oligonucleotide
  Target: ATXN1; (+) strand; PAM type: YTN; PAM sequence: CTC
ctaaccagaaatgacaacaa

SEQ ID NO: 273038 - DNA, 20 bp, Artificial Sequence
  Description of Artificial Sequence: Synthetic oligonucleotide
  Target: ATXN1; (+) strand; PAM type: YTN; PAM sequence: CTA
accagaaatgacaacaagca

SEQ ID NO: 273039 - DNA, 20 bp, Artificial Sequence
  Description of Artificial Sequence: Synthetic oligonucleotide
  Target: ATXN1; (+) strand; PAM type: YTN; PAM sequence: CTT
tctaggaatttgttagtggc

SEQ ID NO: 273040 - DNA, 20 bp, Artificial Sequence
  Description of Artificial Sequence: Synthetic oligonucleotide
  Target: ATXN1; (+) strand; PAM type: YTN; PAM sequence: TTT
ctaggaatttgttagtggct

SEQ ID NO: 273041 - DNA, 20 bp, Artificial Sequence
  Description of Artificial Sequence: Synthetic oligonucleotide
  Target: ATXN1; (+) strand; PAM type: YTN; PAM sequence: TTC
taggaatttgttagtggctg

SEQ ID NO: 273042 - DNA, 20 bp, Artificial Sequence
  Description of Artificial Sequence: Synthetic oligonucleotide
  Target: ATXN1; (+) strand; PAM type: YTN; PAM sequence: CTA
ggaatttgttagtggctgtg

SEQ ID NO: 273043 - DNA, 20 bp, Artificial Sequence
  Description of Artificial Sequence: Synthetic oligonucleotide
  Target: ATXN1; (+) strand; PAM type: YTN; PAM sequence: TTT
gttagtggctgtgatcatgt

SEQ ID NO: 273044 - DNA, 20 bp, Artificial Sequence
  Description of Artificial Sequence: Synthetic oligonucleotide
  Target: ATXN1; (+) strand; PAM type: YTN; PAM sequence: TTG
ttagtggctgtgatcatgtg

SEQ ID NO: 273045 - DNA, 20 bp, Artificial Sequence
  Description of Artificial Sequence: Synthetic oligonucleotide
  Target: ATXN1; (+) strand; PAM type: YTN; PAM sequence: TTA
gtggctgtgatcatgtgtcc

SEQ ID NO: 273046 - DNA, 20 bp, Artificial Sequence
  Description of Artificial Sequence: Synthetic oligonucleotide
  Target: ATXN1; (+) strand; PAM type: YTN; PAM sequence: CTG
tgatcatgtgtccttcttgc

SEQ ID NO: 273047 - DNA, 20 bp, Artificial Sequence
  Description of Artificial Sequence: Synthetic oligonucleotide
  Target: ATXN1; (+) strand; PAM type: YTN; PAM sequence: CTT
cttgcactcacgtttctctt

SEQ ID NO: 273048 - DNA, 20 bp, Artificial Sequence
  Description of Artificial Sequence: Synthetic oligonucleotide
  Target: ATXN1; (+) strand; PAM type: YTN; PAM sequence: TTC
ttgcactcacgtttctcttt

SEQ ID NO: 273049 - DNA, 20 bp, Artificial Sequence
  Description of Artificial Sequence: Synthetic oligonucleotide
  Target: ATXN1; (+) strand; PAM type: YTN; PAM sequence: CTT
gcactcacgtttctcttttg

SEQ ID NO: 273050 - DNA, 20 bp, Artificial Sequence
  Description of Artificial Sequence: Synthetic oligonucleotide
  Target: ATXN1; (+) strand; PAM type: YTN; PAM sequence: TTG
cactcacgtttctcttttga

SEQ ID NO: 273051 - DNA, 20 bp, Artificial Sequence
  Description of Artificial Sequence: Synthetic oligonucleotide
  Target: ATXN1; (+) strand; PAM type: YTN; PAM sequence: CTC
acgtttctcttttgaccaaa

SEQ ID NO: 273052 - DNA, 20 bp, Artificial Sequence
  Description of Artificial Sequence: Synthetic oligonucleotide
  Target: ATXN1; (+) strand; PAM type: YTN; PAM sequence: TTT
ctcttttgaccaaatattat

SEQ ID NO: 273053 - DNA, 20 bp, Artificial Sequence
  Description of Artificial Sequence: Synthetic oligonucleotide
  Target: ATXN1; (+) strand; PAM type: YTN; PAM sequence: TTC
tcttttgaccaaatattatt

SEQ ID NO: 273054 - DNA, 20 bp, Artificial Sequence
  Description of Artificial Sequence: Synthetic oligonucleotide
  Target: ATXN1; (+) strand; PAM type: YTN; PAM sequence: CTC
ttttgaccaaatattattta

SEQ ID NO: 273055 - DNA, 20 bp, Artificial Sequence
  Description of Artificial Sequence: Synthetic oligonucleotide
  Target: ATXN1; (+) strand; PAM type: YTN; PAM sequence: CTT
ttgaccaaatattatttagt

SEQ ID NO: 273056 - DNA, 20 bp, Artificial Sequence
  Description of Artificial Sequence: Synthetic oligonucleotide
  Target: ATXN1; (+) strand; PAM type: YTN; PAM sequence: TTT
tgaccaaatattatttagta

SEQ ID NO: 273057 - DNA, 20 bp, Artificial Sequence
  Description of Artificial Sequence: Synthetic oligonucleotide
  Target: ATXN1; (+) strand; PAM type: YTN; PAM sequence: TTT
gaccaaatattatttagtaa

SEQ ID NO: 273058 - DNA, 20 bp, Artificial Sequence
  Description of Artificial Sequence: Synthetic oligonucleotide
  Target: ATXN1; (+) strand; PAM type: YTN; PAM sequence: TTG
accaaatattatttagtaag

SEQ ID NO: 273059 - DNA, 20 bp, Artificial Sequence
  Description of Artificial Sequence: Synthetic oligonucleotide
  Target: ATXN1; (+) strand; PAM type: YTN; PAM sequence: TTA
tttagtaagatgtggttgag

SEQ ID NO: 273060 - DNA, 20 bp, Artificial Sequence
  Description of Artificial Sequence: Synthetic oligonucleotide
  Target: ATXN1; (+) strand; PAM type: YTN; PAM sequence: TTT
agtaagatgtggttgagtgg

SEQ ID NO: 273061 - DNA, 20 bp, Artificial Sequence
  Description of Artificial Sequence: Synthetic oligonucleotide
  Target: ATXN1; (+) strand; PAM type: YTN; PAM sequence: TTA
gtaagatgtggttgagtggc

SEQ ID NO: 273062 - DNA, 20 bp, Artificial Sequence
  Description of Artificial Sequence: Synthetic oligonucleotide
  Target: ATXN1; (+) strand; PAM type: YTN; PAM sequence: TTG
agtggcccctgggaatcacc

SEQ ID NO: 273063 - DNA, 20 bp, Artificial Sequence
  Description of Artificial Sequence: Synthetic oligonucleotide
  Target: ATXN1; (+) strand; PAM type: YTN; PAM sequence: CTG
ggaatcaccattgaaacaga

SEQ ID NO: 273064 - DNA, 20 bp, Artificial Sequence
  Description of Artificial Sequence: Synthetic oligonucleotide
  Target: ATXN1; (+) strand; PAM type: YTN; PAM sequence: TTG
aaacagaaggctttctaagt

SEQ ID NO: 273065 - DNA, 20 bp, Artificial Sequence
  Description of Artificial Sequence: Synthetic oligonucleotide
  Target: ATXN1; (+) strand; PAM type: YTN; PAM sequence: CTT
tctaagtaaaatatctgttc

SEQ ID NO: 273066 - DNA, 20 bp, Artificial Sequence
  Description of Artificial Sequence: Synthetic oligonucleotide
  Target: ATXN1; (+) strand; PAM type: YTN; PAM sequence: TTT
ctaagtaaaatatctgttca

SEQ ID NO: 273067 - DNA, 20 bp, Artificial Sequence
  Description of Artificial Sequence: Synthetic oligonucleotide
  Target: ATXN1; (+) strand; PAM type: YTN; PAM sequence: TTC
taagtaaaatatctgttcag

SEQ ID NO: 273068 - DNA, 20 bp, Artificial Sequence
  Description of Artificial Sequence: Synthetic oligonucleotide
  Target: ATXN1; (+) strand; PAM type: YTN; PAM sequence: CTA
agtaaaatatctgttcagta

SEQ ID NO: 273069 - DNA, 20 bp, Artificial Sequence
  Description of Artificial Sequence: Synthetic oligonucleotide
  Target: ATXN1; (+) strand; PAM type: YTN; PAM sequence: CTG
ttcagtatctgttcttgcag

SEQ ID NO: 273070 - DNA, 20 bp, Artificial Sequence
  Description of Artificial Sequence: Synthetic oligonucleotide
  Target: ATXN1; (+) strand; PAM type: YTN; PAM sequence: TTC
agtatctgttcttgcagtgc

SEQ ID NO: 273071 - DNA, 20 bp, Artificial Sequence
  Description of Artificial Sequence: Synthetic oligonucleotide
  Target: ATXN1; (+) strand; PAM type: YTN; PAM sequence: CTG
ttcttgcagtgcaaagcaca

SEQ ID NO: 273072 - DNA, 20 bp, Artificial Sequence
  Description of Artificial Sequence: Synthetic oligonucleotide
  Target: ATXN1; (+) strand; PAM type: YTN; PAM sequence: TTC
ttgcagtgcaaagcacattt

SEQ ID NO: 273073 - DNA, 20 bp, Artificial Sequence
  Description of Artificial Sequence: Synthetic oligonucleotide
  Target: ATXN1; (+) strand; PAM type: YTN; PAM sequence: CTT
gcagtgcaaagcacatttca

SEQ ID NO: 273074 - DNA, 20 bp, Artificial Sequence
  Description of Artificial Sequence: Synthetic oligonucleotide
  Target: ATXN1; (+) strand; PAM type: YTN; PAM sequence: TTG
cagtgcaaagcacatttcaa

SEQ ID NO: 273075 - DNA, 20 bp, Artificial Sequence
  Description of Artificial Sequence: Synthetic oligonucleotide
  Target: ATXN1; (+) strand; PAM type: YTN; PAM sequence: TTT
caaaagttcagccaacggct

SEQ ID NO: 273076 - DNA, 20 bp, Artificial Sequence
  Description of Artificial Sequence: Synthetic oligonucleotide
  Target: ATXN1; (+) strand; PAM type: YTN; PAM sequence: TTC
aaaagttcagccaacggcta

SEQ ID NO: 273077 - DNA, 20 bp, Artificial Sequence
  Description of Artificial Sequence: Synthetic oligonucleotide
  Target: ATXN1; (+) strand; PAM type: YTN; PAM sequence: TTC
agccaacggctaggaaaatg

SEQ ID NO: 273078 - DNA, 20 bp, Artificial Sequence
  Description of Artificial Sequence: Synthetic oligonucleotide
  Target: ATXN1; (+) strand; PAM type: YTN; PAM sequence: CTA
ggaaaatgtttggggcacgc

SEQ ID NO: 273079 - DNA, 20 bp, Artificial Sequence
  Description of Artificial Sequence: Synthetic oligonucleotide
  Target: ATXN1; (+) strand; PAM type: YTN; PAM sequence: TTT
ggggcacgcagaatcccttc

SEQ ID NO: 273080 - DNA, 20 bp, Artificial Sequence
  Description of Artificial Sequence: Synthetic oligonucleotide
  Target: ATXN1; (+) strand; PAM type: YTN; PAM sequence: TTG
gggcacgcagaatcccttct

SEQ ID NO: 273081 - DNA, 20 bp, Artificial Sequence
  Description of Artificial Sequence: Synthetic oligonucleotide
  Target: ATXN1; (+) strand; PAM type: YTN; PAM sequence: CTT
ctacgccaacagaactaatc

SEQ ID NO: 273082 - DNA, 20 bp, Artificial Sequence
  Description of Artificial Sequence: Synthetic oligonucleotide
  Target: ATXN1; (+) strand; PAM type: YTN; PAM sequence: TTC
tacgccaacagaactaatct

SEQ ID NO: 273083 - DNA, 20 bp, Artificial Sequence
  Description of Artificial Sequence: Synthetic oligonucleotide
  Target: ATXN1; (+) strand; PAM type: YTN; PAM sequence: CTA
cgccaacagaactaatctca

SEQ ID NO: 273084 - DNA, 20 bp, Artificial Sequence
  Description of Artificial Sequence: Synthetic oligonucleotide
  Target: ATXN1; (+) strand; PAM type: YTN; PAM sequence: CTA
atctcatgtatgcatttttc

SEQ ID NO: 273085 - DNA, 20 bp, Artificial Sequence
  Description of Artificial Sequence: Synthetic oligonucleotide
  Target: ATXN1; (+) strand; PAM type: YTN; PAM sequence: CTC
atgtatgcatttttcagctc

SEQ ID NO: 273086 - DNA, 20 bp, Artificial Sequence
  Description of Artificial Sequence: Synthetic oligonucleotide
  Target: ATXN1; (+) strand; PAM type: YTN; PAM sequence: TTT
ttcagctcctgagttgagaa

SEQ ID NO: 273087 - DNA, 20 bp, Artificial Sequence
  Description of Artificial Sequence: Synthetic oligonucleotide
  Target: ATXN1; (+) strand; PAM type: YTN; PAM sequence: TTT
tcagctcctgagttgagaag

SEQ ID NO: 273088 - DNA, 20 bp, Artificial Sequence
  Description of Artificial Sequence: Synthetic oligonucleotide
  Target: ATXN1; (+) strand; PAM type: YTN; PAM sequence: TTT
cagctcctgagttgagaaga

SEQ ID NO: 273089 - DNA, 20 bp, Artificial Sequence
  Description of Artificial Sequence: Synthetic oligonucleotide
  Target: ATXN1; (+) strand; PAM type: YTN; PAM sequence: TTC
agctcctgagttgagaagac

SEQ ID NO: 273090 - DNA, 20 bp, Artificial Sequence
  Description of Artificial Sequence: Synthetic oligonucleotide
  Target: ATXN1; (+) strand; PAM type: YTN; PAM sequence: CTC
ctgagttgagaagacatatt

SEQ ID NO: 273091 - DNA, 20 bp, Artificial Sequence
  Description of Artificial Sequence: Synthetic oligonucleotide
  Target: ATXN1; (+) strand; PAM type: YTN; PAM sequence: CTG
agttgagaagacatattaaa

SEQ ID NO: 273092 - DNA, 20 bp, Artificial Sequence
  Description of Artificial Sequence: Synthetic oligonucleotide
  Target: ATXN1; (+) strand; PAM type: YTN; PAM sequence: TTG
agaagacatattaaaaaccc

SEQ ID NO: 273093 - DNA, 20 bp, Artificial Sequence
  Description of Artificial Sequence: Synthetic oligonucleotide
  Target: ATXN1; (+) strand; PAM type: YTN; PAM sequence: TTA
aaaacccagcaacatgttta

SEQ ID NO: 273094 - DNA, 20 bp, Artificial Sequence
  Description of Artificial Sequence: Synthetic oligonucleotide
  Target: ATXN1; (+) strand; PAM type: YTN; PAM sequence: TTT
atcttcattaaacagcaaat

SEQ ID NO: 273095 - DNA, 20 bp, Artificial Sequence
  Description of Artificial Sequence: Synthetic oligonucleotide
  Target: ATXN1; (+) strand; PAM type: YTN; PAM sequence: TTA
tcttcattaaacagcaaatg

SEQ ID NO: 273096 - DNA, 20 bp, Artificial Sequence
  Description of Artificial Sequence: Synthetic oligonucleotide
  Target: ATXN1; (+) strand; PAM type: YTN; PAM sequence: CTT
cattaaacagcaaatgtcct

SEQ ID NO: 273097 - DNA, 20 bp, Artificial Sequence
  Description of Artificial Sequence: Synthetic oligonucleotide
  Target: ATXN1; (+) strand; PAM type: YTN; PAM sequence: TTC
attaaacagcaaatgtcctt

SEQ ID NO: 273098 - DNA, 20 bp, Artificial Sequence
  Description of Artificial Sequence: Synthetic oligonucleotide
  Target: ATXN1; (+) strand; PAM type: YTN; PAM sequence: TTA
aacagcaaatgtcctttcaa

SEQ ID NO: 273099 - DNA, 20 bp, Artificial Sequence
  Description of Artificial Sequence: Synthetic oligonucleotide
  Target: ATXN1; (+) strand; PAM type: YTN; PAM sequence: CTT
tcaaacaatatacaacaggg

SEQ ID NO: 273100 - DNA, 20 bp, Artificial Sequence
  Description of Artificial Sequence: Synthetic oligonucleotide
  Target: ATXN1; (+) strand; PAM type: YTN; PAM sequence: TTT
caaacaatatacaacagggc

SEQ ID NO: 273101 - DNA, 20 bp, Artificial Sequence
  Description of Artificial Sequence: Synthetic oligonucleotide
  Target: ATXN1; (+) strand; PAM type: YTN; PAM sequence: TTC
aaacaatatacaacagggca

SEQ ID NO: 273102 - DNA, 20 bp, Artificial Sequence
  Description of Artificial Sequence: Synthetic oligonucleotide
  Target: ATXN1; (+) strand; PAM type: YTN; PAM sequence: CTG
tttgtgctaatggaaagtga

SEQ ID NO: 273103 - DNA, 20 bp, Artificial Sequence
  Description of Artificial Sequence: Synthetic oligonucleotide
  Target: ATXN1; (+) strand; PAM type: YTN; PAM sequence: TTT
gtgctaatggaaagtgatca

SEQ ID NO: 273104 - DNA, 20 bp, Artificial Sequence
  Description of Artificial Sequence: Synthetic oligonucleotide
  Target: ATXN1; (+) strand; PAM type: YTN; PAM sequence: TTG
tgctaatggaaagtgatcaa

SEQ ID NO: 273105 - DNA, 20 bp, Artificial Sequence
  Description of Artificial Sequence: Synthetic oligonucleotide
  Target: ATXN1; (+) strand; PAM type: YTN; PAM sequence: CTA
atggaaagtgatcaaaagcc

SEQ ID NO: 273106 - DNA, 20 bp, Artificial Sequence
  Description of Artificial Sequence: Synthetic oligonucleotide
  Target: ATXN1; (+) strand; PAM type: YTN; PAM sequence: TTC
tttggttagctgactctgaa

SEQ ID NO: 273107 - DNA, 20 bp, Artificial Sequence
  Description of Artificial Sequence: Synthetic oligonucleotide
  Target: ATXN1; (+) strand; PAM type: YTN; PAM sequence: CTT
tggttagctgactctgaagc

SEQ ID NO: 273108 - DNA, 20 bp, Artificial Sequence
  Description of Artificial Sequence: Synthetic oligonucleotide
  Target: ATXN1; (+) strand; PAM type: YTN; PAM sequence: TTT
ggttagctgactctgaagcc

SEQ ID NO: 273109 - DNA, 20 bp, Artificial Sequence
  Description of Artificial Sequence: Synthetic oligonucleotide
  Target: ATXN1; (+) strand; PAM type: YTN; PAM sequence: TTG
gttagctgactctgaagcct

SEQ ID NO: 273110 - DNA, 20 bp, Artificial Sequence
  Description of Artificial Sequence: Synthetic oligonucleotide
  Target: ATXN1; (+) strand; PAM type: YTN; PAM sequence: TTA
gctgactctgaagcctgctc

SEQ ID NO: 273111 - DNA, 20 bp, Artificial Sequence
  Description of Artificial Sequence: Synthetic oligonucleotide
  Target: ATXN1; (+) strand; PAM type: YTN; PAM sequence: CTG
actctgaagcctgctcgtgc

SEQ ID NO: 273112 - DNA, 20 bp, Artificial Sequence
  Description of Artificial Sequence: Synthetic oligonucleotide
  Target: ATXN1; (+) strand; PAM type: YTN; PAM sequence: CTC
tgaagcctgctcgtgcttga

SEQ ID NO: 273113 - DNA, 20 bp, Artificial Sequence
  Description of Artificial Sequence: Synthetic oligonucleotide
  Target: ATXN1; (+) strand; PAM type: YTN; PAM sequence: CTG
aagcctgctcgtgcttgagt

SEQ ID NO: 273114 - DNA, 20 bp, Artificial Sequence
  Description of Artificial Sequence: Synthetic oligonucleotide
  Target: ATXN1; (+) strand; PAM type: YTN; PAM sequence: CTG
ctcgtgcttgagtttctaca

SEQ ID NO: 273115 - DNA, 20 bp, Artificial Sequence
  Description of Artificial Sequence: Synthetic oligonucleotide
  Target: ATXN1; (+) strand; PAM type: YTN; PAM sequence: CTC
gtgcttgagtttctacacaa

SEQ ID NO: 273116 - DNA, 20 bp, Artificial Sequence
  Description of Artificial Sequence: Synthetic oligonucleotide
  Target: ATXN1; (+) strand; PAM type: YTN; PAM sequence: CTT
gagtttctacacaaagtaca

SEQ ID NO: 273117 - DNA, 20 bp, Artificial Sequence
  Description of Artificial Sequence: Synthetic oligonucleotide
  Target: ATXN1; (+) strand; PAM type: YTN; PAM sequence: TTG
agtttctacacaaagtacat

SEQ ID NO: 273118 - DNA, 20 bp, Artificial Sequence
  Description of Artificial Sequence: Synthetic oligonucleotide
  Target: ATXN1; (+) strand; PAM type: YTN; PAM sequence: TTT
ctacacaaagtacatcaaaa

SEQ ID NO: 273119 - DNA, 20 bp, Artificial Sequence
  Description of Artificial Sequence: Synthetic oligonucleotide
  Target: ATXN1; (+) strand; PAM type: YTN; PAM sequence: TTC
tacacaaagtacatcaaaag

SEQ ID NO: 273120 - DNA, 20 bp, Artificial Sequence
  Description of Artificial Sequence: Synthetic oligonucleotide
  Target: ATXN1; (+) strand; PAM type: YTN; PAM sequence: CTA
cacaaagtacatcaaaagaa

SEQ ID NO: 273121 - DNA, 20 bp, Artificial Sequence
  Description of Artificial Sequence: Synthetic oligonucleotide
  Target: ATXN1; (+) strand; PAM type: YTN; PAM sequence: CTG
gagattctaaatgtttaaag

SEQ ID NO: 273122 - DNA, 20 bp, Artificial Sequence
  Description of Artificial Sequence: Synthetic oligonucleotide
  Target: ATXN1; (+) strand; PAM type: YTN; PAM sequence: TTC
taaatgtttaaagtctctag

SEQ ID NO: 273123 - DNA, 20 bp, Artificial Sequence
  Description of Artificial Sequence: Synthetic oligonucleotide
  Target: ATXN1; (+) strand; PAM type: YTN; PAM sequence: CTA
aatgtttaaagtctctagga

SEQ ID NO: 273124 - DNA, 20 bp, Artificial Sequence
  Description of Artificial Sequence: Synthetic oligonucleotide
  Target: ATXN1; (+) strand; PAM type: YTN; PAM sequence: TTT
aaagtctctaggactagcaa

SEQ ID NO: 273125 - DNA, 20 bp, Artificial Sequence
  Description of Artificial Sequence: Synthetic oligonucleotide
  Target: ATXN1; (+) strand; PAM type: YTN; PAM sequence: TTA
aagtctctaggactagcaag

SEQ ID NO: 273126 - DNA, 20 bp, Artificial Sequence
  Description of Artificial Sequence: Synthetic oligonucleotide
  Target: ATXN1; (+) strand; PAM type: YTN; PAM sequence: CTC
taggactagcaagaaaatat

SEQ ID NO: 273127 - DNA, 20 bp, Artificial Sequence
  Description of Artificial Sequence: Synthetic oligonucleotide
  Target: ATXN1; (+) strand; PAM type: YTN; PAM sequence: CTA
ggactagcaagaaaatatgc

SEQ ID NO: 273128 - DNA, 20 bp, Artificial Sequence
  Description of Artificial Sequence: Synthetic oligonucleotide
  Target: ATXN1; (+) strand; PAM type: YTN; PAM sequence: CTA
gcaagaaaatatgcttgaaa

SEQ ID NO: 273129 - DNA, 20 bp, Artificial Sequence
  Description of Artificial Sequence: Synthetic oligonucleotide
  Target: ATXN1; (+) strand; PAM type: YTN; PAM sequence: CTT
gaaactataggaaatgggga

SEQ ID NO: 273130 - DNA, 20 bp, Artificial Sequence
  Description of Artificial Sequence: Synthetic oligonucleotide
  Target: ATXN1; (+) strand; PAM type: YTN; PAM sequence: TTG
aaactataggaaatggggaa

SEQ ID NO: 273131 - DNA, 20 bp, Artificial Sequence
  Description of Artificial Sequence: Synthetic oligonucleotide
  Target: ATXN1; (+) strand; PAM type: YTN; PAM sequence: CTA
taggaaatggggaacagaac

SEQ ID NO: 273132 - DNA, 20 bp, Artificial Sequence
  Description of Artificial Sequence: Synthetic oligonucleotide
  Target: ATXN1; (+) strand; PAM type: YTN; PAM sequence: TTA
ctgttgacttccaccttttc

SEQ ID NO: 273133 - DNA, 20 bp, Artificial Sequence
  Description of Artificial Sequence: Synthetic oligonucleotide
  Target: ATXN1; (+) strand; PAM type: YTN; PAM sequence: CTG
ttgacttccaccttttccct

SEQ ID NO: 273134 - DNA, 20 bp, Artificial Sequence
  Description of Artificial Sequence: Synthetic oligonucleotide
  Target: ATXN1; (+) strand; PAM type: YTN; PAM sequence: TTG
acttccaccttttccctgta

SEQ ID NO: 273135 - DNA, 20 bp, Artificial Sequence
  Description of Artificial Sequence: Synthetic oligonucleotide
  Target: ATXN1; (+) strand; PAM type: YTN; PAM sequence: CTT
ccaccttttccctgtaacac

SEQ ID NO: 273136 - DNA, 20 bp, Artificial Sequence
  Description of Artificial Sequence: Synthetic oligonucleotide
  Target: ATXN1; (+) strand; PAM type: YTN; PAM sequence: TTC
caccttttccctgtaacaca

SEQ ID NO: 273137 - DNA, 20 bp, Artificial Sequence
  Description of Artificial Sequence: Synthetic oligonucleotide
  Target: ATXN1; (+) strand; PAM type: YTN; PAM sequence: CTT
ttccctgtaacacaatacat

SEQ ID NO: 273138 - DNA, 20 bp, Artificial Sequence
  Description of Artificial Sequence: Synthetic oligonucleotide
  Target: ATXN1; (+) strand; PAM type: YTN; PAM sequence: TTT
tccctgtaacacaatacatt

SEQ ID NO: 273139 - DNA, 20 bp, Artificial Sequence
  Description of Artificial Sequence: Synthetic oligonucleotide
  Target: ATXN1; (+) strand; PAM type: YTN; PAM sequence: TTT
ccctgtaacacaatacatta

SEQ ID NO: 273140 - DNA, 20 bp, Artificial Sequence
  Description of Artificial Sequence: Synthetic oligonucleotide
  Target: ATXN1; (+) strand; PAM type: YTN; PAM sequence: TTC
cctgtaacacaatacattac

SEQ ID NO: 273141 - DNA, 20 bp, Artificial Sequence
  Description of Artificial Sequence: Synthetic oligonucleotide
  Target: ATXN1; (+) strand; PAM type: YTN; PAM sequence: CTG
taacacaatacattacaatc

SEQ ID NO: 273142 - DNA, 20 bp, Artificial Sequence
  Description of Artificial Sequence: Synthetic oligonucleotide
  Target: ATXN1; (+) strand; PAM type: YTN; PAM sequence: TTA
caatctataaatagcttagg

SEQ ID NO: 273143 - DNA, 20 bp, Artificial Sequence
  Description of Artificial Sequence: Synthetic oligonucleotide
  Target: ATXN1; (+) strand; PAM type: YTN; PAM sequence: CTA
taaatagcttaggctgtctg

SEQ ID NO: 273144 - DNA, 20 bp, Artificial Sequence
  Description of Artificial Sequence: Synthetic oligonucleotide
  Target: ATXN1; (+) strand; PAM type: YTN; PAM sequence: CTT
aggctgtctgtttaaatatg

SEQ ID NO: 273145 - DNA, 20 bp, Artificial Sequence
  Description of Artificial Sequence: Synthetic oligonucleotide
  Target: ATXN1; (+) strand; PAM type: YTN; PAM sequence: TTA
ggctgtctgtttaaatatgc

SEQ ID NO: 273146 - DNA, 20 bp, Artificial Sequence
  Description of Artificial Sequence: Synthetic oligonucleotide
  Target: ATXN1; (+) strand; PAM type: YTN; PAM sequence: CTG
tctgtttaaatatgcacctc

SEQ ID NO: 273147 - DNA, 20 bp, Artificial Sequence
  Description of Artificial Sequence: Synthetic oligonucleotide
  Target: ATXN1; (+) strand; PAM type: YTN; PAM sequence: CTG
tttaaatatgcacctccccc

SEQ ID NO: 273148 - DNA, 20 bp, Artificial Sequence
  Description of Artificial Sequence: Synthetic oligonucleotide
  Target: ATXN1; (+) strand; PAM type: YTN; PAM sequence: TTT
aaatatgcacctcccccgga

SEQ ID NO: 273149 - DNA, 20 bp, Artificial Sequence
  Description of Artificial Sequence: Synthetic oligonucleotide
  Target: ATXN1; (+) strand; PAM type: YTN; PAM sequence: TTA
aatatgcacctcccccggaa

SEQ ID NO: 273150 - DNA, 20 bp, Artificial Sequence
  Description of Artificial Sequence: Synthetic oligonucleotide
  Target: ATXN1; (+) strand; PAM type: YTN; PAM sequence: CTC
ccccggaaaagatagaggct

SEQ ID NO: 273151 - DNA, 20 bp, Artificial Sequence
  Description of Artificial Sequence: Synthetic oligonucleotide
  Target: ATXN1; (+) strand; PAM type: YTN; PAM sequence: CTT
ccgatcatcttgctatttgc

SEQ ID NO: 273152 - DNA, 20 bp, Artificial Sequence
  Description of Artificial Sequence: Synthetic oligonucleotide
  Target: ATXN1; (+) strand; PAM type: YTN; PAM sequence: TTC
cgatcatcttgctatttgca

SEQ ID NO: 273153 - DNA, 20 bp, Artificial Sequence
  Description of Artificial Sequence: Synthetic oligonucleotide
  Target: ATXN1; (+) strand; PAM type: YTN; PAM sequence: CTT
gctatttgcaaggaatctta

SEQ ID NO: 273154 - DNA, 20 bp, Artificial Sequence
  Description of Artificial Sequence: Synthetic oligonucleotide
  Target: ATXN1; (+) strand; PAM type: YTN; PAM sequence: TTG
ctatttgcaaggaatcttac

SEQ ID NO: 273155 - DNA, 20 bp, Artificial Sequence
  Description of Artificial Sequence: Synthetic oligonucleotide
  Target: ATXN1; (+) strand; PAM type: YTN; PAM sequence: CTA
tttgcaaggaatcttactca

SEQ ID NO: 273156 - DNA, 20 bp, Artificial Sequence
  Description of Artificial Sequence: Synthetic oligonucleotide
  Target: ATXN1; (+) strand; PAM type: YTN; PAM sequence: TTT
gcaaggaatcttactcacaa

SEQ ID NO: 273157 - DNA, 20 bp, Artificial Sequence
  Description of Artificial Sequence: Synthetic oligonucleotide
  Target: ATXN1; (+) strand; PAM type: YTN; PAM sequence: TTG
caaggaatcttactcacaaa

SEQ ID NO: 273158 - DNA, 20 bp, Artificial Sequence
  Description of Artificial Sequence: Synthetic oligonucleotide
  Target: ATXN1; (+) strand; PAM type: YTN; PAM sequence: CTT
actcacaaatcaatctaaca

SEQ ID NO: 273159 - DNA, 20 bp, Artificial Sequence
  Description of Artificial Sequence: Synthetic oligonucleotide
  Target: ATXN1; (+) strand; PAM type: YTN; PAM sequence: TTA
ctcacaaatcaatctaacag

SEQ ID NO: 273160 - DNA, 20 bp, Artificial Sequence
  Description of Artificial Sequence: Synthetic oligonucleotide
  Target: ATXN1; (+) strand; PAM type: YTN; PAM sequence: CTC
acaaatcaatctaacaggcc

SEQ ID NO: 273161 - DNA, 20 bp, Artificial Sequence
  Description of Artificial Sequence: Synthetic oligonucleotide
  Target: ATXN1; (+) strand; PAM type: YTN; PAM sequence: CTA
acaggccacggtgatattat

SEQ ID NO: 273162 - DNA, 20 bp, Artificial Sequence
  Description of Artificial Sequence: Synthetic oligonucleotide
  Target: ATXN1; (+) strand; PAM type: YTN; PAM sequence: TTA
tggggatgtaaaagggactg

SEQ ID NO: 273163 - DNA, 20 bp, Artificial Sequence
  Description of Artificial Sequence: Synthetic oligonucleotide
  Target: ATXN1; (+) strand; PAM type: YTN; PAM sequence: CTG
aaatgatcaagagcgtcacg

SEQ ID NO: 273164 - DNA, 20 bp, Artificial Sequence
  Description of Artificial Sequence: Synthetic oligonucleotide
  Target: ATXN1; (+) strand; PAM type: YTN; PAM sequence: CTT
ccaagccaagtggggtccta

SEQ ID NO: 273165 - DNA, 20 bp, Artificial Sequence
  Description of Artificial Sequence: Synthetic oligonucleotide
  Target: ATXN1; (+) strand; PAM type: YTN; PAM sequence: TTC
caagccaagtggggtcctat

SEQ ID NO: 273166 - DNA, 20 bp, Artificial Sequence
  Description of Artificial Sequence: Synthetic oligonucleotide
  Target: ATXN1; (+) strand; PAM type: YTN; PAM sequence: CTA
tgccttgctggtttgaagaa

SEQ ID NO: 273167 - DNA, 20 bp, Artificial Sequence
  Description of Artificial Sequence: Synthetic oligonucleotide
  Target: ATXN1; (+) strand; PAM type: YTN; PAM sequence: CTT
gctggtttgaagaagtggga

SEQ ID NO: 273168 - DNA, 20 bp, Artificial Sequence
  Description of Artificial Sequence: Synthetic oligonucleotide
  Target: ATXN1; (+) strand; PAM type: YTN; PAM sequence: TTG
ctggtttgaagaagtgggag

SEQ ID NO: 273169 - DNA, 20 bp, Artificial Sequence
  Description of Artificial Sequence: Synthetic oligonucleotide
  Target: ATXN1; (+) strand; PAM type: YTN; PAM sequence: CTG
gtttgaagaagtgggagaaa

SEQ ID NO: 273170 - DNA, 20 bp, Artificial Sequence
  Description of Artificial Sequence: Synthetic oligonucleotide
  Target: ATXN1; (+) strand; PAM type: YTN; PAM sequence: TTT
gaagaagtgggagaaacttc

SEQ ID NO: 273171 - DNA, 20 bp, Artificial Sequence
  Description of Artificial Sequence: Synthetic oligonucleotide
  Target: ATXN1; (+) strand; PAM type: YTN; PAM sequence: TTG
aagaagtgggagaaacttca

SEQ ID NO: 273172 - DNA, 20 bp, Artificial Sequence
  Description of Artificial Sequence: Synthetic oligonucleotide
  Target: ATXN1; (+) strand; PAM type: YTN; PAM sequence: CTT
catcaagagcagcaactcag

SEQ ID NO: 273173 - DNA, 20 bp, Artificial Sequence
  Description of Artificial Sequence: Synthetic oligonucleotide
  Target: ATXN1; (+) strand; PAM type: YTN; PAM sequence: TTC
atcaagagcagcaactcagg

SEQ ID NO: 273174 - DNA, 20 bp, Artificial Sequence
  Description of Artificial Sequence: Synthetic oligonucleotide
  Target: ATXN1; (+) strand; PAM type: YTN; PAM sequence: CTC
aggtgtctgtccaccagagt

SEQ ID NO: 273175 - DNA, 20 bp, Artificial Sequence
  Description of Artificial Sequence: Synthetic oligonucleotide
  Target: ATXN1; (+) strand; PAM type: YTN; PAM sequence: CTG
tccaccagagtaagcaggag

SEQ ID NO: 273176 - DNA, 20 bp, Artificial Sequence
  Description of Artificial Sequence: Synthetic oligonucleotide
  Target: ATXN1; (+) strand; PAM type: YTN; PAM sequence: TTC
tgaccagcaagggtagccta

SEQ ID NO: 273177 - DNA, 20 bp, Artificial Sequence
  Description of Artificial Sequence: Synthetic oligonucleotide
  Target: ATXN1; (+) strand; PAM type: YTN; PAM sequence: CTG
accagcaagggtagcctagg

SEQ ID NO: 273178 - DNA, 20 bp, Artificial Sequence
  Description of Artificial Sequence: Synthetic oligonucleotide
  Target: ATXN1; (+) strand; PAM type: YTN; PAM sequence: CTA
gggcatgggagggagggaga

SEQ ID NO: 273179 - DNA, 20 bp, Artificial Sequence
  Description of Artificial Sequence: Synthetic oligonucleotide
  Target: ATXN1; (+) strand; PAM type: YTN; PAM sequence: CTT
taaagctttcctgttctgtc

SEQ ID NO: 273180 - DNA, 20 bp, Artificial Sequence
  Description of Artificial Sequence: Synthetic oligonucleotide
  Target: ATXN1; (+) strand; PAM type: YTN; PAM sequence: TTT
aaagctttcctgttctgtca

SEQ ID NO: 273181 - DNA, 20 bp, Artificial Sequence
  Description of Artificial Sequence: Synthetic oligonucleotide
  Target: ATXN1; (+) strand; PAM type: YTN; PAM sequence: TTA
aagctttcctgttctgtcac

SEQ ID NO: 273182 - DNA, 20 bp, Artificial Sequence
  Description of Artificial Sequence: Synthetic oligonucleotide
  Target: ATXN1; (+) strand; PAM type: YTN; PAM sequence: CTT
tcctgttctgtcacacttcc

SEQ ID NO: 273183 - DNA, 20 bp, Artificial Sequence
  Description of Artificial Sequence: Synthetic oligonucleotide
  Target: ATXN1; (+) strand; PAM type: YTN; PAM sequence: TTT
cctgttctgtcacacttcct

SEQ ID NO: 273184 - DNA, 20 bp, Artificial Sequence
  Description of Artificial Sequence: Synthetic oligonucleotide
  Target: ATXN1; (+) strand; PAM type: YTN; PAM sequence: TTC
ctgttctgtcacacttcctg

SEQ ID NO: 273185 - DNA, 20 bp, Artificial Sequence
  Description of Artificial Sequence: Synthetic oligonucleotide
  Target: ATXN1; (+) strand; PAM type: YTN; PAM sequence: CTG
ttctgtcacacttcctgcac

SEQ ID NO: 273186 - DNA, 20 bp, Artificial Sequence
  Description of Artificial Sequence: Synthetic oligonucleotide
  Target: ATXN1; (+) strand; PAM type: YTN; PAM sequence: TTC
tgtcacacttcctgcacctc

SEQ ID NO: 273187 - DNA, 20 bp, Artificial Sequence
  Description of Artificial Sequence: Synthetic oligonucleotide
  Target: ATXN1; (+) strand; PAM type: YTN; PAM sequence: CTG
tcacacttcctgcacctctg

SEQ ID NO: 273188 - DNA, 20 bp, Artificial Sequence
  Description of Artificial Sequence: Synthetic oligonucleotide
  Target: ATXN1; (+) strand; PAM type: YTN; PAM sequence: CTT
cctgcacctctgcccagagg

SEQ ID NO: 273189 - DNA, 20 bp, Artificial Sequence
  Description of Artificial Sequence: Synthetic oligonucleotide
  Target: ATXN1; (+) strand; PAM type: YTN; PAM sequence: TTC
ctgcacctctgcccagaggt

SEQ ID NO: 273190 - DNA, 20 bp, Artificial Sequence
  Description of Artificial Sequence: Synthetic oligonucleotide
  Target: ATXN1; (+) strand; PAM type: YTN; PAM sequence: CTG
cacctctgcccagaggtggc

SEQ ID NO: 273191 - DNA, 20 bp, Artificial Sequence
  Description of Artificial Sequence: Synthetic oligonucleotide
  Target: ATXN1; (+) strand; PAM type: YTN; PAM sequence: CTC
tgcccagaggtggctgctcc

SEQ ID NO: 273192 - DNA, 20 bp, Artificial Sequence
  Description of Artificial Sequence: Synthetic oligonucleotide
  Target: ATXN1; (+) strand; PAM type: YTN; PAM sequence: CTG
cccagaggtggctgctccac

SEQ ID NO: 273193 - DNA, 20 bp, Artificial Sequence
  Description of Artificial Sequence: Synthetic oligonucleotide
  Target: ATXN1; (+) strand; PAM type: YTN; PAM sequence: CTG
ctccacagacccaagcagaa

SEQ ID NO: 273194 - DNA, 20 bp, Artificial Sequence
  Description of Artificial Sequence: Synthetic oligonucleotide
  Target: ATXN1; (+) strand; PAM type: YTN; PAM sequence: CTC
cacagacccaagcagaaagc

SEQ ID NO: 273195 - DNA, 20 bp, Artificial Sequence
  Description of Artificial Sequence: Synthetic oligonucleotide
  Target: ATXN1; (+) strand; PAM type: YTN; PAM sequence: TTC
tcttctctcccagtagcatc

SEQ ID NO: 273196 - DNA, 20 bp, Artificial Sequence
  Description of Artificial Sequence: Synthetic oligonucleotide
  Target: ATXN1; (+) strand; PAM type: YTN; PAM sequence: CTC
ttctctcccagtagcatctt

SEQ ID NO: 273197 - DNA, 20 bp, Artificial Sequence
  Description of Artificial Sequence: Synthetic oligonucleotide
  Target: ATXN1; (+) strand; PAM type: YTN; PAM sequence: CTT
ctctcccagtagcatctttc

SEQ ID NO: 273198 - DNA, 20 bp, Artificial Sequence
  Description of Artificial Sequence: Synthetic oligonucleotide
  Target: ATXN1; (+) strand; PAM type: YTN; PAM sequence: TTC
tctcccagtagcatctttcc

SEQ ID NO: 273199 - DNA, 20 bp, Artificial Sequence
  Description of Artificial Sequence: Synthetic oligonucleotide
  Target: ATXN1; (+) strand; PAM type: YTN; PAM sequence: CTC
tcccagtagcatctttcctg

SEQ ID NO: 273200 - DNA, 20 bp, Artificial Sequence
  Description of Artificial Sequence: Synthetic oligonucleotide
  Target: ATXN1; (+) strand; PAM type: YTN; PAM sequence: CTC
ccagtagcatctttcctgtt

SEQ ID NO: 273201 - DNA, 20 bp, Artificial Sequence
  Description of Artificial Sequence: Synthetic oligonucleotide
  Target: ATXN1; (+) strand; PAM type: YTN; PAM sequence: CTT
tcctgttctagcctaaatgc

SEQ ID NO: 273202 - DNA, 20 bp, Artificial Sequence
  Description of Artificial Sequence: Synthetic oligonucleotide
  Target: ATXN1; (+) strand; PAM type: YTN; PAM sequence: TTT
cctgttctagcctaaatgca

SEQ ID NO: 273203 - DNA, 20 bp, Artificial Sequence
  Description of Artificial Sequence: Synthetic oligonucleotide
  Target: ATXN1; (+) strand; PAM type: YTN; PAM sequence: TTC
ctgttctagcctaaatgcag

SEQ ID NO: 273204 - DNA, 20 bp, Artificial Sequence
  Description of Artificial Sequence: Synthetic oligonucleotide
  Target: ATXN1; (+) strand; PAM type: YTN; PAM sequence: CTG
ttctagcctaaatgcagggg

SEQ ID NO: 273205 - DNA, 20 bp, Artificial Sequence
  Description of Artificial Sequence: Synthetic oligonucleotide
  Target: ATXN1; (+) strand; PAM type: YTN; PAM sequence: TTC
tagcctaaatgcaggggaaa

SEQ ID NO: 273206 - DNA, 20 bp, Artificial Sequence
  Description of Artificial Sequence: Synthetic oligonucleotide
  Target: ATXN1; (+) strand; PAM type: YTN; PAM sequence: CTA
gcctaaatgcaggggaaaaa

SEQ ID NO: 273207 - DNA, 20 bp, Artificial Sequence
  Description of Artificial Sequence: Synthetic oligonucleotide
  Target: ATXN1; (+) strand; PAM type: YTN; PAM sequence: CTA
aatgcaggggaaaaagattt

SEQ ID NO: 273208 - DNA, 20 bp, Artificial Sequence
  Description of Artificial Sequence: Synthetic oligonucleotide
  Target: ATXN1; (+) strand; PAM type: YTN; PAM sequence: TTT
ggggctgaggcacctctgaa

SEQ ID NO: 273209 - DNA, 20 bp, Artificial Sequence
  Description of Artificial Sequence: Synthetic oligonucleotide
  Target: ATXN1; (+) strand; PAM type: YTN; PAM sequence: TTG
gggctgaggcacctctgaat

SEQ ID NO: 273210 - DNA, 20 bp, Artificial Sequence
  Description of Artificial Sequence: Synthetic oligonucleotide
  Target: ATXN1; (+) strand; PAM type: YTN; PAM sequence: CTG
aggcacctctgaatcccagg

SEQ ID NO: 273211 - DNA, 20 bp, Artificial Sequence
  Description of Artificial Sequence: Synthetic oligonucleotide
  Target: ATXN1; (+) strand; PAM type: YTN; PAM sequence: CTC
tgaatcccagggagctcagg

SEQ ID NO: 273212 - DNA, 20 bp, Artificial Sequence
  Description of Artificial Sequence: Synthetic oligonucleotide
  Target: ATXN1; (+) strand; PAM type: YTN; PAM sequence: CTG
aatcccagggagctcaggag

SEQ ID NO: 273213 - DNA, 20 bp, Artificial Sequence
  Description of Artificial Sequence: Synthetic oligonucleotide
  Target: ATXN1; (+) strand; PAM type: YTN; PAM sequence: CTC
aggagctcactctgattcct

SEQ ID NO: 273214 - DNA, 20 bp, Artificial Sequence
  Description of Artificial Sequence: Synthetic oligonucleotide
  Target: ATXN1; (+) strand; PAM type: YTN; PAM sequence: CTC
actctgattccttggagctg

SEQ ID NO: 273215 - DNA, 20 bp, Artificial Sequence
  Description of Artificial Sequence: Synthetic oligonucleotide
  Target: ATXN1; (+) strand; PAM type: YTN; PAM sequence: CTC
tgattccttggagctgaaga

SEQ ID NO: 273216 - DNA, 20 bp, Artificial Sequence
  Description of Artificial Sequence: Synthetic oligonucleotide
  Target: ATXN1; (+) strand; PAM type: YTN; PAM sequence: CTG
attccttggagctgaagagt

SEQ ID NO: 273217 - DNA, 20 bp, Artificial Sequence
  Description of Artificial Sequence: Synthetic oligonucleotide
  Target: ATXN1; (+) strand; PAM type: YTN; PAM sequence: TTC
cttggagctgaagagttgct

SEQ ID NO: 273218 - DNA, 20 bp, Artificial Sequence
  Description of Artificial Sequence: Synthetic oligonucleotide
  Target: ATXN1; (+) strand; PAM type: YTN; PAM sequence: CTT
ggagctgaagagttgctgtg

SEQ ID NO: 273219 - DNA, 20 bp, Artificial Sequence
  Description of Artificial Sequence: Synthetic oligonucleotide
  Target: ATXN1; (+) strand; PAM type: YTN; PAM sequence: TTG
gagctgaagagttgctgtgt

SEQ ID NO: 273220 - DNA, 20 bp, Artificial Sequence
  Description of Artificial Sequence: Synthetic oligonucleotide
  Target: ATXN1; (+) strand; PAM type: YTN; PAM sequence: CTG
aagagttgctgtgtgcaagc

SEQ ID NO: 273221 - DNA, 20 bp, Artificial Sequence
  Description of Artificial Sequence: Synthetic oligonucleotide
  Target: ATXN1; (+) strand; PAM type: YTN; PAM sequence: TTG
ctgtgtgcaagctgcacaca

SEQ ID NO: 273222 - DNA, 20 bp, Artificial Sequence
  Description of Artificial Sequence: Synthetic oligonucleotide
  Target: ATXN1; (+) strand; PAM type: YTN; PAM sequence: CTG
tgtgcaagctgcacacagcc

SEQ ID NO: 273223 - DNA, 20 bp, Artificial Sequence
  Description of Artificial Sequence: Synthetic oligonucleotide
  Target: ATXN1; (+) strand; PAM type: YTN; PAM sequence: CTG
cacacagccgtagcgtctct

SEQ ID NO: 273224 - DNA, 20 bp, Artificial Sequence
  Description of Artificial Sequence: Synthetic oligonucleotide
  Target: ATXN1; (+) strand; PAM type: YTN; PAM sequence: CTC
tcattagactctcttctacc

SEQ ID NO: 273225 - DNA, 20 bp, Artificial Sequence
  Description of Artificial Sequence: Synthetic oligonucleotide
  Target: ATXN1; (+) strand; PAM type: YTN; PAM sequence: CTC
attagactctcttctaccac

SEQ ID NO: 273226 - DNA, 20 bp, Artificial Sequence
  Description of Artificial Sequence: Synthetic oligonucleotide
  Target: ATXN1; (+) strand; PAM type: YTN; PAM sequence: TTA
gactctcttctaccactaga

SEQ ID NO: 273227 - DNA, 20 bp, Artificial Sequence
  Description of Artificial Sequence: Synthetic oligonucleotide
  Target: ATXN1; (+) strand; PAM type: YTN; PAM sequence: CTC
tcttctaccactagagccag

SEQ ID NO: 273228 - DNA, 20 bp, Artificial Sequence
  Description of Artificial Sequence: Synthetic oligonucleotide
  Target: ATXN1; (+) strand; PAM type: YTN; PAM sequence: CTC
ttctaccactagagccaggc

SEQ ID NO: 273229 - DNA, 20 bp, Artificial Sequence
  Description of Artificial Sequence: Synthetic oligonucleotide
  Target: ATXN1; (+) strand; PAM type: YTN; PAM sequence: CTT
ctaccactagagccaggcag

SEQ ID NO: 273230 - DNA, 20 bp, Artificial Sequence
  Description of Artificial Sequence: Synthetic oligonucleotide
  Target: ATXN1; (+) strand; PAM type: YTN; PAM sequence: TTC
taccactagagccaggcagc

SEQ ID NO: 273231 - DNA, 20 bp, Artificial Sequence
  Description of Artificial Sequence: Synthetic oligonucleotide
  Target: ATXN1; (+) strand; PAM type: YTN; PAM sequence: CTA
ccactagagccaggcagcta

SEQ ID NO: 273232 - DNA, 20 bp, Artificial Sequence
  Description of Artificial Sequence: Synthetic oligonucleotide
  Target: ATXN1; (+) strand; PAM type: YTN; PAM sequence: CTA
gagccaggcagctatgaaga

SEQ ID NO: 273233 - DNA, 20 bp, Artificial Sequence
  Description of Artificial Sequence: Synthetic oligonucleotide
  Target: ATXN1; (+) strand; PAM type: YTN; PAM sequence: CTA
tgaagagtgacatgaccagc

SEQ ID NO: 273234 - DNA, 20 bp, Artificial Sequence
  Description of Artificial Sequence: Synthetic oligonucleotide
  Target: ATXN1; (+) strand; PAM type: YTN; PAM sequence: CTC
ctctcgcccatcaaacagct

SEQ ID NO: 273235 - DNA, 20 bp, Artificial Sequence
  Description of Artificial Sequence: Synthetic oligonucleotide
  Target: ATXN1; (+) strand; PAM type: YTN; PAM sequence: CTC
tcgcccatcaaacagctttc

SEQ ID NO: 273236 - DNA, 20 bp, Artificial Sequence
  Description of Artificial Sequence: Synthetic oligonucleotide
  Target: ATXN1; (+) strand; PAM type: YTN; PAM sequence: CTC
gcccatcaaacagctttctt

SEQ ID NO: 273237 - DNA, 20 bp, Artificial Sequence
  Description of Artificial Sequence: Synthetic oligonucleotide
  Target: ATXN1; (+) strand; PAM type: YTN; PAM sequence: CTT
tcttcctcctttctcccaaa

SEQ ID NO: 273238 - DNA, 20 bp, Artificial Sequence
  Description of Artificial Sequence: Synthetic oligonucleotide
  Target: ATXN1; (+) strand; PAM type: YTN; PAM sequence: TTT
cttcctcctttctcccaaat

SEQ ID NO: 273239 - DNA, 20 bp, Artificial Sequence
  Description of Artificial Sequence: Synthetic oligonucleotide
  Target: ATXN1; (+) strand; PAM type: YTN; PAM sequence: TTC
ttcctcctttctcccaaatc

SEQ ID NO: 273240 - DNA, 20 bp, Artificial Sequence
  Description of Artificial Sequence: Synthetic oligonucleotide
  Target: ATXN1; (+) strand; PAM type: YTN; PAM sequence: CTT
cctcctttctcccaaatcaa

SEQ ID NO: 273241 - DNA, 20 bp, Artificial Sequence
  Description of Artificial Sequence: Synthetic oligonucleotide
  Target: ATXN1; (+) strand; PAM type: YTN; PAM sequence: TTC
ctcctttctcccaaatcaaa

SEQ ID NO: 273242 - DNA, 20 bp, Artificial Sequence
  Description of Artificial Sequence: Synthetic oligonucleotide
  Target: ATXN1; (+) strand; PAM type: YTN; PAM sequence: CTC
ctttctcccaaatcaaaact

SEQ ID NO: 273243 - DNA, 20 bp, Artificial Sequence
  Description of Artificial Sequence: Synthetic oligonucleotide
  Target: ATXN1; (+) strand; PAM type: YTN; PAM sequence: CTT
tctcccaaatcaaaactgac

SEQ ID NO: 273244 - DNA, 20 bp, Artificial Sequence
  Description of Artificial Sequence: Synthetic oligonucleotide
  Target: ATXN1; (+) strand; PAM type: YTN; PAM sequence: TTT
ctcccaaatcaaaactgact

SEQ ID NO: 273245 - DNA, 20 bp, Artificial Sequence
  Description of Artificial Sequence: Synthetic oligonucleotide
  Target: ATXN1; (+) strand; PAM type: YTN; PAM sequence: TTC
tcccaaatcaaaactgactc

SEQ ID NO: 273246 - DNA, 20 bp, Artificial Sequence
  Description of Artificial Sequence: Synthetic oligonucleotide
  Target: ATXN1; (+) strand; PAM type: YTN; PAM sequence: CTC
ccaaatcaaaactgactccc

SEQ ID NO: 273247 - DNA, 20 bp, Artificial Sequence
  Description of Artificial Sequence: Synthetic oligonucleotide
  Target: ATXN1; (+) strand; PAM type: YTN; PAM sequence: CTG
actccctcttgttggatcac

SEQ ID NO: 273248 - DNA, 20 bp, Artificial Sequence
  Description of Artificial Sequence: Synthetic oligonucleotide
  Target: ATXN1; (+) strand; PAM type: YTN; PAM sequence: CTC
cctcttgttggatcacaaag

SEQ ID NO: 273249 - DNA, 20 bp, Artificial Sequence
  Description of Artificial Sequence: Synthetic oligonucleotide
  Target: ATXN1; (+) strand; PAM type: YTN; PAM sequence: CTC
ttgttggatcacaaagagca

SEQ ID NO: 273250 - DNA, 20 bp, Artificial Sequence
  Description of Artificial Sequence: Synthetic oligonucleotide
  Target: ATXN1; (+) strand; PAM type: YTN; PAM sequence: CTT
gttggatcacaaagagcaag

SEQ ID NO: 273251 - DNA, 20 bp, Artificial Sequence
  Description of Artificial Sequence: Synthetic oligonucleotide
  Target: ATXN1; (+) strand; PAM type: YTN; PAM sequence: TTG
ttggatcacaaagagcaaga

SEQ ID NO: 273252 - DNA, 20 bp, Artificial Sequence
  Description of Artificial Sequence: Synthetic oligonucleotide
  Target: ATXN1; (+) strand; PAM type: YTN; PAM sequence: TTG
gatcacaaagagcaagaacg

SEQ ID NO: 273253 - DNA, 20 bp, Artificial Sequence
  Description of Artificial Sequence: Synthetic oligonucleotide
  Target: ATXN1; (+) strand; PAM type: YTN; PAM sequence: CTT
gtggagcttaaaaaaaagaa

SEQ ID NO: 273254 - DNA, 20 bp, Artificial Sequence
  Description of Artificial Sequence: Synthetic oligonucleotide
  Target: ATXN1; (+) strand; PAM type: YTN; PAM sequence: TTG
tggagcttaaaaaaaagaaa

SEQ ID NO: 273255 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaagaaaaacaaaaa

SEQ ID NO: 273256 - DNA, 20 bp, Artificial Sequence
  Description of Artificial Sequence: Synthetic oligonucleotide
  Target: ATXN1; (+) strand; PAM type: YTN; PAM sequence: TTA
aaaaaaagaaaaacaaaaaa

SEQ ID NO: 273257 - DNA, 20 bp, Artificial Sequence
  Description of Artificial Sequence: Synthetic oligonucleotide
  Target: ATXN1; (+) strand; PAM type: YTN; PAM sequence: CTG
tcagcttgcaagaattttac

SEQ ID NO: 273258 - DNA, 20 bp, Artificial Sequence
  Description of Artificial Sequence: Synthetic oligonucleotide
  Target: ATXN1; (+) strand; PAM type: YTN; PAM sequence: CTT
gcaagaattttaccaaccgg

SEQ ID NO: 273259 - DNA, 20 bp, Artificial Sequence
  Description of Artificial Sequence: Synthetic oligonucleotide
  Target: ATXN1; (+) strand; PAM type: YTN; PAM sequence: TTG
caagaattttaccaaccggc

SEQ ID NO: 273260 - DNA, 20 bp, Artificial Sequence
  Description of Artificial Sequence: Synthetic oligonucleotide
  Target: ATXN1; (+) strand; PAM type: YTN; PAM sequence: TTT
taccaaccggcaagacatta

SEQ ID NO: 273261 - DNA, 20 bp, Artificial Sequence
  Description of Artificial Sequence: Synthetic oligonucleotide
  Target: ATXN1; (+) strand; PAM type: YTN; PAM sequence: TTT
accaaccggcaagacattac

SEQ ID NO: 273262 - DNA, 20 bp, Artificial Sequence
  Description of Artificial Sequence: Synthetic oligonucleotide
  Target: ATXN1; (+) strand; PAM type: YTN; PAM sequence: TTA
ccaaccggcaagacattacc

SEQ ID NO: 273263 - DNA, 20 bp, Artificial Sequence
  Description of Artificial Sequence: Synthetic oligonucleotide
  Target: ATXN1; (+) strand; PAM type: YTN; PAM sequence: TTA
cccctcatgtcccagagcca

SEQ ID NO: 273264 - DNA, 20 bp, Artificial Sequence
  Description of Artificial Sequence: Synthetic oligonucleotide
  Target: ATXN1; (+) strand; PAM type: YTN; PAM sequence: CTC
atgtcccagagccataggga

SEQ ID NO: 273265 - DNA, 20 bp, Artificial Sequence
  Description of Artificial Sequence: Synthetic oligonucleotide
  Target: ATXN1; (+) strand; PAM type: YTN; PAM sequence: CTG
cgtctgagagcgaggcacac

SEQ ID NO: 273266 - DNA, 20 bp, Artificial Sequence
  Description of Artificial Sequence: Synthetic oligonucleotide
  Target: ATXN1; (+) strand; PAM type: YTN; PAM sequence: CTG
agagcgaggcacaccagcag

SEQ ID NO: 273267 - DNA, 20 bp, Artificial Sequence
  Description of Artificial Sequence: Synthetic oligonucleotide
  Target: ATXN1; (+) strand; PAM type: YTN; PAM sequence: TTC
tcatgggtggatggtgaacc

SEQ ID NO: 273268 - DNA, 20 bp, Artificial Sequence
  Description of Artificial Sequence: Synthetic oligonucleotide
  Target: ATXN1; (+) strand; PAM type: YTN; PAM sequence: CTC
atgggtggatggtgaaccct

SEQ ID NO: 273269 - DNA, 20 bp, Artificial Sequence
  Description of Artificial Sequence: Synthetic oligonucleotide
  Target: ATXN1; (+) strand; PAM type: YTN; PAM sequence: CTC
tcttatcaacagctagactc

SEQ ID NO: 273270 - DNA, 20 bp, Artificial Sequence
  Description of Artificial Sequence: Synthetic oligonucleotide
  Target: ATXN1; (+) strand; PAM type: YTN; PAM sequence: CTC
ttatcaacagctagactcag

SEQ ID NO: 273271 - DNA, 20 bp, Artificial Sequence
  Description of Artificial Sequence: Synthetic oligonucleotide
  Target: ATXN1; (+) strand; PAM type: YTN; PAM sequence: CTT
atcaacagctagactcagca

SEQ ID NO: 273272 - DNA, 20 bp, Artificial Sequence
  Description of Artificial Sequence: Synthetic oligonucleotide
  Target: ATXN1; (+) strand; PAM type: YTN; PAM sequence: TTA
tcaacagctagactcagcaa

SEQ ID NO: 273273 - DNA, 20 bp, Artificial Sequence
  Description of Artificial Sequence: Synthetic oligonucleotide
  Target: ATXN1; (+) strand; PAM type: YTN; PAM sequence: CTA
gactcagcaaccacacattc

SEQ ID NO: 273274 - DNA, 20 bp, Artificial Sequence
  Description of Artificial Sequence: Synthetic oligonucleotide
  Target: ATXN1; (+) strand; PAM type: YTN; PAM sequence: CTC
agcaaccacacattccgttt

SEQ ID NO: 273275 - DNA, 20 bp, Artificial Sequence
  Description of Artificial Sequence: Synthetic oligonucleotide
  Target: ATXN1; (+) strand; PAM type: YTN; PAM sequence: TTC
cgttttactttctcgcccac

SEQ ID NO: 273276 - DNA, 20 bp, Artificial Sequence
  Description of Artificial Sequence: Synthetic oligonucleotide
  Target: ATXN1; (+) strand; PAM type: YTN; PAM sequence: TTT
tactttctcgcccacattca

SEQ ID NO: 273277 - DNA, 20 bp, Artificial Sequence
  Description of Artificial Sequence: Synthetic oligonucleotide
  Target: ATXN1; (+) strand; PAM type: YTN; PAM sequence: TTT
actttctcgcccacattcaa

SEQ ID NO: 273278 - DNA, 20 bp, Artificial Sequence
  Description of Artificial Sequence: Synthetic oligonucleotide
  Target: ATXN1; (+) strand; PAM type: YTN; PAM sequence: TTA
ctttctcgcccacattcaaa

SEQ ID NO: 273279 - DNA, 20 bp, Artificial Sequence
  Description of Artificial Sequence: Synthetic oligonucleotide
  Target: ATXN1; (+) strand; PAM type: YTN; PAM sequence: CTT
tctcgcccacattcaaacca

SEQ ID NO: 273280 - DNA, 20 bp, Artificial Sequence
  Description of Artificial Sequence: Synthetic oligonucleotide
  Target: ATXN1; (+) strand; PAM type: YTN; PAM sequence: TTT
ctcgcccacattcaaaccat

SEQ ID NO: 273281 - DNA, 20 bp, Artificial Sequence
  Description of Artificial Sequence: Synthetic oligonucleotide
  Target: ATXN1; (+) strand; PAM type: YTN; PAM sequence: TTC
tcgcccacattcaaaccatt

SEQ ID NO: 273282 - DNA, 20 bp, Artificial Sequence
  Description of Artificial Sequence: Synthetic oligonucleotide
  Target: ATXN1; (+) strand; PAM type: YTN; PAM sequence: CTC
gcccacattcaaaccatttt

SEQ ID NO: 273283 - DNA, 20 bp, Artificial Sequence
  Description of Artificial Sequence: Synthetic oligonucleotide
  Target: ATXN1; (+) strand; PAM type: YTN; PAM sequence: TTC
aaaccattttatctccacta

SEQ ID NO: 273284 - DNA, 20 bp, Artificial Sequence
  Description of Artificial Sequence: Synthetic oligonucleotide
  Target: ATXN1; (+) strand; PAM type: YTN; PAM sequence: TTT
tatctccactagagggccag

SEQ ID NO: 273285 - DNA, 20 bp, Artificial Sequence
  Description of Artificial Sequence: Synthetic oligonucleotide
  Target: ATXN1; (+) strand; PAM type: YTN; PAM sequence: TTT
atctccactagagggccagg

SEQ ID NO: 273286 - DNA, 20 bp, Artificial Sequence
  Description of Artificial Sequence: Synthetic oligonucleotide
  Target: ATXN1; (+) strand; PAM type: YTN; PAM sequence: TTA
tctccactagagggccagga

SEQ ID NO: 273287 - DNA, 20 bp, Artificial Sequence
  Description of Artificial Sequence: Synthetic oligonucleotide
  Target: ATXN1; (+) strand; PAM type: YTN; PAM sequence: CTC
cactagagggccaggatgga

SEQ ID NO: 273288 - DNA, 20 bp, Artificial Sequence
  Description of Artificial Sequence: Synthetic oligonucleotide
  Target: ATXN1; (+) strand; PAM type: YTN; PAM sequence: CTA
gagggccaggatggagatga

SEQ ID NO: 273289 - DNA, 20 bp, Artificial Sequence
  Description of Artificial Sequence: Synthetic oligonucleotide
  Target: ATXN1; (+) strand; PAM type: YTN; PAM sequence: TTT
cagcctggcagttttgctgc

SEQ ID NO: 273290 - DNA, 20 bp, Artificial Sequence
  Description of Artificial Sequence: Synthetic oligonucleotide
  Target: ATXN1; (+) strand; PAM type: YTN; PAM sequence: TTC
agcctggcagttttgctgct

SEQ ID NO: 273291 - DNA, 20 bp, Artificial Sequence
  Description of Artificial Sequence: Synthetic oligonucleotide
  Target: ATXN1; (+) strand; PAM type: YTN; PAM sequence: CTG
gcagttttgctgctgattta

SEQ ID NO: 273292 - DNA, 20 bp, Artificial Sequence
  Description of Artificial Sequence: Synthetic oligonucleotide
  Target: ATXN1; (+) strand; PAM type: YTN; PAM sequence: TTT
tgctgctgatttaagatttg

SEQ ID NO: 273293 - DNA, 20 bp, Artificial Sequence
  Description of Artificial Sequence: Synthetic oligonucleotide
  Target: ATXN1; (+) strand; PAM type: YTN; PAM sequence: TTT
gctgctgatttaagatttga

SEQ ID NO: 273294 - DNA, 20 bp, Artificial Sequence
  Description of Artificial Sequence: Synthetic oligonucleotide
  Target: ATXN1; (+) strand; PAM type: YTN; PAM sequence: TTG
ctgctgatttaagatttgat

SEQ ID NO: 273295 - DNA, 20 bp, Artificial Sequence
  Description of Artificial Sequence: Synthetic oligonucleotide
  Target: ATXN1; (+) strand; PAM type: YTN; PAM sequence: CTG
ctgatttaagatttgatcct

SEQ ID NO: 273296 - DNA, 20 bp, Artificial Sequence
  Description of Artificial Sequence: Synthetic oligonucleotide
  Target: ATXN1; (+) strand; PAM type: YTN; PAM sequence: CTG
atttaagatttgatcctaaa

SEQ ID NO: 273297 - DNA, 20 bp, Artificial Sequence
  Description of Artificial Sequence: Synthetic oligonucleotide
  Target: ATXN1; (+) strand; PAM type: YTN; PAM sequence: TTT
aagatttgatcctaaacctt

SEQ ID NO: 273298 - DNA, 20 bp, Artificial Sequence
  Description of Artificial Sequence: Synthetic oligonucleotide
  Target: ATXN1; (+) strand; PAM type: YTN; PAM sequence: TTA
agatttgatcctaaaccttg

SEQ ID NO: 273299 - DNA, 20 bp, Artificial Sequence
  Description of Artificial Sequence: Synthetic oligonucleotide
  Target: ATXN1; (+) strand; PAM type: YTN; PAM sequence: TTT
gatcctaaaccttggggagg

SEQ ID NO: 273300 - DNA, 20 bp, Artificial Sequence
  Description of Artificial Sequence: Synthetic oligonucleotide
  Target: ATXN1; (+) strand; PAM type: YTN; PAM sequence: TTG
atcctaaaccttggggaggg

SEQ ID NO: 273301 - DNA, 20 bp, Artificial Sequence
  Description of Artificial Sequence: Synthetic oligonucleotide
  Target: ATXN1; (+) strand; PAM type: YTN; PAM sequence: CTA
aaccttggggagggagggct

SEQ ID NO: 273302 - DNA, 20 bp, Artificial Sequence
  Description of Artificial Sequence: Synthetic oligonucleotide
  Target: ATXN1; (+) strand; PAM type: YTN; PAM sequence: CTT
ggggagggagggctcgaagg

SEQ ID NO: 273303 - DNA, 20 bp, Artificial Sequence
  Description of Artificial Sequence: Synthetic oligonucleotide
  Target: ATXN1; (+) strand; PAM type: YTN; PAM sequence: TTG
gggagggagggctcgaagga

SEQ ID NO: 273304 - DNA, 20 bp, Artificial Sequence
  Description of Artificial Sequence: Synthetic oligonucleotide
  Target: ATXN1; (+) strand; PAM type: YTN; PAM sequence: CTC
gaaggaagggaggtggggtt

SEQ ID NO: 273305 - DNA, 20 bp, Artificial Sequence
  Description of Artificial Sequence: Synthetic oligonucleotide
  Target: ATXN1; (+) strand; PAM type: YTN; PAM sequence: TTA
aggcaactcagatactcacg

SEQ ID NO: 273306 - DNA, 20 bp, Artificial Sequence
  Description of Artificial Sequence: Synthetic oligonucleotide
  Target: ATXN1; (+) strand; PAM type: YTN; PAM sequence: CTC
agatactcacgtgggcatat

SEQ ID NO: 273307 - DNA, 20 bp, Artificial Sequence
  Description of Artificial Sequence: Synthetic oligonucleotide
  Target: ATXN1; (+) strand; PAM type: YTN; PAM sequence: CTC
acgtgggcatatctgggtcc

SEQ ID NO: 273308 - DNA, 20 bp, Artificial Sequence
  Description of Artificial Sequence: Synthetic oligonucleotide
  Target: ATXN1; (+) strand; PAM type: YTN; PAM sequence: CTG
ggtcccaggcaatccctggg

SEQ ID NO: 273309 - DNA, 20 bp, Artificial Sequence
  Description of Artificial Sequence: Synthetic oligonucleotide
  Target: ATXN1; (+) strand; PAM type: YTN; PAM sequence: CTG
ggttctgccacaggctctct

SEQ ID NO: 273310 - DNA, 20 bp, Artificial Sequence
  Description of Artificial Sequence: Synthetic oligonucleotide
  Target: ATXN1; (+) strand; PAM type: YTN; PAM sequence: TTC
tgccacaggctctctatctc

SEQ ID NO: 273311 - DNA, 20 bp, Artificial Sequence
  Description of Artificial Sequence: Synthetic oligonucleotide
  Target: ATXN1; (+) strand; PAM type: YTN; PAM sequence: CTG
ccacaggctctctatctcat

SEQ ID NO: 273312 - DNA, 20 bp, Artificial Sequence
  Description of Artificial Sequence: Synthetic oligonucleotide
  Target: ATXN1; (+) strand; PAM type: YTN; PAM sequence: CTC
tctatctcatgggatgacac

SEQ ID NO: 273313 - DNA, 20 bp, Artificial Sequence
  Description of Artificial Sequence: Synthetic oligonucleotide
  Target: ATXN1; (+) strand; PAM type: YTN; PAM sequence: CTC
tatctcatgggatgacactg

SEQ ID NO: 273314 - DNA, 20 bp, Artificial Sequence
  Description of Artificial Sequence: Synthetic oligonucleotide
  Target: ATXN1; (+) strand; PAM type: YTN; PAM sequence: CTA
tctcatgggatgacactgtt

SEQ ID NO: 273315 - DNA, 20 bp, Artificial Sequence
  Description of Artificial Sequence: Synthetic oligonucleotide
  Target: ATXN1; (+) strand; PAM type: YTN; PAM sequence: CTC
atgggatgacactgttatta

SEQ ID NO: 273316 - DNA, 20 bp, Artificial Sequence
  Description of Artificial Sequence: Synthetic oligonucleotide
  Target: ATXN1; (+) strand; PAM type: YTN; PAM sequence: CTG
ttattaaaataatatccacg

SEQ ID NO: 273317 - DNA, 20 bp, Artificial Sequence
  Description of Artificial Sequence: Synthetic oligonucleotide
  Target: ATXN1; (+) strand; PAM type: YTN; PAM sequence: TTA
ttaaaataatatccacggca

SEQ ID NO: 273318 - DNA, 20 bp, Artificial Sequence
  Description of Artificial Sequence: Synthetic oligonucleotide
  Target: ATXN1; (+) strand; PAM type: YTN; PAM sequence: TTA
aaataatatccacggcactt

SEQ ID NO: 273319 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggcag

SEQ ID NO: 273320 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggcaga

SEQ ID NO: 273321 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggcagat

SEQ ID NO: 273322 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccca

SEQ ID NO: 273323 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaatt

SEQ ID NO: 273324 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaattag

SEQ ID NO: 273325 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaattagcca

SEQ ID NO: 273326 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggtggtgggag

SEQ ID NO: 273327 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 273328 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcaggt

SEQ ID NO: 273329 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggtgaa

SEQ ID NO: 273330 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggtgaat

SEQ ID NO: 273331 - DNA, 20 bp, Artificial Sequence
  Description of Artificial Sequence: Synthetic oligonucleotide
  Target: ATXN1; (+) strand; PAM type: YTN; PAM sequence: CTG
aggcaggtgaatcacttgaa

SEQ ID NO: 273332 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcagaggtt

SEQ ID NO: 273333 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcagaggttg

SEQ ID NO: 273334 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcacgcc

SEQ ID NO: 273335 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggcgacaga

SEQ ID NO: 273336 - DNA, 20 bp, Artificial Sequence
  Description of Artificial Sequence: Synthetic oligonucleotide
  Target: ATXN1; (+) strand; PAM type: YTN; PAM sequence: CTC
cagcctggcgacagagcgag

SEQ ID NO: 273337 - DNA, 20 bp, Artificial Sequence
  Description of Artificial Sequence: Synthetic oligonucleotide
  Target: ATXN1; (+) strand; PAM type: YTN; PAM sequence: CTG
gcgacagagcgaggctctgt

SEQ ID NO: 273338 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaataataataat

SEQ ID NO: 273339 - DNA, 20 bp, Artificial Sequence
  Description of Artificial Sequence: Synthetic oligonucleotide
  Target: ATXN1; (+) strand; PAM type: YTN; PAM sequence: CTG
tctcaaaataataataataa

SEQ ID NO: 273340 - DNA, 20 bp, Artificial Sequence
  Description of Artificial Sequence: Synthetic oligonucleotide
  Target: ATXN1; (+) strand; PAM type: YTN; PAM sequence: CTC
aaaataataataataataat

SEQ ID NO: 273341 - DNA, 20 bp, Artificial Sequence
  Description of Artificial Sequence: Synthetic oligonucleotide
  Target: ATXN1; (+) strand; PAM type: YTN; PAM sequence: TTA
ataataataatatccataaa

SEQ ID NO: 273342 - DNA, 20 bp, Artificial Sequence
  Description of Artificial Sequence: Synthetic oligonucleotide
  Target: ATXN1; (+) strand; PAM type: YTN; PAM sequence: CTT
cggtagccacctaggctcaa

SEQ ID NO: 273343 - DNA, 20 bp, Artificial Sequence
  Description of Artificial Sequence: Synthetic oligonucleotide
  Target: ATXN1; (+) strand; PAM type: YTN; PAM sequence: TTC
ggtagccacctaggctcaaa

SEQ ID NO: 273344 - DNA, 20 bp, Artificial Sequence
  Description of Artificial Sequence: Synthetic oligonucleotide
  Target: ATXN1; (+) strand; PAM type: YTN; PAM sequence: CTA
ggctcaaaaattgggttatc

SEQ ID NO: 273345 - DNA, 20 bp, Artificial Sequence
  Description of Artificial Sequence: Synthetic oligonucleotide
  Target: ATXN1; (+) strand; PAM type: YTN; PAM sequence: CTC
aaaaattgggttatctctga

SEQ ID NO: 273346 - DNA, 20 bp, Artificial Sequence
  Description of Artificial Sequence: Synthetic oligonucleotide
  Target: ATXN1; (+) strand; PAM type: YTN; PAM sequence: TTG
ggttatctctgactccattc

SEQ ID NO: 273347 - DNA, 20 bp, Artificial Sequence
  Description of Artificial Sequence: Synthetic oligonucleotide
  Target: ATXN1; (+) strand; PAM type: YTN; PAM sequence: TTA
tctctgactccattcctttc

SEQ ID NO: 273348 - DNA, 20 bp, Artificial Sequence
  Description of Artificial Sequence: Synthetic oligonucleotide
  Target: ATXN1; (+) strand; PAM type: YTN; PAM sequence: CTC
tgactccattcctttcattg

SEQ ID NO: 273349 - DNA, 20 bp, Artificial Sequence
  Description of Artificial Sequence: Synthetic oligonucleotide
  Target: ATXN1; (+) strand; PAM type: YTN; PAM sequence: CTG
actccattcctttcattgtt

SEQ ID NO: 273350 - DNA, 20 bp, Artificial Sequence
  Description of Artificial Sequence: Synthetic oligonucleotide
  Target: ATXN1; (+) strand; PAM type: YTN; PAM sequence: CTC
cattcctttcattgtttcta

SEQ ID NO: 273351 - DNA, 20 bp, Artificial Sequence
  Description of Artificial Sequence: Synthetic oligonucleotide
  Target: ATXN1; (+) strand; PAM type: YTN; PAM sequence: TTC
ctttcattgtttctaatacc

SEQ ID NO: 273352 - DNA, 20 bp, Artificial Sequence
  Description of Artificial Sequence: Synthetic oligonucleotide
  Target: ATXN1; (+) strand; PAM type: YTN; PAM sequence: CTT
tcattgtttctaatacccag

SEQ ID NO: 273353 - DNA, 20 bp, Artificial Sequence
  Description of Artificial Sequence: Synthetic oligonucleotide
  Target: ATXN1; (+) strand; PAM type: YTN; PAM sequence: TTT
cattgtttctaatacccagt

SEQ ID NO: 273354 - DNA, 20 bp, Artificial Sequence
  Description of Artificial Sequence: Synthetic oligonucleotide
  Target: ATXN1; (+) strand; PAM type: YTN; PAM sequence: TTC
attgtttctaatacccagtt

SEQ ID NO: 273355 - DNA, 20 bp, Artificial Sequence
  Description of Artificial Sequence: Synthetic oligonucleotide
  Target: ATXN1; (+) strand; PAM type: YTN; PAM sequence: TTG
tttctaatacccagttgctc

SEQ ID NO: 273356 - DNA, 20 bp, Artificial Sequence
  Description of Artificial Sequence: Synthetic oligonucleotide
  Target: ATXN1; (+) strand; PAM type: YTN; PAM sequence: TTT
ctaatacccagttgctcagt

SEQ ID NO: 273357 - DNA, 20 bp, Artificial Sequence
  Description of Artificial Sequence: Synthetic oligonucleotide
  Target: ATXN1; (+) strand; PAM type: YTN; PAM sequence: TTC
taatacccagttgctcagtt

SEQ ID NO: 273358 - DNA, 20 bp, Artificial Sequence
  Description of Artificial Sequence: Synthetic oligonucleotide
  Target: ATXN1; (+) strand; PAM type: YTN; PAM sequence: CTA
atacccagttgctcagtttg

SEQ ID NO: 273359 - DNA, 20 bp, Artificial Sequence
  Description of Artificial Sequence: Synthetic oligonucleotide
  Target: ATXN1; (+) strand; PAM type: YTN; PAM sequence: TTG
ctcagtttgttcaactcttt

SEQ ID NO: 273360 - DNA, 20 bp, Artificial Sequence
  Description of Artificial Sequence: Synthetic oligonucleotide
  Target: ATXN1; (+) strand; PAM type: YTN; PAM sequence: CTC
agtttgttcaactctttctt

SEQ ID NO: 273361 - DNA, 20 bp, Artificial Sequence
  Description of Artificial Sequence: Synthetic oligonucleotide
  Target: ATXN1; (+) strand; PAM type: YTN; PAM sequence: TTT
gttcaactctttctttgtag

SEQ ID NO: 273362 - DNA, 20 bp, Artificial Sequence
  Description of Artificial Sequence: Synthetic oligonucleotide
  Target: ATXN1; (+) strand; PAM type: YTN; PAM sequence: TTG
ttcaactctttctttgtagt

SEQ ID NO: 273363 - DNA, 20 bp, Artificial Sequence
  Description of Artificial Sequence: Synthetic oligonucleotide
  Target: ATXN1; (+) strand; PAM type: YTN; PAM sequence: TTC
aactctttctttgtagtgtc

SEQ ID NO: 273364 - DNA, 20 bp, Artificial Sequence
  Description of Artificial Sequence: Synthetic oligonucleotide
  Target: ATXN1; (+) strand; PAM type: YTN; PAM sequence: CTC
tttctttgtagtgtcctcca

SEQ ID NO: 273365 - DNA, 20 bp, Artificial Sequence
  Description of Artificial Sequence: Synthetic oligonucleotide
  Target: ATXN1; (+) strand; PAM type: YTN; PAM sequence: CTT
tctttgtagtgtcctccaca

SEQ ID NO: 273366 - DNA, 20 bp, Artificial Sequence
  Description of Artificial Sequence: Synthetic oligonucleotide
  Target: ATXN1; (+) strand; PAM type: YTN; PAM sequence: TTT
ctttgtagtgtcctccacat

SEQ ID NO: 273367 - DNA, 20 bp, Artificial Sequence
  Description of Artificial Sequence: Synthetic oligonucleotide
  Target: ATXN1; (+) strand; PAM type: YTN; PAM sequence: TTC
tttgtagtgtcctccacatc

SEQ ID NO: 273368 - DNA, 20 bp, Artificial Sequence
  Description of Artificial Sequence: Synthetic oligonucleotide
  Target: ATXN1; (+) strand; PAM type: YTN; PAM sequence: CTT
tgtagtgtcctccacatcgg

SEQ ID NO: 273369 - DNA, 20 bp, Artificial Sequence
  Description of Artificial Sequence: Synthetic oligonucleotide
  Target: ATXN1; (+) strand; PAM type: YTN; PAM sequence: TTT
gtagtgtcctccacatcggt

SEQ ID NO: 273370 - DNA, 20 bp, Artificial Sequence
  Description of Artificial Sequence: Synthetic oligonucleotide
  Target: ATXN1; (+) strand; PAM type: YTN; PAM sequence: TTG
tagtgtcctccacatcggtc

SEQ ID NO: 273371 - DNA, 20 bp, Artificial Sequence
  Description of Artificial Sequence: Synthetic oligonucleotide
  Target: ATXN1; (+) strand; PAM type: YTN; PAM sequence: CTC
cacatcggtccctttgtaac

SEQ ID NO: 273372 - DNA, 20 bp, Artificial Sequence
  Description of Artificial Sequence: Synthetic oligonucleotide
  Target: ATXN1; (+) strand; PAM type: YTN; PAM sequence: CTT
tgtaacacgcccacagtagt

SEQ ID NO: 273373 - DNA, 20 bp, Artificial Sequence
  Description of Artificial Sequence: Synthetic oligonucleotide
  Target: ATXN1; (+) strand; PAM type: YTN; PAM sequence: TTT
gtaacacgcccacagtagtt

SEQ ID NO: 273374 - DNA, 20 bp, Artificial Sequence
  Description of Artificial Sequence: Synthetic oligonucleotide
  Target: ATXN1; (+) strand; PAM type: YTN; PAM sequence: TTG
taacacgcccacagtagttc

SEQ ID NO: 273375 - DNA, 20 bp, Artificial Sequence
  Description of Artificial Sequence: Synthetic oligonucleotide
  Target: ATXN1; (+) strand; PAM type: YTN; PAM sequence: TTC
tcaaaaccttatctccttac

SEQ ID NO: 273376 - DNA, 20 bp, Artificial Sequence
  Description of Artificial Sequence: Synthetic oligonucleotide
  Target: ATXN1; (+) strand; PAM type: YTN; PAM sequence: CTC
aaaaccttatctccttacgc

SEQ ID NO: 273377 - DNA, 20 bp, Artificial Sequence
  Description of Artificial Sequence: Synthetic oligonucleotide
  Target: ATXN1; (+) strand; PAM type: YTN; PAM sequence: CTT
atctccttacgcctgcaact

SEQ ID NO: 273378 - DNA, 20 bp, Artificial Sequence
  Description of Artificial Sequence: Synthetic oligonucleotide
  Target: ATXN1; (+) strand; PAM type: YTN; PAM sequence: TTA
tctccttacgcctgcaactg

SEQ ID NO: 273379 - DNA, 20 bp, Artificial Sequence
  Description of Artificial Sequence: Synthetic oligonucleotide
  Target: ATXN1; (+) strand; PAM type: YTN; PAM sequence: CTC
cttacgcctgcaactgcctt

SEQ ID NO: 273380 - DNA, 20 bp, Artificial Sequence
  Description of Artificial Sequence: Synthetic oligonucleotide
  Target: ATXN1; (+) strand; PAM type: YTN; PAM sequence: CTT
acgcctgcaactgccttccc

SEQ ID NO: 273381 - DNA, 20 bp, Artificial Sequence
  Description of Artificial Sequence: Synthetic oligonucleotide
  Target: ATXN1; (+) strand; PAM type: YTN; PAM sequence: TTA
cgcctgcaactgccttccct

SEQ ID NO: 273382 - DNA, 20 bp, Artificial Sequence
  Description of Artificial Sequence: Synthetic oligonucleotide
  Target: ATXN1; (+) strand; PAM type: YTN; PAM sequence: CTG
caactgccttccctctggga

SEQ ID NO: 273383 - DNA, 20 bp, Artificial Sequence
  Description of Artificial Sequence: Synthetic oligonucleotide
  Target: ATXN1; (+) strand; PAM type: YTN; PAM sequence: CTG
ccttccctctgggaccccag

SEQ ID NO: 273384 - DNA, 20 bp, Artificial Sequence
  Description of Artificial Sequence: Synthetic oligonucleotide
  Target: ATXN1; (+) strand; PAM type: YTN; PAM sequence: CTT
ccctctgggaccccagtctc

SEQ ID NO: 273385 - DNA, 20 bp, Artificial Sequence
  Description of Artificial Sequence: Synthetic oligonucleotide
  Target: ATXN1; (+) strand; PAM type: YTN; PAM sequence: TTC
cctctgggaccccagtctct

SEQ ID NO: 273386 - DNA, 20 bp, Artificial Sequence
  Description of Artificial Sequence: Synthetic oligonucleotide
  Target: ATXN1; (+) strand; PAM type: YTN; PAM sequence: CTC
tgggaccccagtctcttttt

SEQ ID NO: 273387 - DNA, 20 bp, Artificial Sequence
  Description of Artificial Sequence: Synthetic oligonucleotide
  Target: ATXN1; (+) strand; PAM type: YTN; PAM sequence: CTG
ggaccccagtctcttttttc

SEQ ID NO: 273388 - DNA, 20 bp, Artificial Sequence
  Description of Artificial Sequence: Synthetic oligonucleotide
  Target: ATXN1; (+) strand; PAM type: YTN; PAM sequence: CTC
ttttttctccaccatctcac

SEQ ID NO: 273389 - DNA, 20 bp, Artificial Sequence
  Description of Artificial Sequence: Synthetic oligonucleotide
  Target: ATXN1; (+) strand; PAM type: YTN; PAM sequence: CTT
ttttctccaccatctcacgg

SEQ ID NO: 273390 - DNA, 20 bp, Artificial Sequence
  Description of Artificial Sequence: Synthetic oligonucleotide
  Target: ATXN1; (+) strand; PAM type: YTN; PAM sequence: TTT
tttctccaccatctcacggg

SEQ ID NO: 273391 - DNA, 20 bp, Artificial Sequence
  Description of Artificial Sequence: Synthetic oligonucleotide
  Target: ATXN1; (+) strand; PAM type: YTN; PAM sequence: TTT
ttctccaccatctcacggga

SEQ ID NO: 273392 - DNA, 20 bp, Artificial Sequence
  Description of Artificial Sequence: Synthetic oligonucleotide
  Target: ATXN1; (+) strand; PAM type: YTN; PAM sequence: TTT
tctccaccatctcacgggat

SEQ ID NO: 273393 - DNA, 20 bp, Artificial Sequence
  Description of Artificial Sequence: Synthetic oligonucleotide
  Target: ATXN1; (+) strand; PAM type: YTN; PAM sequence: TTT
ctccaccatctcacgggata

SEQ ID NO: 273394 - DNA, 20 bp, Artificial Sequence
  Description of Artificial Sequence: Synthetic oligonucleotide
  Target: ATXN1; (+) strand; PAM type: YTN; PAM sequence: TTC
tccaccatctcacgggatat

SEQ ID NO: 273395 - DNA, 20 bp, Artificial Sequence
  Description of Artificial Sequence: Synthetic oligonucleotide
  Target: ATXN1; (+) strand; PAM type: YTN; PAM sequence: CTC
caccatctcacgggatatgg

SEQ ID NO: 273396 - DNA, 20 bp, Artificial Sequence
  Description of Artificial Sequence: Synthetic oligonucleotide
  Target: ATXN1; (+) strand; PAM type: YTN; PAM sequence: CTC
acgggatatggacacagctg

SEQ ID NO: 273397 - DNA, 20 bp, Artificial Sequence
  Description of Artificial Sequence: Synthetic oligonucleotide
  Target: ATXN1; (+) strand; PAM type: YTN; PAM sequence: CTG
taaagctcatctcactaaaa

SEQ ID NO: 273398 - DNA, 20 bp, Artificial Sequence
  Description of Artificial Sequence: Synthetic oligonucleotide
  Target: ATXN1; (+) strand; PAM type: YTN; PAM sequence: CTC
atctcactaaaacatggttc

SEQ ID NO: 273399 - DNA, 20 bp, Artificial Sequence
  Description of Artificial Sequence: Synthetic oligonucleotide
  Target: ATXN1; (+) strand; PAM type: YTN; PAM sequence: CTC
actaaaacatggttcttcac

SEQ ID NO: 273400 - DNA, 20 bp, Artificial Sequence
  Description of Artificial Sequence: Synthetic oligonucleotide
  Target: ATXN1; (+) strand; PAM type: YTN; PAM sequence: CTA
aaacatggttcttcacatcc

SEQ ID NO: 273401 - DNA, 20 bp, Artificial Sequence
  Description of Artificial Sequence: Synthetic oligonucleotide
  Target: ATXN1; (+) strand; PAM type: YTN; PAM sequence: TTC
ttcacatccccaacttgttg

SEQ ID NO: 273402 - DNA, 20 bp, Artificial Sequence
  Description of Artificial Sequence: Synthetic oligonucleotide
  Target: ATXN1; (+) strand; PAM type: YTN; PAM sequence: CTT
cacatccccaacttgttgaa

SEQ ID NO: 273403 - DNA, 20 bp, Artificial Sequence
  Description of Artificial Sequence: Synthetic oligonucleotide
  Target: ATXN1; (+) strand; PAM type: YTN; PAM sequence: TTC
acatccccaacttgttgaaa

SEQ ID NO: 273404 - DNA, 20 bp, Artificial Sequence
  Description of Artificial Sequence: Synthetic oligonucleotide
  Target: ATXN1; (+) strand; PAM type: YTN; PAM sequence: CTT
gttgaaaaatctccagtgac

SEQ ID NO: 273405 - DNA, 20 bp, Artificial Sequence
  Description of Artificial Sequence: Synthetic oligonucleotide
  Target: ATXN1; (+) strand; PAM type: YTN; PAM sequence: TTG
ttgaaaaatctccagtgact

SEQ ID NO: 273406 - DNA, 20 bp, Artificial Sequence
  Description of Artificial Sequence: Synthetic oligonucleotide
  Target: ATXN1; (+) strand; PAM type: YTN; PAM sequence: TTG
aaaaatctccagtgactgcc

SEQ ID NO: 273407 - DNA, 20 bp, Artificial Sequence
  Description of Artificial Sequence: Synthetic oligonucleotide
  Target: ATXN1; (+) strand; PAM type: YTN; PAM sequence: CTC
cagtgactgccaacccccag

SEQ ID NO: 273408 - DNA, 20 bp, Artificial Sequence
  Description of Artificial Sequence: Synthetic oligonucleotide
  Target: ATXN1; (+) strand; PAM type: YTN; PAM sequence: CTG
ccaacccccagttcaggacc

SEQ ID NO: 273409 - DNA, 20 bp, Artificial Sequence
  Description of Artificial Sequence: Synthetic oligonucleotide
  Target: ATXN1; (+) strand; PAM type: YTN; PAM sequence: TTC
aggacccctccccacagcac

SEQ ID NO: 273410 - DNA, 20 bp, Artificial Sequence
  Description of Artificial Sequence: Synthetic oligonucleotide
  Target: ATXN1; (+) strand; PAM type: YTN; PAM sequence: CTC
cccacagcactgcccattta

SEQ ID NO: 273411 - DNA, 20 bp, Artificial Sequence
  Description of Artificial Sequence: Synthetic oligonucleotide
  Target: ATXN1; (+) strand; PAM type: YTN; PAM sequence: CTG
cccatttacacagtgaccac

SEQ ID NO: 273412 - DNA, 20 bp, Artificial Sequence
  Description of Artificial Sequence: Synthetic oligonucleotide
  Target: ATXN1; (+) strand; PAM type: YTN; PAM sequence: TTT
acacagtgaccactcctccc

SEQ ID NO: 273413 - DNA, 20 bp, Artificial Sequence
  Description of Artificial Sequence: Synthetic oligonucleotide
  Target: ATXN1; (+) strand; PAM type: YTN; PAM sequence: TTA
cacagtgaccactcctccct

SEQ ID NO: 273414 - DNA, 20 bp, Artificial Sequence
  Description of Artificial Sequence: Synthetic oligonucleotide
  Target: ATXN1; (+) strand; PAM type: YTN; PAM sequence: CTC
ctccctccctaccactacca

SEQ ID NO: 273415 - DNA, 20 bp, Artificial Sequence
  Description of Artificial Sequence: Synthetic oligonucleotide
  Target: ATXN1; (+) strand; PAM type: YTN; PAM sequence: CTC
cctccctaccactaccaccc

SEQ ID NO: 273416 - DNA, 20 bp, Artificial Sequence
  Description of Artificial Sequence: Synthetic oligonucleotide
  Target: ATXN1; (+) strand; PAM type: YTN; PAM sequence: CTC
cctaccactaccacccccaa

SEQ ID NO: 273417 - DNA, 20 bp, Artificial Sequence
  Description of Artificial Sequence: Synthetic oligonucleotide
  Target: ATXN1; (+) strand; PAM type: YTN; PAM sequence: CTA
ccactaccacccccaaacca

SEQ ID NO: 273418 - DNA, 20 bp, Artificial Sequence
  Description of Artificial Sequence: Synthetic oligonucleotide
  Target: ATXN1; (+) strand; PAM type: YTN; PAM sequence: CTA
ccacccccaaaccacaaacc

SEQ ID NO: 273419 - DNA, 20 bp, Artificial Sequence
  Description of Artificial Sequence: Synthetic oligonucleotide
  Target: ATXN1; (+) strand; PAM type: YTN; PAM sequence: CTG
ggaatctgtcagtggctggg

SEQ ID NO: 273420 - DNA, 20 bp, Artificial Sequence
  Description of Artificial Sequence: Synthetic oligonucleotide
  Target: ATXN1; (+) strand; PAM type: YTN; PAM sequence: CTG
tcagtggctgggactcagtc

SEQ ID NO: 273421 - DNA, 20 bp, Artificial Sequence
  Description of Artificial Sequence: Synthetic oligonucleotide
  Target: ATXN1; (+) strand; PAM type: YTN; PAM sequence: CTG
ggactcagtcctcctcgcag

SEQ ID NO: 273422 - DNA, 20 bp, Artificial Sequence
  Description of Artificial Sequence: Synthetic oligonucleotide
  Target: ATXN1; (+) strand; PAM type: YTN; PAM sequence: CTC
agtcctcctcgcaggcaggt

SEQ ID NO: 273423 - DNA, 20 bp, Artificial Sequence
  Description of Artificial Sequence: Synthetic oligonucleotide
  Target: ATXN1; (+) strand; PAM type: YTN; PAM sequence: CTC
ctcgcaggcaggtttctctt

SEQ ID NO: 273424 - DNA, 20 bp, Artificial Sequence
  Description of Artificial Sequence: Synthetic oligonucleotide
  Target: ATXN1; (+) strand; PAM type: YTN; PAM sequence: CTC
gcaggcaggtttctcttcac

SEQ ID NO: 273425 - DNA, 20 bp, Artificial Sequence
  Description of Artificial Sequence: Synthetic oligonucleotide
  Target: ATXN1; (+) strand; PAM type: YTN; PAM sequence: TTT
ctcttcaccacataatacac

SEQ ID NO: 273426 - DNA, 20 bp, Artificial Sequence
  Description of Artificial Sequence: Synthetic oligonucleotide
  Target: ATXN1; (+) strand; PAM type: YTN; PAM sequence: TTC
tcttcaccacataatacaca

SEQ ID NO: 273427 - DNA, 20 bp, Artificial Sequence
  Description of Artificial Sequence: Synthetic oligonucleotide
  Target: ATXN1; (+) strand; PAM type: YTN; PAM sequence: CTC
ttcaccacataatacacacg

SEQ ID NO: 273428 - DNA, 20 bp, Artificial Sequence
  Description of Artificial Sequence: Synthetic oligonucleotide
  Target: ATXN1; (+) strand; PAM type: YTN; PAM sequence: CTT
caccacataatacacacgta

SEQ ID NO: 273429 - DNA, 20 bp, Artificial Sequence
  Description of Artificial Sequence: Synthetic oligonucleotide
  Target: ATXN1; (+) strand; PAM type: YTN; PAM sequence: TTC
accacataatacacacgtag

SEQ ID NO: 273430 - DNA, 20 bp, Artificial Sequence
  Description of Artificial Sequence: Synthetic oligonucleotide
  Target: ATXN1; (+) strand; PAM type: YTN; PAM sequence: TTG
aggggtccccattctttggt

SEQ ID NO: 273431 - DNA, 20 bp, Artificial Sequence
  Description of Artificial Sequence: Synthetic oligonucleotide
  Target: ATXN1; (+) strand; PAM type: YTN; PAM sequence: TTC
tttggtctgacacatgtggt

SEQ ID NO: 273432 - DNA, 20 bp, Artificial Sequence
  Description of Artificial Sequence: Synthetic oligonucleotide
  Target: ATXN1; (+) strand; PAM type: YTN; PAM sequence: CTT
tggtctgacacatgtggtgt

SEQ ID NO: 273433 - DNA, 20 bp, Artificial Sequence
  Description of Artificial Sequence: Synthetic oligonucleotide
  Target: ATXN1; (+) strand; PAM type: YTN; PAM sequence: TTT
ggtctgacacatgtggtgtg

SEQ ID NO: 273434 - DNA, 20 bp, Artificial Sequence
  Description of Artificial Sequence: Synthetic oligonucleotide
  Target: ATXN1; (+) strand; PAM type: YTN; PAM sequence: TTG
gtctgacacatgtggtgtga

SEQ ID NO: 273435 - DNA, 20 bp, Artificial Sequence
  Description of Artificial Sequence: Synthetic oligonucleotide
  Target: ATXN1; (+) strand; PAM type: YTN; PAM sequence: CTG
acacatgtggtgtgacccct

SEQ ID NO: 273436 - DNA, 20 bp, Artificial Sequence
  Description of Artificial Sequence: Synthetic oligonucleotide
  Target: ATXN1; (+) strand; PAM type: YTN; PAM sequence: CTA
tctccctgtccaaggcagtc

SEQ ID NO: 273437 - DNA, 20 bp, Artificial Sequence
  Description of Artificial Sequence: Synthetic oligonucleotide
  Target: ATXN1; (+) strand; PAM type: YTN; PAM sequence: CTC
cctgtccaaggcagtctccc

SEQ ID NO: 273438 - DNA, 20 bp, Artificial Sequence
  Description of Artificial Sequence: Synthetic oligonucleotide
  Target: ATXN1; (+) strand; PAM type: YTN; PAM sequence: CTG
tccaaggcagtctccccctt

SEQ ID NO: 273439 - DNA, 20 bp, Artificial Sequence
  Description of Artificial Sequence: Synthetic oligonucleotide
  Target: ATXN1; (+) strand; PAM type: YTN; PAM sequence: CTC
cccctttctctctatgagct

SEQ ID NO: 273440 - DNA, 20 bp, Artificial Sequence
  Description of Artificial Sequence: Synthetic oligonucleotide
  Target: ATXN1; (+) strand; PAM type: YTN; PAM sequence: CTT
tctctctatgagctgtccat

SEQ ID NO: 273441 - DNA, 20 bp, Artificial Sequence
  Description of Artificial Sequence: Synthetic oligonucleotide
  Target: ATXN1; (+) strand; PAM type: YTN; PAM sequence: TTT
ctctctatgagctgtccatt

SEQ ID NO: 273442 - DNA, 20 bp, Artificial Sequence
  Description of Artificial Sequence: Synthetic oligonucleotide
  Target: ATXN1; (+) strand; PAM type: YTN; PAM sequence: TTC
tctctatgagctgtccattc

SEQ ID NO: 273443 - DNA, 20 bp, Artificial Sequence
  Description of Artificial Sequence: Synthetic oligonucleotide
  Target: ATXN1; (+) strand; PAM type: YTN; PAM sequence: CTC
tctatgagctgtccattctc

SEQ ID NO: 273444 - DNA, 20 bp, Artificial Sequence
  Description of Artificial Sequence: Synthetic oligonucleotide
  Target: ATXN1; (+) strand; PAM type: YTN; PAM sequence: CTC
tatgagctgtccattctccg

SEQ ID NO: 273445 - DNA, 20 bp, Artificial Sequence
  Description of Artificial Sequence: Synthetic oligonucleotide
  Target: ATXN1; (+) strand; PAM type: YTN; PAM sequence: CTA
tgagctgtccattctccgtg

SEQ ID NO: 273446 - DNA, 20 bp, Artificial Sequence
  Description of Artificial Sequence: Synthetic oligonucleotide
  Target: ATXN1; (+) strand; PAM type: YTN; PAM sequence: CTG
tccattctccgtgttgagtc

SEQ ID NO: 273447 - DNA, 20 bp, Artificial Sequence
  Description of Artificial Sequence: Synthetic oligonucleotide
  Target: ATXN1; (+) strand; PAM type: YTN; PAM sequence: TTC
tccgtgttgagtcctacacg

SEQ ID NO: 273448 - DNA, 20 bp, Artificial Sequence
  Description of Artificial Sequence: Synthetic oligonucleotide
  Target: ATXN1; (+) strand; PAM type: YTN; PAM sequence: CTC
cgtgttgagtcctacacgga

SEQ ID NO: 273449 - DNA, 20 bp, Artificial Sequence
  Description of Artificial Sequence: Synthetic oligonucleotide
  Target: ATXN1; (+) strand; PAM type: YTN; PAM sequence: TTG
agtcctacacggagcttccc

SEQ ID NO: 273450 - DNA, 20 bp, Artificial Sequence
  Description of Artificial Sequence: Synthetic oligonucleotide
  Target: ATXN1; (+) strand; PAM type: YTN; PAM sequence: CTA
cacggagcttcccacttact

SEQ ID NO: 273451 - DNA, 20 bp, Artificial Sequence
  Description of Artificial Sequence: Synthetic oligonucleotide
  Target: ATXN1; (+) strand; PAM type: YTN; PAM sequence: CTT
cccacttactttacatgtta

SEQ ID NO: 273452 - DNA, 20 bp, Artificial Sequence
  Description of Artificial Sequence: Synthetic oligonucleotide
  Target: ATXN1; (+) strand; PAM type: YTN; PAM sequence: TTC
ccacttactttacatgttag

SEQ ID NO: 273453 - DNA, 20 bp, Artificial Sequence
  Description of Artificial Sequence: Synthetic oligonucleotide
  Target: ATXN1; (+) strand; PAM type: YTN; PAM sequence: CTT
actttacatgttagattgct

SEQ ID NO: 273454 - DNA, 20 bp, Artificial Sequence
  Description of Artificial Sequence: Synthetic oligonucleotide
  Target: ATXN1; (+) strand; PAM type: YTN; PAM sequence: TTA
ctttacatgttagattgctg

SEQ ID NO: 273455 - DNA, 20 bp, Artificial Sequence
  Description of Artificial Sequence: Synthetic oligonucleotide
  Target: ATXN1; (+) strand; PAM type: YTN; PAM sequence: CTT
tacatgttagattgctgtgt

SEQ ID NO: 273456 - DNA, 20 bp, Artificial Sequence
  Description of Artificial Sequence: Synthetic oligonucleotide
  Target: ATXN1; (+) strand; PAM type: YTN; PAM sequence: TTT
acatgttagattgctgtgtt

SEQ ID NO: 273457 - DNA, 20 bp, Artificial Sequence
  Description of Artificial Sequence: Synthetic oligonucleotide
  Target: ATXN1; (+) strand; PAM type: YTN; PAM sequence: TTA
catgttagattgctgtgttt

SEQ ID NO: 273458 - DNA, 20 bp, Artificial Sequence
  Description of Artificial Sequence: Synthetic oligonucleotide
  Target: ATXN1; (+) strand; PAM type: YTN; PAM sequence: TTA
gattgctgtgttttcctcag

SEQ ID NO: 273459 - DNA, 20 bp, Artificial Sequence
  Description of Artificial Sequence: Synthetic oligonucleotide
  Target: ATXN1; (+) strand; PAM type: YTN; PAM sequence: TTG
ctgtgttttcctcagcatat

SEQ ID NO: 273460 - DNA, 20 bp, Artificial Sequence
  Description of Artificial Sequence: Synthetic oligonucleotide
  Target: ATXN1; (+) strand; PAM type: YTN; PAM sequence: CTG
tgttttcctcagcatatgcg

SEQ ID NO: 273461 - DNA, 20 bp, Artificial Sequence
  Description of Artificial Sequence: Synthetic oligonucleotide
  Target: ATXN1; (+) strand; PAM type: YTN; PAM sequence: TTT
tcctcagcatatgcgtggcc

SEQ ID NO: 273462 - DNA, 20 bp, Artificial Sequence
  Description of Artificial Sequence: Synthetic oligonucleotide
  Target: ATXN1; (+) strand; PAM type: YTN; PAM sequence: TTT
cctcagcatatgcgtggccc

SEQ ID NO: 273463 - DNA, 20 bp, Artificial Sequence
  Description of Artificial Sequence: Synthetic oligonucleotide
  Target: ATXN1; (+) strand; PAM type: YTN; PAM sequence: TTC
ctcagcatatgcgtggcccc

SEQ ID NO: 273464 - DNA, 20 bp, Artificial Sequence
  Description of Artificial Sequence: Synthetic oligonucleotide
  Target: ATXN1; (+) strand; PAM type: YTN; PAM sequence: CTC
agcatatgcgtggcccctgt

SEQ ID NO: 273465 - DNA, 20 bp, Artificial Sequence
  Description of Artificial Sequence: Synthetic oligonucleotide
  Target: ATXN1; (+) strand; PAM type: YTN; PAM sequence: CTG
tctggaagcccctcttcgtt

SEQ ID NO: 273466 - DNA, 20 bp, Artificial Sequence
  Description of Artificial Sequence: Synthetic oligonucleotide
  Target: ATXN1; (+) strand; PAM type: YTN; PAM sequence: CTG
gaagcccctcttcgttgatc

SEQ ID NO: 273467 - DNA, 20 bp, Artificial Sequence
  Description of Artificial Sequence: Synthetic oligonucleotide
  Target: ATXN1; (+) strand; PAM type: YTN; PAM sequence: CTC
ttcgttgatctggagctgaa

SEQ ID NO: 273468 - DNA, 20 bp, Artificial Sequence
  Description of Artificial Sequence: Synthetic oligonucleotide
  Target: ATXN1; (+) strand; PAM type: YTN; PAM sequence: CTT
cgttgatctggagctgaatt

SEQ ID NO: 273469 - DNA, 20 bp, Artificial Sequence
  Description of Artificial Sequence: Synthetic oligonucleotide
  Target: ATXN1; (+) strand; PAM type: YTN; PAM sequence: TTC
gttgatctggagctgaattg

SEQ ID NO: 273470 - DNA, 20 bp, Artificial Sequence
  Description of Artificial Sequence: Synthetic oligonucleotide
  Target: ATXN1; (+) strand; PAM type: YTN; PAM sequence: TTG
atctggagctgaattgtggt

SEQ ID NO: 273471 - DNA, 20 bp, Artificial Sequence
  Description of Artificial Sequence: Synthetic oligonucleotide
  Target: ATXN1; (+) strand; PAM type: YTN; PAM sequence: CTG
gagctgaattgtggtctgtt

SEQ ID NO: 273472 - DNA, 20 bp, Artificial Sequence
  Description of Artificial Sequence: Synthetic oligonucleotide
  Target: ATXN1; (+) strand; PAM type: YTN; PAM sequence: CTG
aattgtggtctgttcaccag

SEQ ID NO: 273473 - DNA, 20 bp, Artificial Sequence
  Description of Artificial Sequence: Synthetic oligonucleotide
  Target: ATXN1; (+) strand; PAM type: YTN; PAM sequence: TTG
tggtctgttcaccaggaccc

SEQ ID NO: 273474 - DNA, 20 bp, Artificial Sequence
  Description of Artificial Sequence: Synthetic oligonucleotide
  Target: ATXN1; (+) strand; PAM type: YTN; PAM sequence: CTG
ttcaccaggaccccagatga

SEQ ID NO: 273475 - DNA, 20 bp, Artificial Sequence
  Description of Artificial Sequence: Synthetic oligonucleotide
  Target: ATXN1; (+) strand; PAM type: YTN; PAM sequence: TTC
accaggaccccagatgaaag

SEQ ID NO: 273476 - DNA, 20 bp, Artificial Sequence
  Description of Artificial Sequence: Synthetic oligonucleotide
  Target: ATXN1; (+) strand; PAM type: YTN; PAM sequence: CTG
ggatggaatcatggaagcat

SEQ ID NO: 273477 - DNA, 20 bp, Artificial Sequence
  Description of Artificial Sequence: Synthetic oligonucleotide
  Target: ATXN1; (+) strand; PAM type: YTN; PAM sequence: TTA
actttgccttaataaagctt

SEQ ID NO: 273478 - DNA, 20 bp, Artificial Sequence
  Description of Artificial Sequence: Synthetic oligonucleotide
  Target: ATXN1; (+) strand; PAM type: YTN; PAM sequence: CTT
tgccttaataaagcttctta

SEQ ID NO: 273479 - DNA, 20 bp, Artificial Sequence
  Description of Artificial Sequence: Synthetic oligonucleotide
  Target: ATXN1; (+) strand; PAM type: YTN; PAM sequence: TTT
gccttaataaagcttcttaa

SEQ ID NO: 273480 - DNA, 20 bp, Artificial Sequence
  Description of Artificial Sequence: Synthetic oligonucleotide
  Target: ATXN1; (+) strand; PAM type: YTN; PAM sequence: TTG
ccttaataaagcttcttaat

SEQ ID NO: 273481 - DNA, 20 bp, Artificial Sequence
  Description of Artificial Sequence: Synthetic oligonucleotide
  Target: ATXN1; (+) strand; PAM type: YTN; PAM sequence: CTT
aataaagcttcttaattttt

SEQ ID NO: 273482 - DNA, 20 bp, Artificial Sequence
  Description of Artificial Sequence: Synthetic oligonucleotide
  Target: ATXN1; (+) strand; PAM type: YTN; PAM sequence: TTA
ataaagcttcttaattttta

SEQ ID NO: 273483 - DNA, 20 bp, Artificial Sequence
  Description of Artificial Sequence: Synthetic oligonucleotide
  Target: ATXN1; (+) strand; PAM type: YTN; PAM sequence: CTT
cttaatttttaacaagccta

SEQ ID NO: 273484 - DNA, 20 bp, Artificial Sequence
  Description of Artificial Sequence: Synthetic oligonucleotide
  Target: ATXN1; (+) strand; PAM type: YTN; PAM sequence: TTC
ttaatttttaacaagcctaa

SEQ ID NO: 273485 - DNA, 20 bp, Artificial Sequence
  Description of Artificial Sequence: Synthetic oligonucleotide
  Target: ATXN1; (+) strand; PAM type: YTN; PAM sequence: CTT
aatttttaacaagcctaatg

SEQ ID NO: 273486 - DNA, 20 bp, Artificial Sequence
  Description of Artificial Sequence: Synthetic oligonucleotide
  Target: ATXN1; (+) strand; PAM type: YTN; PAM sequence: TTA
atttttaacaagcctaatga

SEQ ID NO: 273487 - DNA, 20 bp, Artificial Sequence
  Description of Artificial Sequence: Synthetic oligonucleotide
  Target: ATXN1; (+) strand; PAM type: YTN; PAM sequence: TTT
ttaacaagcctaatgatctc

SEQ ID NO: 273488 - DNA, 20 bp, Artificial Sequence
  Description of Artificial Sequence: Synthetic oligonucleotide
  Target: ATXN1; (+) strand; PAM type: YTN; PAM sequence: TTT
taacaagcctaatgatctcc

SEQ ID NO: 273489 - DNA, 20 bp, Artificial Sequence
  Description of Artificial Sequence: Synthetic oligonucleotide
  Target: ATXN1; (+) strand; PAM type: YTN; PAM sequence: TTT
aacaagcctaatgatctcca

SEQ ID NO: 273490 - DNA, 20 bp, Artificial Sequence
  Description of Artificial Sequence: Synthetic oligonucleotide
  Target: ATXN1; (+) strand; PAM type: YTN; PAM sequence: TTA
acaagcctaatgatctccat

SEQ ID NO: 273491 - DNA, 20 bp, Artificial Sequence
  Description of Artificial Sequence: Synthetic oligonucleotide
  Target: ATXN1; (+) strand; PAM type: YTN; PAM sequence: CTA
atgatctccatctcattcag

SEQ ID NO: 273492 - DNA, 20 bp, Artificial Sequence
  Description of Artificial Sequence: Synthetic oligonucleotide
  Target: ATXN1; (+) strand; PAM type: YTN; PAM sequence: CTC
catctcattcaggaggaaca

SEQ ID NO: 273493 - DNA, 20 bp, Artificial Sequence
  Description of Artificial Sequence: Synthetic oligonucleotide
  Target: ATXN1; (+) strand; PAM type: YTN; PAM sequence: CTC
attcaggaggaacaaggtca

SEQ ID NO: 273494 - DNA, 20 bp, Artificial Sequence
  Description of Artificial Sequence: Synthetic oligonucleotide
  Target: ATXN1; (+) strand; PAM type: YTN; PAM sequence: TTC
aggaggaacaaggtcagaaa

SEQ ID NO: 273495 - DNA, 20 bp, Artificial Sequence
  Description of Artificial Sequence: Synthetic oligonucleotide
  Target: ATXN1; (+) strand; PAM type: YTN; PAM sequence: CTT
gtgaactgtgagttgagctc

SEQ ID NO: 273496 - DNA, 20 bp, Artificial Sequence
  Description of Artificial Sequence: Synthetic oligonucleotide
  Target: ATXN1; (+) strand; PAM type: YTN; PAM sequence: TTG
tgaactgtgagttgagctct

SEQ ID NO: 273497 - DNA, 20 bp, Artificial Sequence
  Description of Artificial Sequence: Synthetic oligonucleotide
  Target: ATXN1; (+) strand; PAM type: YTN; PAM sequence: CTG
tgagttgagctctggactgt

SEQ ID NO: 273498 - DNA, 20 bp, Artificial Sequence
  Description of Artificial Sequence: Synthetic oligonucleotide
  Target: ATXN1; (+) strand; PAM type: YTN; PAM sequence: TTG
agctctggactgttagacag

SEQ ID NO: 273499 - DNA, 20 bp, Artificial Sequence
  Description of Artificial Sequence: Synthetic oligonucleotide
  Target: ATXN1; (+) strand; PAM type: YTN; PAM sequence: CTC
tggactgttagacagtgatg

SEQ ID NO: 273500 - DNA, 20 bp, Artificial Sequence
  Description of Artificial Sequence: Synthetic oligonucleotide
  Target: ATXN1; (+) strand; PAM type: YTN; PAM sequence: CTG
gactgttagacagtgatgtg

SEQ ID NO: 273501 - DNA, 20 bp, Artificial Sequence
  Description of Artificial Sequence: Synthetic oligonucleotide
  Target: ATXN1; (+) strand; PAM type: YTN; PAM sequence: CTG
ttagacagtgatgtgtctaa

SEQ ID NO: 273502 - DNA, 20 bp, Artificial Sequence
  Description of Artificial Sequence: Synthetic oligonucleotide
  Target: ATXN1; (+) strand; PAM type: YTN; PAM sequence: TTA
gacagtgatgtgtctaagac

SEQ ID NO: 273503 - DNA, 20 bp, Artificial Sequence
  Description of Artificial Sequence: Synthetic oligonucleotide
  Target: ATXN1; (+) strand; PAM type: YTN; PAM sequence: CTA
agacaaggccaatgtctggc

SEQ ID NO: 273504 - DNA, 20 bp, Artificial Sequence
  Description of Artificial Sequence: Synthetic oligonucleotide
  Target: ATXN1; (+) strand; PAM type: YTN; PAM sequence: CTG
gcaggccggggctttagcgt

SEQ ID NO: 273505 - DNA, 20 bp, Artificial Sequence
  Description of Artificial Sequence: Synthetic oligonucleotide
  Target: ATXN1; (+) strand; PAM type: YTN; PAM sequence: CTT
tagcgtaagtttagccacct

SEQ ID NO: 273506 - DNA, 20 bp, Artificial Sequence
  Description of Artificial Sequence: Synthetic oligonucleotide
  Target: ATXN1; (+) strand; PAM type: YTN; PAM sequence: TTT
agcgtaagtttagccacctg

SEQ ID NO: 273507 - DNA, 20 bp, Artificial Sequence
  Description of Artificial Sequence: Synthetic oligonucleotide
  Target: ATXN1; (+) strand; PAM type: YTN; PAM sequence: TTA
gcgtaagtttagccacctgc

SEQ ID NO: 273508 - DNA, 20 bp, Artificial Sequence
  Description of Artificial Sequence: Synthetic oligonucleotide
  Target: ATXN1; (+) strand; PAM type: YTN; PAM sequence: TTT
agccacctgctaaattgagt

SEQ ID NO: 273509 - DNA, 20 bp, Artificial Sequence
  Description of Artificial Sequence: Synthetic oligonucleotide
  Target: ATXN1; (+) strand; PAM type: YTN; PAM sequence: TTA
gccacctgctaaattgagtt

SEQ ID NO: 273510 - DNA, 20 bp, Artificial Sequence
  Description of Artificial Sequence: Synthetic oligonucleotide
  Target: ATXN1; (+) strand; PAM type: YTN; PAM sequence: CTG
ctaaattgagtttaatttgc

SEQ ID NO: 273511 - DNA, 20 bp, Artificial Sequence
  Description of Artificial Sequence: Synthetic oligonucleotide
  Target: ATXN1; (+) strand; PAM type: YTN; PAM sequence: CTA
aattgagtttaatttgcccg

SEQ ID NO: 273512 - DNA, 20 bp, Artificial Sequence
  Description of Artificial Sequence: Synthetic oligonucleotide
  Target: ATXN1; (+) strand; PAM type: YTN; PAM sequence: TTG
agtttaatttgcccgtgtcc

SEQ ID NO: 273513 - DNA, 20 bp, Artificial Sequence
  Description of Artificial Sequence: Synthetic oligonucleotide
  Target: ATXN1; (+) strand; PAM type: YTN; PAM sequence: TTT
aatttgcccgtgtccttatg

SEQ ID NO: 273514 - DNA, 20 bp, Artificial Sequence
  Description of Artificial Sequence: Synthetic oligonucleotide
  Target: ATXN1; (+) strand; PAM type: YTN; PAM sequence: TTA
atttgcccgtgtccttatga

SEQ ID NO: 273515 - DNA, 20 bp, Artificial Sequence
  Description of Artificial Sequence: Synthetic oligonucleotide
  Target: ATXN1; (+) strand; PAM type: YTN; PAM sequence: TTT
gcccgtgtccttatgattgt

SEQ ID NO: 273516 - DNA, 20 bp, Artificial Sequence
  Description of Artificial Sequence: Synthetic oligonucleotide
  Target: ATXN1; (+) strand; PAM type: YTN; PAM sequence: TTG
cccgtgtccttatgattgtc

SEQ ID NO: 273517 - DNA, 20 bp, Artificial Sequence
  Description of Artificial Sequence: Synthetic oligonucleotide
  Target: ATXN1; (+) strand; PAM type: YTN; PAM sequence: CTT
atgattgtcccatcaccata

SEQ ID NO: 273518 - DNA, 20 bp, Artificial Sequence
  Description of Artificial Sequence: Synthetic oligonucleotide
  Target: ATXN1; (+) strand; PAM type: YTN; PAM sequence: TTA
tgattgtcccatcaccatag

SEQ ID NO: 273519 - DNA, 20 bp, Artificial Sequence
  Description of Artificial Sequence: Synthetic oligonucleotide
  Target: ATXN1; (+) strand; PAM type: YTN; PAM sequence: TTG
tcccatcaccatagctaatt

SEQ ID NO: 273520 - DNA, 20 bp, Artificial Sequence
  Description of Artificial Sequence: Synthetic oligonucleotide
  Target: ATXN1; (+) strand; PAM type: YTN; PAM sequence: CTA
attaatgttaactatgttgt

SEQ ID NO: 273521 - DNA, 20 bp, Artificial Sequence
  Description of Artificial Sequence: Synthetic oligonucleotide
  Target: ATXN1; (+) strand; PAM type: YTN; PAM sequence: TTA
atgttaactatgttgttatt

SEQ ID NO: 273522 - DNA, 20 bp, Artificial Sequence
  Description of Artificial Sequence: Synthetic oligonucleotide
  Target: ATXN1; (+) strand; PAM type: YTN; PAM sequence: TTA
actatgttgttatttttatt

SEQ ID NO: 273523 - DNA, 20 bp, Artificial Sequence
  Description of Artificial Sequence: Synthetic oligonucleotide
  Target: ATXN1; (+) strand; PAM type: YTN; PAM sequence: CTA
tgttgttatttttattaatg

SEQ ID NO: 273524 - DNA, 20 bp, Artificial Sequence
  Description of Artificial Sequence: Synthetic oligonucleotide
  Target: ATXN1; (+) strand; PAM type: YTN; PAM sequence: TTG
ttatttttattaatgctctt

SEQ ID NO: 273525 - DNA, 20 bp, Artificial Sequence
  Description of Artificial Sequence: Synthetic oligonucleotide
  Target: ATXN1; (+) strand; PAM type: YTN; PAM sequence: TTA
tttttattaatgctctttta

SEQ ID NO: 273526 - DNA, 20 bp, Artificial Sequence
  Description of Artificial Sequence: Synthetic oligonucleotide
  Target: ATXN1; (+) strand; PAM type: YTN; PAM sequence: TTT
ttattaatgctcttttaatt

SEQ ID NO: 273527 - DNA, 20 bp, Artificial Sequence
  Description of Artificial Sequence: Synthetic oligonucleotide
  Target: ATXN1; (+) strand; PAM type: YTN; PAM sequence: TTT
tattaatgctcttttaattt

SEQ ID NO: 273528 - DNA, 20 bp, Artificial Sequence
  Description of Artificial Sequence: Synthetic oligonucleotide
  Target: ATXN1; (+) strand; PAM type: YTN; PAM sequence: TTT
attaatgctcttttaatttt

SEQ ID NO: 273529 - DNA, 20 bp, Artificial Sequence
  Description of Artificial Sequence: Synthetic oligonucleotide
  Target: ATXN1; (+) strand; PAM type: YTN; PAM sequence: TTA
ttaatgctcttttaatttta

SEQ ID NO: 273530 - DNA, 20 bp, Artificial Sequence
  Description of Artificial Sequence: Synthetic oligonucleotide
  Target: ATXN1; (+) strand; PAM type: YTN; PAM sequence: TTA
atgctcttttaattttagta

SEQ ID NO: 273531 - DNA, 20 bp, Artificial Sequence
  Description of Artificial Sequence: Synthetic oligonucleotide
  Target: ATXN1; (+) strand; PAM type: YTN; PAM sequence: CTC
ttttaattttagtaaatatt

SEQ ID NO: 273532 - DNA, 20 bp, Artificial Sequence
  Description of Artificial Sequence: Synthetic oligonucleotide
  Target: ATXN1; (+) strand; PAM type: YTN; PAM sequence: CTT
ttaattttagtaaatatttt

SEQ ID NO: 273533 - DNA, 20 bp, Artificial Sequence
  Description of Artificial Sequence: Synthetic oligonucleotide
  Target: ATXN1; (+) strand; PAM type: YTN; PAM sequence: TTT
taattttagtaaatattttt

SEQ ID NO: 273534 - DNA, 20 bp, Artificial Sequence
  Description of Artificial Sequence: Synthetic oligonucleotide
  Target: ATXN1; (+) strand; PAM type: YTN; PAM sequence: TTT
aattttagtaaatatttttg

SEQ ID NO: 273535 - DNA, 20 bp, Artificial Sequence
  Description of Artificial Sequence: Synthetic oligonucleotide
  Target: ATXN1; (+) strand; PAM type: YTN; PAM sequence: TTA
attttagtaaatatttttga

SEQ ID NO: 273536 - DNA, 20 bp, Artificial Sequence
  Description of Artificial Sequence: Synthetic oligonucleotide
  Target: ATXN1; (+) strand; PAM type: YTN; PAM sequence: TTT
tagtaaatatttttgagcca

SEQ ID NO: 273537 - DNA, 20 bp, Artificial Sequence
  Description of Artificial Sequence: Synthetic oligonucleotide
  Target: ATXN1; (+) strand; PAM type: YTN; PAM sequence: TTT
agtaaatatttttgagccag

SEQ ID NO: 273538 - DNA, 20 bp, Artificial Sequence
  Description of Artificial Sequence: Synthetic oligonucleotide
  Target: ATXN1; (+) strand; PAM type: YTN; PAM sequence: TTA
gtaaatatttttgagccaga

SEQ ID NO: 273539 - DNA, 20 bp, Artificial Sequence
  Description of Artificial Sequence: Synthetic oligonucleotide
  Target: ATXN1; (+) strand; PAM type: YTN; PAM sequence: TTT
ttgagccagatctgactgtt

SEQ ID NO: 273540 - DNA, 20 bp, Artificial Sequence
  Description of Artificial Sequence: Synthetic oligonucleotide
  Target: ATXN1; (+) strand; PAM type: YTN; PAM sequence: TTT
tgagccagatctgactgttc

SEQ ID NO: 273541 - DNA, 20 bp, Artificial Sequence
  Description of Artificial Sequence: Synthetic oligonucleotide
  Target: ATXN1; (+) strand; PAM type: YTN; PAM sequence: TTT
gagccagatctgactgttcc

SEQ ID NO: 273542 - DNA, 20 bp, Artificial Sequence
  Description of Artificial Sequence: Synthetic oligonucleotide
  Target: ATXN1; (+) strand; PAM type: YTN; PAM sequence: TTG
agccagatctgactgttcca

SEQ ID NO: 273543 - DNA, 20 bp, Artificial Sequence
  Description of Artificial Sequence: Synthetic oligonucleotide
  Target: ATXN1; (+) strand; PAM type: YTN; PAM sequence: CTG
actgttccaagcctgggctt

SEQ ID NO: 273544 - DNA, 20 bp, Artificial Sequence
  Description of Artificial Sequence: Synthetic oligonucleotide
  Target: ATXN1; (+) strand; PAM type: YTN; PAM sequence: CTG
ttccaagcctgggctttggg

SEQ ID NO: 273545 - DNA, 20 bp, Artificial Sequence
  Description of Artificial Sequence: Synthetic oligonucleotide
  Target: ATXN1; (+) strand; PAM type: YTN; PAM sequence: TTC
caagcctgggctttgggggc

SEQ ID NO: 273546 - DNA, 20 bp, Artificial Sequence
  Description of Artificial Sequence: Synthetic oligonucleotide
  Target: ATXN1; (+) strand; PAM type: YTN; PAM sequence: CTG
ggctttgggggctgccaggt

SEQ ID NO: 273547 - DNA, 20 bp, Artificial Sequence
  Description of Artificial Sequence: Synthetic oligonucleotide
  Target: ATXN1; (+) strand; PAM type: YTN; PAM sequence: CTT
tgggggctgccaggtatatt

SEQ ID NO: 273548 - DNA, 20 bp, Artificial Sequence
  Description of Artificial Sequence: Synthetic oligonucleotide
  Target: ATXN1; (+) strand; PAM type: YTN; PAM sequence: TTT
gggggctgccaggtatatta

SEQ ID NO: 273549 - DNA, 20 bp, Artificial Sequence
  Description of Artificial Sequence: Synthetic oligonucleotide
  Target: ATXN1; (+) strand; PAM type: YTN; PAM sequence: TTG
ggggctgccaggtatattac

SEQ ID NO: 273550 - DNA, 20 bp, Artificial Sequence
  Description of Artificial Sequence: Synthetic oligonucleotide
  Target: ATXN1; (+) strand; PAM type: YTN; PAM sequence: CTG
ccaggtatattactgctaca

SEQ ID NO: 273551 - DNA, 20 bp, Artificial Sequence
  Description of Artificial Sequence: Synthetic oligonucleotide
  Target: ATXN1; (+) strand; PAM type: YTN; PAM sequence: TTA
ctgctacaacaccatcagga

SEQ ID NO: 273552 - DNA, 20 bp, Artificial Sequence
  Description of Artificial Sequence: Synthetic oligonucleotide
  Target: ATXN1; (+) strand; PAM type: YTN; PAM sequence: CTG
ctacaacaccatcaggagca

SEQ ID NO: 273553 - DNA, 20 bp, Artificial Sequence
  Description of Artificial Sequence: Synthetic oligonucleotide
  Target: ATXN1; (+) strand; PAM type: YTN; PAM sequence: CTA
caacaccatcaggagcaagt

SEQ ID NO: 273554 - DNA, 20 bp, Artificial Sequence
  Description of Artificial Sequence: Synthetic oligonucleotide
  Target: ATXN1; (+) strand; PAM type: YTN; PAM sequence: TTC
ttaagttcattcattctttt

SEQ ID NO: 273555 - DNA, 20 bp, Artificial Sequence
  Description of Artificial Sequence: Synthetic oligonucleotide
  Target: ATXN1; (+) strand; PAM type: YTN; PAM sequence: CTT
aagttcattcattcttttac

SEQ ID NO: 273556 - DNA, 20 bp, Artificial Sequence
  Description of Artificial Sequence: Synthetic oligonucleotide
  Target: ATXN1; (+) strand; PAM type: YTN; PAM sequence: TTA
agttcattcattcttttacc

SEQ ID NO: 273557 - DNA, 20 bp, Artificial Sequence
  Description of Artificial Sequence: Synthetic oligonucleotide
  Target: ATXN1; (+) strand; PAM type: YTN; PAM sequence: TTC
attcattcttttaccctaca

SEQ ID NO: 273558 - DNA, 20 bp, Artificial Sequence
  Description of Artificial Sequence: Synthetic oligonucleotide
  Target: ATXN1; (+) strand; PAM type: YTN; PAM sequence: TTC
attcttttaccctacacgtt

SEQ ID NO: 273559 - DNA, 20 bp, Artificial Sequence
  Description of Artificial Sequence: Synthetic oligonucleotide
  Target: ATXN1; (+) strand; PAM type: YTN; PAM sequence: TTC
ttttaccctacacgttatcg

SEQ ID NO: 273560 - DNA, 20 bp, Artificial Sequence
  Description of Artificial Sequence: Synthetic oligonucleotide
  Target: ATXN1; (+) strand; PAM type: YTN; PAM sequence: CTT
ttaccctacacgttatcgag

SEQ ID NO: 273561 - DNA, 20 bp, Artificial Sequence
  Description of Artificial Sequence: Synthetic oligonucleotide
  Target: ATXN1; (+) strand; PAM type: YTN; PAM sequence: TTT
taccctacacgttatcgagc

SEQ ID NO: 273562 - DNA, 20 bp, Artificial Sequence
  Description of Artificial Sequence: Synthetic oligonucleotide
  Target: ATXN1; (+) strand; PAM type: YTN; PAM sequence: TTT
accctacacgttatcgagca

SEQ ID NO: 273563 - DNA, 20 bp, Artificial Sequence
  Description of Artificial Sequence: Synthetic oligonucleotide
  Target: ATXN1; (+) strand; PAM type: YTN; PAM sequence: TTA
ccctacacgttatcgagcac

SEQ ID NO: 273564 - DNA, 20 bp, Artificial Sequence
  Description of Artificial Sequence: Synthetic oligonucleotide
  Target: ATXN1; (+) strand; PAM type: YTN; PAM sequence: CTA
cacgttatcgagcacctact

SEQ ID NO: 273565 - DNA, 20 bp, Artificial Sequence
  Description of Artificial Sequence: Synthetic oligonucleotide
  Target: ATXN1; (+) strand; PAM type: YTN; PAM sequence: TTA
tcgagcacctactgtgtgct

SEQ ID NO: 273566 - DNA, 20 bp, Artificial Sequence
  Description of Artificial Sequence: Synthetic oligonucleotide
  Target: ATXN1; (+) strand; PAM type: YTN; PAM sequence: CTA
ctgtgtgctgtgtgagagga

SEQ ID NO: 273567 - DNA, 20 bp, Artificial Sequence
  Description of Artificial Sequence: Synthetic oligonucleotide
  Target: ATXN1; (+) strand; PAM type: YTN; PAM sequence: CTG
tgtgctgtgtgagaggactg

SEQ ID NO: 273568 - DNA, 20 bp, Artificial Sequence
  Description of Artificial Sequence: Synthetic oligonucleotide
  Target: ATXN1; (+) strand; PAM type: YTN; PAM sequence: CTG
tgtgagaggactgggacgtt

SEQ ID NO: 273569 - DNA, 20 bp, Artificial Sequence
  Description of Artificial Sequence: Synthetic oligonucleotide
  Target: ATXN1; (+) strand; PAM type: YTN; PAM sequence: CTG
ggacgttgggagttatacaa

SEQ ID NO: 273570 - DNA, 20 bp, Artificial Sequence
  Description of Artificial Sequence: Synthetic oligonucleotide
  Target: ATXN1; (+) strand; PAM type: YTN; PAM sequence: TTG
ggagttatacaaaaagctaa

SEQ ID NO: 273571 - DNA, 20 bp, Artificial Sequence
  Description of Artificial Sequence: Synthetic oligonucleotide
  Target: ATXN1; (+) strand; PAM type: YTN; PAM sequence: TTA
tacaaaaagctaaaagccat

SEQ ID NO: 273572 - DNA, 20 bp, Artificial Sequence
  Description of Artificial Sequence: Synthetic oligonucleotide
  Target: ATXN1; (+) strand; PAM type: YTN; PAM sequence: CTA
aaagccatgcttaggacata

SEQ ID NO: 273573 - DNA, 20 bp, Artificial Sequence
  Description of Artificial Sequence: Synthetic oligonucleotide
  Target: ATXN1; (+) strand; PAM type: YTN; PAM sequence: CTT
aggacatagcaggtgacaag

SEQ ID NO: 273574 - DNA, 20 bp, Artificial Sequence
  Description of Artificial Sequence: Synthetic oligonucleotide
  Target: ATXN1; (+) strand; PAM type: YTN; PAM sequence: TTA
ggacatagcaggtgacaagt

SEQ ID NO: 273575 - DNA, 20 bp, Artificial Sequence
  Description of Artificial Sequence: Synthetic oligonucleotide
  Target: ATXN1; (+) strand; PAM type: YTN; PAM sequence: CTT
ctaggccaaagctttgaagc

SEQ ID NO: 273576 - DNA, 20 bp, Artificial Sequence
  Description of Artificial Sequence: Synthetic oligonucleotide
  Target: ATXN1; (+) strand; PAM type: YTN; PAM sequence: TTC
taggccaaagctttgaagca

SEQ ID NO: 273577 - DNA, 20 bp, Artificial Sequence
  Description of Artificial Sequence: Synthetic oligonucleotide
  Target: ATXN1; (+) strand; PAM type: YTN; PAM sequence: CTA
ggccaaagctttgaagcatt

SEQ ID NO: 273578 - DNA, 20 bp, Artificial Sequence
  Description of Artificial Sequence: Synthetic oligonucleotide
  Target: ATXN1; (+) strand; PAM type: YTN; PAM sequence: CTT
tgaagcattgaattgctggt

SEQ ID NO: 273579 - DNA, 20 bp, Artificial Sequence
  Description of Artificial Sequence: Synthetic oligonucleotide
  Target: ATXN1; (+) strand; PAM type: YTN; PAM sequence: TTT
gaagcattgaattgctggtg

SEQ ID NO: 273580 - DNA, 20 bp, Artificial Sequence
  Description of Artificial Sequence: Synthetic oligonucleotide
  Target: ATXN1; (+) strand; PAM type: YTN; PAM sequence: TTG
aagcattgaattgctggtgc

SEQ ID NO: 273581 - DNA, 20 bp, Artificial Sequence
  Description of Artificial Sequence: Synthetic oligonucleotide
  Target: ATXN1; (+) strand; PAM type: YTN; PAM sequence: TTG
aattgctggtgcaattttcc

SEQ ID NO: 273582 - DNA, 20 bp, Artificial Sequence
  Description of Artificial Sequence: Synthetic oligonucleotide
  Target: ATXN1; (+) strand; PAM type: YTN; PAM sequence: TTG
ctggtgcaattttccaattt

SEQ ID NO: 273583 - DNA, 20 bp, Artificial Sequence
  Description of Artificial Sequence: Synthetic oligonucleotide
  Target: ATXN1; (+) strand; PAM type: YTN; PAM sequence: CTG
gtgcaattttccaatttttc

SEQ ID NO: 273584 - DNA, 20 bp, Artificial Sequence
  Description of Artificial Sequence: Synthetic oligonucleotide
  Target: ATXN1; (+) strand; PAM type: YTN; PAM sequence: TTT
tccaatttttctctcttcca

SEQ ID NO: 273585 - DNA, 20 bp, Artificial Sequence
  Description of Artificial Sequence: Synthetic oligonucleotide
  Target: ATXN1; (+) strand; PAM type: YTN; PAM sequence: TTT
ccaatttttctctcttccag

SEQ ID NO: 273586 - DNA, 20 bp, Artificial Sequence
  Description of Artificial Sequence: Synthetic oligonucleotide
  Target: ATXN1; (+) strand; PAM type: YTN; PAM sequence: TTC
caatttttctctcttccagt

SEQ ID NO: 273587 - DNA, 20 bp, Artificial Sequence
  Description of Artificial Sequence: Synthetic oligonucleotide
  Target: ATXN1; (+) strand; PAM type: YTN; PAM sequence: TTT
ttctctcttccagtgatcat

SEQ ID NO: 273588 - DNA, 20 bp, Artificial Sequence
  Description of Artificial Sequence: Synthetic oligonucleotide
  Target: ATXN1; (+) strand; PAM type: YTN; PAM sequence: TTT
tctctcttccagtgatcatg

SEQ ID NO: 273589 - DNA, 20 bp, Artificial Sequence
  Description of Artificial Sequence: Synthetic oligonucleotide
  Target: ATXN1; (+) strand; PAM type: YTN; PAM sequence: TTT
ctctcttccagtgatcatga

SEQ ID NO: 273590 - DNA, 20 bp, Artificial Sequence
  Description of Artificial Sequence: Synthetic oligonucleotide
  Target: ATXN1; (+) strand; PAM type: YTN; PAM sequence: TTC
tctcttccagtgatcatgaa

SEQ ID NO: 273591 - DNA, 20 bp, Artificial Sequence
  Description of Artificial Sequence: Synthetic oligonucleotide
  Target: ATXN1; (+) strand; PAM type: YTN; PAM sequence: CTC
tcttccagtgatcatgaaag

SEQ ID NO: 273592 - DNA, 20 bp, Artificial Sequence
  Description of Artificial Sequence: Synthetic oligonucleotide
  Target: ATXN1; (+) strand; PAM type: YTN; PAM sequence: CTC
ttccagtgatcatgaaagag

SEQ ID NO: 273593 - DNA, 20 bp, Artificial Sequence
  Description of Artificial Sequence: Synthetic oligonucleotide
  Target: ATXN1; (+) strand; PAM type: YTN; PAM sequence: CTT
ccagtgatcatgaaagaggc

SEQ ID NO: 273594 - DNA, 20 bp, Artificial Sequence
  Description of Artificial Sequence: Synthetic oligonucleotide
  Target: ATXN1; (+) strand; PAM type: YTN; PAM sequence: TTC
cagtgatcatgaaagaggcc

SEQ ID NO: 273595 - DNA, 20 bp, Artificial Sequence
  Description of Artificial Sequence: Synthetic oligonucleotide
  Target: ATXN1; (+) strand; PAM type: YTN; PAM sequence: CTA
gatggctggataaaaagatc

SEQ ID NO: 273596 - DNA, 20 bp, Artificial Sequence
  Description of Artificial Sequence: Synthetic oligonucleotide
  Target: ATXN1; (+) strand; PAM type: YTN; PAM sequence: CTG
gataaaaagatcaaagcaga

SEQ ID NO: 273597 - DNA, 20 bp, Artificial Sequence
  Description of Artificial Sequence: Synthetic oligonucleotide
  Target: ATXN1; (+) strand; PAM type: YTN; PAM sequence: CTG
catcatggagttatgcatgg

SEQ ID NO: 273598 - DNA, 20 bp, Artificial Sequence
  Description of Artificial Sequence: Synthetic oligonucleotide
  Target: ATXN1; (+) strand; PAM type: YTN; PAM sequence: TTA
tgcatggaggacagttgtcc

SEQ ID NO: 273599 - DNA, 20 bp, Artificial Sequence
  Description of Artificial Sequence: Synthetic oligonucleotide
  Target: ATXN1; (+) strand; PAM type: YTN; PAM sequence: TTG
tcctggagagatactgcatc

SEQ ID NO: 273600 - DNA, 20 bp, Artificial Sequence
  Description of Artificial Sequence: Synthetic oligonucleotide
  Target: ATXN1; (+) strand; PAM type: YTN; PAM sequence: CTG
gagagatactgcatccacag

SEQ ID NO: 273601 - DNA, 20 bp, Artificial Sequence
  Description of Artificial Sequence: Synthetic oligonucleotide
  Target: ATXN1; (+) strand; PAM type: YTN; PAM sequence: CTG
catccacagcggtcactgta

SEQ ID NO: 273602 - DNA, 20 bp, Artificial Sequence
  Description of Artificial Sequence: Synthetic oligonucleotide
  Target: ATXN1; (+) strand; PAM type: YTN; PAM sequence: CTG
tatgaatgagaaataaactt

SEQ ID NO: 273603 - DNA, 20 bp, Artificial Sequence
  Description of Artificial Sequence: Synthetic oligonucleotide
  Target: ATXN1; (+) strand; PAM type: YTN; PAM sequence: CTT
ttattttgctaagctactga

SEQ ID NO: 273604 - DNA, 20 bp, Artificial Sequence
  Description of Artificial Sequence: Synthetic oligonucleotide
  Target: ATXN1; (+) strand; PAM type: YTN; PAM sequence: TTT
tattttgctaagctactgaa

SEQ ID NO: 273605 - DNA, 20 bp, Artificial Sequence
  Description of Artificial Sequence: Synthetic oligonucleotide
  Target: ATXN1; (+) strand; PAM type: YTN; PAM sequence: TTT
attttgctaagctactgaaa

SEQ ID NO: 273606 - DNA, 20 bp, Artificial Sequence
  Description of Artificial Sequence: Synthetic oligonucleotide
  Target: ATXN1; (+) strand; PAM type: YTN; PAM sequence: TTA
ttttgctaagctactgaaag

SEQ ID NO: 273607 - DNA, 20 bp, Artificial Sequence
  Description of Artificial Sequence: Synthetic oligonucleotide
  Target: ATXN1; (+) strand; PAM type: YTN; PAM sequence: TTT
tgctaagctactgaaagttt

SEQ ID NO: 273608 - DNA, 20 bp, Artificial Sequence
  Description of Artificial Sequence: Synthetic oligonucleotide
  Target: ATXN1; (+) strand; PAM type: YTN; PAM sequence: TTT
gctaagctactgaaagttta

SEQ ID NO: 273609 - DNA, 20 bp, Artificial Sequence
  Description of Artificial Sequence: Synthetic oligonucleotide
  Target: ATXN1; (+) strand; PAM type: YTN; PAM sequence: TTG
ctaagctactgaaagtttag

SEQ ID NO: 273610 - DNA, 20 bp, Artificial Sequence
  Description of Artificial Sequence: Synthetic oligonucleotide
  Target: ATXN1; (+) strand; PAM type: YTN; PAM sequence: CTA
agctactgaaagtttagggt

SEQ ID NO: 273611 - DNA, 20 bp, Artificial Sequence
  Description of Artificial Sequence: Synthetic oligonucleotide
  Target: ATXN1; (+) strand; PAM type: YTN; PAM sequence: CTA
ctgaaagtttagggttgacc

SEQ ID NO: 273612 - DNA, 20 bp, Artificial Sequence
  Description of Artificial Sequence: Synthetic oligonucleotide
  Target: ATXN1; (+) strand; PAM type: YTN; PAM sequence: CTG
aaagtttagggttgaccttt

SEQ ID NO: 273613 - DNA, 20 bp, Artificial Sequence
  Description of Artificial Sequence: Synthetic oligonucleotide
  Target: ATXN1; (+) strand; PAM type: YTN; PAM sequence: TTT
agggttgacctttctgcaac

SEQ ID NO: 273614 - DNA, 20 bp, Artificial Sequence
  Description of Artificial Sequence: Synthetic oligonucleotide
  Target: ATXN1; (+) strand; PAM type: YTN; PAM sequence: TTA
gggttgacctttctgcaaca

SEQ ID NO: 273615 - DNA, 20 bp, Artificial Sequence
  Description of Artificial Sequence: Synthetic oligonucleotide
  Target: ATXN1; (+) strand; PAM type: YTN; PAM sequence: TTG
acctttctgcaacaaaagct

SEQ ID NO: 273616 - DNA, 20 bp, Artificial Sequence
  Description of Artificial Sequence: Synthetic oligonucleotide
  Target: ATXN1; (+) strand; PAM type: YTN; PAM sequence: CTT
tctgcaacaaaagcttatcc

SEQ ID NO: 273617 - DNA, 20 bp, Artificial Sequence
  Description of Artificial Sequence: Synthetic oligonucleotide
  Target: ATXN1; (+) strand; PAM type: YTN; PAM sequence: TTT
ctgcaacaaaagcttatcct

SEQ ID NO: 273618 - DNA, 20 bp, Artificial Sequence
  Description of Artificial Sequence: Synthetic oligonucleotide
  Target: ATXN1; (+) strand; PAM type: YTN; PAM sequence: TTC
tgcaacaaaagcttatccta

SEQ ID NO: 273619 - DNA, 20 bp, Artificial Sequence
  Description of Artificial Sequence: Synthetic oligonucleotide
  Target: ATXN1; (+) strand; PAM type: YTN; PAM sequence: CTG
caacaaaagcttatcctatc

SEQ ID NO: 273620 - DNA, 20 bp, Artificial Sequence
  Description of Artificial Sequence: Synthetic oligonucleotide
  Target: ATXN1; (+) strand; PAM type: YTN; PAM sequence: CTT
atcctatcctgactaataca

SEQ ID NO: 273621 - DNA, 20 bp, Artificial Sequence
  Description of Artificial Sequence: Synthetic oligonucleotide
  Target: ATXN1; (+) strand; PAM type: YTN; PAM sequence: TTA
tcctatcctgactaatacaa

SEQ ID NO: 273622 - DNA, 20 bp, Artificial Sequence
  Description of Artificial Sequence: Synthetic oligonucleotide
  Target: ATXN1; (+) strand; PAM type: YTN; PAM sequence: CTA
tcctgactaatacaatagct

SEQ ID NO: 273623 - DNA, 20 bp, Artificial Sequence
  Description of Artificial Sequence: Synthetic oligonucleotide
  Target: ATXN1; (+) strand; PAM type: YTN; PAM sequence: CTG
actaatacaatagcttttat

SEQ ID NO: 273624 - DNA, 20 bp, Artificial Sequence
  Description of Artificial Sequence: Synthetic oligonucleotide
  Target: ATXN1; (+) strand; PAM type: YTN; PAM sequence: CTA
atacaatagcttttattttc

SEQ ID NO: 273625 - DNA, 20 bp, Artificial Sequence
  Description of Artificial Sequence: Synthetic oligonucleotide
  Target: ATXN1; (+) strand; PAM type: YTN; PAM sequence: CTT
ttattttctctattattacc

SEQ ID NO: 273626 - DNA, 20 bp, Artificial Sequence
  Description of Artificial Sequence: Synthetic oligonucleotide
  Target: ATXN1; (+) strand; PAM type: YTN; PAM sequence: TTT
tattttctctattattacca

SEQ ID NO: 273627 - DNA, 20 bp, Artificial Sequence
  Description of Artificial Sequence: Synthetic oligonucleotide
  Target: ATXN1; (+) strand; PAM type: YTN; PAM sequence: TTT
attttctctattattaccat

SEQ ID NO: 273628 - DNA, 20 bp, Artificial Sequence
  Description of Artificial Sequence: Synthetic oligonucleotide
  Target: ATXN1; (+) strand; PAM type: YTN; PAM sequence: TTA
ttttctctattattaccatt

SEQ ID NO: 273629 - DNA, 20 bp, Artificial Sequence
  Description of Artificial Sequence: Synthetic oligonucleotide
  Target: ATXN1; (+) strand; PAM type: YTN; PAM sequence: TTT
tctctattattaccatttgg

SEQ ID NO: 273630 - DNA, 20 bp, Artificial Sequence
  Description of Artificial Sequence: Synthetic oligonucleotide
  Target: ATXN1; (+) strand; PAM type: YTN; PAM sequence: TTT
ctctattattaccatttggt

SEQ ID NO: 273631 - DNA, 20 bp, Artificial Sequence
  Description of Artificial Sequence: Synthetic oligonucleotide
  Target: ATXN1; (+) strand; PAM type: YTN; PAM sequence: TTC
tctattattaccatttggta

SEQ ID NO: 273632 - DNA, 20 bp, Artificial Sequence
  Description of Artificial Sequence: Synthetic oligonucleotide
  Target: ATXN1; (+) strand; PAM type: YTN; PAM sequence: CTC
tattattaccatttggtaat

SEQ ID NO: 273633 - DNA, 20 bp, Artificial Sequence
  Description of Artificial Sequence: Synthetic oligonucleotide
  Target: ATXN1; (+) strand; PAM type: YTN; PAM sequence: CTA
ttattaccatttggtaatga

SEQ ID NO: 273634 - DNA, 20 bp, Artificial Sequence
  Description of Artificial Sequence: Synthetic oligonucleotide
  Target: ATXN1; (+) strand; PAM type: YTN; PAM sequence: TTA
ttaccatttggtaatgaatc

SEQ ID NO: 273635 - DNA, 20 bp, Artificial Sequence
  Description of Artificial Sequence: Synthetic oligonucleotide
  Target: ATXN1; (+) strand; PAM type: YTN; PAM sequence: TTA
ccatttggtaatgaatcatg

SEQ ID NO: 273636 - DNA, 20 bp, Artificial Sequence
  Description of Artificial Sequence: Synthetic oligonucleotide
  Target: ATXN1; (+) strand; PAM type: YTN; PAM sequence: TTT
ggtaatgaatcatgtctaac

SEQ ID NO: 273637 - DNA, 20 bp, Artificial Sequence
  Description of Artificial Sequence: Synthetic oligonucleotide
  Target: ATXN1; (+) strand; PAM type: YTN; PAM sequence: TTG
gtaatgaatcatgtctaaca

SEQ ID NO: 273638 - DNA, 20 bp, Artificial Sequence
  Description of Artificial Sequence: Synthetic oligonucleotide
  Target: ATXN1; (+) strand; PAM type: YTN; PAM sequence: CTA
acaatgccttgtgctaggct

SEQ ID NO: 273639 - DNA, 20 bp, Artificial Sequence
  Description of Artificial Sequence: Synthetic oligonucleotide
  Target: ATXN1; (+) strand; PAM type: YTN; PAM sequence: CTT
gtgctaggctttatatttac

SEQ ID NO: 273640 - DNA, 20 bp, Artificial Sequence
  Description of Artificial Sequence: Synthetic oligonucleotide
  Target: ATXN1; (+) strand; PAM type: YTN; PAM sequence: TTG
tgctaggctttatatttact

SEQ ID NO: 273641 - DNA, 20 bp, Artificial Sequence
  Description of Artificial Sequence: Synthetic oligonucleotide
  Target: ATXN1; (+) strand; PAM type: YTN; PAM sequence: CTA
ggctttatatttactgccct

SEQ ID NO: 273642 - DNA, 20 bp, Artificial Sequence
  Description of Artificial Sequence: Synthetic oligonucleotide
  Target: ATXN1; (+) strand; PAM type: YTN; PAM sequence: CTT
tatatttactgccctcagta

SEQ ID NO: 273643 - DNA, 20 bp, Artificial Sequence
  Description of Artificial Sequence: Synthetic oligonucleotide
  Target: ATXN1; (+) strand; PAM type: YTN; PAM sequence: TTT
atatttactgccctcagtat

SEQ ID NO: 273644 - DNA, 20 bp, Artificial Sequence
  Description of Artificial Sequence: Synthetic oligonucleotide
  Target: ATXN1; (+) strand; PAM type: YTN; PAM sequence: TTA
tatttactgccctcagtatc

SEQ ID NO: 273645 - DNA, 20 bp, Artificial Sequence
  Description of Artificial Sequence: Synthetic oligonucleotide
  Target: ATXN1; (+) strand; PAM type: YTN; PAM sequence: TTT
actgccctcagtatctttta

SEQ ID NO: 273646 - DNA, 20 bp, Artificial Sequence
  Description of Artificial Sequence: Synthetic oligonucleotide
  Target: ATXN1; (+) strand; PAM type: YTN; PAM sequence: TTA
ctgccctcagtatcttttaa

SEQ ID NO: 273647 - DNA, 20 bp, Artificial Sequence
  Description of Artificial Sequence: Synthetic oligonucleotide
  Target: ATXN1; (+) strand; PAM type: YTN; PAM sequence: CTG
ccctcagtatcttttaattg

SEQ ID NO: 273648 - DNA, 20 bp, Artificial Sequence
  Description of Artificial Sequence: Synthetic oligonucleotide
  Target: ATXN1; (+) strand; PAM type: YTN; PAM sequence: CTC
agtatcttttaattgcctta

SEQ ID NO: 273649 - DNA, 20 bp, Artificial Sequence
  Description of Artificial Sequence: Synthetic oligonucleotide
  Target: ATXN1; (+) strand; PAM type: YTN; PAM sequence: CTT
ttaattgccttaatgtcact

SEQ ID NO: 273650 - DNA, 20 bp, Artificial Sequence
  Description of Artificial Sequence: Synthetic oligonucleotide
  Target: ATXN1; (+) strand; PAM type: YTN; PAM sequence: TTT
taattgccttaatgtcactt

SEQ ID NO: 273651 - DNA, 20 bp, Artificial Sequence
  Description of Artificial Sequence: Synthetic oligonucleotide
  Target: ATXN1; (+) strand; PAM type: YTN; PAM sequence: TTT
aattgccttaatgtcacttt

SEQ ID NO: 273652 - DNA, 20 bp, Artificial Sequence
  Description of Artificial Sequence: Synthetic oligonucleotide
  Target: ATXN1; (+) strand; PAM type: YTN; PAM sequence: TTA
attgccttaatgtcactttt

SEQ ID NO: 273653 - DNA, 20 bp, Artificial Sequence
  Description of Artificial Sequence: Synthetic oligonucleotide
  Target: ATXN1; (+) strand; PAM type: YTN; PAM sequence: TTG
ccttaatgtcacttttactc

SEQ ID NO: 273654 - DNA, 20 bp, Artificial Sequence
  Description of Artificial Sequence: Synthetic oligonucleotide
  Target: ATXN1; (+) strand; PAM type: YTN; PAM sequence: CTT
aatgtcacttttactcactc

SEQ ID NO: 273655 - DNA, 20 bp, Artificial Sequence
  Description of Artificial Sequence: Synthetic oligonucleotide
  Target: ATXN1; (+) strand; PAM type: YTN; PAM sequence: TTA
atgtcacttttactcactcc

SEQ ID NO: 273656 - DNA, 20 bp, Artificial Sequence
  Description of Artificial Sequence: Synthetic oligonucleotide
  Target: ATXN1; (+) strand; PAM type: YTN; PAM sequence: CTT
ttactcactccttgccactt

SEQ ID NO: 273657 - DNA, 20 bp, Artificial Sequence
  Description of Artificial Sequence: Synthetic oligonucleotide
  Target: ATXN1; (+) strand; PAM type: YTN; PAM sequence: TTT
tactcactccttgccactta

SEQ ID NO: 273658 - DNA, 20 bp, Artificial Sequence
  Description of Artificial Sequence: Synthetic oligonucleotide
  Target: ATXN1; (+) strand; PAM type: YTN; PAM sequence: TTT
actcactccttgccacttaa

SEQ ID NO: 273659 - DNA, 20 bp, Artificial Sequence
  Description of Artificial Sequence: Synthetic oligonucleotide
  Target: ATXN1; (+) strand; PAM type: YTN; PAM sequence: TTA
ctcactccttgccacttaat

SEQ ID NO: 273660 - DNA, 20 bp, Artificial Sequence
  Description of Artificial Sequence: Synthetic oligonucleotide
  Target: ATXN1; (+) strand; PAM type: YTN; PAM sequence: CTC
actccttgccacttaatgag

SEQ ID NO: 273661 - DNA, 20 bp, Artificial Sequence
  Description of Artificial Sequence: Synthetic oligonucleotide
  Target: ATXN1; (+) strand; PAM type: YTN; PAM sequence: CTC
cttgccacttaatgagacaa

SEQ ID NO: 273662 - DNA, 20 bp, Artificial Sequence
  Description of Artificial Sequence: Synthetic oligonucleotide
  Target: ATXN1; (+) strand; PAM type: YTN; PAM sequence: CTT
gccacttaatgagacaagag

SEQ ID NO: 273663 - DNA, 20 bp, Artificial Sequence
  Description of Artificial Sequence: Synthetic oligonucleotide
  Target: ATXN1; (+) strand; PAM type: YTN; PAM sequence: TTG
ccacttaatgagacaagagc

SEQ ID NO: 273664 - DNA, 20 bp, Artificial Sequence
  Description of Artificial Sequence: Synthetic oligonucleotide
  Target: ATXN1; (+) strand; PAM type: YTN; PAM sequence: CTT
aatgagacaagagcctcttg

SEQ ID NO: 273665 - DNA, 20 bp, Artificial Sequence
  Description of Artificial Sequence: Synthetic oligonucleotide
  Target: ATXN1; (+) strand; PAM type: YTN; PAM sequence: TTA
atgagacaagagcctcttga

SEQ ID NO: 273666 - DNA, 20 bp, Artificial Sequence
  Description of Artificial Sequence: Synthetic oligonucleotide
  Target: ATXN1; (+) strand; PAM type: YTN; PAM sequence: CTC
ttgaagacagtgaccttggc

SEQ ID NO: 273667 - DNA, 20 bp, Artificial Sequence
  Description of Artificial Sequence: Synthetic oligonucleotide
  Target: ATXN1; (+) strand; PAM type: YTN; PAM sequence: CTT
gaagacagtgaccttggctt

SEQ ID NO: 273668 - DNA, 20 bp, Artificial Sequence
  Description of Artificial Sequence: Synthetic oligonucleotide
  Target: ATXN1; (+) strand; PAM type: YTN; PAM sequence: TTG
aagacagtgaccttggcttg

SEQ ID NO: 273669 - DNA, 20 bp, Artificial Sequence
  Description of Artificial Sequence: Synthetic oligonucleotide
  Target: ATXN1; (+) strand; PAM type: YTN; PAM sequence: CTT
ggcttgtactttcagggctt

SEQ ID NO: 273670 - DNA, 20 bp, Artificial Sequence
  Description of Artificial Sequence: Synthetic oligonucleotide
  Target: ATXN1; (+) strand; PAM type: YTN; PAM sequence: TTG
gcttgtactttcagggctta

SEQ ID NO: 273671 - DNA, 20 bp, Artificial Sequence
  Description of Artificial Sequence: Synthetic oligonucleotide
  Target: ATXN1; (+) strand; PAM type: YTN; PAM sequence: CTT
gtactttcagggcttacctt

SEQ ID NO: 273672 - DNA, 20 bp, Artificial Sequence
  Description of Artificial Sequence: Synthetic oligonucleotide
  Target: ATXN1; (+) strand; PAM type: YTN; PAM sequence: TTG
tactttcagggcttaccttt

SEQ ID NO: 273673 - DNA, 20 bp, Artificial Sequence
  Description of Artificial Sequence: Synthetic oligonucleotide
  Target: ATXN1; (+) strand; PAM type: YTN; PAM sequence: CTT
tcagggcttaccttttcacc

SEQ ID NO: 273674 - DNA, 20 bp, Artificial Sequence
  Description of Artificial Sequence: Synthetic oligonucleotide
  Target: ATXN1; (+) strand; PAM type: YTN; PAM sequence: TTT
cagggcttaccttttcaccc

SEQ ID NO: 273675 - DNA, 20 bp, Artificial Sequence
  Description of Artificial Sequence: Synthetic oligonucleotide
  Target: ATXN1; (+) strand; PAM type: YTN; PAM sequence: TTC
agggcttaccttttcaccct

SEQ ID NO: 273676 - DNA, 20 bp, Artificial Sequence
  Description of Artificial Sequence: Synthetic oligonucleotide
  Target: ATXN1; (+) strand; PAM type: YTN; PAM sequence: CTT
accttttcaccctccaactc

SEQ ID NO: 273677 - DNA, 20 bp, Artificial Sequence
  Description of Artificial Sequence: Synthetic oligonucleotide
  Target: ATXN1; (+) strand; PAM type: YTN; PAM sequence: TTA
ccttttcaccctccaactca

SEQ ID NO: 273678 - DNA, 20 bp, Artificial Sequence
  Description of Artificial Sequence: Synthetic oligonucleotide
  Target: ATXN1; (+) strand; PAM type: YTN; PAM sequence: CTT
ttcaccctccaactcacatt

SEQ ID NO: 273679 - DNA, 20 bp, Artificial Sequence
  Description of Artificial Sequence: Synthetic oligonucleotide
  Target: ATXN1; (+) strand; PAM type: YTN; PAM sequence: TTT
tcaccctccaactcacattt

SEQ ID NO: 273680 - DNA, 20 bp, Artificial Sequence
  Description of Artificial Sequence: Synthetic oligonucleotide
  Target: ATXN1; (+) strand; PAM type: YTN; PAM sequence: TTT
caccctccaactcacatttt

SEQ ID NO: 273681 - DNA, 20 bp, Artificial Sequence
  Description of Artificial Sequence: Synthetic oligonucleotide
  Target: ATXN1; (+) strand; PAM type: YTN; PAM sequence: TTC
accctccaactcacattttc

SEQ ID NO: 273682 - DNA, 20 bp, Artificial Sequence
  Description of Artificial Sequence: Synthetic oligonucleotide
  Target: ATXN1; (+) strand; PAM type: YTN; PAM sequence: CTC
caactcacattttccttcct

SEQ ID NO: 273683 - DNA, 20 bp, Artificial Sequence
  Description of Artificial Sequence: Synthetic oligonucleotide
  Target: ATXN1; (+) strand; PAM type: YTN; PAM sequence: CTC
acattttccttcctctcatc

SEQ ID NO: 273684 - DNA, 20 bp, Artificial Sequence
  Description of Artificial Sequence: Synthetic oligonucleotide
  Target: ATXN1; (+) strand; PAM type: YTN; PAM sequence: TTT
tccttcctctcatcattttc

SEQ ID NO: 273685 - DNA, 20 bp, Artificial Sequence
  Description of Artificial Sequence: Synthetic oligonucleotide
  Target: ATXN1; (+) strand; PAM type: YTN; PAM sequence: TTT
ccttcctctcatcattttcc

SEQ ID NO: 273686 - DNA, 20 bp, Artificial Sequence
  Description of Artificial Sequence: Synthetic oligonucleotide
  Target: ATXN1; (+) strand; PAM type: YTN; PAM sequence: TTC
cttcctctcatcattttccc

SEQ ID NO: 273687 - DNA, 20 bp, Artificial Sequence
  Description of Artificial Sequence: Synthetic oligonucleotide
  Target: ATXN1; (+) strand; PAM type: YTN; PAM sequence: CTT
cctctcatcattttccccaa

SEQ ID NO: 273688 - DNA, 20 bp, Artificial Sequence
  Description of Artificial Sequence: Synthetic oligonucleotide
  Target: ATXN1; (+) strand; PAM type: YTN; PAM sequence: TTC
ctctcatcattttccccaaa

SEQ ID NO: 273689 - DNA, 20 bp, Artificial Sequence
  Description of Artificial Sequence: Synthetic oligonucleotide
  Target: ATXN1; (+) strand; PAM type: YTN; PAM sequence: CTC
tcatcattttccccaaaatt

SEQ ID NO: 273690 - DNA, 20 bp, Artificial Sequence
  Description of Artificial Sequence: Synthetic oligonucleotide
  Target: ATXN1; (+) strand; PAM type: YTN; PAM sequence: CTC
atcattttccccaaaattta

SEQ ID NO: 273691 - DNA, 20 bp, Artificial Sequence
  Description of Artificial Sequence: Synthetic oligonucleotide
  Target: ATXN1; (+) strand; PAM type: YTN; PAM sequence: TTT
tccccaaaatttagttgtga

SEQ ID NO: 273692 - DNA, 20 bp, Artificial Sequence
  Description of Artificial Sequence: Synthetic oligonucleotide
  Target: ATXN1; (+) strand; PAM type: YTN; PAM sequence: TTT
ccccaaaatttagttgtgag

SEQ ID NO: 273693 - DNA, 20 bp, Artificial Sequence
  Description of Artificial Sequence: Synthetic oligonucleotide
  Target: ATXN1; (+) strand; PAM type: YTN; PAM sequence: TTC
cccaaaatttagttgtgagc

SEQ ID NO: 273694 - DNA, 20 bp, Artificial Sequence
  Description of Artificial Sequence: Synthetic oligonucleotide
  Target: ATXN1; (+) strand; PAM type: YTN; PAM sequence: TTT
agttgtgagcctcgcaagca

SEQ ID NO: 273695 - DNA, 20 bp, Artificial Sequence
  Description of Artificial Sequence: Synthetic oligonucleotide
  Target: ATXN1; (+) strand; PAM type: YTN; PAM sequence: TTA
gttgtgagcctcgcaagcag

SEQ ID NO: 273696 - DNA, 20 bp, Artificial Sequence
  Description of Artificial Sequence: Synthetic oligonucleotide
  Target: ATXN1; (+) strand; PAM type: YTN; PAM sequence: TTG
tgagcctcgcaagcagtagc

SEQ ID NO: 273697 - DNA, 20 bp, Artificial Sequence
  Description of Artificial Sequence: Synthetic oligonucleotide
  Target: ATXN1; (+) strand; PAM type: YTN; PAM sequence: CTC
gcaagcagtagctgcttaac

SEQ ID NO: 273698 - DNA, 20 bp, Artificial Sequence
  Description of Artificial Sequence: Synthetic oligonucleotide
  Target: ATXN1; (+) strand; PAM type: YTN; PAM sequence: CTG
cttaactcataactgatgac

SEQ ID NO: 273699 - DNA, 20 bp, Artificial Sequence
  Description of Artificial Sequence: Synthetic oligonucleotide
  Target: ATXN1; (+) strand; PAM type: YTN; PAM sequence: CTT
aactcataactgatgacttg

SEQ ID NO: 273700 - DNA, 20 bp, Artificial Sequence
  Description of Artificial Sequence: Synthetic oligonucleotide
  Target: ATXN1; (+) strand; PAM type: YTN; PAM sequence: TTA
actcataactgatgacttga

SEQ ID NO: 273701 - DNA, 20 bp, Artificial Sequence
  Description of Artificial Sequence: Synthetic oligonucleotide
  Target: ATXN1; (+) strand; PAM type: YTN; PAM sequence: CTC
ataactgatgacttgatatt

SEQ ID NO: 273702 - DNA, 20 bp, Artificial Sequence
  Description of Artificial Sequence: Synthetic oligonucleotide
  Target: ATXN1; (+) strand; PAM type: YTN; PAM sequence: CTG
atgacttgatattttcccac

SEQ ID NO: 273703 - DNA, 20 bp, Artificial Sequence
  Description of Artificial Sequence: Synthetic oligonucleotide
  Target: ATXN1; (+) strand; PAM type: YTN; PAM sequence: CTT
gatattttcccactaggaaa

SEQ ID NO: 273704 - DNA, 20 bp, Artificial Sequence
  Description of Artificial Sequence: Synthetic oligonucleotide
  Target: ATXN1; (+) strand; PAM type: YTN; PAM sequence: TTG
atattttcccactaggaaat

SEQ ID NO: 273705 - DNA, 20 bp, Artificial Sequence
  Description of Artificial Sequence: Synthetic oligonucleotide
  Target: ATXN1; (+) strand; PAM type: YTN; PAM sequence: TTT
tcccactaggaaataattcc

SEQ ID NO: 273706 - DNA, 20 bp, Artificial Sequence
  Description of Artificial Sequence: Synthetic oligonucleotide
  Target: ATXN1; (+) strand; PAM type: YTN; PAM sequence: TTT
cccactaggaaataattccc

SEQ ID NO: 273707 - DNA, 20 bp, Artificial Sequence
  Description of Artificial Sequence: Synthetic oligonucleotide
  Target: ATXN1; (+) strand; PAM type: YTN; PAM sequence: TTC
ccactaggaaataattccca

SEQ ID NO: 273708 - DNA, 20 bp, Artificial Sequence
  Description of Artificial Sequence: Synthetic oligonucleotide
  Target: ATXN1; (+) strand; PAM type: YTN; PAM sequence: CTA
ggaaataattcccaatacgt

SEQ ID NO: 273709 - DNA, 20 bp, Artificial Sequence
  Description of Artificial Sequence: Synthetic oligonucleotide
  Target: ATXN1; (+) strand; PAM type: YTN; PAM sequence: TTC
ccaatacgtaataacaatta

SEQ ID NO: 273710 - DNA, 20 bp, Artificial Sequence
  Description of Artificial Sequence: Synthetic oligonucleotide
  Target: ATXN1; (+) strand; PAM type: YTN; PAM sequence: TTA
ttcatttgcattaaccaata

SEQ ID NO: 273711 - DNA, 20 bp, Artificial Sequence
  Description of Artificial Sequence: Synthetic oligonucleotide
  Target: ATXN1; (+) strand; PAM type: YTN; PAM sequence: TTC
atttgcattaaccaatacca

SEQ ID NO: 273712 - DNA, 20 bp, Artificial Sequence
  Description of Artificial Sequence: Synthetic oligonucleotide
  Target: ATXN1; (+) strand; PAM type: YTN; PAM sequence: TTT
gcattaaccaataccaccat

SEQ ID NO: 273713 - DNA, 20 bp, Artificial Sequence
  Description of Artificial Sequence: Synthetic oligonucleotide
  Target: ATXN1; (+) strand; PAM type: YTN; PAM sequence: TTG
cattaaccaataccaccatg

SEQ ID NO: 273714 - DNA, 20 bp, Artificial Sequence
  Description of Artificial Sequence: Synthetic oligonucleotide
  Target: ATXN1; (+) strand; PAM type: YTN; PAM sequence: TTA
accaataccaccatgcaggc

SEQ ID NO: 273715 - DNA, 20 bp, Artificial Sequence
  Description of Artificial Sequence: Synthetic oligonucleotide
  Target: ATXN1; (+) strand; PAM type: YTN; PAM sequence: TTA
agtgcaatggctacaagaag

SEQ ID NO: 273716 - DNA, 20 bp, Artificial Sequence
  Description of Artificial Sequence: Synthetic oligonucleotide
  Target: ATXN1; (+) strand; PAM type: YTN; PAM sequence: CTA
caagaaggcattagctattc

SEQ ID NO: 273717 - DNA, 20 bp, Artificial Sequence
  Description of Artificial Sequence: Synthetic oligonucleotide
  Target: ATXN1; (+) strand; PAM type: YTN; PAM sequence: TTA
gctattcatctgtgaattta

SEQ ID NO: 273718 - DNA, 20 bp, Artificial Sequence
  Description of Artificial Sequence: Synthetic oligonucleotide
  Target: ATXN1; (+) strand; PAM type: YTN; PAM sequence: CTA
ttcatctgtgaatttatctt

SEQ ID NO: 273719 - DNA, 20 bp, Artificial Sequence
  Description of Artificial Sequence: Synthetic oligonucleotide
  Target: ATXN1; (+) strand; PAM type: YTN; PAM sequence: TTC
atctgtgaatttatcttagc

SEQ ID NO: 273720 - DNA, 20 bp, Artificial Sequence
  Description of Artificial Sequence: Synthetic oligonucleotide
  Target: ATXN1; (+) strand; PAM type: YTN; PAM sequence: CTG
tgaatttatcttagccatgg

SEQ ID NO: 273721 - DNA, 20 bp, Artificial Sequence
  Description of Artificial Sequence: Synthetic oligonucleotide
  Target: ATXN1; (+) strand; PAM type: YTN; PAM sequence: TTT
atcttagccatggccttgat

SEQ ID NO: 273722 - DNA, 20 bp, Artificial Sequence
  Description of Artificial Sequence: Synthetic oligonucleotide
  Target: ATXN1; (+) strand; PAM type: YTN; PAM sequence: TTA
tcttagccatggccttgatt

SEQ ID NO: 273723 - DNA, 20 bp, Artificial Sequence
  Description of Artificial Sequence: Synthetic oligonucleotide
  Target: ATXN1; (+) strand; PAM type: YTN; PAM sequence: CTT
agccatggccttgattctgt

SEQ ID NO: 273724 - DNA, 20 bp, Artificial Sequence
  Description of Artificial Sequence: Synthetic oligonucleotide
  Target: ATXN1; (+) strand; PAM type: YTN; PAM sequence: TTA
gccatggccttgattctgtg

SEQ ID NO: 273725 - DNA, 20 bp, Artificial Sequence
  Description of Artificial Sequence: Synthetic oligonucleotide
  Target: ATXN1; (+) strand; PAM type: YTN; PAM sequence: CTT
gattctgtgtcaaccatggc

SEQ ID NO: 273726 - DNA, 20 bp, Artificial Sequence
  Description of Artificial Sequence: Synthetic oligonucleotide
  Target: ATXN1; (+) strand; PAM type: YTN; PAM sequence: TTG
attctgtgtcaaccatggct

SEQ ID NO: 273727 - DNA, 20 bp, Artificial Sequence
  Description of Artificial Sequence: Synthetic oligonucleotide
  Target: ATXN1; (+) strand; PAM type: YTN; PAM sequence: TTC
tgtgtcaaccatggctcatc

SEQ ID NO: 273728 - DNA, 20 bp, Artificial Sequence
  Description of Artificial Sequence: Synthetic oligonucleotide
  Target: ATXN1; (+) strand; PAM type: YTN; PAM sequence: CTG
tgtcaaccatggctcatcat

SEQ ID NO: 273729 - DNA, 20 bp, Artificial Sequence
  Description of Artificial Sequence: Synthetic oligonucleotide
  Target: ATXN1; (+) strand; PAM type: YTN; PAM sequence: CTC
atcatttttacttatttgtg

SEQ ID NO: 273730 - DNA, 20 bp, Artificial Sequence
  Description of Artificial Sequence: Synthetic oligonucleotide
  Target: ATXN1; (+) strand; PAM type: YTN; PAM sequence: TTT
ttacttatttgtgttgaccc

SEQ ID NO: 273731 - DNA, 20 bp, Artificial Sequence
  Description of Artificial Sequence: Synthetic oligonucleotide
  Target: ATXN1; (+) strand; PAM type: YTN; PAM sequence: TTT
tacttatttgtgttgaccct

SEQ ID NO: 273732 - DNA, 20 bp, Artificial Sequence
  Description of Artificial Sequence: Synthetic oligonucleotide
  Target: ATXN1; (+) strand; PAM type: YTN; PAM sequence: TTT
acttatttgtgttgacccta

SEQ ID NO: 273733 - DNA, 20 bp, Artificial Sequence
  Description of Artificial Sequence: Synthetic oligonucleotide
  Target: ATXN1; (+) strand; PAM type: YTN; PAM sequence: TTA
cttatttgtgttgaccctaa

SEQ ID NO: 273734 - DNA, 20 bp, Artificial Sequence
  Description of Artificial Sequence: Synthetic oligonucleotide
  Target: ATXN1; (+) strand; PAM type: YTN; PAM sequence: CTT
atttgtgttgaccctaatgt

SEQ ID NO: 273735 - DNA, 20 bp, Artificial Sequence
  Description of Artificial Sequence: Synthetic oligonucleotide
  Target: ATXN1; (+) strand; PAM type: YTN; PAM sequence: TTA
tttgtgttgaccctaatgtc

SEQ ID NO: 273736 - DNA, 20 bp, Artificial Sequence
  Description of Artificial Sequence: Synthetic oligonucleotide
  Target: ATXN1; (+) strand; PAM type: YTN; PAM sequence: TTT
gtgttgaccctaatgtcttt

SEQ ID NO: 273737 - DNA, 20 bp, Artificial Sequence
  Description of Artificial Sequence: Synthetic oligonucleotide
  Target: ATXN1; (+) strand; PAM type: YTN; PAM sequence: TTG
tgttgaccctaatgtcttta

SEQ ID NO: 273738 - DNA, 20 bp, Artificial Sequence
  Description of Artificial Sequence: Synthetic oligonucleotide
  Target: ATXN1; (+) strand; PAM type: YTN; PAM sequence: TTG
accctaatgtctttaggtct

SEQ ID NO: 273739 - DNA, 20 bp, Artificial Sequence
  Description of Artificial Sequence: Synthetic oligonucleotide
  Target: ATXN1; (+) strand; PAM type: YTN; PAM sequence: CTA
atgtctttaggtctatttaa

SEQ ID NO: 273740 - DNA, 20 bp, Artificial Sequence
  Description of Artificial Sequence: Synthetic oligonucleotide
  Target: ATXN1; (+) strand; PAM type: YTN; PAM sequence: CTT
taggtctatttaatgatttt

SEQ ID NO: 273741 - DNA, 20 bp, Artificial Sequence
  Description of Artificial Sequence: Synthetic oligonucleotide
  Target: ATXN1; (+) strand; PAM type: YTN; PAM sequence: TTT
aggtctatttaatgattttg

SEQ ID NO: 273742 - DNA, 20 bp, Artificial Sequence
  Description of Artificial Sequence: Synthetic oligonucleotide
  Target: ATXN1; (+) strand; PAM type: YTN; PAM sequence: TTA
ggtctatttaatgattttgg

SEQ ID NO: 273743 - DNA, 20 bp, Artificial Sequence
  Description of Artificial Sequence: Synthetic oligonucleotide
  Target: ATXN1; (+) strand; PAM type: YTN; PAM sequence: CTA
tttaatgattttggtctggg

SEQ ID NO: 273744 - DNA, 20 bp, Artificial Sequence
  Description of Artificial Sequence: Synthetic oligonucleotide
  Target: ATXN1; (+) strand; PAM type: YTN; PAM sequence: TTT
aatgattttggtctgggctt

SEQ ID NO: 273745 - DNA, 20 bp, Artificial Sequence
  Description of Artificial Sequence: Synthetic oligonucleotide
  Target: ATXN1; (+) strand; PAM type: YTN; PAM sequence: TTA
atgattttggtctgggcttc

SEQ ID NO: 273746 - DNA, 20 bp, Artificial Sequence
  Description of Artificial Sequence: Synthetic oligonucleotide
  Target: ATXN1; (+) strand; PAM type: YTN; PAM sequence: TTT
tggtctgggcttctaaaatt

SEQ ID NO: 273747 - DNA, 20 bp, Artificial Sequence
  Description of Artificial Sequence: Synthetic oligonucleotide
  Target: ATXN1; (+) strand; PAM type: YTN; PAM sequence: TTT
ggtctgggcttctaaaattc

SEQ ID NO: 273748 - DNA, 20 bp, Artificial Sequence
  Description of Artificial Sequence: Synthetic oligonucleotide
  Target: ATXN1; (+) strand; PAM type: YTN; PAM sequence: TTG
gtctgggcttctaaaattct

SEQ ID NO: 273749 - DNA, 20 bp, Artificial Sequence
  Description of Artificial Sequence: Synthetic oligonucleotide
  Target: ATXN1; (+) strand; PAM type: YTN; PAM sequence: CTG
ggcttctaaaattctcattc

SEQ ID NO: 273750 - DNA, 20 bp, Artificial Sequence
  Description of Artificial Sequence: Synthetic oligonucleotide
  Target: ATXN1; (+) strand; PAM type: YTN; PAM sequence: CTT
ctaaaattctcattcagtca

SEQ ID NO: 273751 - DNA, 20 bp, Artificial Sequence
  Description of Artificial Sequence: Synthetic oligonucleotide
  Target: ATXN1; (+) strand; PAM type: YTN; PAM sequence: TTC
taaaattctcattcagtcat

SEQ ID NO: 273752 - DNA, 20 bp, Artificial Sequence
  Description of Artificial Sequence: Synthetic oligonucleotide
  Target: ATXN1; (+) strand; PAM type: YTN; PAM sequence: CTA
aaattctcattcagtcattt

SEQ ID NO: 273753 - DNA, 20 bp, Artificial Sequence
  Description of Artificial Sequence: Synthetic oligonucleotide
  Target: ATXN1; (+) strand; PAM type: YTN; PAM sequence: TTC
tcattcagtcatttgttcat

SEQ ID NO: 273754 - DNA, 20 bp, Artificial Sequence
  Description of Artificial Sequence: Synthetic oligonucleotide
  Target: ATXN1; (+) strand; PAM type: YTN; PAM sequence: CTC
attcagtcatttgttcattc

SEQ ID NO: 273755 - DNA, 20 bp, Artificial Sequence
  Description of Artificial Sequence: Synthetic oligonucleotide
  Target: ATXN1; (+) strand; PAM type: YTN; PAM sequence: TTC
agtcatttgttcattcacac

SEQ ID NO: 273756 - DNA, 20 bp, Artificial Sequence
  Description of Artificial Sequence: Synthetic oligonucleotide
  Target: ATXN1; (+) strand; PAM type: YTN; PAM sequence: TTT
gttcattcacacaaatacag

SEQ ID NO: 273757 - DNA, 20 bp, Artificial Sequence
  Description of Artificial Sequence: Synthetic oligonucleotide
  Target: ATXN1; (+) strand; PAM type: YTN; PAM sequence: TTG
ttcattcacacaaatacagt

SEQ ID NO: 273758 - DNA, 20 bp, Artificial Sequence
  Description of Artificial Sequence: Synthetic oligonucleotide
  Target: ATXN1; (+) strand; PAM type: YTN; PAM sequence: TTC
attcacacaaatacagtagt

SEQ ID NO: 273759 - DNA, 20 bp, Artificial Sequence
  Description of Artificial Sequence: Synthetic oligonucleotide
  Target: ATXN1; (+) strand; PAM type: YTN; PAM sequence: TTC
acacaaatacagtagtcagt

SEQ ID NO: 273760 - DNA, 20 bp, Artificial Sequence
  Description of Artificial Sequence: Synthetic oligonucleotide
  Target: ATXN1; (+) strand; PAM type: YTN; PAM sequence: TTT
ctgagaggtagcagagaaaa

SEQ ID NO: 273761 - DNA, 20 bp, Artificial Sequence
  Description of Artificial Sequence: Synthetic oligonucleotide
  Target: ATXN1; (+) strand; PAM type: YTN; PAM sequence: TTC
tgagaggtagcagagaaaaa

SEQ ID NO: 273762 - DNA, 20 bp, Artificial Sequence
  Description of Artificial Sequence: Synthetic oligonucleotide
  Target: ATXN1; (+) strand; PAM type: YTN; PAM sequence: CTG
agaggtagcagagaaaaaaa

SEQ ID NO: 273763 - DNA, 20 bp, Artificial Sequence
  Description of Artificial Sequence: Synthetic oligonucleotide
  Target: ATXN1; (+) strand; PAM type: YTN; PAM sequence: CTA
tggagtcaggctagctgtga

SEQ ID NO: 273764 - DNA, 20 bp, Artificial Sequence
  Description of Artificial Sequence: Synthetic oligonucleotide
  Target: ATXN1; (+) strand; PAM type: YTN; PAM sequence: CTA
gctgtgagactgtgggccag

SEQ ID NO: 273765 - DNA, 20 bp, Artificial Sequence
  Description of Artificial Sequence: Synthetic oligonucleotide
  Target: ATXN1; (+) strand; PAM type: YTN; PAM sequence: CTG
tgagactgtgggccagccac

SEQ ID NO: 273766 - DNA, 20 bp, Artificial Sequence
  Description of Artificial Sequence: Synthetic oligonucleotide
  Target: ATXN1; (+) strand; PAM type: YTN; PAM sequence: CTG
tgggccagccacttgacctc

SEQ ID NO: 273767 - DNA, 20 bp, Artificial Sequence
  Description of Artificial Sequence: Synthetic oligonucleotide
  Target: ATXN1; (+) strand; PAM type: YTN; PAM sequence: CTT
gacctcttcatgtccccagt

SEQ ID NO: 273768 - DNA, 20 bp, Artificial Sequence
  Description of Artificial Sequence: Synthetic oligonucleotide
  Target: ATXN1; (+) strand; PAM type: YTN; PAM sequence: TTG
acctcttcatgtccccagtt

SEQ ID NO: 273769 - DNA, 20 bp, Artificial Sequence
  Description of Artificial Sequence: Synthetic oligonucleotide
  Target: ATXN1; (+) strand; PAM type: YTN; PAM sequence: CTC
ttcatgtccccagtttcctt

SEQ ID NO: 273770 - DNA, 20 bp, Artificial Sequence
  Description of Artificial Sequence: Synthetic oligonucleotide
  Target: ATXN1; (+) strand; PAM type: YTN; PAM sequence: CTT
catgtccccagtttcctttc

SEQ ID NO: 273771 - DNA, 20 bp, Artificial Sequence
  Description of Artificial Sequence: Synthetic oligonucleotide
  Target: ATXN1; (+) strand; PAM type: YTN; PAM sequence: TTC
atgtccccagtttcctttcc

SEQ ID NO: 273772 - DNA, 20 bp, Artificial Sequence
  Description of Artificial Sequence: Synthetic oligonucleotide
  Target: ATXN1; (+) strand; PAM type: YTN; PAM sequence: TTT
cctttcccacaaaacgagtt

SEQ ID NO: 273773 - DNA, 20 bp, Artificial Sequence
  Description of Artificial Sequence: Synthetic oligonucleotide
  Target: ATXN1; (+) strand; PAM type: YTN; PAM sequence: TTC
ctttcccacaaaacgagttt

SEQ ID NO: 273774 - DNA, 20 bp, Artificial Sequence
  Description of Artificial Sequence: Synthetic oligonucleotide
  Target: ATXN1; (+) strand; PAM type: YTN; PAM sequence: CTT
tcccacaaaacgagtttaaa

SEQ ID NO: 273775 - DNA, 20 bp, Artificial Sequence
  Description of Artificial Sequence: Synthetic oligonucleotide
  Target: ATXN1; (+) strand; PAM type: YTN; PAM sequence: TTT
cccacaaaacgagtttaaaa

SEQ ID NO: 273776 - DNA, 20 bp, Artificial Sequence
  Description of Artificial Sequence: Synthetic oligonucleotide
  Target: ATXN1; (+) strand; PAM type: YTN; PAM sequence: TTC
ccacaaaacgagtttaaaat

SEQ ID NO: 273777 - DNA, 20 bp, Artificial Sequence
  Description of Artificial Sequence: Synthetic oligonucleotide
  Target: ATXN1; (+) strand; PAM type: YTN; PAM sequence: TTT
aaaatgtatcttgtaaggtt

SEQ ID NO: 273778 - DNA, 20 bp, Artificial Sequence
  Description of Artificial Sequence: Synthetic oligonucleotide
  Target: ATXN1; (+) strand; PAM type: YTN; PAM sequence: TTA
aaatgtatcttgtaaggttg

SEQ ID NO: 273779 - DNA, 20 bp, Artificial Sequence
  Description of Artificial Sequence: Synthetic oligonucleotide
  Target: ATXN1; (+) strand; PAM type: YTN; PAM sequence: CTT
gtaaggttgttgtgagaatt

SEQ ID NO: 273780 - DNA, 20 bp, Artificial Sequence
  Description of Artificial Sequence: Synthetic oligonucleotide
  Target: ATXN1; (+) strand; PAM type: YTN; PAM sequence: TTG
taaggttgttgtgagaatta

SEQ ID NO: 273781 - DNA, 20 bp, Artificial Sequence
  Description of Artificial Sequence: Synthetic oligonucleotide
  Target: ATXN1; (+) strand; PAM type: YTN; PAM sequence: TTG
ttgtgagaattacacaagtt

SEQ ID NO: 273782 - DNA, 20 bp, Artificial Sequence
  Description of Artificial Sequence: Synthetic oligonucleotide
  Target: ATXN1; (+) strand; PAM type: YTN; PAM sequence: TTG
tgagaattacacaagttaat

SEQ ID NO: 273783 - DNA, 20 bp, Artificial Sequence
  Description of Artificial Sequence: Synthetic oligonucleotide
  Target: ATXN1; (+) strand; PAM type: YTN; PAM sequence: TTA
cacaagttaatatatgcaag

SEQ ID NO: 273784 - DNA, 20 bp, Artificial Sequence
  Description of Artificial Sequence: Synthetic oligonucleotide
  Target: ATXN1; (+) strand; PAM type: YTN; PAM sequence: TTA
atatatgcaagatacataaa

SEQ ID NO: 273785 - DNA, 20 bp, Artificial Sequence
  Description of Artificial Sequence: Synthetic oligonucleotide
  Target: ATXN1; (+) strand; PAM type: YTN; PAM sequence: TTA
ttttaaattttaaaataaag

SEQ ID NO: 273786 - DNA, 20 bp, Artificial Sequence
  Description of Artificial Sequence: Synthetic oligonucleotide
  Target: ATXN1; (+) strand; PAM type: YTN; PAM sequence: TTT
taaattttaaaataaagcag

SEQ ID NO: 273787 - DNA, 20 bp, Artificial Sequence
  Description of Artificial Sequence: Synthetic oligonucleotide
  Target: ATXN1; (+) strand; PAM type: YTN; PAM sequence: TTT
aaattttaaaataaagcagt

SEQ ID NO: 273788 - DNA, 20 bp, Artificial Sequence
  Description of Artificial Sequence: Synthetic oligonucleotide
  Target: ATXN1; (+) strand; PAM type: YTN; PAM sequence: TTA
aattttaaaataaagcagta

SEQ ID NO: 273789 - DNA, 20 bp, Artificial Sequence
  Description of Artificial Sequence: Synthetic oligonucleotide
  Target: ATXN1; (+) strand; PAM type: YTN; PAM sequence: TTT
taaaataaagcagtactggg

SEQ ID NO: 273790 - DNA, 20 bp, Artificial Sequence
  Description of Artificial Sequence: Synthetic oligonucleotide
  Target: ATXN1; (+) strand; PAM type: YTN; PAM sequence: TTT
aaaataaagcagtactgggc

SEQ ID NO: 273791 - DNA, 20 bp, Artificial Sequence
  Description of Artificial Sequence: Synthetic oligonucleotide
  Target: ATXN1; (+) strand; PAM type: YTN; PAM sequence: TTA
aaataaagcagtactgggca

SEQ ID NO: 273792 - DNA, 20 bp, Artificial Sequence
  Description of Artificial Sequence: Synthetic oligonucleotide
  Target: ATXN1; (+) strand; PAM type: YTN; PAM sequence: CTG
ggcatgttgtaagtgcttag

SEQ ID NO: 273793 - DNA, 20 bp, Artificial Sequence
  Description of Artificial Sequence: Synthetic oligonucleotide
  Target: ATXN1; (+) strand; PAM type: YTN; PAM sequence: TTG
taagtgcttagaatgctaat

SEQ ID NO: 273794 - DNA, 20 bp, Artificial Sequence
  Description of Artificial Sequence: Synthetic oligonucleotide
  Target: ATXN1; (+) strand; PAM type: YTN; PAM sequence: CTT
agaatgctaatattatcata

SEQ ID NO: 273795 - DNA, 20 bp, Artificial Sequence
  Description of Artificial Sequence: Synthetic oligonucleotide
  Target: ATXN1; (+) strand; PAM type: YTN; PAM sequence: TTA
gaatgctaatattatcatat

SEQ ID NO: 273796 - DNA, 20 bp, Artificial Sequence
  Description of Artificial Sequence: Synthetic oligonucleotide
  Target: ATXN1; (+) strand; PAM type: YTN; PAM sequence: CTA
atattatcatatactgagca

SEQ ID NO: 273797 - DNA, 20 bp, Artificial Sequence
  Description of Artificial Sequence: Synthetic oligonucleotide
  Target: ATXN1; (+) strand; PAM type: YTN; PAM sequence: TTA
tcatatactgagcacctact

SEQ ID NO: 273798 - DNA, 20 bp, Artificial Sequence
  Description of Artificial Sequence: Synthetic oligonucleotide
  Target: ATXN1; (+) strand; PAM type: YTN; PAM sequence: CTG
agcacctactacatggcaga

SEQ ID NO: 273799 - DNA, 20 bp, Artificial Sequence
  Description of Artificial Sequence: Synthetic oligonucleotide
  Target: ATXN1; (+) strand; PAM type: YTN; PAM sequence: CTA
ctacatggcagatattagag

SEQ ID NO: 273800 - DNA, 20 bp, Artificial Sequence
  Description of Artificial Sequence: Synthetic oligonucleotide
  Target: ATXN1; (+) strand; PAM type: YTN; PAM sequence: CTA
catggcagatattagaggaa

SEQ ID NO: 273801 - DNA, 20 bp, Artificial Sequence
  Description of Artificial Sequence: Synthetic oligonucleotide
  Target: ATXN1; (+) strand; PAM type: YTN; PAM sequence: TTA
gaggaacaagaatgattaac

SEQ ID NO: 273802 - DNA, 20 bp, Artificial Sequence
  Description of Artificial Sequence: Synthetic oligonucleotide
  Target: ATXN1; (+) strand; PAM type: YTN; PAM sequence: TTA
acaggttccccagttcttca

SEQ ID NO: 273803 - DNA, 20 bp, Artificial Sequence
  Description of Artificial Sequence: Synthetic oligonucleotide
  Target: ATXN1; (+) strand; PAM type: YTN; PAM sequence: TTC
cccagttcttcaagcatttg

SEQ ID NO: 273804 - DNA, 20 bp, Artificial Sequence
  Description of Artificial Sequence: Synthetic oligonucleotide
  Target: ATXN1; (+) strand; PAM type: YTN; PAM sequence: TTC
ttcaagcatttgcaatctag

SEQ ID NO: 273805 - DNA, 20 bp, Artificial Sequence
  Description of Artificial Sequence: Synthetic oligonucleotide
  Target: ATXN1; (+) strand; PAM type: YTN; PAM sequence: CTT
caagcatttgcaatctagta

SEQ ID NO: 273806 - DNA, 20 bp, Artificial Sequence
  Description of Artificial Sequence: Synthetic oligonucleotide
  Target: ATXN1; (+) strand; PAM type: YTN; PAM sequence: TTC
aagcatttgcaatctagtaa

SEQ ID NO: 273807 - DNA, 20 bp, Artificial Sequence
  Description of Artificial Sequence: Synthetic oligonucleotide
  Target: ATXN1; (+) strand; PAM type: YTN; PAM sequence: TTT
gcaatctagtaagggtaaaa

SEQ ID NO: 273808 - DNA, 20 bp, Artificial Sequence
  Description of Artificial Sequence: Synthetic oligonucleotide
  Target: ATXN1; (+) strand; PAM type: YTN; PAM sequence: TTG
caatctagtaagggtaaaag

SEQ ID NO: 273809 - DNA, 20 bp, Artificial Sequence
  Description of Artificial Sequence: Synthetic oligonucleotide
  Target: ATXN1; (+) strand; PAM type: YTN; PAM sequence: CTA
gtaagggtaaaagatatgta

SEQ ID NO: 273810 - DNA, 20 bp, Artificial Sequence
  Description of Artificial Sequence: Synthetic oligonucleotide
  Target: ATXN1; (+) strand; PAM type: YTN; PAM sequence: TTA
cagagccagagagagagaga

SEQ ID NO: 273811 - DNA, 20 bp, Artificial Sequence
  Description of Artificial Sequence: Synthetic oligonucleotide
  Target: ATXN1; (+) strand; PAM type: YTN; PAM sequence: CTC
acctacatgagagcacacac

SEQ ID NO: 273812 - DNA, 20 bp, Artificial Sequence
  Description of Artificial Sequence: Synthetic oligonucleotide
  Target: ATXN1; (+) strand; PAM type: YTN; PAM sequence: CTA
catgagagcacacacatgca

SEQ ID NO: 273813 - DNA, 20 bp, Artificial Sequence
  Description of Artificial Sequence: Synthetic oligonucleotide
  Target: ATXN1; (+) strand; PAM type: YTN; PAM sequence: CTA
ctgccaactgatgagctaca

SEQ ID NO: 273814 - DNA, 20 bp, Artificial Sequence
  Description of Artificial Sequence: Synthetic oligonucleotide
  Target: ATXN1; (+) strand; PAM type: YTN; PAM sequence: CTG
ccaactgatgagctacatac

SEQ ID NO: 273815 - DNA, 20 bp, Artificial Sequence
  Description of Artificial Sequence: Synthetic oligonucleotide
  Target: ATXN1; (+) strand; PAM type: YTN; PAM sequence: CTG
atgagctacatacagagcaa

SEQ ID NO: 273816 - DNA, 20 bp, Artificial Sequence
  Description of Artificial Sequence: Synthetic oligonucleotide
  Target: ATXN1; (+) strand; PAM type: YTN; PAM sequence: CTA
catacagagcaagaagagac

SEQ ID NO: 273817 - DNA, 20 bp, Artificial Sequence
  Description of Artificial Sequence: Synthetic oligonucleotide
  Target: ATXN1; (+) strand; PAM type: YTN; PAM sequence: TTG
ctgaactagctcctacagac

SEQ ID NO: 273818 - DNA, 20 bp, Artificial Sequence
  Description of Artificial Sequence: Synthetic oligonucleotide
  Target: ATXN1; (+) strand; PAM type: YTN; PAM sequence: CTG
aactagctcctacagacttg

SEQ ID NO: 273819 - DNA, 20 bp, Artificial Sequence
  Description of Artificial Sequence: Synthetic oligonucleotide
  Target: ATXN1; (+) strand; PAM type: YTN; PAM sequence: CTA
gctcctacagacttgccaga

SEQ ID NO: 273820 - DNA, 20 bp, Artificial Sequence
  Description of Artificial Sequence: Synthetic oligonucleotide
  Target: ATXN1; (+) strand; PAM type: YTN; PAM sequence: CTC
ctacagacttgccagacaag

SEQ ID NO: 273821 - DNA, 20 bp, Artificial Sequence
  Description of Artificial Sequence: Synthetic oligonucleotide
  Target: ATXN1; (+) strand; PAM type: YTN; PAM sequence: CTA
cagacttgccagacaagaca

SEQ ID NO: 273822 - DNA, 20 bp, Artificial Sequence
  Description of Artificial Sequence: Synthetic oligonucleotide
  Target: ATXN1; (+) strand; PAM type: YTN; PAM sequence: CTT
gccagacaagacagggcacc

SEQ ID NO: 273823 - DNA, 20 bp, Artificial Sequence
  Description of Artificial Sequence: Synthetic oligonucleotide
  Target: ATXN1; (+) strand; PAM type: YTN; PAM sequence: TTG
ccagacaagacagggcacca

SEQ ID NO: 273824 - DNA, 20 bp, Artificial Sequence
  Description of Artificial Sequence: Synthetic oligonucleotide
  Target: ATXN1; (+) strand; PAM type: YTN; PAM sequence: TTA
aagagtgtgagcagaggcat

SEQ ID NO: 273825 - DNA, 20 bp, Artificial Sequence
  Description of Artificial Sequence: Synthetic oligonucleotide
  Target: ATXN1; (+) strand; PAM type: YTN; PAM sequence: CTA
tgtgtttattcattcaacaa

SEQ ID NO: 273826 - DNA, 20 bp, Artificial Sequence
  Description of Artificial Sequence: Synthetic oligonucleotide
  Target: ATXN1; (+) strand; PAM type: YTN; PAM sequence: TTT
attcattcaacaaatattga

SEQ ID NO: 273827 - DNA, 20 bp, Artificial Sequence
  Description of Artificial Sequence: Synthetic oligonucleotide
  Target: ATXN1; (+) strand; PAM type: YTN; PAM sequence: TTA
ttcattcaacaaatattgat

SEQ ID NO: 273828 - DNA, 20 bp, Artificial Sequence
  Description of Artificial Sequence: Synthetic oligonucleotide
  Target: ATXN1; (+) strand; PAM type: YTN; PAM sequence: TTC
attcaacaaatattgatcaa

SEQ ID NO: 273829 - DNA, 20 bp, Artificial Sequence
  Description of Artificial Sequence: Synthetic oligonucleotide
  Target: ATXN1; (+) strand; PAM type: YTN; PAM sequence: TTC
aacaaatattgatcaaatgc

SEQ ID NO: 273830 - DNA, 20 bp, Artificial Sequence
  Description of Artificial Sequence: Synthetic oligonucleotide
  Target: ATXN1; (+) strand; PAM type: YTN; PAM sequence: TTG
atcaaatgcctcctatgtgc

SEQ ID NO: 273831 - DNA, 20 bp, Artificial Sequence
  Description of Artificial Sequence: Synthetic oligonucleotide
  Target: ATXN1; (+) strand; PAM type: YTN; PAM sequence: CTC
ctatgtgcttggcacagttt

SEQ ID NO: 273832 - DNA, 20 bp, Artificial Sequence
  Description of Artificial Sequence: Synthetic oligonucleotide
  Target: ATXN1; (+) strand; PAM type: YTN; PAM sequence: CTA
tgtgcttggcacagttttaa

SEQ ID NO: 273833 - DNA, 20 bp, Artificial Sequence
  Description of Artificial Sequence: Synthetic oligonucleotide
  Target: ATXN1; (+) strand; PAM type: YTN; PAM sequence: CTT
ggcacagttttaaatactgg

SEQ ID NO: 273834 - DNA, 20 bp, Artificial Sequence
  Description of Artificial Sequence: Synthetic oligonucleotide
  Target: ATXN1; (+) strand; PAM type: YTN; PAM sequence: TTG
gcacagttttaaatactggg

SEQ ID NO: 273835 - DNA, 20 bp, Artificial Sequence
  Description of Artificial Sequence: Synthetic oligonucleotide
  Target: ATXN1; (+) strand; PAM type: YTN; PAM sequence: TTT
taaatactgggatacatgca

SEQ ID NO: 273836 - DNA, 20 bp, Artificial Sequence
  Description of Artificial Sequence: Synthetic oligonucleotide
  Target: ATXN1; (+) strand; PAM type: YTN; PAM sequence: TTT
aaatactgggatacatgcag

SEQ ID NO: 273837 - DNA, 20 bp, Artificial Sequence
  Description of Artificial Sequence: Synthetic oligonucleotide
  Target: ATXN1; (+) strand; PAM type: YTN; PAM sequence: TTA
aatactgggatacatgcagt

SEQ ID NO: 273838 - DNA, 20 bp, Artificial Sequence
  Description of Artificial Sequence: Synthetic oligonucleotide
  Target: ATXN1; (+) strand; PAM type: YTN; PAM sequence: CTG
ggatacatgcagtccatgag

SEQ ID NO: 273839 - DNA, 20 bp, Artificial Sequence
  Description of Artificial Sequence: Synthetic oligonucleotide
  Target: ATXN1; (+) strand; PAM type: YTN; PAM sequence: CTT
ttgcttccactgagctaatt

SEQ ID NO: 273840 - DNA, 20 bp, Artificial Sequence
  Description of Artificial Sequence: Synthetic oligonucleotide
  Target: ATXN1; (+) strand; PAM type: YTN; PAM sequence: TTT
tgcttccactgagctaattc

SEQ ID NO: 273841 - DNA, 20 bp, Artificial Sequence
  Description of Artificial Sequence: Synthetic oligonucleotide
  Target: ATXN1; (+) strand; PAM type: YTN; PAM sequence: TTT
gcttccactgagctaattct

SEQ ID NO: 273842 - DNA, 20 bp, Artificial Sequence
  Description of Artificial Sequence: Synthetic oligonucleotide
  Target: ATXN1; (+) strand; PAM type: YTN; PAM sequence: TTG
cttccactgagctaattcta

SEQ ID NO: 273843 - DNA, 20 bp, Artificial Sequence
  Description of Artificial Sequence: Synthetic oligonucleotide
  Target: ATXN1; (+) strand; PAM type: YTN; PAM sequence: CTT
ccactgagctaattctaata

SEQ ID NO: 273844 - DNA, 20 bp, Artificial Sequence
  Description of Artificial Sequence: Synthetic oligonucleotide
  Target: ATXN1; (+) strand; PAM type: YTN; PAM sequence: TTC
cactgagctaattctaatag

SEQ ID NO: 273845 - DNA, 20 bp, Artificial Sequence
  Description of Artificial Sequence: Synthetic oligonucleotide
  Target: ATXN1; (+) strand; PAM type: YTN; PAM sequence: CTG
agctaattctaatagaggag

SEQ ID NO: 273846 - DNA, 20 bp, Artificial Sequence
  Description of Artificial Sequence: Synthetic oligonucleotide
  Target: ATXN1; (+) strand; PAM type: YTN; PAM sequence: CTA
attctaatagaggagactaa

SEQ ID NO: 273847 - DNA, 20 bp, Artificial Sequence
  Description of Artificial Sequence: Synthetic oligonucleotide
  Target: ATXN1; (+) strand; PAM type: YTN; PAM sequence: TTC
taatagaggagactaacaat

SEQ ID NO: 273848 - DNA, 20 bp, Artificial Sequence
  Description of Artificial Sequence: Synthetic oligonucleotide
  Target: ATXN1; (+) strand; PAM type: YTN; PAM sequence: CTA
atagaggagactaacaataa

SEQ ID NO: 273849 - DNA, 20 bp, Artificial Sequence
  Description of Artificial Sequence: Synthetic oligonucleotide
  Target: ATXN1; (+) strand; PAM type: YTN; PAM sequence: CTA
acaataaaccagcagtcgga

SEQ ID NO: 273850 - DNA, 20 bp, Artificial Sequence
  Description of Artificial Sequence: Synthetic oligonucleotide
  Target: ATXN1; (+) strand; PAM type: YTN; PAM sequence: CTT
gagtgagctgggggcgggta

SEQ ID NO: 273851 - DNA, 20 bp, Artificial Sequence
  Description of Artificial Sequence: Synthetic oligonucleotide
  Target: ATXN1; (+) strand; PAM type: YTN; PAM sequence: TTG
agtgagctgggggcgggtag

SEQ ID NO: 273852 - DNA, 20 bp, Artificial Sequence
  Description of Artificial Sequence: Synthetic oligonucleotide
  Target: ATXN1; (+) strand; PAM type: YTN; PAM sequence: CTG
ggggcgggtaggcctgatgg

SEQ ID NO: 273853 - DNA, 20 bp, Artificial Sequence
  Description of Artificial Sequence: Synthetic oligonucleotide
  Target: ATXN1; (+) strand; PAM type: YTN; PAM sequence: CTG
atggggtgcagggagcagaa

SEQ ID NO: 273854 - DNA, 20 bp, Artificial Sequence
  Description of Artificial Sequence: Synthetic oligonucleotide
  Target: ATXN1; (+) strand; PAM type: YTN; PAM sequence: CTT
tctatgggggaggatttccc

SEQ ID NO: 273855 - DNA, 20 bp, Artificial Sequence
  Description of Artificial Sequence: Synthetic oligonucleotide
  Target: ATXN1; (+) strand; PAM type: YTN; PAM sequence: TTT
ctatgggggaggatttccct

SEQ ID NO: 273856 - DNA, 20 bp, Artificial Sequence
  Description of Artificial Sequence: Synthetic oligonucleotide
  Target: ATXN1; (+) strand; PAM type: YTN; PAM sequence: TTC
tatgggggaggatttccctt

SEQ ID NO: 273857 - DNA, 20 bp, Artificial Sequence
  Description of Artificial Sequence: Synthetic oligonucleotide
  Target: ATXN1; (+) strand; PAM type: YTN; PAM sequence: CTA
tgggggaggatttcccttat

SEQ ID NO: 273858 - DNA, 20 bp, Artificial Sequence
  Description of Artificial Sequence: Synthetic oligonucleotide
  Target: ATXN1; (+) strand; PAM type: YTN; PAM sequence: TTT
cccttatgccctctgacctc

SEQ ID NO: 273859 - DNA, 20 bp, Artificial Sequence
  Description of Artificial Sequence: Synthetic oligonucleotide
  Target: ATXN1; (+) strand; PAM type: YTN; PAM sequence: TTC
ccttatgccctctgacctct

SEQ ID NO: 273860 - DNA, 20 bp, Artificial Sequence
  Description of Artificial Sequence: Synthetic oligonucleotide
  Target: ATXN1; (+) strand; PAM type: YTN; PAM sequence: CTT
atgccctctgacctcttgct

SEQ ID NO: 273861 - DNA, 20 bp, Artificial Sequence
  Description of Artificial Sequence: Synthetic oligonucleotide
  Target: ATXN1; (+) strand; PAM type: YTN; PAM sequence: TTA
tgccctctgacctcttgctc

SEQ ID NO: 273862 - DNA, 20 bp, Artificial Sequence
  Description of Artificial Sequence: Synthetic oligonucleotide
  Target: ATXN1; (+) strand; PAM type: YTN; PAM sequence: CTC
tgacctcttgctccaacctt

SEQ ID NO: 273863 - DNA, 20 bp, Artificial Sequence
  Description of Artificial Sequence: Synthetic oligonucleotide
  Target: ATXN1; (+) strand; PAM type: YTN; PAM sequence: CTG
acctcttgctccaacctttt

SEQ ID NO: 273864 - DNA, 20 bp, Artificial Sequence
  Description of Artificial Sequence: Synthetic oligonucleotide
  Target: ATXN1; (+) strand; PAM type: YTN; PAM sequence: CTC
ttgctccaaccttttcttcc

SEQ ID NO: 273865 - DNA, 20 bp, Artificial Sequence
  Description of Artificial Sequence: Synthetic oligonucleotide
  Target: ATXN1; (+) strand; PAM type: YTN; PAM sequence: CTT
gctccaaccttttcttcccc

SEQ ID NO: 273866 - DNA, 20 bp, Artificial Sequence
  Description of Artificial Sequence: Synthetic oligonucleotide
  Target: ATXN1; (+) strand; PAM type: YTN; PAM sequence: TTG
ctccaaccttttcttcccca

SEQ ID NO: 273867 - DNA, 20 bp, Artificial Sequence
  Description of Artificial Sequence: Synthetic oligonucleotide
  Target: ATXN1; (+) strand; PAM type: YTN; PAM sequence: CTC
caaccttttcttccccaagg

SEQ ID NO: 273868 - DNA, 20 bp, Artificial Sequence
  Description of Artificial Sequence: Synthetic oligonucleotide
  Target: ATXN1; (+) strand; PAM type: YTN; PAM sequence: CTT
ttcttccccaagggtgtgga

SEQ ID NO: 273869 - DNA, 20 bp, Artificial Sequence
  Description of Artificial Sequence: Synthetic oligonucleotide
  Target: ATXN1; (+) strand; PAM type: YTN; PAM sequence: TTT
tcttccccaagggtgtggaa

SEQ ID NO: 273870 - DNA, 20 bp, Artificial Sequence
  Description of Artificial Sequence: Synthetic oligonucleotide
  Target: ATXN1; (+) strand; PAM type: YTN; PAM sequence: TTT
cttccccaagggtgtggaat

SEQ ID NO: 273871 - DNA, 20 bp, Artificial Sequence
  Description of Artificial Sequence: Synthetic oligonucleotide
  Target: ATXN1; (+) strand; PAM type: YTN; PAM sequence: TTC
ttccccaagggtgtggaatg

SEQ ID NO: 273872 - DNA, 20 bp, Artificial Sequence
  Description of Artificial Sequence: Synthetic oligonucleotide
  Target: ATXN1; (+) strand; PAM type: YTN; PAM sequence: CTT
ccccaagggtgtggaatgag

SEQ ID NO: 273873 - DNA, 20 bp, Artificial Sequence
  Description of Artificial Sequence: Synthetic oligonucleotide
  Target: ATXN1; (+) strand; PAM type: YTN; PAM sequence: TTC
cccaagggtgtggaatgagt

SEQ ID NO: 273874 - DNA, 20 bp, Artificial Sequence
  Description of Artificial Sequence: Synthetic oligonucleotide
  Target: ATXN1; (+) strand; PAM type: YTN; PAM sequence: CTG
gggctaaagccaacgtggcc

SEQ ID NO: 273875 - DNA, 20 bp, Artificial Sequence
  Description of Artificial Sequence: Synthetic oligonucleotide
  Target: ATXN1; (+) strand; PAM type: YTN; PAM sequence: CTA
aagccaacgtggcctatgcc

SEQ ID NO: 273876 - DNA, 20 bp, Artificial Sequence
  Description of Artificial Sequence: Synthetic oligonucleotide
  Target: ATXN1; (+) strand; PAM type: YTN; PAM sequence: CTA
tgccccctccttggataggg

SEQ ID NO: 273877 - DNA, 20 bp, Artificial Sequence
  Description of Artificial Sequence: Synthetic oligonucleotide
  Target: ATXN1; (+) strand; PAM type: YTN; PAM sequence: CTC
cttggatagggtgaatctat

SEQ ID NO: 273878 - DNA, 20 bp, Artificial Sequence
  Description of Artificial Sequence: Synthetic oligonucleotide
  Target: ATXN1; (+) strand; PAM type: YTN; PAM sequence: CTT
ggatagggtgaatctatata

SEQ ID NO: 273879 - DNA, 20 bp, Artificial Sequence
  Description of Artificial Sequence: Synthetic oligonucleotide
  Target: ATXN1; (+) strand; PAM type: YTN; PAM sequence: TTG
gatagggtgaatctatataa

SEQ ID NO: 273880 - DNA, 20 bp, Artificial Sequence
  Description of Artificial Sequence: Synthetic oligonucleotide
  Target: ATXN1; (+) strand; PAM type: YTN; PAM sequence: CTA
tataattttgagcagggtta

SEQ ID NO: 273881 - DNA, 20 bp, Artificial Sequence
  Description of Artificial Sequence: Synthetic oligonucleotide
  Target: ATXN1; (+) strand; PAM type: YTN; PAM sequence: TTT
tgagcagggttagcagggat

SEQ ID NO: 273882 - DNA, 20 bp, Artificial Sequence
  Description of Artificial Sequence: Synthetic oligonucleotide
  Target: ATXN1; (+) strand; PAM type: YTN; PAM sequence: TTT
gagcagggttagcagggatt

SEQ ID NO: 273883 - DNA, 20 bp, Artificial Sequence
  Description of Artificial Sequence: Synthetic oligonucleotide
  Target: ATXN1; (+) strand; PAM type: YTN; PAM sequence: TTG
agcagggttagcagggattt

SEQ ID NO: 273884 - DNA, 20 bp, Artificial Sequence
  Description of Artificial Sequence: Synthetic oligonucleotide
  Target: ATXN1; (+) strand; PAM type: YTN; PAM sequence: TTA
gcagggatttgggcctcttt

SEQ ID NO: 273885 - DNA, 20 bp, Artificial Sequence
  Description of Artificial Sequence: Synthetic oligonucleotide
  Target: ATXN1; (+) strand; PAM type: YTN; PAM sequence: TTT
gggcctctttctccttccct

SEQ ID NO: 273886 - DNA, 20 bp, Artificial Sequence
  Description of Artificial Sequence: Synthetic oligonucleotide
  Target: ATXN1; (+) strand; PAM type: YTN; PAM sequence: TTG
ggcctctttctccttccctc

SEQ ID NO: 273887 - DNA, 20 bp, Artificial Sequence
  Description of Artificial Sequence: Synthetic oligonucleotide
  Target: ATXN1; (+) strand; PAM type: YTN; PAM sequence: CTC
tttctccttccctcttcaca

SEQ ID NO: 273888 - DNA, 20 bp, Artificial Sequence
  Description of Artificial Sequence: Synthetic oligonucleotide
  Target: ATXN1; (+) strand; PAM type: YTN; PAM sequence: CTT
tctccttccctcttcacaca

SEQ ID NO: 273889 - DNA, 20 bp, Artificial Sequence
  Description of Artificial Sequence: Synthetic oligonucleotide
  Target: ATXN1; (+) strand; PAM type: YTN; PAM sequence: TTT
ctccttccctcttcacacag

SEQ ID NO: 273890 - DNA, 20 bp, Artificial Sequence
  Description of Artificial Sequence: Synthetic oligonucleotide
  Target: ATXN1; (+) strand; PAM type: YTN; PAM sequence: TTC
tccttccctcttcacacaga

SEQ ID NO: 273891 - DNA, 20 bp, Artificial Sequence
  Description of Artificial Sequence: Synthetic oligonucleotide
  Target: ATXN1; (+) strand; PAM type: YTN; PAM sequence: CTC
cttccctcttcacacagaca

SEQ ID NO: 273892 - DNA, 20 bp, Artificial Sequence
  Description of Artificial Sequence: Synthetic oligonucleotide
  Target: ATXN1; (+) strand; PAM type: YTN; PAM sequence: CTT
ccctcttcacacagacaggt

SEQ ID NO: 273893 - DNA, 20 bp, Artificial Sequence
  Description of Artificial Sequence: Synthetic oligonucleotide
  Target: ATXN1; (+) strand; PAM type: YTN; PAM sequence: TTC
cctcttcacacagacaggtg

SEQ ID NO: 273894 - DNA, 20 bp, Artificial Sequence
  Description of Artificial Sequence: Synthetic oligonucleotide
  Target: ATXN1; (+) strand; PAM type: YTN; PAM sequence: CTC
ttcacacagacaggtgcctg

SEQ ID NO: 273895 - DNA, 20 bp, Artificial Sequence
  Description of Artificial Sequence: Synthetic oligonucleotide
  Target: ATXN1; (+) strand; PAM type: YTN; PAM sequence: CTT
cacacagacaggtgcctgta

SEQ ID NO: 273896 - DNA, 20 bp, Artificial Sequence
  Description of Artificial Sequence: Synthetic oligonucleotide
  Target: ATXN1; (+) strand; PAM type: YTN; PAM sequence: TTC
acacagacaggtgcctgtag

SEQ ID NO: 273897 - DNA, 20 bp, Artificial Sequence
  Description of Artificial Sequence: Synthetic oligonucleotide
  Target: ATXN1; (+) strand; PAM type: YTN; PAM sequence: CTG
tagactcaaaactttcctgc

SEQ ID NO: 273898 - DNA, 20 bp, Artificial Sequence
  Description of Artificial Sequence: Synthetic oligonucleotide
  Target: ATXN1; (+) strand; PAM type: YTN; PAM sequence: CTC
aaaactttcctgcaggtggc

SEQ ID NO: 273899 - DNA, 20 bp, Artificial Sequence
  Description of Artificial Sequence: Synthetic oligonucleotide
  Target: ATXN1; (+) strand; PAM type: YTN; PAM sequence: CTT
tcctgcaggtggcctgcgac

SEQ ID NO: 273900 - DNA, 20 bp, Artificial Sequence
  Description of Artificial Sequence: Synthetic oligonucleotide
  Target: ATXN1; (+) strand; PAM type: YTN; PAM sequence: TTT
cctgcaggtggcctgcgacc

SEQ ID NO: 273901 - DNA, 20 bp, Artificial Sequence
  Description of Artificial Sequence: Synthetic oligonucleotide
  Target: ATXN1; (+) strand; PAM type: YTN; PAM sequence: TTC
ctgcaggtggcctgcgacca

SEQ ID NO: 273902 - DNA, 20 bp, Artificial Sequence
  Description of Artificial Sequence: Synthetic oligonucleotide
  Target: ATXN1; (+) strand; PAM type: YTN; PAM sequence: CTG
caggtggcctgcgaccaggc

SEQ ID NO: 273903 - DNA, 20 bp, Artificial Sequence
  Description of Artificial Sequence: Synthetic oligonucleotide
  Target: ATXN1; (+) strand; PAM type: YTN; PAM sequence: CTG
cgaccaggctagactgggga

SEQ ID NO: 273904 - DNA, 20 bp, Artificial Sequence
  Description of Artificial Sequence: Synthetic oligonucleotide
  Target: ATXN1; (+) strand; PAM type: YTN; PAM sequence: CTA
gactggggaacaggcaggtg

SEQ ID NO: 273905 - DNA, 20 bp, Artificial Sequence
  Description of Artificial Sequence: Synthetic oligonucleotide
  Target: ATXN1; (+) strand; PAM type: YTN; PAM sequence: CTG
gggaacaggcaggtgtcaag

SEQ ID NO: 273906 - DNA, 20 bp, Artificial Sequence
  Description of Artificial Sequence: Synthetic oligonucleotide
  Target: ATXN1; (+) strand; PAM type: YTN; PAM sequence: TTA
gctcattgccctcagtcaca

SEQ ID NO: 273907 - DNA, 20 bp, Artificial Sequence
  Description of Artificial Sequence: Synthetic oligonucleotide
  Target: ATXN1; (+) strand; PAM type: YTN; PAM sequence: CTC
attgccctcagtcacatagt

SEQ ID NO: 273908 - DNA, 20 bp, Artificial Sequence
  Description of Artificial Sequence: Synthetic oligonucleotide
  Target: ATXN1; (+) strand; PAM type: YTN; PAM sequence: TTG
ccctcagtcacatagttgca

SEQ ID NO: 273909 - DNA, 20 bp, Artificial Sequence
  Description of Artificial Sequence: Synthetic oligonucleotide
  Target: ATXN1; (+) strand; PAM type: YTN; PAM sequence: CTC
agtcacatagttgcattctg

SEQ ID NO: 273910 - DNA, 20 bp, Artificial Sequence
  Description of Artificial Sequence: Synthetic oligonucleotide
  Target: ATXN1; (+) strand; PAM type: YTN; PAM sequence: TTG
cattctggcccccgtctgcc

SEQ ID NO: 273911 - DNA, 20 bp, Artificial Sequence
  Description of Artificial Sequence: Synthetic oligonucleotide
  Target: ATXN1; (+) strand; PAM type: YTN; PAM sequence: TTC
tggcccccgtctgcctcaat

SEQ ID NO: 273912 - DNA, 20 bp, Artificial Sequence
  Description of Artificial Sequence: Synthetic oligonucleotide
  Target: ATXN1; (+) strand; PAM type: YTN; PAM sequence: CTG
gcccccgtctgcctcaatac

SEQ ID NO: 273913 - DNA, 20 bp, Artificial Sequence
  Description of Artificial Sequence: Synthetic oligonucleotide
  Target: ATXN1; (+) strand; PAM type: YTN; PAM sequence: CTG
cctcaatactcttgtcttat

SEQ ID NO: 273914 - DNA, 20 bp, Artificial Sequence
  Description of Artificial Sequence: Synthetic oligonucleotide
  Target: ATXN1; (+) strand; PAM type: YTN; PAM sequence: CTC
aatactcttgtcttatttct

SEQ ID NO: 273915 - DNA, 20 bp, Artificial Sequence
  Description of Artificial Sequence: Synthetic oligonucleotide
  Target: ATXN1; (+) strand; PAM type: YTN; PAM sequence: CTC
ttgtcttatttctcagtggg

SEQ ID NO: 273916 - DNA, 20 bp, Artificial Sequence
  Description of Artificial Sequence: Synthetic oligonucleotide
  Target: ATXN1; (+) strand; PAM type: YTN; PAM sequence: CTT
gtcttatttctcagtgggct

SEQ ID NO: 273917 - DNA, 20 bp, Artificial Sequence
  Description of Artificial Sequence: Synthetic oligonucleotide
  Target: ATXN1; (+) strand; PAM type: YTN; PAM sequence: TTG
tcttatttctcagtgggctc

SEQ ID NO: 273918 - DNA, 20 bp, Artificial Sequence
  Description of Artificial Sequence: Synthetic oligonucleotide
  Target: ATXN1; (+) strand; PAM type: YTN; PAM sequence: CTT
atttctcagtgggctcagaa

SEQ ID NO: 273919 - DNA, 20 bp, Artificial Sequence
  Description of Artificial Sequence: Synthetic oligonucleotide
  Target: ATXN1; (+) strand; PAM type: YTN; PAM sequence: TTA
tttctcagtgggctcagaac

SEQ ID NO: 273920 - DNA, 20 bp, Artificial Sequence
  Description of Artificial Sequence: Synthetic oligonucleotide
  Target: ATXN1; (+) strand; PAM type: YTN; PAM sequence: TTT
ctcagtgggctcagaacttg

SEQ ID NO: 273921 - DNA, 20 bp, Artificial Sequence
  Description of Artificial Sequence: Synthetic oligonucleotide
  Target: ATXN1; (+) strand; PAM type: YTN; PAM sequence: TTC
tcagtgggctcagaacttgg

SEQ ID NO: 273922 - DNA, 20 bp, Artificial Sequence
  Description of Artificial Sequence: Synthetic oligonucleotide
  Target: ATXN1; (+) strand; PAM type: YTN; PAM sequence: CTC
agtgggctcagaacttggga

SEQ ID NO: 273923 - DNA, 20 bp, Artificial Sequence
  Description of Artificial Sequence: Synthetic oligonucleotide
  Target: ATXN1; (+) strand; PAM type: YTN; PAM sequence: CTC
agaacttgggacgggaagag

SEQ ID NO: 273924 - DNA, 20 bp, Artificial Sequence
  Description of Artificial Sequence: Synthetic oligonucleotide
  Target: ATXN1; (+) strand; PAM type: YTN; PAM sequence: CTT
gggacgggaagagaactctt

SEQ ID NO: 273925 - DNA, 20 bp, Artificial Sequence
  Description of Artificial Sequence: Synthetic oligonucleotide
  Target: ATXN1; (+) strand; PAM type: YTN; PAM sequence: TTG
ggacgggaagagaactcttg

SEQ ID NO: 273926 - DNA, 20 bp, Artificial Sequence
  Description of Artificial Sequence: Synthetic oligonucleotide
  Target: ATXN1; (+) strand; PAM type: YTN; PAM sequence: CTC
ttgtaagataaaagtttcca

SEQ ID NO: 273927 - DNA, 20 bp, Artificial Sequence
  Description of Artificial Sequence: Synthetic oligonucleotide
  Target: ATXN1; (+) strand; PAM type: YTN; PAM sequence: CTT
gtaagataaaagtttccata

SEQ ID NO: 273928 - DNA, 20 bp, Artificial Sequence
  Description of Artificial Sequence: Synthetic oligonucleotide
  Target: ATXN1; (+) strand; PAM type: YTN; PAM sequence: TTG
taagataaaagtttccataa

SEQ ID NO: 273929 - DNA, 20 bp, Artificial Sequence
  Description of Artificial Sequence: Synthetic oligonucleotide
  Target: ATXN1; (+) strand; PAM type: YTN; PAM sequence: TTT
ccataagataaaaaccttcc

SEQ ID NO: 273930 - DNA, 20 bp, Artificial Sequence
  Description of Artificial Sequence: Synthetic oligonucleotide
  Target: ATXN1; (+) strand; PAM type: YTN; PAM sequence: TTC
cataagataaaaaccttccc

SEQ ID NO: 273931 - DNA, 20 bp, Artificial Sequence
  Description of Artificial Sequence: Synthetic oligonucleotide
  Target: ATXN1; (+) strand; PAM type: YTN; PAM sequence: CTT
ccctcccctaaacagacctc

SEQ ID NO: 273932 - DNA, 20 bp, Artificial Sequence
  Description of Artificial Sequence: Synthetic oligonucleotide
  Target: ATXN1; (+) strand; PAM type: YTN; PAM sequence: TTC
cctcccctaaacagacctca

SEQ ID NO: 273933 - DNA, 20 bp, Artificial Sequence
  Description of Artificial Sequence: Synthetic oligonucleotide
  Target: ATXN1; (+) strand; PAM type: YTN; PAM sequence: CTC
ccctaaacagacctcaaaac

SEQ ID NO: 273934 - DNA, 20 bp, Artificial Sequence
  Description of Artificial Sequence: Synthetic oligonucleotide
  Target: ATXN1; (+) strand; PAM type: YTN; PAM sequence: CTA
aacagacctcaaaaccaaat

SEQ ID NO: 273935 - DNA, 20 bp, Artificial Sequence
  Description of Artificial Sequence: Synthetic oligonucleotide
  Target: ATXN1; (+) strand; PAM type: YTN; PAM sequence: CTC
aaaaccaaattaggaatcac

SEQ ID NO: 273936 - DNA, 20 bp, Artificial Sequence
  Description of Artificial Sequence: Synthetic oligonucleotide
  Target: ATXN1; (+) strand; PAM type: YTN; PAM sequence: TTA
ggaatcactatcctaatcta

SEQ ID NO: 273937 - DNA, 20 bp, Artificial Sequence
  Description of Artificial Sequence: Synthetic oligonucleotide
  Target: ATXN1; (+) strand; PAM type: YTN; PAM sequence: CTA
tcctaatctatcaaacctaa

SEQ ID NO: 273938 - DNA, 20 bp, Artificial Sequence
  Description of Artificial Sequence: Synthetic oligonucleotide
  Target: ATXN1; (+) strand; PAM type: YTN; PAM sequence: CTA
atctatcaaacctaatctat

SEQ ID NO: 273939 - DNA, 20 bp, Artificial Sequence
  Description of Artificial Sequence: Synthetic oligonucleotide
  Target: ATXN1; (+) strand; PAM type: YTN; PAM sequence: CTA
tcaaacctaatctatctgtc

SEQ ID NO: 273940 - DNA, 20 bp, Artificial Sequence
  Description of Artificial Sequence: Synthetic oligonucleotide
  Target: ATXN1; (+) strand; PAM type: YTN; PAM sequence: CTA
atctatctgtcatcttaatg

SEQ ID NO: 273941 - DNA, 20 bp, Artificial Sequence
  Description of Artificial Sequence: Synthetic oligonucleotide
  Target: ATXN1; (+) strand; PAM type: YTN; PAM sequence: CTA
tctgtcatcttaatggaaaa

SEQ ID NO: 273942 - DNA, 20 bp, Artificial Sequence
  Description of Artificial Sequence: Synthetic oligonucleotide
  Target: ATXN1; (+) strand; PAM type: YTN; PAM sequence: CTG
tcatcttaatggaaaaatcc

SEQ ID NO: 273943 - DNA, 20 bp, Artificial Sequence
  Description of Artificial Sequence: Synthetic oligonucleotide
  Target: ATXN1; (+) strand; PAM type: YTN; PAM sequence: CTT
aatggaaaaatccctcaaat

SEQ ID NO: 273944 - DNA, 20 bp, Artificial Sequence
  Description of Artificial Sequence: Synthetic oligonucleotide
  Target: ATXN1; (+) strand; PAM type: YTN; PAM sequence: TTA
atggaaaaatccctcaaatc

SEQ ID NO: 273945 - DNA, 20 bp, Artificial Sequence
  Description of Artificial Sequence: Synthetic oligonucleotide
  Target: ATXN1; (+) strand; PAM type: YTN; PAM sequence: CTC
aaatctcttacttaatagtc

SEQ ID NO: 273946 - DNA, 20 bp, Artificial Sequence
  Description of Artificial Sequence: Synthetic oligonucleotide
  Target: ATXN1; (+) strand; PAM type: YTN; PAM sequence: CTC
ttacttaatagtccaaaacg

SEQ ID NO: 273947 - DNA, 20 bp, Artificial Sequence
  Description of Artificial Sequence: Synthetic oligonucleotide
  Target: ATXN1; (+) strand; PAM type: YTN; PAM sequence: CTT
acttaatagtccaaaacgct

SEQ ID NO: 273948 - DNA, 20 bp, Artificial Sequence
  Description of Artificial Sequence: Synthetic oligonucleotide
  Target: ATXN1; (+) strand; PAM type: YTN; PAM sequence: TTA
cttaatagtccaaaacgcta

SEQ ID NO: 273949 - DNA, 20 bp, Artificial Sequence
  Description of Artificial Sequence: Synthetic oligonucleotide
  Target: ATXN1; (+) strand; PAM type: YTN; PAM sequence: CTT
aatagtccaaaacgctagac

SEQ ID NO: 273950 - DNA, 20 bp, Artificial Sequence
  Description of Artificial Sequence: Synthetic oligonucleotide
  Target: ATXN1; (+) strand; PAM type: YTN; PAM sequence: TTA
atagtccaaaacgctagact

SEQ ID NO: 273951 - DNA, 20 bp, Artificial Sequence
  Description of Artificial Sequence: Synthetic oligonucleotide
  Target: ATXN1; (+) strand; PAM type: YTN; PAM sequence: CTA
gactgagaagtctgatccca

SEQ ID NO: 273952 - DNA, 20 bp, Artificial Sequence
  Description of Artificial Sequence: Synthetic oligonucleotide
  Target: ATXN1; (+) strand; PAM type: YTN; PAM sequence: CTG
agaagtctgatcccaaagac

SEQ ID NO: 273953 - DNA, 20 bp, Artificial Sequence
  Description of Artificial Sequence: Synthetic oligonucleotide
  Target: ATXN1; (+) strand; PAM type: YTN; PAM sequence: CTG
atcccaaagacaaattcaat

SEQ ID NO: 273954 - DNA, 20 bp, Artificial Sequence
  Description of Artificial Sequence: Synthetic oligonucleotide
  Target: ATXN1; (+) strand; PAM type: YTN; PAM sequence: TTC
aatacagtgaatattgggag

SEQ ID NO: 273955 - DNA, 20 bp, Artificial Sequence
  Description of Artificial Sequence: Synthetic oligonucleotide
  Target: ATXN1; (+) strand; PAM type: YTN; PAM sequence: TTG
ggagtgaggtgggaaaaagg

SEQ ID NO: 273956 - DNA, 20 bp, Artificial Sequence
  Description of Artificial Sequence: Synthetic oligonucleotide
  Target: ATXN1; (+) strand; PAM type: YTN; PAM sequence: TTT
tggtgccagtataaaaccca

SEQ ID NO: 273957 - DNA, 20 bp, Artificial Sequence
  Description of Artificial Sequence: Synthetic oligonucleotide
  Target: ATXN1; (+) strand; PAM type: YTN; PAM sequence: TTT
ggtgccagtataaaacccag

SEQ ID NO: 273958 - DNA, 20 bp, Artificial Sequence
  Description of Artificial Sequence: Synthetic oligonucleotide
  Target: ATXN1; (+) strand; PAM type: YTN; PAM sequence: TTG
gtgccagtataaaacccagg

SEQ ID NO: 273959 - DNA, 20 bp, Artificial Sequence
  Description of Artificial Sequence: Synthetic oligonucleotide
  Target: ATXN1; (+) strand; PAM type: YTN; PAM sequence: CTA
tggtcagtagccagaaagag

SEQ ID NO: 273960 - DNA, 20 bp, Artificial Sequence
  Description of Artificial Sequence: Synthetic oligonucleotide
  Target: ATXN1; (+) strand; PAM type: YTN; PAM sequence: CTT
tagatattcttaccttgtga

SEQ ID NO: 273961 - DNA, 20 bp, Artificial Sequence
  Description of Artificial Sequence: Synthetic oligonucleotide
  Target: ATXN1; (+) strand; PAM type: YTN; PAM sequence: TTT
agatattcttaccttgtgac

SEQ ID NO: 273962 - DNA, 20 bp, Artificial Sequence
  Description of Artificial Sequence: Synthetic oligonucleotide
  Target: ATXN1; (+) strand; PAM type: YTN; PAM sequence: TTA
gatattcttaccttgtgact

SEQ ID NO: 273963 - DNA, 20 bp, Artificial Sequence
  Description of Artificial Sequence: Synthetic oligonucleotide
  Target: ATXN1; (+) strand; PAM type: YTN; PAM sequence: TTC
ttaccttgtgactttatatc

SEQ ID NO: 273964 - DNA, 20 bp, Artificial Sequence
  Description of Artificial Sequence: Synthetic oligonucleotide
  Target: ATXN1; (+) strand; PAM type: YTN; PAM sequence: CTT
accttgtgactttatatctg

SEQ ID NO: 273965 - DNA, 20 bp, Artificial Sequence
  Description of Artificial Sequence: Synthetic oligonucleotide
  Target: ATXN1; (+) strand; PAM type: YTN; PAM sequence: TTA
ccttgtgactttatatctgc

SEQ ID NO: 273966 - DNA, 20 bp, Artificial Sequence
  Description of Artificial Sequence: Synthetic oligonucleotide
  Target: ATXN1; (+) strand; PAM type: YTN; PAM sequence: CTT
gtgactttatatctgcatta

SEQ ID NO: 273967 - DNA, 20 bp, Artificial Sequence
  Description of Artificial Sequence: Synthetic oligonucleotide
  Target: ATXN1; (+) strand; PAM type: YTN; PAM sequence: TTG
tgactttatatctgcattaa

SEQ ID NO: 273968 - DNA, 20 bp, Artificial Sequence
  Description of Artificial Sequence: Synthetic oligonucleotide
  Target: ATXN1; (+) strand; PAM type: YTN; PAM sequence: CTT
tatatctgcattaaaaaaac

SEQ ID NO: 273969 - DNA, 20 bp, Artificial Sequence
  Description of Artificial Sequence: Synthetic oligonucleotide
  Target: ATXN1; (+) strand; PAM type: YTN; PAM sequence: TTT
atatctgcattaaaaaaacc

SEQ ID NO: 273970 - DNA, 20 bp, Artificial Sequence
  Description of Artificial Sequence: Synthetic oligonucleotide
  Target: ATXN1; (+) strand; PAM type: YTN; PAM sequence: TTA
tatctgcattaaaaaaacca

SEQ ID NO: 273971 - DNA, 20 bp, Artificial Sequence
  Description of Artificial Sequence: Synthetic oligonucleotide
  Target: ATXN1; (+) strand; PAM type: YTN; PAM sequence: CTG
cattaaaaaaaccacattag

SEQ ID NO: 273972 - DNA, 20 bp, Artificial Sequence
  Description of Artificial Sequence: Synthetic oligonucleotide
  Target: ATXN1; (+) strand; PAM type: YTN; PAM sequence: TTA
aaaaaaccacattaggaaaa

SEQ ID NO: 273973 - DNA, 20 bp, Artificial Sequence
  Description of Artificial Sequence: Synthetic oligonucleotide
  Target: ATXN1; (+) strand; PAM type: YTN; PAM sequence: TTA
ggaaaataatttcttgagtt

SEQ ID NO: 273974 - DNA, 20 bp, Artificial Sequence
  Description of Artificial Sequence: Synthetic oligonucleotide
  Target: ATXN1; (+) strand; PAM type: YTN; PAM sequence: TTT
cttgagtttatcttttcttt

SEQ ID NO: 273975 - DNA, 20 bp, Artificial Sequence
  Description of Artificial Sequence: Synthetic oligonucleotide
  Target: ATXN1; (+) strand; PAM type: YTN; PAM sequence: TTC
ttgagtttatcttttctttg

SEQ ID NO: 273976 - DNA, 20 bp, Artificial Sequence
  Description of Artificial Sequence: Synthetic oligonucleotide
  Target: ATXN1; (+) strand; PAM type: YTN; PAM sequence: CTT
gagtttatcttttctttgaa

SEQ ID NO: 273977 - DNA, 20 bp, Artificial Sequence
  Description of Artificial Sequence: Synthetic oligonucleotide
  Target: ATXN1; (+) strand; PAM type: YTN; PAM sequence: TTG
agtttatcttttctttgaag

SEQ ID NO: 273978 - DNA, 20 bp, Artificial Sequence
  Description of Artificial Sequence: Synthetic oligonucleotide
  Target: ATXN1; (+) strand; PAM type: YTN; PAM sequence: TTT
atcttttctttgaagaactg

SEQ ID NO: 273979 - DNA, 20 bp, Artificial Sequence
  Description of Artificial Sequence: Synthetic oligonucleotide
  Target: ATXN1; (+) strand; PAM type: YTN; PAM sequence: TTA
tcttttctttgaagaactga

SEQ ID NO: 273980 - DNA, 20 bp, Artificial Sequence
  Description of Artificial Sequence: Synthetic oligonucleotide
  Target: ATXN1; (+) strand; PAM type: YTN; PAM sequence: CTT
ttctttgaagaactgaacaa

SEQ ID NO: 273981 - DNA, 20 bp, Artificial Sequence
  Description of Artificial Sequence: Synthetic oligonucleotide
  Target: ATXN1; (+) strand; PAM type: YTN; PAM sequence: TTT
tctttgaagaactgaacaac

SEQ ID NO: 273982 - DNA, 20 bp, Artificial Sequence
  Description of Artificial Sequence: Synthetic oligonucleotide
  Target: ATXN1; (+) strand; PAM type: YTN; PAM sequence: TTT
ctttgaagaactgaacaaca

SEQ ID NO: 273983 - DNA, 20 bp, Artificial Sequence
  Description of Artificial Sequence: Synthetic oligonucleotide
  Target: ATXN1; (+) strand; PAM type: YTN; PAM sequence: TTC
tttgaagaactgaacaacat

SEQ ID NO: 273984 - DNA, 20 bp, Artificial Sequence
  Description of Artificial Sequence: Synthetic oligonucleotide
  Target: ATXN1; (+) strand; PAM type: YTN; PAM sequence: CTT
tgaagaactgaacaacattt

SEQ ID NO: 273985 - DNA, 20 bp, Artificial Sequence
  Description of Artificial Sequence: Synthetic oligonucleotide
  Target: ATXN1; (+) strand; PAM type: YTN; PAM sequence: TTT
gaagaactgaacaacatttt

SEQ ID NO: 273986 - DNA, 20 bp, Artificial Sequence
  Description of Artificial Sequence: Synthetic oligonucleotide
  Target: ATXN1; (+) strand; PAM type: YTN; PAM sequence: TTG
aagaactgaacaacattttc

SEQ ID NO: 273987 - DNA, 20 bp, Artificial Sequence
  Description of Artificial Sequence: Synthetic oligonucleotide
  Target: ATXN1; (+) strand; PAM type: YTN; PAM sequence: CTG
aacaacattttcaatatatt

SEQ ID NO: 273988 - DNA, 20 bp, Artificial Sequence
  Description of Artificial Sequence: Synthetic oligonucleotide
  Target: ATXN1; (+) strand; PAM type: YTN; PAM sequence: TTT
tcaatatatttacacacttg

SEQ ID NO: 273989 - DNA, 20 bp, Artificial Sequence
  Description of Artificial Sequence: Synthetic oligonucleotide
  Target: ATXN1; (+) strand; PAM type: YTN; PAM sequence: TTT
caatatatttacacacttgc

SEQ ID NO: 273990 - DNA, 20 bp, Artificial Sequence
  Description of Artificial Sequence: Synthetic oligonucleotide
  Target: ATXN1; (+) strand; PAM type: YTN; PAM sequence: TTC
aatatatttacacacttgcc

SEQ ID NO: 273991 - DNA, 20 bp, Artificial Sequence
  Description of Artificial Sequence: Synthetic oligonucleotide
  Target: ATXN1; (+) strand; PAM type: YTN; PAM sequence: TTT
acacacttgcctcacaattt

SEQ ID NO: 273992 - DNA, 20 bp, Artificial Sequence
  Description of Artificial Sequence: Synthetic oligonucleotide
  Target: ATXN1; (+) strand; PAM type: YTN; PAM sequence: TTA
cacacttgcctcacaatttc

SEQ ID NO: 273993 - DNA, 20 bp, Artificial Sequence
  Description of Artificial Sequence: Synthetic oligonucleotide
  Target: ATXN1; (+) strand; PAM type: YTN; PAM sequence: CTT
gcctcacaatttccttggga

SEQ ID NO: 273994 - DNA, 20 bp, Artificial Sequence
  Description of Artificial Sequence: Synthetic oligonucleotide
  Target: ATXN1; (+) strand; PAM type: YTN; PAM sequence: TTG
cctcacaatttccttgggag

SEQ ID NO: 273995 - DNA, 20 bp, Artificial Sequence
  Description of Artificial Sequence: Synthetic oligonucleotide
  Target: ATXN1; (+) strand; PAM type: YTN; PAM sequence: CTC
acaatttccttgggagatgg

SEQ ID NO: 273996 - DNA, 20 bp, Artificial Sequence
  Description of Artificial Sequence: Synthetic oligonucleotide
  Target: ATXN1; (+) strand; PAM type: YTN; PAM sequence: TTT
ccttgggagatggagtgaga

SEQ ID NO: 273997 - DNA, 20 bp, Artificial Sequence
  Description of Artificial Sequence: Synthetic oligonucleotide
  Target: ATXN1; (+) strand; PAM type: YTN; PAM sequence: TTC
cttgggagatggagtgagaa

SEQ ID NO: 273998 - DNA, 20 bp, Artificial Sequence
  Description of Artificial Sequence: Synthetic oligonucleotide
  Target: ATXN1; (+) strand; PAM type: YTN; PAM sequence: CTT
gggagatggagtgagaatat

SEQ ID NO: 273999 - DNA, 20 bp, Artificial Sequence
  Description of Artificial Sequence: Synthetic oligonucleotide
  Target: ATXN1; (+) strand; PAM type: YTN; PAM sequence: TTG
ggagatggagtgagaatata

SEQ ID NO: 274000 - DNA, 20 bp, Artificial Sequence
  Description of Artificial Sequence: Synthetic oligonucleotide
  Target: ATXN1; (+) strand; PAM type: YTN; PAM sequence: TTG
tcgtgaacaaatattaatgt

SEQ ID NO: 274001 - DNA, 20 bp, Artificial Sequence
  Description of Artificial Sequence: Synthetic oligonucleotide
  Target: ATXN1; (+) strand; PAM type: YTN; PAM sequence: TTA
atgtcatggttactatctgc

SEQ ID NO: 274002 - DNA, 20 bp, Artificial Sequence
  Description of Artificial Sequence: Synthetic oligonucleotide
  Target: ATXN1; (+) strand; PAM type: YTN; PAM sequence: TTA
ctatctgcagaactcagttg

SEQ ID NO: 274003 - DNA, 20 bp, Artificial Sequence
  Description of Artificial Sequence: Synthetic oligonucleotide
  Target: ATXN1; (+) strand; PAM type: YTN; PAM sequence: CTA
tctgcagaactcagttgtga

SEQ ID NO: 274004 - DNA, 20 bp, Artificial Sequence
  Description of Artificial Sequence: Synthetic oligonucleotide
  Target: ATXN1; (+) strand; PAM type: YTN; PAM sequence: CTG
cagaactcagttgtgagcat

SEQ ID NO: 274005 - DNA, 20 bp, Artificial Sequence
  Description of Artificial Sequence: Synthetic oligonucleotide
  Target: ATXN1; (+) strand; PAM type: YTN; PAM sequence: CTC
agttgtgagcattagagaaa

SEQ ID NO: 274006 - DNA, 20 bp, Artificial Sequence
  Description of Artificial Sequence: Synthetic oligonucleotide
  Target: ATXN1; (+) strand; PAM type: YTN; PAM sequence: TTG
tgagcattagagaaattttt

SEQ ID NO: 274007 - DNA, 20 bp, Artificial Sequence
  Description of Artificial Sequence: Synthetic oligonucleotide
  Target: ATXN1; (+) strand; PAM type: YTN; PAM sequence: TTA
gagaaatttttttaagagga

SEQ ID NO: 274008 - DNA, 20 bp, Artificial Sequence
  Description of Artificial Sequence: Synthetic oligonucleotide
  Target: ATXN1; (+) strand; PAM type: YTN; PAM sequence: TTT
ttttaagaggaagaagaaga

SEQ ID NO: 274009 - DNA, 20 bp, Artificial Sequence
  Description of Artificial Sequence: Synthetic oligonucleotide
  Target: ATXN1; (+) strand; PAM type: YTN; PAM sequence: TTT
tttaagaggaagaagaagat

SEQ ID NO: 274010 - DNA, 20 bp, Artificial Sequence
  Description of Artificial Sequence: Synthetic oligonucleotide
  Target: ATXN1; (+) strand; PAM type: YTN; PAM sequence: TTT
ttaagaggaagaagaagata

SEQ ID NO: 274011 - DNA, 20 bp, Artificial Sequence
  Description of Artificial Sequence: Synthetic oligonucleotide
  Target: ATXN1; (+) strand; PAM type: YTN; PAM sequence: TTT
taagaggaagaagaagatac

SEQ ID NO: 274012 - DNA, 20 bp, Artificial Sequence
  Description of Artificial Sequence: Synthetic oligonucleotide
  Target: ATXN1; (+) strand; PAM type: YTN; PAM sequence: TTT
aagaggaagaagaagataca

SEQ ID NO: 274013 - DNA, 20 bp, Artificial Sequence
  Description of Artificial Sequence: Synthetic oligonucleotide
  Target: ATXN1; (+) strand; PAM type: YTN; PAM sequence: TTA
agaggaagaagaagatacat

SEQ ID NO: 274014 - DNA, 20 bp, Artificial Sequence
  Description of Artificial Sequence: Synthetic oligonucleotide
  Target: ATXN1; (+) strand; PAM type: YTN; PAM sequence: TTT
cgtatccttgaagggcttag

SEQ ID NO: 274015 - DNA, 20 bp, Artificial Sequence
  Description of Artificial Sequence: Synthetic oligonucleotide
  Target: ATXN1; (+) strand; PAM type: YTN; PAM sequence: TTC
gtatccttgaagggcttagc

SEQ ID NO: 274016 - DNA, 20 bp, Artificial Sequence
  Description of Artificial Sequence: Synthetic oligonucleotide
  Target: ATXN1; (+) strand; PAM type: YTN; PAM sequence: CTT
gaagggcttagcctcgacct

SEQ ID NO: 274017 - DNA, 20 bp, Artificial Sequence
  Description of Artificial Sequence: Synthetic oligonucleotide
  Target: ATXN1; (+) strand; PAM type: YTN; PAM sequence: TTG
aagggcttagcctcgaccta

SEQ ID NO: 274018 - DNA, 20 bp, Artificial Sequence
  Description of Artificial Sequence: Synthetic oligonucleotide
  Target: ATXN1; (+) strand; PAM type: YTN; PAM sequence: CTT
agcctcgacctagaaaacac

SEQ ID NO: 274019 - DNA, 20 bp, Artificial Sequence
  Description of Artificial Sequence: Synthetic oligonucleotide
  Target: ATXN1; (+) strand; PAM type: YTN; PAM sequence: TTA
gcctcgacctagaaaacact

SEQ ID NO: 274020 - DNA, 20 bp, Artificial Sequence
  Description of Artificial Sequence: Synthetic oligonucleotide
  Target: ATXN1; (+) strand; PAM type: YTN; PAM sequence: CTC
gacctagaaaacactcaggc

SEQ ID NO: 274021 - DNA, 20 bp, Artificial Sequence
  Description of Artificial Sequence: Synthetic oligonucleotide
  Target: ATXN1; (+) strand; PAM type: YTN; PAM sequence: CTA
gaaaacactcaggcccccaa

SEQ ID NO: 274022 - DNA, 20 bp, Artificial Sequence
  Description of Artificial Sequence: Synthetic oligonucleotide
  Target: ATXN1; (+) strand; PAM type: YTN; PAM sequence: CTC
aggcccccaaagcaatatat

SEQ ID NO: 274023 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatgcttcaggagtt

SEQ ID NO: 274024 - DNA, 20 bp, Artificial Sequence
  Description of Artificial Sequence: Synthetic oligonucleotide
  Target: ATXN1; (+) strand; PAM type: YTN; PAM sequence: TTT
taaaaatgcttcaggagttc

SEQ ID NO: 274025 - DNA, 20 bp, Artificial Sequence
  Description of Artificial Sequence: Synthetic oligonucleotide
  Target: ATXN1; (+) strand; PAM type: YTN; PAM sequence: TTT
aaaaatgcttcaggagttca

SEQ ID NO: 274026 - DNA, 20 bp, Artificial Sequence
  Description of Artificial Sequence: Synthetic oligonucleotide
  Target: ATXN1; (+) strand; PAM type: YTN; PAM sequence: TTA
aaaatgcttcaggagttcag

SEQ ID NO: 274027 - DNA, 20 bp, Artificial Sequence
  Description of Artificial Sequence: Synthetic oligonucleotide
  Target: ATXN1; (+) strand; PAM type: YTN; PAM sequence: CTT
caggagttcagaggggaaaa

SEQ ID NO: 274028 - DNA, 20 bp, Artificial Sequence
  Description of Artificial Sequence: Synthetic oligonucleotide
  Target: ATXN1; (+) strand; PAM type: YTN; PAM sequence: TTC
aggagttcagaggggaaaaa

SEQ ID NO: 274029 - DNA, 20 bp, Artificial Sequence
  Description of Artificial Sequence: Synthetic oligonucleotide
  Target: ATXN1; (+) strand; PAM type: YTN; PAM sequence: TTC
agaggggaaaaaaagtatcc

SEQ ID NO: 274030 - DNA, 20 bp, Artificial Sequence
  Description of Artificial Sequence: Synthetic oligonucleotide
  Target: ATXN1; (+) strand; PAM type: YTN; PAM sequence: TTG
gaactaagagttcttacaat

SEQ ID NO: 274031 - DNA, 20 bp, Artificial Sequence
  Description of Artificial Sequence: Synthetic oligonucleotide
  Target: ATXN1; (+) strand; PAM type: YTN; PAM sequence: CTA
agagttcttacaattctttc

SEQ ID NO: 274032 - DNA, 20 bp, Artificial Sequence
  Description of Artificial Sequence: Synthetic oligonucleotide
  Target: ATXN1; (+) strand; PAM type: YTN; PAM sequence: TTC
ttacaattctttcatcaagg

SEQ ID NO: 274033 - DNA, 20 bp, Artificial Sequence
  Description of Artificial Sequence: Synthetic oligonucleotide
  Target: ATXN1; (+) strand; PAM type: YTN; PAM sequence: CTT
acaattctttcatcaaggat

SEQ ID NO: 274034 - DNA, 20 bp, Artificial Sequence
  Description of Artificial Sequence: Synthetic oligonucleotide
  Target: ATXN1; (+) strand; PAM type: YTN; PAM sequence: TTA
caattctttcatcaaggatt

SEQ ID NO: 274035 - DNA, 20 bp, Artificial Sequence
  Description of Artificial Sequence: Synthetic oligonucleotide
  Target: ATXN1; (+) strand; PAM type: YTN; PAM sequence: TTC
tttcatcaaggattatatag

SEQ ID NO: 274036 - DNA, 20 bp, Artificial Sequence
  Description of Artificial Sequence: Synthetic oligonucleotide
  Target: ATXN1; (+) strand; PAM type: YTN; PAM sequence: CTT
tcatcaaggattatatagat

SEQ ID NO: 274037 - DNA, 20 bp, Artificial Sequence
  Description of Artificial Sequence: Synthetic oligonucleotide
  Target: ATXN1; (+) strand; PAM type: YTN; PAM sequence: TTT
catcaaggattatatagatg

SEQ ID NO: 274038 - DNA, 20 bp, Artificial Sequence
  Description of Artificial Sequence: Synthetic oligonucleotide
  Target: ATXN1; (+) strand; PAM type: YTN; PAM sequence: TTC
atcaaggattatatagatga

SEQ ID NO: 274039 - DNA, 20 bp, Artificial Sequence
  Description of Artificial Sequence: Synthetic oligonucleotide
  Target: ATXN1; (+) strand; PAM type: YTN; PAM sequence: TTA
tatagatgaggaaacattag

SEQ ID NO: 274040 - DNA, 20 bp, Artificial Sequence
  Description of Artificial Sequence: Synthetic oligonucleotide
  Target: ATXN1; (+) strand; PAM type: YTN; PAM sequence: TTA
gagaaatgtgaaagccccaa

SEQ ID NO: 274041 - DNA, 20 bp, Artificial Sequence
  Description of Artificial Sequence: Synthetic oligonucleotide
  Target: ATXN1; (+) strand; PAM type: YTN; PAM sequence: CTG
caattagaaactgcctctct

SEQ ID NO: 274042 - DNA, 20 bp, Artificial Sequence
  Description of Artificial Sequence: Synthetic oligonucleotide
  Target: ATXN1; (+) strand; PAM type: YTN; PAM sequence: TTA
gaaactgcctctctggtaag

SEQ ID NO: 274043 - DNA, 20 bp, Artificial Sequence
  Description of Artificial Sequence: Synthetic oligonucleotide
  Target: ATXN1; (+) strand; PAM type: YTN; PAM sequence: CTG
cctctctggtaagagctccc

SEQ ID NO: 274044 - DNA, 20 bp, Artificial Sequence
  Description of Artificial Sequence: Synthetic oligonucleotide
  Target: ATXN1; (+) strand; PAM type: YTN; PAM sequence: CTC
tctggtaagagctcccagaa

SEQ ID NO: 274045 - DNA, 20 bp, Artificial Sequence
  Description of Artificial Sequence: Synthetic oligonucleotide
  Target: ATXN1; (+) strand; PAM type: YTN; PAM sequence: CTC
tggtaagagctcccagaaga

SEQ ID NO: 274046 - DNA, 20 bp, Artificial Sequence
  Description of Artificial Sequence: Synthetic oligonucleotide
  Target: ATXN1; (+) strand; PAM type: YTN; PAM sequence: CTG
gtaagagctcccagaagatg

SEQ ID NO: 274047 - DNA, 20 bp, Artificial Sequence
  Description of Artificial Sequence: Synthetic oligonucleotide
  Target: ATXN1; (+) strand; PAM type: YTN; PAM sequence: CTC
ccagaagatgagaaatgggt

SEQ ID NO: 274048 - DNA, 20 bp, Artificial Sequence
  Description of Artificial Sequence: Synthetic oligonucleotide
  Target: ATXN1; (+) strand; PAM type: YTN; PAM sequence: TTG
catttctctgtgcagtccta

SEQ ID NO: 274049 - DNA, 20 bp, Artificial Sequence
  Description of Artificial Sequence: Synthetic oligonucleotide
  Target: ATXN1; (+) strand; PAM type: YTN; PAM sequence: TTT
ctctgtgcagtcctactggg

SEQ ID NO: 274050 - DNA, 20 bp, Artificial Sequence
  Description of Artificial Sequence: Synthetic oligonucleotide
  Target: ATXN1; (+) strand; PAM type: YTN; PAM sequence: TTC
tctgtgcagtcctactgggc

SEQ ID NO: 274051 - DNA, 20 bp, Artificial Sequence
  Description of Artificial Sequence: Synthetic oligonucleotide
  Target: ATXN1; (+) strand; PAM type: YTN; PAM sequence: CTC
tgtgcagtcctactgggcct

SEQ ID NO: 274052 - DNA, 20 bp, Artificial Sequence
  Description of Artificial Sequence: Synthetic oligonucleotide
  Target: ATXN1; (+) strand; PAM type: YTN; PAM sequence: CTG
tgcagtcctactgggcctgg

SEQ ID NO: 274053 - DNA, 20 bp, Artificial Sequence
  Description of Artificial Sequence: Synthetic oligonucleotide
  Target: ATXN1; (+) strand; PAM type: YTN; PAM sequence: CTA
ctgggcctggcattgcaggc

SEQ ID NO: 274054 - DNA, 20 bp, Artificial Sequence
  Description of Artificial Sequence: Synthetic oligonucleotide
  Target: ATXN1; (+) strand; PAM type: YTN; PAM sequence: CTG
ggcctggcattgcaggctcc

SEQ ID NO: 274055 - DNA, 20 bp, Artificial Sequence
  Description of Artificial Sequence: Synthetic oligonucleotide
  Target: ATXN1; (+) strand; PAM type: YTN; PAM sequence: CTG
gcattgcaggctccactggt

SEQ ID NO: 274056 - DNA, 20 bp, Artificial Sequence
  Description of Artificial Sequence: Synthetic oligonucleotide
  Target: ATXN1; (+) strand; PAM type: YTN; PAM sequence: TTG
caggctccactggtaggtgt

SEQ ID NO: 274057 - DNA, 20 bp, Artificial Sequence
  Description of Artificial Sequence: Synthetic oligonucleotide
  Target: ATXN1; (+) strand; PAM type: YTN; PAM sequence: CTC
cactggtaggtgtctcctca

SEQ ID NO: 274058 - DNA, 20 bp, Artificial Sequence
  Description of Artificial Sequence: Synthetic oligonucleotide
  Target: ATXN1; (+) strand; PAM type: YTN; PAM sequence: CTG
gtaggtgtctcctcaatctg

SEQ ID NO: 274059 - DNA, 20 bp, Artificial Sequence
  Description of Artificial Sequence: Synthetic oligonucleotide
  Target: ATXN1; (+) strand; PAM type: YTN; PAM sequence: CTC
ctcaatctgcagcatattaa

SEQ ID NO: 274060 - DNA, 20 bp, Artificial Sequence
  Description of Artificial Sequence: Synthetic oligonucleotide
  Target: ATXN1; (+) strand; PAM type: YTN; PAM sequence: CTC
aatctgcagcatattaaatg

SEQ ID NO: 274061 - DNA, 20 bp, Artificial Sequence
  Description of Artificial Sequence: Synthetic oligonucleotide
  Target: ATXN1; (+) strand; PAM type: YTN; PAM sequence: CTG
cagcatattaaatgagcact

SEQ ID NO: 274062 - DNA, 20 bp, Artificial Sequence
  Description of Artificial Sequence: Synthetic oligonucleotide
  Target: ATXN1; (+) strand; PAM type: YTN; PAM sequence: TTA
aatgagcactctgtttccct

SEQ ID NO: 274063 - DNA, 20 bp, Artificial Sequence
  Description of Artificial Sequence: Synthetic oligonucleotide
  Target: ATXN1; (+) strand; PAM type: YTN; PAM sequence: CTC
tgtttccctggatttcacat

SEQ ID NO: 274064 - DNA, 20 bp, Artificial Sequence
  Description of Artificial Sequence: Synthetic oligonucleotide
  Target: ATXN1; (+) strand; PAM type: YTN; PAM sequence: CTG
tttccctggatttcacattg

SEQ ID NO: 274065 - DNA, 20 bp, Artificial Sequence
  Description of Artificial Sequence: Synthetic oligonucleotide
  Target: ATXN1; (+) strand; PAM type: YTN; PAM sequence: TTT
ccctggatttcacattgctc

SEQ ID NO: 274066 - DNA, 20 bp, Artificial Sequence
  Description of Artificial Sequence: Synthetic oligonucleotide
  Target: ATXN1; (+) strand; PAM type: YTN; PAM sequence: TTC
cctggatttcacattgctcc

SEQ ID NO: 274067 - DNA, 20 bp, Artificial Sequence
  Description of Artificial Sequence: Synthetic oligonucleotide
  Target: ATXN1; (+) strand; PAM type: YTN; PAM sequence: CTG
gatttcacattgctccatgt

SEQ ID NO: 274068 - DNA, 20 bp, Artificial Sequence
  Description of Artificial Sequence: Synthetic oligonucleotide
  Target: ATXN1; (+) strand; PAM type: YTN; PAM sequence: TTT
cacattgctccatgtcacta

SEQ ID NO: 274069 - DNA, 20 bp, Artificial Sequence
  Description of Artificial Sequence: Synthetic oligonucleotide
  Target: ATXN1; (+) strand; PAM type: YTN; PAM sequence: TTC
acattgctccatgtcactac

SEQ ID NO: 274070 - DNA, 20 bp, Artificial Sequence
  Description of Artificial Sequence: Synthetic oligonucleotide
  Target: ATXN1; (+) strand; PAM type: YTN; PAM sequence: TTG
ctccatgtcactacccacac

SEQ ID NO: 274071 - DNA, 20 bp, Artificial Sequence
  Description of Artificial Sequence: Synthetic oligonucleotide
  Target: ATXN1; (+) strand; PAM type: YTN; PAM sequence: CTC
catgtcactacccacacatt

SEQ ID NO: 274072 - DNA, 20 bp, Artificial Sequence
  Description of Artificial Sequence: Synthetic oligonucleotide
  Target: ATXN1; (+) strand; PAM type: YTN; PAM sequence: CTA
cccacacatttcagccagga

SEQ ID NO: 274073 - DNA, 20 bp, Artificial Sequence
  Description of Artificial Sequence: Synthetic oligonucleotide
  Target: ATXN1; (+) strand; PAM type: YTN; PAM sequence: TTT
cagccaggagcagctgacca

SEQ ID NO: 274074 - DNA, 20 bp, Artificial Sequence
  Description of Artificial Sequence: Synthetic oligonucleotide
  Target: ATXN1; (+) strand; PAM type: YTN; PAM sequence: TTC
agccaggagcagctgaccac

SEQ ID NO: 274075 - DNA, 20 bp, Artificial Sequence
  Description of Artificial Sequence: Synthetic oligonucleotide
  Target: ATXN1; (+) strand; PAM type: YTN; PAM sequence: CTG
accacgatgcccaggaagta

SEQ ID NO: 274076 - DNA, 20 bp, Artificial Sequence
  Description of Artificial Sequence: Synthetic oligonucleotide
  Target: ATXN1; (+) strand; PAM type: YTN; PAM sequence: CTC
cccaccaggtcattctgaca

SEQ ID NO: 274077 - DNA, 20 bp, Artificial Sequence
  Description of Artificial Sequence: Synthetic oligonucleotide
  Target: ATXN1; (+) strand; PAM type: YTN; PAM sequence: TTC
tgacagagccgctgtgccac

SEQ ID NO: 274078 - DNA, 20 bp, Artificial Sequence
  Description of Artificial Sequence: Synthetic oligonucleotide
  Target: ATXN1; (+) strand; PAM type: YTN; PAM sequence: CTG
acagagccgctgtgccacac

SEQ ID NO: 274079 - DNA, 20 bp, Artificial Sequence
  Description of Artificial Sequence: Synthetic oligonucleotide
  Target: ATXN1; (+) strand; PAM type: YTN; PAM sequence: CTG
tgccacacacagggaggatg

SEQ ID NO: 274080 - DNA, 20 bp, Artificial Sequence
  Description of Artificial Sequence: Synthetic oligonucleotide
  Target: ATXN1; (+) strand; PAM type: YTN; PAM sequence: CTC
tccacctcctttcaattgct

SEQ ID NO: 274081 - DNA, 20 bp, Artificial Sequence
  Description of Artificial Sequence: Synthetic oligonucleotide
  Target: ATXN1; (+) strand; PAM type: YTN; PAM sequence: CTC
cacctcctttcaattgctaa

SEQ ID NO: 274082 - DNA, 20 bp, Artificial Sequence
  Description of Artificial Sequence: Synthetic oligonucleotide
  Target: ATXN1; (+) strand; PAM type: YTN; PAM sequence: CTC
ctttcaattgctaagacagg

SEQ ID NO: 274083 - DNA, 20 bp, Artificial Sequence
  Description of Artificial Sequence: Synthetic oligonucleotide
  Target: ATXN1; (+) strand; PAM type: YTN; PAM sequence: CTT
tcaattgctaagacaggcag

SEQ ID NO: 274084 - DNA, 20 bp, Artificial Sequence
  Description of Artificial Sequence: Synthetic oligonucleotide
  Target: ATXN1; (+) strand; PAM type: YTN; PAM sequence: TTT
caattgctaagacaggcagg

SEQ ID NO: 274085 - DNA, 20 bp, Artificial Sequence
  Description of Artificial Sequence: Synthetic oligonucleotide
  Target: ATXN1; (+) strand; PAM type: YTN; PAM sequence: TTC
aattgctaagacaggcaggt

SEQ ID NO: 274086 - DNA, 20 bp, Artificial Sequence
  Description of Artificial Sequence: Synthetic oligonucleotide
  Target: ATXN1; (+) strand; PAM type: YTN; PAM sequence: TTG
ctaagacaggcaggtgctgc

SEQ ID NO: 274087 - DNA, 20 bp, Artificial Sequence
  Description of Artificial Sequence: Synthetic oligonucleotide
  Target: ATXN1; (+) strand; PAM type: YTN; PAM sequence: CTA
agacaggcaggtgctgccaa

SEQ ID NO: 274088 - DNA, 20 bp, Artificial Sequence
  Description of Artificial Sequence: Synthetic oligonucleotide
  Target: ATXN1; (+) strand; PAM type: YTN; PAM sequence: CTG
ccaaccctgctgacccattc

SEQ ID NO: 274089 - DNA, 20 bp, Artificial Sequence
  Description of Artificial Sequence: Synthetic oligonucleotide
  Target: ATXN1; (+) strand; PAM type: YTN; PAM sequence: CTG
ctgacccattcagaggcctg

SEQ ID NO: 274090 - DNA, 20 bp, Artificial Sequence
  Description of Artificial Sequence: Synthetic oligonucleotide
  Target: ATXN1; (+) strand; PAM type: YTN; PAM sequence: CTG
acccattcagaggcctgcag

SEQ ID NO: 274091 - DNA, 20 bp, Artificial Sequence
  Description of Artificial Sequence: Synthetic oligonucleotide
  Target: ATXN1; (+) strand; PAM type: YTN; PAM sequence: TTC
agaggcctgcagaacactcc

SEQ ID NO: 274092 - DNA, 20 bp, Artificial Sequence
  Description of Artificial Sequence: Synthetic oligonucleotide
  Target: ATXN1; (+) strand; PAM type: YTN; PAM sequence: CTG
cagaacactcctacaggcat

SEQ ID NO: 274093 - DNA, 20 bp, Artificial Sequence
  Description of Artificial Sequence: Synthetic oligonucleotide
  Target: ATXN1; (+) strand; PAM type: YTN; PAM sequence: CTC
ctacaggcattgccttgtct

SEQ ID NO: 274094 - DNA, 20 bp, Artificial Sequence
  Description of Artificial Sequence: Synthetic oligonucleotide
  Target: ATXN1; (+) strand; PAM type: YTN; PAM sequence: CTA
caggcattgccttgtctctc

SEQ ID NO: 274095 - DNA, 20 bp, Artificial Sequence
  Description of Artificial Sequence: Synthetic oligonucleotide
  Target: ATXN1; (+) strand; PAM type: YTN; PAM sequence: TTG
ccttgtctctcatcaagttc

SEQ ID NO: 274096 - DNA, 20 bp, Artificial Sequence
  Description of Artificial Sequence: Synthetic oligonucleotide
  Target: ATXN1; (+) strand; PAM type: YTN; PAM sequence: CTT
gtctctcatcaagttccaag

SEQ ID NO: 274097 - DNA, 20 bp, Artificial Sequence
  Description of Artificial Sequence: Synthetic oligonucleotide
  Target: ATXN1; (+) strand; PAM type: YTN; PAM sequence: TTG
tctctcatcaagttccaaga

SEQ ID NO: 274098 - DNA, 20 bp, Artificial Sequence
  Description of Artificial Sequence: Synthetic oligonucleotide
  Target: ATXN1; (+) strand; PAM type: YTN; PAM sequence: CTC
tcatcaagttccaagatgga

SEQ ID NO: 274099 - DNA, 20 bp, Artificial Sequence
  Description of Artificial Sequence: Synthetic oligonucleotide
  Target: ATXN1; (+) strand; PAM type: YTN; PAM sequence: CTC
atcaagttccaagatggacc

SEQ ID NO: 274100 - DNA, 20 bp, Artificial Sequence
  Description of Artificial Sequence: Synthetic oligonucleotide
  Target: ATXN1; (+) strand; PAM type: YTN; PAM sequence: TTC
caagatggaccgagacagga

SEQ ID NO: 274101 - DNA, 20 bp, Artificial Sequence
  Description of Artificial Sequence: Synthetic oligonucleotide
  Target: ATXN1; (+) strand; PAM type: YTN; PAM sequence: TTA
atagcaagagtagatagtaa

SEQ ID NO: 274102 - DNA, 20 bp, Artificial Sequence
  Description of Artificial Sequence: Synthetic oligonucleotide
  Target: ATXN1; (+) strand; PAM type: YTN; PAM sequence: TTA
cgaaaaccacattctccgca

SEQ ID NO: 274103 - DNA, 20 bp, Artificial Sequence
  Description of Artificial Sequence: Synthetic oligonucleotide
  Target: ATXN1; (+) strand; PAM type: YTN; PAM sequence: TTC
tccgcatatcacaggcccca

SEQ ID NO: 274104 - DNA, 20 bp, Artificial Sequence
  Description of Artificial Sequence: Synthetic oligonucleotide
  Target: ATXN1; (+) strand; PAM type: YTN; PAM sequence: CTC
cgcatatcacaggccccagg

SEQ ID NO: 274105 - DNA, 20 bp, Artificial Sequence
  Description of Artificial Sequence: Synthetic oligonucleotide
  Target: ATXN1; (+) strand; PAM type: YTN; PAM sequence: CTG
ccctcatcctgcccaggata

SEQ ID NO: 274106 - DNA, 20 bp, Artificial Sequence
  Description of Artificial Sequence: Synthetic oligonucleotide
  Target: ATXN1; (+) strand; PAM type: YTN; PAM sequence: CTC
atcctgcccaggatacactg

SEQ ID NO: 274107 - DNA, 20 bp, Artificial Sequence
  Description of Artificial Sequence: Synthetic oligonucleotide
  Target: ATXN1; (+) strand; PAM type: YTN; PAM sequence: CTG
cccaggatacactggctgtc

SEQ ID NO: 274108 - DNA, 20 bp, Artificial Sequence
  Description of Artificial Sequence: Synthetic oligonucleotide
  Target: ATXN1; (+) strand; PAM type: YTN; PAM sequence: CTG
gctgtcacagtcattatatg

SEQ ID NO: 274109 - DNA, 20 bp, Artificial Sequence
  Description of Artificial Sequence: Synthetic oligonucleotide
  Target: ATXN1; (+) strand; PAM type: YTN; PAM sequence: CTG
tcacagtcattatatgtttt

SEQ ID NO: 274110 - DNA, 20 bp, Artificial Sequence
  Description of Artificial Sequence: Synthetic oligonucleotide
  Target: ATXN1; (+) strand; PAM type: YTN; PAM sequence: TTA
tatgttttctggcagcacag

SEQ ID NO: 274111 - DNA, 20 bp, Artificial Sequence
  Description of Artificial Sequence: Synthetic oligonucleotide
  Target: ATXN1; (+) strand; PAM type: YTN; PAM sequence: TTT
tctggcagcacagtcacgtt

SEQ ID NO: 274112 - DNA, 20 bp, Artificial Sequence
  Description of Artificial Sequence: Synthetic oligonucleotide
  Target: ATXN1; (+) strand; PAM type: YTN; PAM sequence: TTT
ctggcagcacagtcacgttg

SEQ ID NO: 274113 - DNA, 20 bp, Artificial Sequence
  Description of Artificial Sequence: Synthetic oligonucleotide
  Target: ATXN1; (+) strand; PAM type: YTN; PAM sequence: TTC
tggcagcacagtcacgttgc

SEQ ID NO: 274114 - DNA, 20 bp, Artificial Sequence
  Description of Artificial Sequence: Synthetic oligonucleotide
  Target: ATXN1; (+) strand; PAM type: YTN; PAM sequence: CTG
gcagcacagtcacgttgcta

SEQ ID NO: 274115 - DNA, 20 bp, Artificial Sequence
  Description of Artificial Sequence: Synthetic oligonucleotide
  Target: ATXN1; (+) strand; PAM type: YTN; PAM sequence: TTG
ctatggaaccaatgcatgtc

SEQ ID NO: 274116 - DNA, 20 bp, Artificial Sequence
  Description of Artificial Sequence: Synthetic oligonucleotide
  Target: ATXN1; (+) strand; PAM type: YTN; PAM sequence: CTA
tggaaccaatgcatgtcatt

SEQ ID NO: 274117 - DNA, 20 bp, Artificial Sequence
  Description of Artificial Sequence: Synthetic oligonucleotide
  Target: ATXN1; (+) strand; PAM type: YTN; PAM sequence: TTG
ccacctggcctctagcaaat

SEQ ID NO: 274118 - DNA, 20 bp, Artificial Sequence
  Description of Artificial Sequence: Synthetic oligonucleotide
  Target: ATXN1; (+) strand; PAM type: YTN; PAM sequence: CTG
gcctctagcaaataaaatca

SEQ ID NO: 274119 - DNA, 20 bp, Artificial Sequence
  Description of Artificial Sequence: Synthetic oligonucleotide
  Target: ATXN1; (+) strand; PAM type: YTN; PAM sequence: CTC
tagcaaataaaatcacagcg

SEQ ID NO: 274120 - DNA, 20 bp, Artificial Sequence
  Description of Artificial Sequence: Synthetic oligonucleotide
  Target: ATXN1; (+) strand; PAM type: YTN; PAM sequence: CTA
gcaaataaaatcacagcgct

SEQ ID NO: 274121 - DNA, 20 bp, Artificial Sequence
  Description of Artificial Sequence: Synthetic oligonucleotide
  Target: ATXN1; (+) strand; PAM type: YTN; PAM sequence: CTG
gcaagagcatttccctggat

SEQ ID NO: 274122 - DNA, 20 bp, Artificial Sequence
  Description of Artificial Sequence: Synthetic oligonucleotide
  Target: ATXN1; (+) strand; PAM type: YTN; PAM sequence: TTT
ccctggatttcccttaaaga

SEQ ID NO: 274123 - DNA, 20 bp, Artificial Sequence
  Description of Artificial Sequence: Synthetic oligonucleotide
  Target: ATXN1; (+) strand; PAM type: YTN; PAM sequence: TTC
cctggatttcccttaaagag

SEQ ID NO: 274124 - DNA, 20 bp, Artificial Sequence
  Description of Artificial Sequence: Synthetic oligonucleotide
  Target: ATXN1; (+) strand; PAM type: YTN; PAM sequence: CTG
gatttcccttaaagagatac

SEQ ID NO: 274125 - DNA, 20 bp, Artificial Sequence
  Description of Artificial Sequence: Synthetic oligonucleotide
  Target: ATXN1; (+) strand; PAM type: YTN; PAM sequence: TTT
cccttaaagagataccattg

SEQ ID NO: 274126 - DNA, 20 bp, Artificial Sequence
  Description of Artificial Sequence: Synthetic oligonucleotide
  Target: ATXN1; (+) strand; PAM type: YTN; PAM sequence: TTC
ccttaaagagataccattga

SEQ ID NO: 274127 - DNA, 20 bp, Artificial Sequence
  Description of Artificial Sequence: Synthetic oligonucleotide
  Target: ATXN1; (+) strand; PAM type: YTN; PAM sequence: CTT
aaagagataccattgatggt

SEQ ID NO: 274128 - DNA, 20 bp, Artificial Sequence
  Description of Artificial Sequence: Synthetic oligonucleotide
  Target: ATXN1; (+) strand; PAM type: YTN; PAM sequence: TTA
aagagataccattgatggtg

SEQ ID NO: 274129 - DNA, 20 bp, Artificial Sequence
  Description of Artificial Sequence: Synthetic oligonucleotide
  Target: ATXN1; (+) strand; PAM type: YTN; PAM sequence: TTG
atggtgagtgctgtttgagc

SEQ ID NO: 274130 - DNA, 20 bp, Artificial Sequence
  Description of Artificial Sequence: Synthetic oligonucleotide
  Target: ATXN1; (+) strand; PAM type: YTN; PAM sequence: CTG
tttgagcttagaaacaacag

SEQ ID NO: 274131 - DNA, 20 bp, Artificial Sequence
  Description of Artificial Sequence: Synthetic oligonucleotide
  Target: ATXN1; (+) strand; PAM type: YTN; PAM sequence: TTT
gagcttagaaacaacagcag

SEQ ID NO: 274132 - DNA, 20 bp, Artificial Sequence
  Description of Artificial Sequence: Synthetic oligonucleotide
  Target: ATXN1; (+) strand; PAM type: YTN; PAM sequence: TTG
agcttagaaacaacagcagc

SEQ ID NO: 274133 - DNA, 20 bp, Artificial Sequence
  Description of Artificial Sequence: Synthetic oligonucleotide
  Target: ATXN1; (+) strand; PAM type: YTN; PAM sequence: CTT
agaaacaacagcagcattgt

SEQ ID NO: 274134 - DNA, 20 bp, Artificial Sequence
  Description of Artificial Sequence: Synthetic oligonucleotide
  Target: ATXN1; (+) strand; PAM type: YTN; PAM sequence: TTA
gaaacaacagcagcattgtt

SEQ ID NO: 274135 - DNA, 20 bp, Artificial Sequence
  Description of Artificial Sequence: Synthetic oligonucleotide
  Target: ATXN1; (+) strand; PAM type: YTN; PAM sequence: TTG
ttcccaagacccagccccat

SEQ ID NO: 274136 - DNA, 20 bp, Artificial Sequence
  Description of Artificial Sequence: Synthetic oligonucleotide
  Target: ATXN1; (+) strand; PAM type: YTN; PAM sequence: TTC
ccaagacccagccccattgc

SEQ ID NO: 274137 - DNA, 20 bp, Artificial Sequence
  Description of Artificial Sequence: Synthetic oligonucleotide
  Target: ATXN1; (+) strand; PAM type: YTN; PAM sequence: TTG
cataccatgaaactgagccc

SEQ ID NO: 274138 - DNA, 20 bp, Artificial Sequence
  Description of Artificial Sequence: Synthetic oligonucleotide
  Target: ATXN1; (+) strand; PAM type: YTN; PAM sequence: CTG
agcccagggactcacgtttt

SEQ ID NO: 274139 - DNA, 20 bp, Artificial Sequence
  Description of Artificial Sequence: Synthetic oligonucleotide
  Target: ATXN1; (+) strand; PAM type: YTN; PAM sequence: CTC
acgttttacaaggtatatat

SEQ ID NO: 274140 - DNA, 20 bp, Artificial Sequence
  Description of Artificial Sequence: Synthetic oligonucleotide
  Target: ATXN1; (+) strand; PAM type: YTN; PAM sequence: TTT
tacaaggtatatatgcatgt

SEQ ID NO: 274141 - DNA, 20 bp, Artificial Sequence
  Description of Artificial Sequence: Synthetic oligonucleotide
  Target: ATXN1; (+) strand; PAM type: YTN; PAM sequence: TTT
acaaggtatatatgcatgtg

SEQ ID NO: 274142 - DNA, 20 bp, Artificial Sequence
  Description of Artificial Sequence: Synthetic oligonucleotide
  Target: ATXN1; (+) strand; PAM type: YTN; PAM sequence: TTA
caaggtatatatgcatgtgg

SEQ ID NO: 274143 - DNA, 20 bp, Artificial Sequence
  Description of Artificial Sequence: Synthetic oligonucleotide
  Target: ATXN1; (+) strand; PAM type: YTN; PAM sequence: CTT
ctgagcttctttttagggag

SEQ ID NO: 274144 - DNA, 20 bp, Artificial Sequence
  Description of Artificial Sequence: Synthetic oligonucleotide
  Target: ATXN1; (+) strand; PAM type: YTN; PAM sequence: TTC
tgagcttctttttagggaga

SEQ ID NO: 274145 - DNA, 20 bp, Artificial Sequence
  Description of Artificial Sequence: Synthetic oligonucleotide
  Target: ATXN1; (+) strand; PAM type: YTN; PAM sequence: CTG
agcttctttttagggagaaa

SEQ ID NO: 274146 - DNA, 20 bp, Artificial Sequence
  Description of Artificial Sequence: Synthetic oligonucleotide
  Target: ATXN1; (+) strand; PAM type: YTN; PAM sequence: CTT
ctttttagggagaaaaatac

SEQ ID NO: 274147 - DNA, 20 bp, Artificial Sequence
  Description of Artificial Sequence: Synthetic oligonucleotide
  Target: ATXN1; (+) strand; PAM type: YTN; PAM sequence: TTC
tttttagggagaaaaatact

SEQ ID NO: 274148 - DNA, 20 bp, Artificial Sequence
  Description of Artificial Sequence: Synthetic oligonucleotide
  Target: ATXN1; (+) strand; PAM type: YTN; PAM sequence: CTT
tttagggagaaaaatactca

SEQ ID NO: 274149 - DNA, 20 bp, Artificial Sequence
  Description of Artificial Sequence: Synthetic oligonucleotide
  Target: ATXN1; (+) strand; PAM type: YTN; PAM sequence: TTT
ttagggagaaaaatactcat

SEQ ID NO: 274150 - DNA, 20 bp, Artificial Sequence
  Description of Artificial Sequence: Synthetic oligonucleotide
  Target: ATXN1; (+) strand; PAM type: YTN; PAM sequence: TTT
tagggagaaaaatactcatg

SEQ ID NO: 274151 - DNA, 20 bp, Artificial Sequence
  Description of Artificial Sequence: Synthetic oligonucleotide
  Target: ATXN1; (+) strand; PAM type: YTN; PAM sequence: TTT
agggagaaaaatactcatgg

SEQ ID NO: 274152 - DNA, 20 bp, Artificial Sequence
  Description of Artificial Sequence: Synthetic oligonucleotide
  Target: ATXN1; (+) strand; PAM type: YTN; PAM sequence: TTA
gggagaaaaatactcatggc

SEQ ID NO: 274153 - DNA, 20 bp, Artificial Sequence
  Description of Artificial Sequence: Synthetic oligonucleotide
  Target: ATXN1; (+) strand; PAM type: YTN; PAM sequence: CTC
atggcttctatctgtgttta

SEQ ID NO: 274154 - DNA, 20 bp, Artificial Sequence
  Description of Artificial Sequence: Synthetic oligonucleotide
  Target: ATXN1; (+) strand; PAM type: YTN; PAM sequence: CTT
ctatctgtgtttagtttttt

SEQ ID NO: 274155 - DNA, 20 bp, Artificial Sequence
  Description of Artificial Sequence: Synthetic oligonucleotide
  Target: ATXN1; (+) strand; PAM type: YTN; PAM sequence: TTC
tatctgtgtttagttttttc

SEQ ID NO: 274156 - DNA, 20 bp, Artificial Sequence
  Description of Artificial Sequence: Synthetic oligonucleotide
  Target: ATXN1; (+) strand; PAM type: YTN; PAM sequence: CTA
tctgtgtttagttttttctc

SEQ ID NO: 274157 - DNA, 20 bp, Artificial Sequence
  Description of Artificial Sequence: Synthetic oligonucleotide
  Target: ATXN1; (+) strand; PAM type: YTN; PAM sequence: CTG
tgtttagttttttctcattt

SEQ ID NO: 274158 - DNA, 20 bp, Artificial Sequence
  Description of Artificial Sequence: Synthetic oligonucleotide
  Target: ATXN1; (+) strand; PAM type: YTN; PAM sequence: TTT
agttttttctcatttggtaa

SEQ ID NO: 274159 - DNA, 20 bp, Artificial Sequence
  Description of Artificial Sequence: Synthetic oligonucleotide
  Target: ATXN1; (+) strand; PAM type: YTN; PAM sequence: TTA
gttttttctcatttggtaaa

SEQ ID NO: 274160 - DNA, 20 bp, Artificial Sequence
  Description of Artificial Sequence: Synthetic oligonucleotide
  Target: ATXN1; (+) strand; PAM type: YTN; PAM sequence: TTT
tttctcatttggtaaaataa

SEQ ID NO: 274161 - DNA, 20 bp, Artificial Sequence
  Description of Artificial Sequence: Synthetic oligonucleotide
  Target: ATXN1; (+) strand; PAM type: YTN; PAM sequence: TTT
ttctcatttggtaaaataaa

SEQ ID NO: 274162 - DNA, 20 bp, Artificial Sequence
  Description of Artificial Sequence: Synthetic oligonucleotide
  Target: ATXN1; (+) strand; PAM type: YTN; PAM sequence: TTT
tctcatttggtaaaataaaa

SEQ ID NO: 274163 - DNA, 20 bp, Artificial Sequence
  Description of Artificial Sequence: Synthetic oligonucleotide
  Target: ATXN1; (+) strand; PAM type: YTN; PAM sequence: TTT
ctcatttggtaaaataaaaa

SEQ ID NO: 274164 - DNA, 20 bp, Artificial Sequence
  Description of Artificial Sequence: Synthetic oligonucleotide
  Target: ATXN1; (+) strand; PAM type: YTN; PAM sequence: TTC
tcatttggtaaaataaaaaa

SEQ ID NO: 274165 - DNA, 20 bp, Artificial Sequence
  Description of Artificial Sequence: Synthetic oligonucleotide
  Target: ATXN1; (+) strand; PAM type: YTN; PAM sequence: CTC
atttggtaaaataaaaaaat

SEQ ID NO: 274166 - DNA, 20 bp, Artificial Sequence
  Description of Artificial Sequence: Synthetic oligonucleotide
  Target: ATXN1; (+) strand; PAM type: YTN; PAM sequence: TTT
ggtaaaataaaaaaattacg

SEQ ID NO: 274167 - DNA, 20 bp, Artificial Sequence
  Description of Artificial Sequence: Synthetic oligonucleotide
  Target: ATXN1; (+) strand; PAM type: YTN; PAM sequence: TTG
gtaaaataaaaaaattacgg

SEQ ID NO: 274168 - DNA, 20 bp, Artificial Sequence
  Description of Artificial Sequence: Synthetic oligonucleotide
  Target: ATXN1; (+) strand; PAM type: YTN; PAM sequence: TTA
cggcttgtaatattttggat

SEQ ID NO: 274169 - DNA, 20 bp, Artificial Sequence
  Description of Artificial Sequence: Synthetic oligonucleotide
  Target: ATXN1; (+) strand; PAM type: YTN; PAM sequence: CTT
gtaatattttggataataat

SEQ ID NO: 274170 - DNA, 20 bp, Artificial Sequence
  Description of Artificial Sequence: Synthetic oligonucleotide
  Target: ATXN1; (+) strand; PAM type: YTN; PAM sequence: TTG
taatattttggataataatt

SEQ ID NO: 274171 - DNA, 20 bp, Artificial Sequence
  Description of Artificial Sequence: Synthetic oligonucleotide
  Target: ATXN1; (+) strand; PAM type: YTN; PAM sequence: TTT
tggataataatttgatgccc

SEQ ID NO: 274172 - DNA, 20 bp, Artificial Sequence
  Description of Artificial Sequence: Synthetic oligonucleotide
  Target: ATXN1; (+) strand; PAM type: YTN; PAM sequence: TTT
ggataataatttgatgccct

SEQ ID NO: 274173 - DNA, 20 bp, Artificial Sequence
  Description of Artificial Sequence: Synthetic oligonucleotide
  Target: ATXN1; (+) strand; PAM type: YTN; PAM sequence: TTG
gataataatttgatgccctc

SEQ ID NO: 274174 - DNA, 20 bp, Artificial Sequence
  Description of Artificial Sequence: Synthetic oligonucleotide
  Target: ATXN1; (+) strand; PAM type: YTN; PAM sequence: TTT
gatgccctcttgaatgtcaa

SEQ ID NO: 274175 - DNA, 20 bp, Artificial Sequence
  Description of Artificial Sequence: Synthetic oligonucleotide
  Target: ATXN1; (+) strand; PAM type: YTN; PAM sequence: TTG
atgccctcttgaatgtcaac

SEQ ID NO: 274176 - DNA, 20 bp, Artificial Sequence
  Description of Artificial Sequence: Synthetic oligonucleotide
  Target: ATXN1; (+) strand; PAM type: YTN; PAM sequence: CTC
ttgaatgtcaacatcaaagt

SEQ ID NO: 274177 - DNA, 20 bp, Artificial Sequence
  Description of Artificial Sequence: Synthetic oligonucleotide
  Target: ATXN1; (+) strand; PAM type: YTN; PAM sequence: CTT
gaatgtcaacatcaaagtgc

SEQ ID NO: 274178 - DNA, 20 bp, Artificial Sequence
  Description of Artificial Sequence: Synthetic oligonucleotide
  Target: ATXN1; (+) strand; PAM type: YTN; PAM sequence: TTG
aatgtcaacatcaaagtgct

SEQ ID NO: 274179 - DNA, 20 bp, Artificial Sequence
  Description of Artificial Sequence: Synthetic oligonucleotide
  Target: ATXN1; (+) strand; PAM type: YTN; PAM sequence: CTC
atgaccccagaaggaaacca

SEQ ID NO: 274180 - DNA, 20 bp, Artificial Sequence
  Description of Artificial Sequence: Synthetic oligonucleotide
  Target: ATXN1; (+) strand; PAM type: YTN; PAM sequence: CTA
catgggttcaggcagtcctt

SEQ ID NO: 274181 - DNA, 20 bp, Artificial Sequence
  Description of Artificial Sequence: Synthetic oligonucleotide
  Target: ATXN1; (+) strand; PAM type: YTN; PAM sequence: TTC
aggcagtccttctttcattc

SEQ ID NO: 274182 - DNA, 20 bp, Artificial Sequence
  Description of Artificial Sequence: Synthetic oligonucleotide
  Target: ATXN1; (+) strand; PAM type: YTN; PAM sequence: CTT
ctttcattccttcaccattt

SEQ ID NO: 274183 - DNA, 20 bp, Artificial Sequence
  Description of Artificial Sequence: Synthetic oligonucleotide
  Target: ATXN1; (+) strand; PAM type: YTN; PAM sequence: TTC
tttcattccttcaccatttc

SEQ ID NO: 274184 - DNA, 20 bp, Artificial Sequence
  Description of Artificial Sequence: Synthetic oligonucleotide
  Target: ATXN1; (+) strand; PAM type: YTN; PAM sequence: CTT
tcattccttcaccatttctt

SEQ ID NO: 274185 - DNA, 20 bp, Artificial Sequence
  Description of Artificial Sequence: Synthetic oligonucleotide
  Target: ATXN1; (+) strand; PAM type: YTN; PAM sequence: TTT
cattccttcaccatttcttg

SEQ ID NO: 274186 - DNA, 20 bp, Artificial Sequence
  Description of Artificial Sequence: Synthetic oligonucleotide
  Target: ATXN1; (+) strand; PAM type: YTN; PAM sequence: TTC
attccttcaccatttcttgc

SEQ ID NO: 274187 - DNA, 20 bp, Artificial Sequence
  Description of Artificial Sequence: Synthetic oligonucleotide
  Target: ATXN1; (+) strand; PAM type: YTN; PAM sequence: TTC
cttcaccatttcttgcctca

SEQ ID NO: 274188 - DNA, 20 bp, Artificial Sequence
  Description of Artificial Sequence: Synthetic oligonucleotide
  Target: ATXN1; (+) strand; PAM type: YTN; PAM sequence: CTT
caccatttcttgcctcagac

SEQ ID NO: 274189 - DNA, 20 bp, Artificial Sequence
  Description of Artificial Sequence: Synthetic oligonucleotide
  Target: ATXN1; (+) strand; PAM type: YTN; PAM sequence: TTC
accatttcttgcctcagacc

SEQ ID NO: 274190 - DNA, 20 bp, Artificial Sequence
  Description of Artificial Sequence: Synthetic oligonucleotide
  Target: ATXN1; (+) strand; PAM type: YTN; PAM sequence: TTT
cttgcctcagacccttctct

SEQ ID NO: 274191 - DNA, 20 bp, Artificial Sequence
  Description of Artificial Sequence: Synthetic oligonucleotide
  Target: ATXN1; (+) strand; PAM type: YTN; PAM sequence: TTC
ttgcctcagacccttctcta

SEQ ID NO: 274192 - DNA, 20 bp, Artificial Sequence
  Description of Artificial Sequence: Synthetic oligonucleotide
  Target: ATXN1; (+) strand; PAM type: YTN; PAM sequence: CTT
gcctcagacccttctctacc

SEQ ID NO: 274193 - DNA, 20 bp, Artificial Sequence
  Description of Artificial Sequence: Synthetic oligonucleotide
  Target: ATXN1; (+) strand; PAM type: YTN; PAM sequence: TTG
cctcagacccttctctacca

SEQ ID NO: 274194 - DNA, 20 bp, Artificial Sequence
  Description of Artificial Sequence: Synthetic oligonucleotide
  Target: ATXN1; (+) strand; PAM type: YTN; PAM sequence: CTC
agacccttctctaccagttt

SEQ ID NO: 274195 - DNA, 20 bp, Artificial Sequence
  Description of Artificial Sequence: Synthetic oligonucleotide
  Target: ATXN1; (+) strand; PAM type: YTN; PAM sequence: CTT
ctctaccagtttattcttta

SEQ ID NO: 274196 - DNA, 20 bp, Artificial Sequence
  Description of Artificial Sequence: Synthetic oligonucleotide
  Target: ATXN1; (+) strand; PAM type: YTN; PAM sequence: TTC
tctaccagtttattctttac

SEQ ID NO: 274197 - DNA, 20 bp, Artificial Sequence
  Description of Artificial Sequence: Synthetic oligonucleotide
  Target: ATXN1; (+) strand; PAM type: YTN; PAM sequence: CTC
taccagtttattctttaccc

SEQ ID NO: 274198 - DNA, 20 bp, Artificial Sequence
  Description of Artificial Sequence: Synthetic oligonucleotide
  Target: ATXN1; (+) strand; PAM type: YTN; PAM sequence: CTA
ccagtttattctttacccaa

SEQ ID NO: 274199 - DNA, 20 bp, Artificial Sequence
  Description of Artificial Sequence: Synthetic oligonucleotide
  Target: ATXN1; (+) strand; PAM type: YTN; PAM sequence: TTT
attctttacccaaagaatcc

SEQ ID NO: 274200 - DNA, 20 bp, Artificial Sequence
  Description of Artificial Sequence: Synthetic oligonucleotide
  Target: ATXN1; (+) strand; PAM type: YTN; PAM sequence: TTA
ttctttacccaaagaatcct

SEQ ID NO: 274201 - DNA, 20 bp, Artificial Sequence
  Description of Artificial Sequence: Synthetic oligonucleotide
  Target: ATXN1; (+) strand; PAM type: YTN; PAM sequence: TTC
tttacccaaagaatcctatg

SEQ ID NO: 274202 - DNA, 20 bp, Artificial Sequence
  Description of Artificial Sequence: Synthetic oligonucleotide
  Target: ATXN1; (+) strand; PAM type: YTN; PAM sequence: CTT
tacccaaagaatcctatgat

SEQ ID NO: 274203 - DNA, 20 bp, Artificial Sequence
  Description of Artificial Sequence: Synthetic oligonucleotide
  Target: ATXN1; (+) strand; PAM type: YTN; PAM sequence: TTT
acccaaagaatcctatgatg

SEQ ID NO: 274204 - DNA, 20 bp, Artificial Sequence
  Description of Artificial Sequence: Synthetic oligonucleotide
  Target: ATXN1; (+) strand; PAM type: YTN; PAM sequence: TTA
cccaaagaatcctatgatgt

SEQ ID NO: 274205 - DNA, 20 bp, Artificial Sequence
  Description of Artificial Sequence: Synthetic oligonucleotide
  Target: ATXN1; (+) strand; PAM type: YTN; PAM sequence: CTA
tgatgtaagcatggaaatgg

SEQ ID NO: 274206 - DNA, 20 bp, Artificial Sequence
  Description of Artificial Sequence: Synthetic oligonucleotide
  Target: ATXN1; (+) strand; PAM type: YTN; PAM sequence: TTT
cttcactttctcaaggccct

SEQ ID NO: 274207 - DNA, 20 bp, Artificial Sequence
  Description of Artificial Sequence: Synthetic oligonucleotide
  Target: ATXN1; (+) strand; PAM type: YTN; PAM sequence: TTC
ttcactttctcaaggccctt

SEQ ID NO: 274208 - DNA, 20 bp, Artificial Sequence
  Description of Artificial Sequence: Synthetic oligonucleotide
  Target: ATXN1; (+) strand; PAM type: YTN; PAM sequence: CTT
cactttctcaaggcccttaa

SEQ ID NO: 274209 - DNA, 20 bp, Artificial Sequence
  Description of Artificial Sequence: Synthetic oligonucleotide
  Target: ATXN1; (+) strand; PAM type: YTN; PAM sequence: TTC
actttctcaaggcccttaat

SEQ ID NO: 274210 - DNA, 20 bp, Artificial Sequence
  Description of Artificial Sequence: Synthetic oligonucleotide
  Target: ATXN1; (+) strand; PAM type: YTN; PAM sequence: CTT
tctcaaggcccttaattgcc

SEQ ID NO: 274211 - DNA, 20 bp, Artificial Sequence
  Description of Artificial Sequence: Synthetic oligonucleotide
  Target: ATXN1; (+) strand; PAM type: YTN; PAM sequence: TTT
ctcaaggcccttaattgccc

SEQ ID NO: 274212 - DNA, 20 bp, Artificial Sequence
  Description of Artificial Sequence: Synthetic oligonucleotide
  Target: ATXN1; (+) strand; PAM type: YTN; PAM sequence: TTC
tcaaggcccttaattgcccc

SEQ ID NO: 274213 - DNA, 20 bp, Artificial Sequence
  Description of Artificial Sequence: Synthetic oligonucleotide
  Target: ATXN1; (+) strand; PAM type: YTN; PAM sequence: CTC
aaggcccttaattgccccct

SEQ ID NO: 274214 - DNA, 20 bp, Artificial Sequence
  Description of Artificial Sequence: Synthetic oligonucleotide
  Target: ATXN1; (+) strand; PAM type: YTN; PAM sequence: CTT
aattgcccccttcttttagt

SEQ ID NO: 274215 - DNA, 20 bp, Artificial Sequence
  Description of Artificial Sequence: Synthetic oligonucleotide
  Target: ATXN1; (+) strand; PAM type: YTN; PAM sequence: TTA
attgcccccttcttttagtc

SEQ ID NO: 274216 - DNA, 20 bp, Artificial Sequence
  Description of Artificial Sequence: Synthetic oligonucleotide
  Target: ATXN1; (+) strand; PAM type: YTN; PAM sequence: TTG
cccccttcttttagtctaat

SEQ ID NO: 274217 - DNA, 20 bp, Artificial Sequence
  Description of Artificial Sequence: Synthetic oligonucleotide
  Target: ATXN1; (+) strand; PAM type: YTN; PAM sequence: CTT
cttttagtctaattaatctc

SEQ ID NO: 274218 - DNA, 20 bp, Artificial Sequence
  Description of Artificial Sequence: Synthetic oligonucleotide
  Target: ATXN1; (+) strand; PAM type: YTN; PAM sequence: TTC
ttttagtctaattaatctct

SEQ ID NO: 274219 - DNA, 20 bp, Artificial Sequence
  Description of Artificial Sequence: Synthetic oligonucleotide
  Target: ATXN1; (+) strand; PAM type: YTN; PAM sequence: CTT
ttagtctaattaatctcttg

SEQ ID NO: 274220 - DNA, 20 bp, Artificial Sequence
  Description of Artificial Sequence: Synthetic oligonucleotide
  Target: ATXN1; (+) strand; PAM type: YTN; PAM sequence: TTT
tagtctaattaatctcttga

SEQ ID NO: 274221 - DNA, 20 bp, Artificial Sequence
  Description of Artificial Sequence: Synthetic oligonucleotide
  Target: ATXN1; (+) strand; PAM type: YTN; PAM sequence: TTT
agtctaattaatctcttgac

SEQ ID NO: 274222 - DNA, 20 bp, Artificial Sequence
  Description of Artificial Sequence: Synthetic oligonucleotide
  Target: ATXN1; (+) strand; PAM type: YTN; PAM sequence: TTA
gtctaattaatctcttgact

SEQ ID NO: 274223 - DNA, 20 bp, Artificial Sequence
  Description of Artificial Sequence: Synthetic oligonucleotide
  Target: ATXN1; (+) strand; PAM type: YTN; PAM sequence: CTA
attaatctcttgactctaaa

SEQ ID NO: 274224 - DNA, 20 bp, Artificial Sequence
  Description of Artificial Sequence: Synthetic oligonucleotide
  Target: ATXN1; (+) strand; PAM type: YTN; PAM sequence: TTA
atctcttgactctaaagaga

SEQ ID NO: 274225 - DNA, 20 bp, Artificial Sequence
  Description of Artificial Sequence: Synthetic oligonucleotide
  Target: ATXN1; (+) strand; PAM type: YTN; PAM sequence: CTC
ttgactctaaagagaccttt

SEQ ID NO: 274226 - DNA, 20 bp, Artificial Sequence
  Description of Artificial Sequence: Synthetic oligonucleotide
  Target: ATXN1; (+) strand; PAM type: YTN; PAM sequence: CTT
gactctaaagagacctttac

SEQ ID NO: 274227 - DNA, 20 bp, Artificial Sequence
  Description of Artificial Sequence: Synthetic oligonucleotide
  Target: ATXN1; (+) strand; PAM type: YTN; PAM sequence: TTG
actctaaagagacctttaca

SEQ ID NO: 274228 - DNA, 20 bp, Artificial Sequence
  Description of Artificial Sequence: Synthetic oligonucleotide
  Target: ATXN1; (+) strand; PAM type: YTN; PAM sequence: CTC
taaagagacctttacagtcc

SEQ ID NO: 274229 - DNA, 20 bp, Artificial Sequence
  Description of Artificial Sequence: Synthetic oligonucleotide
  Target: ATXN1; (+) strand; PAM type: YTN; PAM sequence: CTA
aagagacctttacagtcccc

SEQ ID NO: 274230 - DNA, 20 bp, Artificial Sequence
  Description of Artificial Sequence: Synthetic oligonucleotide
  Target: ATXN1; (+) strand; PAM type: YTN; PAM sequence: CTT
tacagtccccagagagcaac

SEQ ID NO: 274231 - DNA, 20 bp, Artificial Sequence
  Description of Artificial Sequence: Synthetic oligonucleotide
  Target: ATXN1; (+) strand; PAM type: YTN; PAM sequence: TTT
acagtccccagagagcaaca

SEQ ID NO: 274232 - DNA, 20 bp, Artificial Sequence
  Description of Artificial Sequence: Synthetic oligonucleotide
  Target: ATXN1; (+) strand; PAM type: YTN; PAM sequence: TTA
cagtccccagagagcaacag

SEQ ID NO: 274233 - DNA, 20 bp, Artificial Sequence
  Description of Artificial Sequence: Synthetic oligonucleotide
  Target: ATXN1; (+) strand; PAM type: YTN; PAM sequence: TTG
tactgtggtgtgctctgaga

SEQ ID NO: 274234 - DNA, 20 bp, Artificial Sequence
  Description of Artificial Sequence: Synthetic oligonucleotide
  Target: ATXN1; (+) strand; PAM type: YTN; PAM sequence: CTG
tggtgtgctctgagaataaa

SEQ ID NO: 274235 - DNA, 20 bp, Artificial Sequence
  Description of Artificial Sequence: Synthetic oligonucleotide
  Target: ATXN1; (+) strand; PAM type: YTN; PAM sequence: CTC
tgagaataaactttttgggc

SEQ ID NO: 274236 - DNA, 20 bp, Artificial Sequence
  Description of Artificial Sequence: Synthetic oligonucleotide
  Target: ATXN1; (+) strand; PAM type: YTN; PAM sequence: CTG
agaataaactttttgggctt

SEQ ID NO: 274237 - DNA, 20 bp, Artificial Sequence
  Description of Artificial Sequence: Synthetic oligonucleotide
  Target: ATXN1; (+) strand; PAM type: YTN; PAM sequence: CTT
tttgggcttttctcagataa

SEQ ID NO: 274238 - DNA, 20 bp, Artificial Sequence
  Description of Artificial Sequence: Synthetic oligonucleotide
  Target: ATXN1; (+) strand; PAM type: YTN; PAM sequence: TTT
ttgggcttttctcagataag

SEQ ID NO: 274239 - DNA, 20 bp, Artificial Sequence
  Description of Artificial Sequence: Synthetic oligonucleotide
  Target: ATXN1; (+) strand; PAM type: YTN; PAM sequence: TTT
tgggcttttctcagataaga

SEQ ID NO: 274240 - DNA, 20 bp, Artificial Sequence
  Description of Artificial Sequence: Synthetic oligonucleotide
  Target: ATXN1; (+) strand; PAM type: YTN; PAM sequence: TTT
gggcttttctcagataagac

SEQ ID NO: 274241 - DNA, 20 bp, Artificial Sequence
  Description of Artificial Sequence: Synthetic oligonucleotide
  Target: ATXN1; (+) strand; PAM type: YTN; PAM sequence: TTG
ggcttttctcagataagaca

SEQ ID NO: 274242 - DNA, 20 bp, Artificial Sequence
  Description of Artificial Sequence: Synthetic oligonucleotide
  Target: ATXN1; (+) strand; PAM type: YTN; PAM sequence: CTT
ttctcagataagacaggaaa

SEQ ID NO: 274243 - DNA, 20 bp, Artificial Sequence
  Description of Artificial Sequence: Synthetic oligonucleotide
  Target: ATXN1; (+) strand; PAM type: YTN; PAM sequence: TTT
tctcagataagacaggaaaa

SEQ ID NO: 274244 - DNA, 20 bp, Artificial Sequence
  Description of Artificial Sequence: Synthetic oligonucleotide
  Target: ATXN1; (+) strand; PAM type: YTN; PAM sequence: TTT
ctcagataagacaggaaaat

SEQ ID NO: 274245 - DNA, 20 bp, Artificial Sequence
  Description of Artificial Sequence: Synthetic oligonucleotide
  Target: ATXN1; (+) strand; PAM type: YTN; PAM sequence: TTC
tcagataagacaggaaaatg

SEQ ID NO: 274246 - DNA, 20 bp, Artificial Sequence
  Description of Artificial Sequence: Synthetic oligonucleotide
  Target: ATXN1; (+) strand; PAM type: YTN; PAM sequence: CTC
agataagacaggaaaatgga

SEQ ID NO: 274247 - DNA, 20 bp, Artificial Sequence
  Description of Artificial Sequence: Synthetic oligonucleotide
  Target: ATXN1; (+) strand; PAM type: YTN; PAM sequence: CTT
cacagttctaatgaatgcta

SEQ ID NO: 274248 - DNA, 20 bp, Artificial Sequence
  Description of Artificial Sequence: Synthetic oligonucleotide
  Target: ATXN1; (+) strand; PAM type: YTN; PAM sequence: TTC
acagttctaatgaatgctaa

SEQ ID NO: 274249 - DNA, 20 bp, Artificial Sequence
  Description of Artificial Sequence: Synthetic oligonucleotide
  Target: ATXN1; (+) strand; PAM type: YTN; PAM sequence: TTC
taatgaatgctaactcgtgt

SEQ ID NO: 274250 - DNA, 20 bp, Artificial Sequence
  Description of Artificial Sequence: Synthetic oligonucleotide
  Target: ATXN1; (+) strand; PAM type: YTN; PAM sequence: CTA
atgaatgctaactcgtgtag

SEQ ID NO: 274251 - DNA, 20 bp, Artificial Sequence
  Description of Artificial Sequence: Synthetic oligonucleotide
  Target: ATXN1; (+) strand; PAM type: YTN; PAM sequence: CTA
actcgtgtagacccagctct

SEQ ID NO: 274252 - DNA, 20 bp, Artificial Sequence
  Description of Artificial Sequence: Synthetic oligonucleotide
  Target: ATXN1; (+) strand; PAM type: YTN; PAM sequence: CTC
gtgtagacccagctctgtgg

SEQ ID NO: 274253 - DNA, 20 bp, Artificial Sequence
  Description of Artificial Sequence: Synthetic oligonucleotide
  Target: ATXN1; (+) strand; PAM type: YTN; PAM sequence: CTC
tgtggacaggagcgatcaat

SEQ ID NO: 274254 - DNA, 20 bp, Artificial Sequence
  Description of Artificial Sequence: Synthetic oligonucleotide
  Target: ATXN1; (+) strand; PAM type: YTN; PAM sequence: CTG
tggacaggagcgatcaatgt

SEQ ID NO: 274255 - DNA, 20 bp, Artificial Sequence
  Description of Artificial Sequence: Synthetic oligonucleotide
  Target: ATXN1; (+) strand; PAM type: YTN; PAM sequence: TTA
gggtaactcagcagatgatc

SEQ ID NO: 274256 - DNA, 20 bp, Artificial Sequence
  Description of Artificial Sequence: Synthetic oligonucleotide
  Target: ATXN1; (+) strand; PAM type: YTN; PAM sequence: CTC
agcagatgatccctcacaaa

SEQ ID NO: 274257 - DNA, 20 bp, Artificial Sequence
  Description of Artificial Sequence: Synthetic oligonucleotide
  Target: ATXN1; (+) strand; PAM type: YTN; PAM sequence: CTC
acaaatcagcaatctatgtt

SEQ ID NO: 274258 - DNA, 20 bp, Artificial Sequence
  Description of Artificial Sequence: Synthetic oligonucleotide
  Target: ATXN1; (+) strand; PAM type: YTN; PAM sequence: CTA
tgttctacattccattcagt

SEQ ID NO: 274259 - DNA, 20 bp, Artificial Sequence
  Description of Artificial Sequence: Synthetic oligonucleotide
  Target: ATXN1; (+) strand; PAM type: YTN; PAM sequence: TTC
tacattccattcagtatgtt

SEQ ID NO: 274260 - DNA, 20 bp, Artificial Sequence
  Description of Artificial Sequence: Synthetic oligonucleotide
  Target: ATXN1; (+) strand; PAM type: YTN; PAM sequence: CTA
cattccattcagtatgttgg

SEQ ID NO: 274261 - DNA, 20 bp, Artificial Sequence
  Description of Artificial Sequence: Synthetic oligonucleotide
  Target: ATXN1; (+) strand; PAM type: YTN; PAM sequence: TTC
cattcagtatgttggtagac

SEQ ID NO: 274262 - DNA, 20 bp, Artificial Sequence
  Description of Artificial Sequence: Synthetic oligonucleotide
  Target: ATXN1; (+) strand; PAM type: YTN; PAM sequence: TTC
agtatgttggtagacaccaa

SEQ ID NO: 274263 - DNA, 20 bp, Artificial Sequence
  Description of Artificial Sequence: Synthetic oligonucleotide
  Target: ATXN1; (+) strand; PAM type: YTN; PAM sequence: TTG
gtagacaccaattacgtctg

SEQ ID NO: 274264 - DNA, 20 bp, Artificial Sequence
  Description of Artificial Sequence: Synthetic oligonucleotide
  Target: ATXN1; (+) strand; PAM type: YTN; PAM sequence: TTA
cgtctgtatgtacataagga

SEQ ID NO: 274265 - DNA, 20 bp, Artificial Sequence
  Description of Artificial Sequence: Synthetic oligonucleotide
  Target: ATXN1; (+) strand; PAM type: YTN; PAM sequence: CTG
tatgtacataaggagatgat

SEQ ID NO: 274266 - DNA, 20 bp, Artificial Sequence
  Description of Artificial Sequence: Synthetic oligonucleotide
  Target: ATXN1; (+) strand; PAM type: YTN; PAM sequence: TTC
cgcaataatgactctagtta

SEQ ID NO: 274267 - DNA, 20 bp, Artificial Sequence
  Description of Artificial Sequence: Synthetic oligonucleotide
  Target: ATXN1; (+) strand; PAM type: YTN; PAM sequence: CTC
tagttagggaagaagacaaa

SEQ ID NO: 274268 - DNA, 20 bp, Artificial Sequence
  Description of Artificial Sequence: Synthetic oligonucleotide
  Target: ATXN1; (+) strand; PAM type: YTN; PAM sequence: CTA
gttagggaagaagacaaagt

SEQ ID NO: 274269 - DNA, 20 bp, Artificial Sequence
  Description of Artificial Sequence: Synthetic oligonucleotide
  Target: ATXN1; (+) strand; PAM type: YTN; PAM sequence: TTA
gggaagaagacaaagtgatt

SEQ ID NO: 274270 - DNA, 20 bp, Artificial Sequence
  Description of Artificial Sequence: Synthetic oligonucleotide
  Target: ATXN1; (+) strand; PAM type: YTN; PAM sequence: TTA
agctgacaagttggataaaa

SEQ ID NO: 274271 - DNA, 20 bp, Artificial Sequence
  Description of Artificial Sequence: Synthetic oligonucleotide
  Target: ATXN1; (+) strand; PAM type: YTN; PAM sequence: CTG
acaagttggataaaataata

SEQ ID NO: 274272 - DNA, 20 bp, Artificial Sequence
  Description of Artificial Sequence: Synthetic oligonucleotide
  Target: ATXN1; (+) strand; PAM type: YTN; PAM sequence: TTG
gataaaataataaacacaag

SEQ ID NO: 274273 - DNA, 20 bp, Artificial Sequence
  Description of Artificial Sequence: Synthetic oligonucleotide
  Target: ATXN1; (+) strand; PAM type: YTN; PAM sequence: CTC
ttaatactaccctttgacca

SEQ ID NO: 274274 - DNA, 20 bp, Artificial Sequence
  Description of Artificial Sequence: Synthetic oligonucleotide
  Target: ATXN1; (+) strand; PAM type: YTN; PAM sequence: CTT
aatactaccctttgaccact

SEQ ID NO: 274275 - DNA, 20 bp, Artificial Sequence
  Description of Artificial Sequence: Synthetic oligonucleotide
  Target: ATXN1; (+) strand; PAM type: YTN; PAM sequence: TTA
atactaccctttgaccactc

SEQ ID NO: 274276 - DNA, 20 bp, Artificial Sequence
  Description of Artificial Sequence: Synthetic oligonucleotide
  Target: ATXN1; (+) strand; PAM type: YTN; PAM sequence: CTA
ccctttgaccactccctagg

SEQ ID NO: 274277 - DNA, 20 bp, Artificial Sequence
  Description of Artificial Sequence: Synthetic oligonucleotide
  Target: ATXN1; (+) strand; PAM type: YTN; PAM sequence: CTT
tgaccactccctaggtgaga

SEQ ID NO: 274278 - DNA, 20 bp, Artificial Sequence
  Description of Artificial Sequence: Synthetic oligonucleotide
  Target: ATXN1; (+) strand; PAM type: YTN; PAM sequence: TTT
gaccactccctaggtgagat

SEQ ID NO: 274279 - DNA, 20 bp, Artificial Sequence
  Description of Artificial Sequence: Synthetic oligonucleotide
  Target: ATXN1; (+) strand; PAM type: YTN; PAM sequence: TTG
accactccctaggtgagatg

SEQ ID NO: 274280 - DNA, 20 bp, Artificial Sequence
  Description of Artificial Sequence: Synthetic oligonucleotide
  Target: ATXN1; (+) strand; PAM type: YTN; PAM sequence: CTC
cctaggtgagatgaaatgtt

SEQ ID NO: 274281 - DNA, 20 bp, Artificial Sequence
  Description of Artificial Sequence: Synthetic oligonucleotide
  Target: ATXN1; (+) strand; PAM type: YTN; PAM sequence: CTA
ggtgagatgaaatgttttgg

SEQ ID NO: 274282 - DNA, 20 bp, Artificial Sequence
  Description of Artificial Sequence: Synthetic oligonucleotide
  Target: ATXN1; (+) strand; PAM type: YTN; PAM sequence: TTT
tggaaataagtgcacttagt

SEQ ID NO: 274283 - DNA, 20 bp, Artificial Sequence
  Description of Artificial Sequence: Synthetic oligonucleotide
  Target: ATXN1; (+) strand; PAM type: YTN; PAM sequence: TTT
ggaaataagtgcacttagtt

SEQ ID NO: 274284 - DNA, 20 bp, Artificial Sequence
  Description of Artificial Sequence: Synthetic oligonucleotide
  Target: ATXN1; (+) strand; PAM type: YTN; PAM sequence: TTG
gaaataagtgcacttagttc

SEQ ID NO: 274285 - DNA, 20 bp, Artificial Sequence
  Description of Artificial Sequence: Synthetic oligonucleotide
  Target: ATXN1; (+) strand; PAM type: YTN; PAM sequence: CTT
agttcaccaacctaaatgaa

SEQ ID NO: 274286 - DNA, 20 bp, Artificial Sequence
  Description of Artificial Sequence: Synthetic oligonucleotide
  Target: ATXN1; (+) strand; PAM type: YTN; PAM sequence: TTA
gttcaccaacctaaatgaac

SEQ ID NO: 274287 - DNA, 20 bp, Artificial Sequence
  Description of Artificial Sequence: Synthetic oligonucleotide
  Target: ATXN1; (+) strand; PAM type: YTN; PAM sequence: TTC
accaacctaaatgaacacaa

SEQ ID NO: 274288 - DNA, 20 bp, Artificial Sequence
  Description of Artificial Sequence: Synthetic oligonucleotide
  Target: ATXN1; (+) strand; PAM type: YTN; PAM sequence: CTA
aatgaacacaatttgaagcc

SEQ ID NO: 274289 - DNA, 20 bp, Artificial Sequence
  Description of Artificial Sequence: Synthetic oligonucleotide
  Target: ATXN1; (+) strand; PAM type: YTN; PAM sequence: TTT
gaagccagatttaacctagg

SEQ ID NO: 274290 - DNA, 20 bp, Artificial Sequence
  Description of Artificial Sequence: Synthetic oligonucleotide
  Target: ATXN1; (+) strand; PAM type: YTN; PAM sequence: TTG
aagccagatttaacctagga

SEQ ID NO: 274291 - DNA, 20 bp, Artificial Sequence
  Description of Artificial Sequence: Synthetic oligonucleotide
  Target: ATXN1; (+) strand; PAM type: YTN; PAM sequence: TTT
aacctaggatgtctaaaaaa

SEQ ID NO: 274292 - DNA, 20 bp, Artificial Sequence
  Description of Artificial Sequence: Synthetic oligonucleotide
  Target: ATXN1; (+) strand; PAM type: YTN; PAM sequence: TTA
acctaggatgtctaaaaaaa

SEQ ID NO: 274293 - DNA, 20 bp, Artificial Sequence
  Description of Artificial Sequence: Synthetic oligonucleotide
  Target: ATXN1; (+) strand; PAM type: YTN; PAM sequence: CTA
ggatgtctaaaaaaacaaac

SEQ ID NO: 274294 - DNA, 20 bp, Artificial Sequence
  Description of Artificial Sequence: Synthetic oligonucleotide
  Target: ATXN1; (+) strand; PAM type: YTN; PAM sequence: CTA
aaaaaacaaacaaacaaaca

SEQ ID NO: 274295 - DNA, 20 bp, Artificial Sequence
  Description of Artificial Sequence: Synthetic oligonucleotide
  Target: ATXN1; (+) strand; PAM type: YTN; PAM sequence: TTT
accttctgggattctaactg

SEQ ID NO: 274296 - DNA, 20 bp, Artificial Sequence
  Description of Artificial Sequence: Synthetic oligonucleotide
  Target: ATXN1; (+) strand; PAM type: YTN; PAM sequence: TTA
ccttctgggattctaactga

SEQ ID NO: 274297 - DNA, 20 bp, Artificial Sequence
  Description of Artificial Sequence: Synthetic oligonucleotide
  Target: ATXN1; (+) strand; PAM type: YTN; PAM sequence: CTT
ctgggattctaactgagaat

SEQ ID NO: 274298 - DNA, 20 bp, Artificial Sequence
  Description of Artificial Sequence: Synthetic oligonucleotide
  Target: ATXN1; (+) strand; PAM type: YTN; PAM sequence: TTC
tgggattctaactgagaatc

SEQ ID NO: 274299 - DNA, 20 bp, Artificial Sequence
  Description of Artificial Sequence: Synthetic oligonucleotide
  Target: ATXN1; (+) strand; PAM type: YTN; PAM sequence: CTG
ggattctaactgagaatcat

SEQ ID NO: 274300 - DNA, 20 bp, Artificial Sequence
  Description of Artificial Sequence: Synthetic oligonucleotide
  Target: ATXN1; (+) strand; PAM type: YTN; PAM sequence: TTC
taactgagaatcatattctt

SEQ ID NO: 274301 - DNA, 20 bp, Artificial Sequence
  Description of Artificial Sequence: Synthetic oligonucleotide
  Target: ATXN1; (+) strand; PAM type: YTN; PAM sequence: CTA
actgagaatcatattcttaa

SEQ ID NO: 274302 - DNA, 20 bp, Artificial Sequence
  Description of Artificial Sequence: Synthetic oligonucleotide
  Target: ATXN1; (+) strand; PAM type: YTN; PAM sequence: CTG
agaatcatattcttaacttc

SEQ ID NO: 274303 - DNA, 20 bp, Artificial Sequence
  Description of Artificial Sequence: Synthetic oligonucleotide
  Target: ATXN1; (+) strand; PAM type: YTN; PAM sequence: TTC
ttaacttctctccatcttat

SEQ ID NO: 274304 - DNA, 20 bp, Artificial Sequence
  Description of Artificial Sequence: Synthetic oligonucleotide
  Target: ATXN1; (+) strand; PAM type: YTN; PAM sequence: CTT
aacttctctccatcttattg

SEQ ID NO: 274305 - DNA, 20 bp, Artificial Sequence
  Description of Artificial Sequence: Synthetic oligonucleotide
  Target: ATXN1; (+) strand; PAM type: YTN; PAM sequence: TTA
acttctctccatcttattgc

SEQ ID NO: 274306 - DNA, 20 bp, Artificial Sequence
  Description of Artificial Sequence: Synthetic oligonucleotide
  Target: ATXN1; (+) strand; PAM type: YTN; PAM sequence: CTT
ctctccatcttattgcacaa

SEQ ID NO: 274307 - DNA, 20 bp, Artificial Sequence
  Description of Artificial Sequence: Synthetic oligonucleotide
  Target: ATXN1; (+) strand; PAM type: YTN; PAM sequence: TTC
tctccatcttattgcacaac

SEQ ID NO: 274308 - DNA, 20 bp, Artificial Sequence
  Description of Artificial Sequence: Synthetic oligonucleotide
  Target: ATXN1; (+) strand; PAM type: YTN; PAM sequence: CTC
tccatcttattgcacaactg

SEQ ID NO: 274309 - DNA, 20 bp, Artificial Sequence
  Description of Artificial Sequence: Synthetic oligonucleotide
  Target: ATXN1; (+) strand; PAM type: YTN; PAM sequence: CTC
catcttattgcacaactgca

SEQ ID NO: 274310 - DNA, 20 bp, Artificial Sequence
  Description of Artificial Sequence: Synthetic oligonucleotide
  Target: ATXN1; (+) strand; PAM type: YTN; PAM sequence: CTT
attgcacaactgcactctta

SEQ ID NO: 274311 - DNA, 20 bp, Artificial Sequence
  Description of Artificial Sequence: Synthetic oligonucleotide
  Target: ATXN1; (+) strand; PAM type: YTN; PAM sequence: TTA
ttgcacaactgcactcttat

SEQ ID NO: 274312 - DNA, 20 bp, Artificial Sequence
  Description of Artificial Sequence: Synthetic oligonucleotide
  Target: ATXN1; (+) strand; PAM type: YTN; PAM sequence: TTG
cacaactgcactcttatgta

SEQ ID NO: 274313 - DNA, 20 bp, Artificial Sequence
  Description of Artificial Sequence: Synthetic oligonucleotide
  Target: ATXN1; (+) strand; PAM type: YTN; PAM sequence: CTG
cactcttatgtaaaaaccaa

SEQ ID NO: 274314 - DNA, 20 bp, Artificial Sequence
  Description of Artificial Sequence: Synthetic oligonucleotide
  Target: ATXN1; (+) strand; PAM type: YTN; PAM sequence: CTC
ttatgtaaaaaccaacataa

SEQ ID NO: 274315 - DNA, 20 bp, Artificial Sequence
  Description of Artificial Sequence: Synthetic oligonucleotide
  Target: ATXN1; (+) strand; PAM type: YTN; PAM sequence: CTT
atgtaaaaaccaacataact

SEQ ID NO: 274316 - DNA, 20 bp, Artificial Sequence
  Description of Artificial Sequence: Synthetic oligonucleotide
  Target: ATXN1; (+) strand; PAM type: YTN; PAM sequence: TTA
tgtaaaaaccaacataactt

SEQ ID NO: 274317 - DNA, 20 bp, Artificial Sequence
  Description of Artificial Sequence: Synthetic oligonucleotide
  Target: ATXN1; (+) strand; PAM type: YTN; PAM sequence: CTT
taaaaaaaacgaataaatgg

SEQ ID NO: 274318 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaacgaataaatggg

SEQ ID NO: 274319 - DNA, 20 bp, Artificial Sequence
  Description of Artificial Sequence: Synthetic oligonucleotide
  Target: ATXN1; (+) strand; PAM type: YTN; PAM sequence: TTA
aaaaaaacgaataaatgggg

SEQ ID NO: 274320 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 274321 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 274322 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcggatca

SEQ ID NO: 274323 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcggatcac

SEQ ID NO: 274324 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcggatcacg

SEQ ID NO: 274325 - DNA, 20 bp, Artificial Sequence
  Description of Artificial Sequence: Synthetic oligonucleotide
  Target: ATXN1; (+) strand; PAM type: YTN; PAM sequence: CTT
ggtaacacagtgaaacccat

SEQ ID NO: 274326 - DNA, 20 bp, Artificial Sequence
  Description of Artificial Sequence: Synthetic oligonucleotide
  Target: ATXN1; (+) strand; PAM type: YTN; PAM sequence: TTG
gtaacacagtgaaacccatc

SEQ ID NO: 274327 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaatt

SEQ ID NO: 274328 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaattag

SEQ ID NO: 274329 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaattagcca

SEQ ID NO: 274330 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggcaggca

SEQ ID NO: 274331 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcaggag

SEQ ID NO: 274332 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 274333 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 274334 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcgtgaa

SEQ ID NO: 274335 - DNA, 20 bp, Artificial Sequence
  Description of Artificial Sequence: Synthetic oligonucleotide
  Target: ATXN1; (+) strand; PAM type: YTN; PAM sequence: CTT
gcagtgagccgagatcgtgc

SEQ ID NO: 274336 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcgtgcc

SEQ ID NO: 274337 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacag

SEQ ID NO: 274338 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagaggga

SEQ ID NO: 274339 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagggagatccgt

SEQ ID NO: 274340 - DNA, 20 bp, Artificial Sequence
  Description of Artificial Sequence: Synthetic oligonucleotide
  Target: ATXN1; (+) strand; PAM type: YTN; PAM sequence: CTC
aaagtaaataaataaacaaa

SEQ ID NO: 274341 - DNA, 20 bp, Artificial Sequence
  Description of Artificial Sequence: Synthetic oligonucleotide
  Target: ATXN1; (+) strand; PAM type: YTN; PAM sequence: TTT
ctcaaaagtctctatgaagg

SEQ ID NO: 274342 - DNA, 20 bp, Artificial Sequence
  Description of Artificial Sequence: Synthetic oligonucleotide
  Target: ATXN1; (+) strand; PAM type: YTN; PAM sequence: TTC
tcaaaagtctctatgaaggt

SEQ ID NO: 274343 - DNA, 20 bp, Artificial Sequence
  Description of Artificial Sequence: Synthetic oligonucleotide
  Target: ATXN1; (+) strand; PAM type: YTN; PAM sequence: CTC
aaaagtctctatgaaggtca

SEQ ID NO: 274344 - DNA, 20 bp, Artificial Sequence
  Description of Artificial Sequence: Synthetic oligonucleotide
  Target: ATXN1; (+) strand; PAM type: YTN; PAM sequence: CTC
tatgaaggtcagatttgtac

SEQ ID NO: 274345 - DNA, 20 bp, Artificial Sequence
  Description of Artificial Sequence: Synthetic oligonucleotide
  Target: ATXN1; (+) strand; PAM type: YTN; PAM sequence: CTA
tgaaggtcagatttgtactt

SEQ ID NO: 274346 - DNA, 20 bp, Artificial Sequence
  Description of Artificial Sequence: Synthetic oligonucleotide
  Target: ATXN1; (+) strand; PAM type: YTN; PAM sequence: TTT
gtacttcaatataggaaccc

SEQ ID NO: 274347 - DNA, 20 bp, Artificial Sequence
  Description of Artificial Sequence: Synthetic oligonucleotide
  Target: ATXN1; (+) strand; PAM type: YTN; PAM sequence: TTG
tacttcaatataggaaccct

SEQ ID NO: 274348 - DNA, 20 bp, Artificial Sequence
  Description of Artificial Sequence: Synthetic oligonucleotide
  Target: ATXN1; (+) strand; PAM type: YTN; PAM sequence: CTT
caatataggaaccctgttag

SEQ ID NO: 274349 - DNA, 20 bp, Artificial Sequence
  Description of Artificial Sequence: Synthetic oligonucleotide
  Target: ATXN1; (+) strand; PAM type: YTN; PAM sequence: TTC
aatataggaaccctgttagc

SEQ ID NO: 274350 - DNA, 20 bp, Artificial Sequence
  Description of Artificial Sequence: Synthetic oligonucleotide
  Target: ATXN1; (+) strand; PAM type: YTN; PAM sequence: CTG
ttagccattcttctgcaggt

SEQ ID NO: 274351 - DNA, 20 bp, Artificial Sequence
  Description of Artificial Sequence: Synthetic oligonucleotide
  Target: ATXN1; (+) strand; PAM type: YTN; PAM sequence: TTA
gccattcttctgcaggtgca

SEQ ID NO: 274352 - DNA, 20 bp, Artificial Sequence
  Description of Artificial Sequence: Synthetic oligonucleotide
  Target: ATXN1; (+) strand; PAM type: YTN; PAM sequence: TTC
ttctgcaggtgcagacaacc

SEQ ID NO: 274353 - DNA, 20 bp, Artificial Sequence
  Description of Artificial Sequence: Synthetic oligonucleotide
  Target: ATXN1; (+) strand; PAM type: YTN; PAM sequence: CTT
ctgcaggtgcagacaaccgc

SEQ ID NO: 274354 - DNA, 20 bp, Artificial Sequence
  Description of Artificial Sequence: Synthetic oligonucleotide
  Target: ATXN1; (+) strand; PAM type: YTN; PAM sequence: TTC
tgcaggtgcagacaaccgcg

SEQ ID NO: 274355 - DNA, 20 bp, Artificial Sequence
  Description of Artificial Sequence: Synthetic oligonucleotide
  Target: ATXN1; (+) strand; PAM type: YTN; PAM sequence: CTG
caggtgcagacaaccgcgag

SEQ ID NO: 274356 - DNA, 20 bp, Artificial Sequence
  Description of Artificial Sequence: Synthetic oligonucleotide
  Target: ATXN1; (+) strand; PAM type: YTN; PAM sequence: CTG
cagctggactgcacacacct

SEQ ID NO: 274357 - DNA, 20 bp, Artificial Sequence
  Description of Artificial Sequence: Synthetic oligonucleotide
  Target: ATXN1; (+) strand; PAM type: YTN; PAM sequence: CTG
gactgcacacacctgcaggt

SEQ ID NO: 274358 - DNA, 20 bp, Artificial Sequence
  Description of Artificial Sequence: Synthetic oligonucleotide
  Target: ATXN1; (+) strand; PAM type: YTN; PAM sequence: CTG
cacacacctgcaggtgtacc

SEQ ID NO: 274359 - DNA, 20 bp, Artificial Sequence
  Description of Artificial Sequence: Synthetic oligonucleotide
  Target: ATXN1; (+) strand; PAM type: YTN; PAM sequence: CTG
caggtgtaccatgacttcta

SEQ ID NO: 274360 - DNA, 20 bp, Artificial Sequence
  Description of Artificial Sequence: Synthetic oligonucleotide
  Target: ATXN1; (+) strand; PAM type: YTN; PAM sequence: CTT
ctagctgcaaagcagatgta

SEQ ID NO: 274361 - DNA, 20 bp, Artificial Sequence
  Description of Artificial Sequence: Synthetic oligonucleotide
  Target: ATXN1; (+) strand; PAM type: YTN; PAM sequence: TTC
tagctgcaaagcagatgtac

SEQ ID NO: 274362 - DNA, 20 bp, Artificial Sequence
  Description of Artificial Sequence: Synthetic oligonucleotide
  Target: ATXN1; (+) strand; PAM type: YTN; PAM sequence: CTA
gctgcaaagcagatgtacca

SEQ ID NO: 274363 - DNA, 20 bp, Artificial Sequence
  Description of Artificial Sequence: Synthetic oligonucleotide
  Target: ATXN1; (+) strand; PAM type: YTN; PAM sequence: CTG
caaagcagatgtaccaccaa

SEQ ID NO: 274364 - DNA, 20 bp, Artificial Sequence
  Description of Artificial Sequence: Synthetic oligonucleotide
  Target: ATXN1; (+) strand; PAM type: YTN; PAM sequence: CTC
agcacatgacaacgtggcat

SEQ ID NO: 274365 - DNA, 20 bp, Artificial Sequence
  Description of Artificial Sequence: Synthetic oligonucleotide
  Target: ATXN1; (+) strand; PAM type: YTN; PAM sequence: TTG
cagatgcagtggtttggaaa

SEQ ID NO: 274366 - DNA, 20 bp, Artificial Sequence
  Description of Artificial Sequence: Synthetic oligonucleotide
  Target: ATXN1; (+) strand; PAM type: YTN; PAM sequence: TTT
ggaaagggcgcagaagaaaa

SEQ ID NO: 274367 - DNA, 20 bp, Artificial Sequence
  Description of Artificial Sequence: Synthetic oligonucleotide
  Target: ATXN1; (+) strand; PAM type: YTN; PAM sequence: TTG
gaaagggcgcagaagaaaat

SEQ ID NO: 274368 - DNA, 20 bp, Artificial Sequence
  Description of Artificial Sequence: Synthetic oligonucleotide
  Target: ATXN1; (+) strand; PAM type: YTN; PAM sequence: CTT
tctcagatgacatccataac

SEQ ID NO: 274369 - DNA, 20 bp, Artificial Sequence
  Description of Artificial Sequence: Synthetic oligonucleotide
  Target: ATXN1; (+) strand; PAM type: YTN; PAM sequence: TTT
ctcagatgacatccataaca

SEQ ID NO: 274370 - DNA, 20 bp, Artificial Sequence
  Description of Artificial Sequence: Synthetic oligonucleotide
  Target: ATXN1; (+) strand; PAM type: YTN; PAM sequence: TTC
tcagatgacatccataacag

SEQ ID NO: 274371 - DNA, 20 bp, Artificial Sequence
  Description of Artificial Sequence: Synthetic oligonucleotide
  Target: ATXN1; (+) strand; PAM type: YTN; PAM sequence: CTC
agatgacatccataacagaa

SEQ ID NO: 274372 - DNA, 20 bp, Artificial Sequence
  Description of Artificial Sequence: Synthetic oligonucleotide
  Target: ATXN1; (+) strand; PAM type: YTN; PAM sequence: TTC
tgggtgcactcactctgcca

SEQ ID NO: 274373 - DNA, 20 bp, Artificial Sequence
  Description of Artificial Sequence: Synthetic oligonucleotide
  Target: ATXN1; (+) strand; PAM type: YTN; PAM sequence: CTG
ggtgcactcactctgccaac

SEQ ID NO: 274374 - DNA, 20 bp, Artificial Sequence
  Description of Artificial Sequence: Synthetic oligonucleotide
  Target: ATXN1; (+) strand; PAM type: YTN; PAM sequence: CTC
actctgccaacccctttact

SEQ ID NO: 274375 - DNA, 20 bp, Artificial Sequence
  Description of Artificial Sequence: Synthetic oligonucleotide
  Target: ATXN1; (+) strand; PAM type: YTN; PAM sequence: CTC
tgccaacccctttacttagt

SEQ ID NO: 274376 - DNA, 20 bp, Artificial Sequence
  Description of Artificial Sequence: Synthetic oligonucleotide
  Target: ATXN1; (+) strand; PAM type: YTN; PAM sequence: CTG
ccaacccctttacttagtag

SEQ ID NO: 274377 - DNA, 20 bp, Artificial Sequence
  Description of Artificial Sequence: Synthetic oligonucleotide
  Target: ATXN1; (+) strand; PAM type: YTN; PAM sequence: CTT
tacttagtagccaactagga

SEQ ID NO: 274378 - DNA, 20 bp, Artificial Sequence
  Description of Artificial Sequence: Synthetic oligonucleotide
  Target: ATXN1; (+) strand; PAM type: YTN; PAM sequence: TTT
acttagtagccaactaggat

SEQ ID NO: 274379 - DNA, 20 bp, Artificial Sequence
  Description of Artificial Sequence: Synthetic oligonucleotide
  Target: ATXN1; (+) strand; PAM type: YTN; PAM sequence: TTA
cttagtagccaactaggatt

SEQ ID NO: 274380 - DNA, 20 bp, Artificial Sequence
  Description of Artificial Sequence: Synthetic oligonucleotide
  Target: ATXN1; (+) strand; PAM type: YTN; PAM sequence: CTT
agtagccaactaggattatg

SEQ ID NO: 274381 - DNA, 20 bp, Artificial Sequence
  Description of Artificial Sequence: Synthetic oligonucleotide
  Target: ATXN1; (+) strand; PAM type: YTN; PAM sequence: TTA
gtagccaactaggattatga

SEQ ID NO: 274382 - DNA, 20 bp, Artificial Sequence
  Description of Artificial Sequence: Synthetic oligonucleotide
  Target: ATXN1; (+) strand; PAM type: YTN; PAM sequence: CTA
ggattatgagaaagtcaaat

SEQ ID NO: 274383 - DNA, 20 bp, Artificial Sequence
  Description of Artificial Sequence: Synthetic oligonucleotide
  Target: ATXN1; (+) strand; PAM type: YTN; PAM sequence: TTA
tgagaaagtcaaatagtcta

SEQ ID NO: 274384 - DNA, 20 bp, Artificial Sequence
  Description of Artificial Sequence: Synthetic oligonucleotide
  Target: ATXN1; (+) strand; PAM type: YTN; PAM sequence: CTA
tcagtatcagtcttgaccct

SEQ ID NO: 274385 - DNA, 20 bp, Artificial Sequence
  Description of Artificial Sequence: Synthetic oligonucleotide
  Target: ATXN1; (+) strand; PAM type: YTN; PAM sequence: CTT
gacccttgccttaggggtga

SEQ ID NO: 274386 - DNA, 20 bp, Artificial Sequence
  Description of Artificial Sequence: Synthetic oligonucleotide
  Target: ATXN1; (+) strand; PAM type: YTN; PAM sequence: TTG
acccttgccttaggggtgat

SEQ ID NO: 274387 - DNA, 20 bp, Artificial Sequence
  Description of Artificial Sequence: Synthetic oligonucleotide
  Target: ATXN1; (+) strand; PAM type: YTN; PAM sequence: CTT
gccttaggggtgatcattat

SEQ ID NO: 274388 - DNA, 20 bp, Artificial Sequence
  Description of Artificial Sequence: Synthetic oligonucleotide
  Target: ATXN1; (+) strand; PAM type: YTN; PAM sequence: TTG
ccttaggggtgatcattatt

SEQ ID NO: 274389 - DNA, 20 bp, Artificial Sequence
  Description of Artificial Sequence: Synthetic oligonucleotide
  Target: ATXN1; (+) strand; PAM type: YTN; PAM sequence: CTT
aggggtgatcattattagat

SEQ ID NO: 274390 - DNA, 20 bp, Artificial Sequence
  Description of Artificial Sequence: Synthetic oligonucleotide
  Target: ATXN1; (+) strand; PAM type: YTN; PAM sequence: TTA
ggggtgatcattattagatt

SEQ ID NO: 274391 - DNA, 20 bp, Artificial Sequence
  Description of Artificial Sequence: Synthetic oligonucleotide
  Target: ATXN1; (+) strand; PAM type: YTN; PAM sequence: TTA
ttagattaccaagaccacat

SEQ ID NO: 274392 - DNA, 20 bp, Artificial Sequence
  Description of Artificial Sequence: Synthetic oligonucleotide
  Target: ATXN1; (+) strand; PAM type: YTN; PAM sequence: TTA
gattaccaagaccacattaa

SEQ ID NO: 274393 - DNA, 20 bp, Artificial Sequence
  Description of Artificial Sequence: Synthetic oligonucleotide
  Target: ATXN1; (+) strand; PAM type: YTN; PAM sequence: TTA
ccaagaccacattaagttaa

SEQ ID NO: 274394 - DNA, 20 bp, Artificial Sequence
  Description of Artificial Sequence: Synthetic oligonucleotide
  Target: ATXN1; (+) strand; PAM type: YTN; PAM sequence: TTA
agttaaactacctataactc

SEQ ID NO: 274395 - DNA, 20 bp, Artificial Sequence
  Description of Artificial Sequence: Synthetic oligonucleotide
  Target: ATXN1; (+) strand; PAM type: YTN; PAM sequence: TTA
aactacctataactctacag

SEQ ID NO: 274396 - DNA, 20 bp, Artificial Sequence
  Description of Artificial Sequence: Synthetic oligonucleotide
  Target: ATXN1; (+) strand; PAM type: YTN; PAM sequence: CTA
cctataactctacagcctca

SEQ ID NO: 274397 - DNA, 20 bp, Artificial Sequence
  Description of Artificial Sequence: Synthetic oligonucleotide
  Target: ATXN1; (+) strand; PAM type: YTN; PAM sequence: CTA
taactctacagcctcaaaaa

SEQ ID NO: 274398 - DNA, 20 bp, Artificial Sequence
  Description of Artificial Sequence: Synthetic oligonucleotide
  Target: ATXN1; (+) strand; PAM type: YTN; PAM sequence: CTC
tacagcctcaaaaagaatct

SEQ ID NO: 274399 - DNA, 20 bp, Artificial Sequence
  Description of Artificial Sequence: Synthetic oligonucleotide
  Target: ATXN1; (+) strand; PAM type: YTN; PAM sequence: CTA
cagcctcaaaaagaatctgc

SEQ ID NO: 274400 - DNA, 20 bp, Artificial Sequence
  Description of Artificial Sequence: Synthetic oligonucleotide
  Target: ATXN1; (+) strand; PAM type: YTN; PAM sequence: CTC
aaaaagaatctgcagattcc

SEQ ID NO: 274401 - DNA, 20 bp, Artificial Sequence
  Description of Artificial Sequence: Synthetic oligonucleotide
  Target: ATXN1; (+) strand; PAM type: YTN; PAM sequence: CTG
cagattccaaaaccagactt

SEQ ID NO: 274402 - DNA, 20 bp, Artificial Sequence
  Description of Artificial Sequence: Synthetic oligonucleotide
  Target: ATXN1; (+) strand; PAM type: YTN; PAM sequence: TTC
caaaaccagacttgtgcagg

SEQ ID NO: 274403 - DNA, 20 bp, Artificial Sequence
  Description of Artificial Sequence: Synthetic oligonucleotide
  Target: ATXN1; (+) strand; PAM type: YTN; PAM sequence: CTT
gtgcagggcaaacatcatgc

SEQ ID NO: 274404 - DNA, 20 bp, Artificial Sequence
  Description of Artificial Sequence: Synthetic oligonucleotide
  Target: ATXN1; (+) strand; PAM type: YTN; PAM sequence: TTG
tgcagggcaaacatcatgca

SEQ ID NO: 274405 - DNA, 20 bp, Artificial Sequence
  Description of Artificial Sequence: Synthetic oligonucleotide
  Target: ATXN1; (+) strand; PAM type: YTN; PAM sequence: CTA
ggagccaaacacaccagtat

SEQ ID NO: 274406 - DNA, 20 bp, Artificial Sequence
  Description of Artificial Sequence: Synthetic oligonucleotide
  Target: ATXN1; (+) strand; PAM type: YTN; PAM sequence: CTA
gctctgctactctccatgaa

SEQ ID NO: 274407 - DNA, 20 bp, Artificial Sequence
  Description of Artificial Sequence: Synthetic oligonucleotide
  Target: ATXN1; (+) strand; PAM type: YTN; PAM sequence: CTC
tgctactctccatgaagccc

SEQ ID NO: 274408 - DNA, 20 bp, Artificial Sequence
  Description of Artificial Sequence: Synthetic oligonucleotide
  Target: ATXN1; (+) strand; PAM type: YTN; PAM sequence: CTG
ctactctccatgaagcccca

SEQ ID NO: 274409 - DNA, 20 bp, Artificial Sequence
  Description of Artificial Sequence: Synthetic oligonucleotide
  Target: ATXN1; (+) strand; PAM type: YTN; PAM sequence: CTA
ctctccatgaagccccataa

SEQ ID NO: 274410 - DNA, 20 bp, Artificial Sequence
  Description of Artificial Sequence: Synthetic oligonucleotide
  Target: ATXN1; (+) strand; PAM type: YTN; PAM sequence: CTC
tccatgaagccccataaagg

SEQ ID NO: 274411 - DNA, 20 bp, Artificial Sequence
  Description of Artificial Sequence: Synthetic oligonucleotide
  Target: ATXN1; (+) strand; PAM type: YTN; PAM sequence: CTC
catgaagccccataaaggtg

SEQ ID NO: 274412 - DNA, 20 bp, Artificial Sequence
  Description of Artificial Sequence: Synthetic oligonucleotide
  Target: ATXN1; (+) strand; PAM type: YTN; PAM sequence: CTC
tgggcctcagatgccccatc

SEQ ID NO: 274413 - DNA, 20 bp, Artificial Sequence
  Description of Artificial Sequence: Synthetic oligonucleotide
  Target: ATXN1; (+) strand; PAM type: YTN; PAM sequence: CTG
ggcctcagatgccccatctg

SEQ ID NO: 274414 - DNA, 20 bp, Artificial Sequence
  Description of Artificial Sequence: Synthetic oligonucleotide
  Target: ATXN1; (+) strand; PAM type: YTN; PAM sequence: CTC
agatgccccatctgtacata

SEQ ID NO: 274415 - DNA, 20 bp, Artificial Sequence
  Description of Artificial Sequence: Synthetic oligonucleotide
  Target: ATXN1; (+) strand; PAM type: YTN; PAM sequence: CTG
tacatagggcctttgccaga

SEQ ID NO: 274416 - DNA, 20 bp, Artificial Sequence
  Description of Artificial Sequence: Synthetic oligonucleotide
  Target: ATXN1; (+) strand; PAM type: YTN; PAM sequence: CTT
tgccagacaagctctcaggt

SEQ ID NO: 274417 - DNA, 20 bp, Artificial Sequence
  Description of Artificial Sequence: Synthetic oligonucleotide
  Target: ATXN1; (+) strand; PAM type: YTN; PAM sequence: TTT
gccagacaagctctcaggtc

SEQ ID NO: 274418 - DNA, 20 bp, Artificial Sequence
  Description of Artificial Sequence: Synthetic oligonucleotide
  Target: ATXN1; (+) strand; PAM type: YTN; PAM sequence: TTG
ccagacaagctctcaggtct

SEQ ID NO: 274419 - DNA, 20 bp, Artificial Sequence
  Description of Artificial Sequence: Synthetic oligonucleotide
  Target: ATXN1; (+) strand; PAM type: YTN; PAM sequence: CTC
tcaggtctcatctggtgctc

SEQ ID NO: 274420 - DNA, 20 bp, Artificial Sequence
  Description of Artificial Sequence: Synthetic oligonucleotide
  Target: ATXN1; (+) strand; PAM type: YTN; PAM sequence: CTC
aggtctcatctggtgctcat

SEQ ID NO: 274421 - DNA, 20 bp, Artificial Sequence
  Description of Artificial Sequence: Synthetic oligonucleotide
  Target: ATXN1; (+) strand; PAM type: YTN; PAM sequence: CTC
atctggtgctcatatcctgt

SEQ ID NO: 274422 - DNA, 20 bp, Artificial Sequence
  Description of Artificial Sequence: Synthetic oligonucleotide
  Target: ATXN1; (+) strand; PAM type: YTN; PAM sequence: CTG
gtgctcatatcctgttattc

SEQ ID NO: 274423 - DNA, 20 bp, Artificial Sequence
  Description of Artificial Sequence: Synthetic oligonucleotide
  Target: ATXN1; (+) strand; PAM type: YTN; PAM sequence: CTC
atatcctgttattcttggtc

SEQ ID NO: 274424 - DNA, 20 bp, Artificial Sequence
  Description of Artificial Sequence: Synthetic oligonucleotide
  Target: ATXN1; (+) strand; PAM type: YTN; PAM sequence: CTG
ttattcttggtcatggaatt

SEQ ID NO: 274425 - DNA, 20 bp, Artificial Sequence
  Description of Artificial Sequence: Synthetic oligonucleotide
  Target: ATXN1; (+) strand; PAM type: YTN; PAM sequence: TTA
ttcttggtcatggaattcaa

SEQ ID NO: 274426 - DNA, 20 bp, Artificial Sequence
  Description of Artificial Sequence: Synthetic oligonucleotide
  Target: ATXN1; (+) strand; PAM type: YTN; PAM sequence: TTC
ttggtcatggaattcaaaag

SEQ ID NO: 274427 - DNA, 20 bp, Artificial Sequence
  Description of Artificial Sequence: Synthetic oligonucleotide
  Target: ATXN1; (+) strand; PAM type: YTN; PAM sequence: CTT
ggtcatggaattcaaaagac

SEQ ID NO: 274428 - DNA, 20 bp, Artificial Sequence
  Description of Artificial Sequence: Synthetic oligonucleotide
  Target: ATXN1; (+) strand; PAM type: YTN; PAM sequence: TTG
gtcatggaattcaaaagaca

SEQ ID NO: 274429 - DNA, 20 bp, Artificial Sequence
  Description of Artificial Sequence: Synthetic oligonucleotide
  Target: ATXN1; (+) strand; PAM type: YTN; PAM sequence: TTC
aaaagacatcacagtcactt

SEQ ID NO: 274430 - DNA, 20 bp, Artificial Sequence
  Description of Artificial Sequence: Synthetic oligonucleotide
  Target: ATXN1; (+) strand; PAM type: YTN; PAM sequence: CTT
gaaactggatggttccccct

SEQ ID NO: 274431 - DNA, 20 bp, Artificial Sequence
  Description of Artificial Sequence: Synthetic oligonucleotide
  Target: ATXN1; (+) strand; PAM type: YTN; PAM sequence: TTG
aaactggatggttccccctt

SEQ ID NO: 274432 - DNA, 20 bp, Artificial Sequence
  Description of Artificial Sequence: Synthetic oligonucleotide
  Target: ATXN1; (+) strand; PAM type: YTN; PAM sequence: CTG
gatggttcccccttgcctac

SEQ ID NO: 274433 - DNA, 20 bp, Artificial Sequence
  Description of Artificial Sequence: Synthetic oligonucleotide
  Target: ATXN1; (+) strand; PAM type: YTN; PAM sequence: TTC
ccccttgcctacagctgtat

SEQ ID NO: 274434 - DNA, 20 bp, Artificial Sequence
  Description of Artificial Sequence: Synthetic oligonucleotide
  Target: ATXN1; (+) strand; PAM type: YTN; PAM sequence: CTT
gcctacagctgtatctctgt

SEQ ID NO: 274435 - DNA, 20 bp, Artificial Sequence
  Description of Artificial Sequence: Synthetic oligonucleotide
  Target: ATXN1; (+) strand; PAM type: YTN; PAM sequence: TTG
cctacagctgtatctctgtg

SEQ ID NO: 274436 - DNA, 20 bp, Artificial Sequence
  Description of Artificial Sequence: Synthetic oligonucleotide
  Target: ATXN1; (+) strand; PAM type: YTN; PAM sequence: CTA
cagctgtatctctgtgcacc

SEQ ID NO: 274437 - DNA, 20 bp, Artificial Sequence
  Description of Artificial Sequence: Synthetic oligonucleotide
  Target: ATXN1; (+) strand; PAM type: YTN; PAM sequence: CTG
tatctctgtgcaccagttgc

SEQ ID NO: 274438 - DNA, 20 bp, Artificial Sequence
  Description of Artificial Sequence: Synthetic oligonucleotide
  Target: ATXN1; (+) strand; PAM type: YTN; PAM sequence: CTC
tgtgcaccagttgctgaggg

SEQ ID NO: 274439 - DNA, 20 bp, Artificial Sequence
  Description of Artificial Sequence: Synthetic oligonucleotide
  Target: ATXN1; (+) strand; PAM type: YTN; PAM sequence: CTG
tgcaccagttgctgagggaa

SEQ ID NO: 274440 - DNA, 20 bp, Artificial Sequence
  Description of Artificial Sequence: Synthetic oligonucleotide
  Target: ATXN1; (+) strand; PAM type: YTN; PAM sequence: TTG
ctgagggaaagaaacttcct

SEQ ID NO: 274441 - DNA, 20 bp, Artificial Sequence
  Description of Artificial Sequence: Synthetic oligonucleotide
  Target: ATXN1; (+) strand; PAM type: YTN; PAM sequence: CTG
agggaaagaaacttcctttc

SEQ ID NO: 274442 - DNA, 20 bp, Artificial Sequence
  Description of Artificial Sequence: Synthetic oligonucleotide
  Target: ATXN1; (+) strand; PAM type: YTN; PAM sequence: CTT
cctttctgtgagctggacaa

SEQ ID NO: 274443 - DNA, 20 bp, Artificial Sequence
  Description of Artificial Sequence: Synthetic oligonucleotide
  Target: ATXN1; (+) strand; PAM type: YTN; PAM sequence: TTC
ctttctgtgagctggacaag

SEQ ID NO: 274444 - DNA, 20 bp, Artificial Sequence
  Description of Artificial Sequence: Synthetic oligonucleotide
  Target: ATXN1; (+) strand; PAM type: YTN; PAM sequence: CTT
tctgtgagctggacaaggta

SEQ ID NO: 274445 - DNA, 20 bp, Artificial Sequence
  Description of Artificial Sequence: Synthetic oligonucleotide
  Target: ATXN1; (+) strand; PAM type: YTN; PAM sequence: TTT
ctgtgagctggacaaggtaa

SEQ ID NO: 274446 - DNA, 20 bp, Artificial Sequence
  Description of Artificial Sequence: Synthetic oligonucleotide
  Target: ATXN1; (+) strand; PAM type: YTN; PAM sequence: TTC
tgtgagctggacaaggtaat

SEQ ID NO: 274447 - DNA, 20 bp, Artificial Sequence
  Description of Artificial Sequence: Synthetic oligonucleotide
  Target: ATXN1; (+) strand; PAM type: YTN; PAM sequence: CTG
tgagctggacaaggtaatag

SEQ ID NO: 274448 - DNA, 20 bp, Artificial Sequence
  Description of Artificial Sequence: Synthetic oligonucleotide
  Target: ATXN1; (+) strand; PAM type: YTN; PAM sequence: CTG
gacaaggtaatagcaacaat

SEQ ID NO: 274449 - DNA, 20 bp, Artificial Sequence
  Description of Artificial Sequence: Synthetic oligonucleotide
  Target: ATXN1; (+) strand; PAM type: YTN; PAM sequence: CTC
gcacgaggcaaagcatgtga

SEQ ID NO: 274450 - DNA, 20 bp, Artificial Sequence
  Description of Artificial Sequence: Synthetic oligonucleotide
  Target: ATXN1; (+) strand; PAM type: YTN; PAM sequence: CTA
caagggaaaccatcctctcc

SEQ ID NO: 274451 - DNA, 20 bp, Artificial Sequence
  Description of Artificial Sequence: Synthetic oligonucleotide
  Target: ATXN1; (+) strand; PAM type: YTN; PAM sequence: CTC
tccaaaggacccagtgatga

SEQ ID NO: 274452 - DNA, 20 bp, Artificial Sequence
  Description of Artificial Sequence: Synthetic oligonucleotide
  Target: ATXN1; (+) strand; PAM type: YTN; PAM sequence: CTC
caaaggacccagtgatgagg

SEQ ID NO: 274453 - DNA, 20 bp, Artificial Sequence
  Description of Artificial Sequence: Synthetic oligonucleotide
  Target: ATXN1; (+) strand; PAM type: YTN; PAM sequence: CTT
ggttccaagcaggagaaaac

SEQ ID NO: 274454 - DNA, 20 bp, Artificial Sequence
  Description of Artificial Sequence: Synthetic oligonucleotide
  Target: ATXN1; (+) strand; PAM type: YTN; PAM sequence: TTG
gttccaagcaggagaaaact

SEQ ID NO: 274455 - DNA, 20 bp, Artificial Sequence
  Description of Artificial Sequence: Synthetic oligonucleotide
  Target: ATXN1; (+) strand; PAM type: YTN; PAM sequence: TTC
caagcaggagaaaactagag

SEQ ID NO: 274456 - DNA, 20 bp, Artificial Sequence
  Description of Artificial Sequence: Synthetic oligonucleotide
  Target: ATXN1; (+) strand; PAM type: YTN; PAM sequence: CTA
gagagtgcatgctgtcacac

SEQ ID NO: 274457 - DNA, 20 bp, Artificial Sequence
  Description of Artificial Sequence: Synthetic oligonucleotide
  Target: ATXN1; (+) strand; PAM type: YTN; PAM sequence: CTG
tcacacactttttcttggtg

SEQ ID NO: 274458 - DNA, 20 bp, Artificial Sequence
  Description of Artificial Sequence: Synthetic oligonucleotide
  Target: ATXN1; (+) strand; PAM type: YTN; PAM sequence: CTT
tttcttggtgcatcatagta

SEQ ID NO: 274459 - DNA, 20 bp, Artificial Sequence
  Description of Artificial Sequence: Synthetic oligonucleotide
  Target: ATXN1; (+) strand; PAM type: YTN; PAM sequence: TTT
ttcttggtgcatcatagtaa

SEQ ID NO: 274460 - DNA, 20 bp, Artificial Sequence
  Description of Artificial Sequence: Synthetic oligonucleotide
  Target: ATXN1; (+) strand; PAM type: YTN; PAM sequence: TTT
tcttggtgcatcatagtaat

SEQ ID NO: 274461 - DNA, 20 bp, Artificial Sequence
  Description of Artificial Sequence: Synthetic oligonucleotide
  Target: ATXN1; (+) strand; PAM type: YTN; PAM sequence: TTT
cttggtgcatcatagtaatt

SEQ ID NO: 274462 - DNA, 20 bp, Artificial Sequence
  Description of Artificial Sequence: Synthetic oligonucleotide
  Target: ATXN1; (+) strand; PAM type: YTN; PAM sequence: TTC
ttggtgcatcatagtaattg

SEQ ID NO: 274463 - DNA, 20 bp, Artificial Sequence
  Description of Artificial Sequence: Synthetic oligonucleotide
  Target: ATXN1; (+) strand; PAM type: YTN; PAM sequence: CTT
ggtgcatcatagtaattgga

SEQ ID NO: 274464 - DNA, 20 bp, Artificial Sequence
  Description of Artificial Sequence: Synthetic oligonucleotide
  Target: ATXN1; (+) strand; PAM type: YTN; PAM sequence: TTG
gtgcatcatagtaattggat

SEQ ID NO: 274465 - DNA, 20 bp, Artificial Sequence
  Description of Artificial Sequence: Synthetic oligonucleotide
  Target: ATXN1; (+) strand; PAM type: YTN; PAM sequence: TTG
gataatattttgatgtgggt

SEQ ID NO: 274466 - DNA, 20 bp, Artificial Sequence
  Description of Artificial Sequence: Synthetic oligonucleotide
  Target: ATXN1; (+) strand; PAM type: YTN; PAM sequence: TTT
tgatgtgggtaaaaatacat

SEQ ID NO: 274467 - DNA, 20 bp, Artificial Sequence
  Description of Artificial Sequence: Synthetic oligonucleotide
  Target: ATXN1; (+) strand; PAM type: YTN; PAM sequence: TTT
gatgtgggtaaaaatacatg

SEQ ID NO: 274468 - DNA, 20 bp, Artificial Sequence
  Description of Artificial Sequence: Synthetic oligonucleotide
  Target: ATXN1; (+) strand; PAM type: YTN; PAM sequence: TTG
atgtgggtaaaaatacatga

SEQ ID NO: 274469 - DNA, 20 bp, Artificial Sequence
  Description of Artificial Sequence: Synthetic oligonucleotide
  Target: ATXN1; (+) strand; PAM type: YTN; PAM sequence: TTC
aaaggatcactcaccctatg

SEQ ID NO: 274470 - DNA, 20 bp, Artificial Sequence
  Description of Artificial Sequence: Synthetic oligonucleotide
  Target: ATXN1; (+) strand; PAM type: YTN; PAM sequence: CTC
accctatgaaaacagcacgt

SEQ ID NO: 274471 - DNA, 20 bp, Artificial Sequence
  Description of Artificial Sequence: Synthetic oligonucleotide
  Target: ATXN1; (+) strand; PAM type: YTN; PAM sequence: CTA
tgaaaacagcacgtcgattt

SEQ ID NO: 274472 - DNA, 20 bp, Artificial Sequence
  Description of Artificial Sequence: Synthetic oligonucleotide
  Target: ATXN1; (+) strand; PAM type: YTN; PAM sequence: TTT
ctttctcacgaagaaaatgg

SEQ ID NO: 274473 - DNA, 20 bp, Artificial Sequence
  Description of Artificial Sequence: Synthetic oligonucleotide
  Target: ATXN1; (+) strand; PAM type: YTN; PAM sequence: TTC
tttctcacgaagaaaatggt

SEQ ID NO: 274474 - DNA, 20 bp, Artificial Sequence
  Description of Artificial Sequence: Synthetic oligonucleotide
  Target: ATXN1; (+) strand; PAM type: YTN; PAM sequence: CTT
tctcacgaagaaaatggtct

SEQ ID NO: 274475 - DNA, 20 bp, Artificial Sequence
  Description of Artificial Sequence: Synthetic oligonucleotide
  Target: ATXN1; (+) strand; PAM type: YTN; PAM sequence: TTT
ctcacgaagaaaatggtcta

SEQ ID NO: 274476 - DNA, 20 bp, Artificial Sequence
  Description of Artificial Sequence: Synthetic oligonucleotide
  Target: ATXN1; (+) strand; PAM type: YTN; PAM sequence: TTC
tcacgaagaaaatggtctaa

SEQ ID NO: 274477 - DNA, 20 bp, Artificial Sequence
  Description of Artificial Sequence: Synthetic oligonucleotide
  Target: ATXN1; (+) strand; PAM type: YTN; PAM sequence: CTC
acgaagaaaatggtctaatt

SEQ ID NO: 274478 - DNA, 20 bp, Artificial Sequence
  Description of Artificial Sequence: Synthetic oligonucleotide
  Target: ATXN1; (+) strand; PAM type: YTN; PAM sequence: CTA
atttctttggaaaactggaa

SEQ ID NO: 274479 - DNA, 20 bp, Artificial Sequence
  Description of Artificial Sequence: Synthetic oligonucleotide
  Target: ATXN1; (+) strand; PAM type: YTN; PAM sequence: TTT
ctttggaaaactggaataga

SEQ ID NO: 274480 - DNA, 20 bp, Artificial Sequence
  Description of Artificial Sequence: Synthetic oligonucleotide
  Target: ATXN1; (+) strand; PAM type: YTN; PAM sequence: TTC
tttggaaaactggaatagaa

SEQ ID NO: 274481 - DNA, 20 bp, Artificial Sequence
  Description of Artificial Sequence: Synthetic oligonucleotide
  Target: ATXN1; (+) strand; PAM type: YTN; PAM sequence: CTT
tggaaaactggaatagaaaa

SEQ ID NO: 274482 - DNA, 20 bp, Artificial Sequence
  Description of Artificial Sequence: Synthetic oligonucleotide
  Target: ATXN1; (+) strand; PAM type: YTN; PAM sequence: TTT
ggaaaactggaatagaaaaa

SEQ ID NO: 274483 - DNA, 20 bp, Artificial Sequence
  Description of Artificial Sequence: Synthetic oligonucleotide
  Target: ATXN1; (+) strand; PAM type: YTN; PAM sequence: TTG
gaaaactggaatagaaaaaa

SEQ ID NO: 274484 - DNA, 20 bp, Artificial Sequence
  Description of Artificial Sequence: Synthetic oligonucleotide
  Target: ATXN1; (+) strand; PAM type: YTN; PAM sequence: CTG
gaatagaaaaaaagattttt

SEQ ID NO: 274485 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaaattaataactc

SEQ ID NO: 274486 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaattaataactcc

SEQ ID NO: 274487 - DNA, 20 bp, Artificial Sequence
  Description of Artificial Sequence: Synthetic oligonucleotide
  Target: ATXN1; (+) strand; PAM type: YTN; PAM sequence: TTT
taaaaaaattaataactcca

SEQ ID NO: 274488 - DNA, 20 bp, Artificial Sequence
  Description of Artificial Sequence: Synthetic oligonucleotide
  Target: ATXN1; (+) strand; PAM type: YTN; PAM sequence: TTT
aaaaaaattaataactccat

SEQ ID NO: 274489 - DNA, 20 bp, Artificial Sequence
  Description of Artificial Sequence: Synthetic oligonucleotide
  Target: ATXN1; (+) strand; PAM type: YTN; PAM sequence: TTA
aaaaaattaataactccatt

SEQ ID NO: 274490 - DNA, 20 bp, Artificial Sequence
  Description of Artificial Sequence: Synthetic oligonucleotide
  Target: ATXN1; (+) strand; PAM type: YTN; PAM sequence: TTA
ataactccattctctaaatc

SEQ ID NO: 274491 - DNA, 20 bp, Artificial Sequence
  Description of Artificial Sequence: Synthetic oligonucleotide
  Target: ATXN1; (+) strand; PAM type: YTN; PAM sequence: CTC
cattctctaaatcagtccaa

SEQ ID NO: 274492 - DNA, 20 bp, Artificial Sequence
  Description of Artificial Sequence: Synthetic oligonucleotide
  Target: ATXN1; (+) strand; PAM type: YTN; PAM sequence: TTC
tctaaatcagtccaaatgag

SEQ ID NO: 274493 - DNA, 20 bp, Artificial Sequence
  Description of Artificial Sequence: Synthetic oligonucleotide
  Target: ATXN1; (+) strand; PAM type: YTN; PAM sequence: CTC
taaatcagtccaaatgagca

SEQ ID NO: 274494 - DNA, 20 bp, Artificial Sequence
  Description of Artificial Sequence: Synthetic oligonucleotide
  Target: ATXN1; (+) strand; PAM type: YTN; PAM sequence: CTA
aatcagtccaaatgagcagg

SEQ ID NO: 274495 - DNA, 20 bp, Artificial Sequence
  Description of Artificial Sequence: Synthetic oligonucleotide
  Target: ATXN1; (+) strand; PAM type: YTN; PAM sequence: CTA
gaggtgataagaaattccag

SEQ ID NO: 274496 - DNA, 20 bp, Artificial Sequence
  Description of Artificial Sequence: Synthetic oligonucleotide
  Target: ATXN1; (+) strand; PAM type: YTN; PAM sequence: TTC
cagcccctagcactttggcc

SEQ ID NO: 274497 - DNA, 20 bp, Artificial Sequence
  Description of Artificial Sequence: Synthetic oligonucleotide
  Target: ATXN1; (+) strand; PAM type: YTN; PAM sequence: CTA
gcactttggcctttattagg

SEQ ID NO: 274498 - DNA, 20 bp, Artificial Sequence
  Description of Artificial Sequence: Synthetic oligonucleotide
  Target: ATXN1; (+) strand; PAM type: YTN; PAM sequence: CTT
tggcctttattaggtgcaca

SEQ ID NO: 274499 - DNA, 20 bp, Artificial Sequence
  Description of Artificial Sequence: Synthetic oligonucleotide
  Target: ATXN1; (+) strand; PAM type: YTN; PAM sequence: TTT
ggcctttattaggtgcacaa

SEQ ID NO: 274500 - DNA, 20 bp, Artificial Sequence
  Description of Artificial Sequence: Synthetic oligonucleotide
  Target: ATXN1; (+) strand; PAM type: YTN; PAM sequence: TTG
gcctttattaggtgcacaat

SEQ ID NO: 274501 - DNA, 20 bp, Artificial Sequence
  Description of Artificial Sequence: Synthetic oligonucleotide
  Target: ATXN1; (+) strand; PAM type: YTN; PAM sequence: CTT
tattaggtgcacaataaatg

SEQ ID NO: 274502 - DNA, 20 bp, Artificial Sequence
  Description of Artificial Sequence: Synthetic oligonucleotide
  Target: ATXN1; (+) strand; PAM type: YTN; PAM sequence: TTT
attaggtgcacaataaatgt

SEQ ID NO: 274503 - DNA, 20 bp, Artificial Sequence
  Description of Artificial Sequence: Synthetic oligonucleotide
  Target: ATXN1; (+) strand; PAM type: YTN; PAM sequence: TTA
ttaggtgcacaataaatgtc

SEQ ID NO: 274504 - DNA, 20 bp, Artificial Sequence
  Description of Artificial Sequence: Synthetic oligonucleotide
  Target: ATXN1; (+) strand; PAM type: YTN; PAM sequence: TTA
ggtgcacaataaatgtctga

SEQ ID NO: 274505 - DNA, 20 bp, Artificial Sequence
  Description of Artificial Sequence: Synthetic oligonucleotide
  Target: ATXN1; (+) strand; PAM type: YTN; PAM sequence: CTG
aagaacaatagatgcgtgat

SEQ ID NO: 274506 - DNA, 20 bp, Artificial Sequence
  Description of Artificial Sequence: Synthetic oligonucleotide
  Target: ATXN1; (+) strand; PAM type: YTN; PAM sequence: TTA
tttggctgactatatgaatt

SEQ ID NO: 274507 - DNA, 20 bp, Artificial Sequence
  Description of Artificial Sequence: Synthetic oligonucleotide
  Target: ATXN1; (+) strand; PAM type: YTN; PAM sequence: TTT
ggctgactatatgaatttta

SEQ ID NO: 274508 - DNA, 20 bp, Artificial Sequence
  Description of Artificial Sequence: Synthetic oligonucleotide
  Target: ATXN1; (+) strand; PAM type: YTN; PAM sequence: TTG
gctgactatatgaattttaa

SEQ ID NO: 274509 - DNA, 20 bp, Artificial Sequence
  Description of Artificial Sequence: Synthetic oligonucleotide
  Target: ATXN1; (+) strand; PAM type: YTN; PAM sequence: CTG
actatatgaattttaaaagc

SEQ ID NO: 274510 - DNA, 20 bp, Artificial Sequence
  Description of Artificial Sequence: Synthetic oligonucleotide
  Target: ATXN1; (+) strand; PAM type: YTN; PAM sequence: CTA
tatgaattttaaaagcagag

SEQ ID NO: 274511 - DNA, 20 bp, Artificial Sequence
  Description of Artificial Sequence: Synthetic oligonucleotide
  Target: ATXN1; (+) strand; PAM type: YTN; PAM sequence: TTT
taaaagcagagctttgaaca

SEQ ID NO: 274512 - DNA, 20 bp, Artificial Sequence
  Description of Artificial Sequence: Synthetic oligonucleotide
  Target: ATXN1; (+) strand; PAM type: YTN; PAM sequence: TTT
aaaagcagagctttgaacaa

SEQ ID NO: 274513 - DNA, 20 bp, Artificial Sequence
  Description of Artificial Sequence: Synthetic oligonucleotide
  Target: ATXN1; (+) strand; PAM type: YTN; PAM sequence: TTA
aaagcagagctttgaacaat

SEQ ID NO: 274514 - DNA, 20 bp, Artificial Sequence
  Description of Artificial Sequence: Synthetic oligonucleotide
  Target: ATXN1; (+) strand; PAM type: YTN; PAM sequence: CTT
tgaacaatcaatatgtagag

SEQ ID NO: 274515 - DNA, 20 bp, Artificial Sequence
  Description of Artificial Sequence: Synthetic oligonucleotide
  Target: ATXN1; (+) strand; PAM type: YTN; PAM sequence: TTT
gaacaatcaatatgtagaga

SEQ ID NO: 274516 - DNA, 20 bp, Artificial Sequence
  Description of Artificial Sequence: Synthetic oligonucleotide
  Target: ATXN1; (+) strand; PAM type: YTN; PAM sequence: TTG
aacaatcaatatgtagagaa

SEQ ID NO: 274517 - DNA, 20 bp, Artificial Sequence
  Description of Artificial Sequence: Synthetic oligonucleotide
  Target: ATXN1; (+) strand; PAM type: YTN; PAM sequence: TTC
atttatcatgagatgtatgg

SEQ ID NO: 274518 - DNA, 20 bp, Artificial Sequence
  Description of Artificial Sequence: Synthetic oligonucleotide
  Target: ATXN1; (+) strand; PAM type: YTN; PAM sequence: TTT
atcatgagatgtatggtcct

SEQ ID NO: 274519 - DNA, 20 bp, Artificial Sequence
  Description of Artificial Sequence: Synthetic oligonucleotide
  Target: ATXN1; (+) strand; PAM type: YTN; PAM sequence: TTA
tcatgagatgtatggtcctt

SEQ ID NO: 274520 - DNA, 20 bp, Artificial Sequence
  Description of Artificial Sequence: Synthetic oligonucleotide
  Target: ATXN1; (+) strand; PAM type: YTN; PAM sequence: CTT
gtgacaaggagtccatattg

SEQ ID NO: 274521 - DNA, 20 bp, Artificial Sequence
  Description of Artificial Sequence: Synthetic oligonucleotide
  Target: ATXN1; (+) strand; PAM type: YTN; PAM sequence: TTG
tgacaaggagtccatattgt

SEQ ID NO: 274522 - DNA, 20 bp, Artificial Sequence
  Description of Artificial Sequence: Synthetic oligonucleotide
  Target: ATXN1; (+) strand; PAM type: YTN; PAM sequence: TTG
tggtgcccaagaaatcaatt

SEQ ID NO: 274523 - DNA, 20 bp, Artificial Sequence
  Description of Artificial Sequence: Synthetic oligonucleotide
  Target: ATXN1; (+) strand; PAM type: YTN; PAM sequence: TTT
tttaggtgcctttcttaaaa

SEQ ID NO: 274524 - DNA, 20 bp, Artificial Sequence
  Description of Artificial Sequence: Synthetic oligonucleotide
  Target: ATXN1; (+) strand; PAM type: YTN; PAM sequence: TTT
ttaggtgcctttcttaaaat

SEQ ID NO: 274525 - DNA, 20 bp, Artificial Sequence
  Description of Artificial Sequence: Synthetic oligonucleotide
  Target: ATXN1; (+) strand; PAM type: YTN; PAM sequence: TTT
taggtgcctttcttaaaatg

SEQ ID NO: 274526 - DNA, 20 bp, Artificial Sequence
  Description of Artificial Sequence: Synthetic oligonucleotide
  Target: ATXN1; (+) strand; PAM type: YTN; PAM sequence: TTT
aggtgcctttcttaaaatgt

SEQ ID NO: 274527 - DNA, 20 bp, Artificial Sequence
  Description of Artificial Sequence: Synthetic oligonucleotide
  Target: ATXN1; (+) strand; PAM type: YTN; PAM sequence: TTA
ggtgcctttcttaaaatgtc

SEQ ID NO: 274528 - DNA, 20 bp, Artificial Sequence
  Description of Artificial Sequence: Synthetic oligonucleotide
  Target: ATXN1; (+) strand; PAM type: YTN; PAM sequence: CTT
tcttaaaatgtcatgtcctc

SEQ ID NO: 274529 - DNA, 20 bp, Artificial Sequence
  Description of Artificial Sequence: Synthetic oligonucleotide
  Target: ATXN1; (+) strand; PAM type: YTN; PAM sequence: TTT
cttaaaatgtcatgtcctcc

SEQ ID NO: 274530 - DNA, 20 bp, Artificial Sequence
  Description of Artificial Sequence: Synthetic oligonucleotide
  Target: ATXN1; (+) strand; PAM type: YTN; PAM sequence: TTC
ttaaaatgtcatgtcctcca

SEQ ID NO: 274531 - DNA, 20 bp, Artificial Sequence
  Description of Artificial Sequence: Synthetic oligonucleotide
  Target: ATXN1; (+) strand; PAM type: YTN; PAM sequence: CTT
aaaatgtcatgtcctccatg

SEQ ID NO: 274532 - DNA, 20 bp, Artificial Sequence
  Description of Artificial Sequence: Synthetic oligonucleotide
  Target: ATXN1; (+) strand; PAM type: YTN; PAM sequence: TTA
aaatgtcatgtcctccatgc

SEQ ID NO: 274533 - DNA, 20 bp, Artificial Sequence
  Description of Artificial Sequence: Synthetic oligonucleotide
  Target: ATXN1; (+) strand; PAM type: YTN; PAM sequence: CTC
catgcccaccatgatgctta

SEQ ID NO: 274534 - DNA, 20 bp, Artificial Sequence
  Description of Artificial Sequence: Synthetic oligonucleotide
  Target: ATXN1; (+) strand; PAM type: YTN; PAM sequence: CTT
attgaagaagtctttttttg

SEQ ID NO: 274535 - DNA, 20 bp, Artificial Sequence
  Description of Artificial Sequence: Synthetic oligonucleotide
  Target: ATXN1; (+) strand; PAM type: YTN; PAM sequence: TTA
ttgaagaagtctttttttgt

SEQ ID NO: 274536 - DNA, 20 bp, Artificial Sequence
  Description of Artificial Sequence: Synthetic oligonucleotide
  Target: ATXN1; (+) strand; PAM type: YTN; PAM sequence: TTG
aagaagtctttttttgtatt

SEQ ID NO: 274537 - DNA, 20 bp, Artificial Sequence
  Description of Artificial Sequence: Synthetic oligonucleotide
  Target: ATXN1; (+) strand; PAM type: YTN; PAM sequence: CTT
tttttgtatttttttgaagt

SEQ ID NO: 274538 - DNA, 20 bp, Artificial Sequence
  Description of Artificial Sequence: Synthetic oligonucleotide
  Target: ATXN1; (+) strand; PAM type: YTN; PAM sequence: TTT
ttttgtatttttttgaagta

SEQ ID NO: 274539 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttttgaagtaa

SEQ ID NO: 274540 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttttgaagtaat

SEQ ID NO: 274541 - DNA, 20 bp, Artificial Sequence
  Description of Artificial Sequence: Synthetic oligonucleotide
  Target: ATXN1; (+) strand; PAM type: YTN; PAM sequence: TTT
tgtatttttttgaagtaatg

SEQ ID NO: 274542 - DNA, 20 bp, Artificial Sequence
  Description of Artificial Sequence: Synthetic oligonucleotide
  Target: ATXN1; (+) strand; PAM type: YTN; PAM sequence: TTT
gtatttttttgaagtaatgt

SEQ ID NO: 274543 - DNA, 20 bp, Artificial Sequence
  Description of Artificial Sequence: Synthetic oligonucleotide
  Target: ATXN1; (+) strand; PAM type: YTN; PAM sequence: TTG
tatttttttgaagtaatgtt

SEQ ID NO: 274544 - DNA, 20 bp, Artificial Sequence
  Description of Artificial Sequence: Synthetic oligonucleotide
  Target: ATXN1; (+) strand; PAM type: YTN; PAM sequence: TTT
ttttgaagtaatgtttctgt

SEQ ID NO: 274545 - DNA, 20 bp, Artificial Sequence
  Description of Artificial Sequence: Synthetic oligonucleotide
  Target: ATXN1; (+) strand; PAM type: YTN; PAM sequence: TTT
tttgaagtaatgtttctgta

SEQ ID NO: 274546 - DNA, 20 bp, Artificial Sequence
  Description of Artificial Sequence: Synthetic oligonucleotide
  Target: ATXN1; (+) strand; PAM type: YTN; PAM sequence: TTT
ttgaagtaatgtttctgtag

SEQ ID NO: 274547 - DNA, 20 bp, Artificial Sequence
  Description of Artificial Sequence: Synthetic oligonucleotide
  Target: ATXN1; (+) strand; PAM type: YTN; PAM sequence: TTT
tgaagtaatgtttctgtaga

SEQ ID NO: 274548 - DNA, 20 bp, Artificial Sequence
  Description of Artificial Sequence: Synthetic oligonucleotide
  Target: ATXN1; (+) strand; PAM type: YTN; PAM sequence: TTT
gaagtaatgtttctgtagag

SEQ ID NO: 274549 - DNA, 20 bp, Artificial Sequence
  Description of Artificial Sequence: Synthetic oligonucleotide
  Target: ATXN1; (+) strand; PAM type: YTN; PAM sequence: TTG
aagtaatgtttctgtagaga

SEQ ID NO: 274550 - DNA, 20 bp, Artificial Sequence
  Description of Artificial Sequence: Synthetic oligonucleotide
  Target: ATXN1; (+) strand; PAM type: YTN; PAM sequence: TTT
ctgtagagatggggtctcac

SEQ ID NO: 274551 - DNA, 20 bp, Artificial Sequence
  Description of Artificial Sequence: Synthetic oligonucleotide
  Target: ATXN1; (+) strand; PAM type: YTN; PAM sequence: TTC
tgtagagatggggtctcact

SEQ ID NO: 274552 - DNA, 20 bp, Artificial Sequence
  Description of Artificial Sequence: Synthetic oligonucleotide
  Target: ATXN1; (+) strand; PAM type: YTN; PAM sequence: CTG
tagagatggggtctcactat

SEQ ID NO: 274553 - DNA, 20 bp, Artificial Sequence
  Description of Artificial Sequence: Synthetic oligonucleotide
  Target: ATXN1; (+) strand; PAM type: YTN; PAM sequence: CTC
actatgttgcccaggctggt

SEQ ID NO: 274554 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaggctggtcttg

SEQ ID NO: 274555 - DNA, 20 bp, Artificial Sequence
  Description of Artificial Sequence: Synthetic oligonucleotide
  Target: ATXN1; (+) strand; PAM type: YTN; PAM sequence: TTG
cccaggctggtcttgaactc

SEQ ID NO: 274556 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctggcctca

SEQ ID NO: 274557 - DNA, 20 bp, Artificial Sequence
  Description of Artificial Sequence: Synthetic oligonucleotide
  Target: ATXN1; (+) strand; PAM type: YTN; PAM sequence: CTT
gaactcctggcctcaagcgc

SEQ ID NO: 274558 - DNA, 20 bp, Artificial Sequence
  Description of Artificial Sequence: Synthetic oligonucleotide
  Target: ATXN1; (+) strand; PAM type: YTN; PAM sequence: TTG
aactcctggcctcaagcgct

SEQ ID NO: 274559 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagcgctccttc

SEQ ID NO: 274560 - DNA, 20 bp, Artificial Sequence
  Description of Artificial Sequence: Synthetic oligonucleotide
  Target: ATXN1; (+) strand; PAM type: YTN; PAM sequence: CTG
gcctcaagcgctccttccac

SEQ ID NO: 274561 - DNA, 20 bp, Artificial Sequence
  Description of Artificial Sequence: Synthetic oligonucleotide
  Target: ATXN1; (+) strand; PAM type: YTN; PAM sequence: CTC
aagcgctccttccacctcag

SEQ ID NO: 274562 - DNA, 20 bp, Artificial Sequence
  Description of Artificial Sequence: Synthetic oligonucleotide
  Target: ATXN1; (+) strand; PAM type: YTN; PAM sequence: CTC
cttccacctcagcctcccaa

SEQ ID NO: 274563 - DNA, 20 bp, Artificial Sequence
  Description of Artificial Sequence: Synthetic oligonucleotide
  Target: ATXN1; (+) strand; PAM type: YTN; PAM sequence: CTT
ccacctcagcctcccaaagt

SEQ ID NO: 274564 - DNA, 20 bp, Artificial Sequence
  Description of Artificial Sequence: Synthetic oligonucleotide
  Target: ATXN1; (+) strand; PAM type: YTN; PAM sequence: TTC
cacctcagcctcccaaagtg

SEQ ID NO: 274565 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgttggga

SEQ ID NO: 274566 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgttgggattacag

SEQ ID NO: 274567 - DNA, 20 bp, Artificial Sequence
  Description of Artificial Sequence: Synthetic oligonucleotide
  Target: ATXN1; (+) strand; PAM type: YTN; PAM sequence: TTG
ggattacaggtttgagccat

SEQ ID NO: 274568 - DNA, 20 bp, Artificial Sequence
  Description of Artificial Sequence: Synthetic oligonucleotide
  Target: ATXN1; (+) strand; PAM type: YTN; PAM sequence: TTA
caggtttgagccatcgtacc

SEQ ID NO: 274569 - DNA, 20 bp, Artificial Sequence
  Description of Artificial Sequence: Synthetic oligonucleotide
  Target: ATXN1; (+) strand; PAM type: YTN; PAM sequence: TTT
gagccatcgtacccagccgt

SEQ ID NO: 274570 - DNA, 20 bp, Artificial Sequence
  Description of Artificial Sequence: Synthetic oligonucleotide
  Target: ATXN1; (+) strand; PAM type: YTN; PAM sequence: TTG
agccatcgtacccagccgtg

SEQ ID NO: 274571 - DNA, 20 bp, Artificial Sequence
  Description of Artificial Sequence: Synthetic oligonucleotide
  Target: ATXN1; (+) strand; PAM type: YTN; PAM sequence: TTT
tatttttttgagatagggtc

SEQ ID NO: 274572 - DNA, 20 bp, Artificial Sequence
  Description of Artificial Sequence: Synthetic oligonucleotide
  Target: ATXN1; (+) strand; PAM type: YTN; PAM sequence: TTT
atttttttgagatagggtct

SEQ ID NO: 274573 - DNA, 20 bp, Artificial Sequence
  Description of Artificial Sequence: Synthetic oligonucleotide
  Target: ATXN1; (+) strand; PAM type: YTN; PAM sequence: TTA
tttttttgagatagggtctt

SEQ ID NO: 274574 - DNA, 20 bp, Artificial Sequence
  Description of Artificial Sequence: Synthetic oligonucleotide
  Target: ATXN1; (+) strand; PAM type: YTN; PAM sequence: TTT
ttttgagatagggtcttgct

SEQ ID NO: 274575 - DNA, 20 bp, Artificial Sequence
  Description of Artificial Sequence: Synthetic oligonucleotide
  Target: ATXN1; (+) strand; PAM type: YTN; PAM sequence: TTT
tttgagatagggtcttgctt

SEQ ID NO: 274576 - DNA, 20 bp, Artificial Sequence
  Description of Artificial Sequence: Synthetic oligonucleotide
  Target: ATXN1; (+) strand; PAM type: YTN; PAM sequence: TTT
ttgagatagggtcttgcttt

SEQ ID NO: 274577 - DNA, 20 bp, Artificial Sequence
  Description of Artificial Sequence: Synthetic oligonucleotide
  Target: ATXN1; (+) strand; PAM type: YTN; PAM sequence: TTT
tgagatagggtcttgctttg

SEQ ID NO: 274578 - DNA, 20 bp, Artificial Sequence
  Description of Artificial Sequence: Synthetic oligonucleotide
  Target: ATXN1; (+) strand; PAM type: YTN; PAM sequence: TTT
gagatagggtcttgctttgt

SEQ ID NO: 274579 - DNA, 20 bp, Artificial Sequence
  Description of Artificial Sequence: Synthetic oligonucleotide
  Target: ATXN1; (+) strand; PAM type: YTN; PAM sequence: TTG
agatagggtcttgctttgtt

SEQ ID NO: 274580 - DNA, 20 bp, Artificial Sequence
  Description of Artificial Sequence: Synthetic oligonucleotide
  Target: ATXN1; (+) strand; PAM type: YTN; PAM sequence: CTT
gctttgttacccgggtttgt

SEQ ID NO: 274581 - DNA, 20 bp, Artificial Sequence
  Description of Artificial Sequence: Synthetic oligonucleotide
  Target: ATXN1; (+) strand; PAM type: YTN; PAM sequence: TTG
ctttgttacccgggtttgtc

SEQ ID NO: 274582 - DNA, 20 bp, Artificial Sequence
  Description of Artificial Sequence: Synthetic oligonucleotide
  Target: ATXN1; (+) strand; PAM type: YTN; PAM sequence: CTT
tgttacccgggtttgtcata

SEQ ID NO: 274583 - DNA, 20 bp, Artificial Sequence
  Description of Artificial Sequence: Synthetic oligonucleotide
  Target: ATXN1; (+) strand; PAM type: YTN; PAM sequence: TTT
gttacccgggtttgtcatag

SEQ ID NO: 274584 - DNA, 20 bp, Artificial Sequence
  Description of Artificial Sequence: Synthetic oligonucleotide
  Target: ATXN1; (+) strand; PAM type: YTN; PAM sequence: TTG
ttacccgggtttgtcataga

SEQ ID NO: 274585 - DNA, 20 bp, Artificial Sequence
  Description of Artificial Sequence: Synthetic oligonucleotide
  Target: ATXN1; (+) strand; PAM type: YTN; PAM sequence: TTA
cccgggtttgtcatagatcc

SEQ ID NO: 274586 - DNA, 20 bp, Artificial Sequence
  Description of Artificial Sequence: Synthetic oligonucleotide
  Target: ATXN1; (+) strand; PAM type: YTN; PAM sequence: TTT
gtcatagatccgtgcccatt

SEQ ID NO: 274587 - DNA, 20 bp, Artificial Sequence
  Description of Artificial Sequence: Synthetic oligonucleotide
  Target: ATXN1; (+) strand; PAM type: YTN; PAM sequence: TTG
tcatagatccgtgcccattt

SEQ ID NO: 274588 - DNA, 20 bp, Artificial Sequence
  Description of Artificial Sequence: Synthetic oligonucleotide
  Target: ATXN1; (+) strand; PAM type: YTN; PAM sequence: TTT
tatagctggaaaccctgagg

SEQ ID NO: 274589 - DNA, 20 bp, Artificial Sequence
  Description of Artificial Sequence: Synthetic oligonucleotide
  Target: ATXN1; (+) strand; PAM type: YTN; PAM sequence: TTT
atagctggaaaccctgaggc

SEQ ID NO: 274590 - DNA, 20 bp, Artificial Sequence
  Description of Artificial Sequence: Synthetic oligonucleotide
  Target: ATXN1; (+) strand; PAM type: YTN; PAM sequence: TTA
tagctggaaaccctgaggcc

SEQ ID NO: 274591 - DNA, 20 bp, Artificial Sequence
  Description of Artificial Sequence: Synthetic oligonucleotide
  Target: ATXN1; (+) strand; PAM type: YTN; PAM sequence: CTG
gaaaccctgaggcccagggg

SEQ ID NO: 274592 - DNA, 20 bp, Artificial Sequence
  Description of Artificial Sequence: Synthetic oligonucleotide
  Target: ATXN1; (+) strand; PAM type: YTN; PAM sequence: CTG
aggcccaggggactgagcca

SEQ ID NO: 274593 - DNA, 20 bp, Artificial Sequence
  Description of Artificial Sequence: Synthetic oligonucleotide
  Target: ATXN1; (+) strand; PAM type: YTN; PAM sequence: CTG
agccacttgctcacgtgcac

SEQ ID NO: 274594 - DNA, 20 bp, Artificial Sequence
  Description of Artificial Sequence: Synthetic oligonucleotide
  Target: ATXN1; (+) strand; PAM type: YTN; PAM sequence: CTT
gctcacgtgcacatggctgt

SEQ ID NO: 274595 - DNA, 20 bp, Artificial Sequence
  Description of Artificial Sequence: Synthetic oligonucleotide
  Target: ATXN1; (+) strand; PAM type: YTN; PAM sequence: TTG
ctcacgtgcacatggctgtg

SEQ ID NO: 274596 - DNA, 20 bp, Artificial Sequence
  Description of Artificial Sequence: Synthetic oligonucleotide
  Target: ATXN1; (+) strand; PAM type: YTN; PAM sequence: CTC
acgtgcacatggctgtgagt

SEQ ID NO: 274597 - DNA, 20 bp, Artificial Sequence
  Description of Artificial Sequence: Synthetic oligonucleotide
  Target: ATXN1; (+) strand; PAM type: YTN; PAM sequence: CTG
tgagtggcagagctgagctc

SEQ ID NO: 274598 - DNA, 20 bp, Artificial Sequence
  Description of Artificial Sequence: Synthetic oligonucleotide
  Target: ATXN1; (+) strand; PAM type: YTN; PAM sequence: CTG
agctcagaccctgggatcct

SEQ ID NO: 274599 - DNA, 20 bp, Artificial Sequence
  Description of Artificial Sequence: Synthetic oligonucleotide
  Target: ATXN1; (+) strand; PAM type: YTN; PAM sequence: CTC
agaccctgggatcctccctc

SEQ ID NO: 274600 - DNA, 20 bp, Artificial Sequence
  Description of Artificial Sequence: Synthetic oligonucleotide
  Target: ATXN1; (+) strand; PAM type: YTN; PAM sequence: CTG
ggatcctccctccaaagtcc

SEQ ID NO: 274601 - DNA, 20 bp, Artificial Sequence
  Description of Artificial Sequence: Synthetic oligonucleotide
  Target: ATXN1; (+) strand; PAM type: YTN; PAM sequence: CTC
cctccaaagtccctctcatg

SEQ ID NO: 274602 - DNA, 20 bp, Artificial Sequence
  Description of Artificial Sequence: Synthetic oligonucleotide
  Target: ATXN1; (+) strand; PAM type: YTN; PAM sequence: CTC
caaagtccctctcatggggg

SEQ ID NO: 274603 - DNA, 20 bp, Artificial Sequence
  Description of Artificial Sequence: Synthetic oligonucleotide
  Target: ATXN1; (+) strand; PAM type: YTN; PAM sequence: CTC
tcatgggggaattcagtgac

SEQ ID NO: 274604 - DNA, 20 bp, Artificial Sequence
  Description of Artificial Sequence: Synthetic oligonucleotide
  Target: ATXN1; (+) strand; PAM type: YTN; PAM sequence: CTC
atgggggaattcagtgaccg

SEQ ID NO: 274605 - DNA, 20 bp, Artificial Sequence
  Description of Artificial Sequence: Synthetic oligonucleotide
  Target: ATXN1; (+) strand; PAM type: YTN; PAM sequence: TTC
agtgaccgtggatggggatg

SEQ ID NO: 274606 - DNA, 20 bp, Artificial Sequence
  Description of Artificial Sequence: Synthetic oligonucleotide
  Target: ATXN1; (+) strand; PAM type: YTN; PAM sequence: CTC
actgcagcctccaactccta

SEQ ID NO: 274607 - DNA, 20 bp, Artificial Sequence
  Description of Artificial Sequence: Synthetic oligonucleotide
  Target: ATXN1; (+) strand; PAM type: YTN; PAM sequence: CTG
cagcctccaactcctagact

SEQ ID NO: 274608 - DNA, 20 bp, Artificial Sequence
  Description of Artificial Sequence: Synthetic oligonucleotide
  Target: ATXN1; (+) strand; PAM type: YTN; PAM sequence: CTC
caactcctagactcaaactc

SEQ ID NO: 274609 - DNA, 20 bp, Artificial Sequence
  Description of Artificial Sequence: Synthetic oligonucleotide
  Target: ATXN1; (+) strand; PAM type: YTN; PAM sequence: CTC
ctagactcaaactcctgcct

SEQ ID NO: 274610 - DNA, 20 bp, Artificial Sequence
  Description of Artificial Sequence: Synthetic oligonucleotide
  Target: ATXN1; (+) strand; PAM type: YTN; PAM sequence: CTA
gactcaaactcctgccttag

SEQ ID NO: 274611 - DNA, 20 bp, Artificial Sequence
  Description of Artificial Sequence: Synthetic oligonucleotide
  Target: ATXN1; (+) strand; PAM type: YTN; PAM sequence: CTC
aaactcctgccttagccgcc

SEQ ID NO: 274612 - DNA, 20 bp, Artificial Sequence
  Description of Artificial Sequence: Synthetic oligonucleotide
  Target: ATXN1; (+) strand; PAM type: YTN; PAM sequence: CTC
ctgccttagccgccaagtag

SEQ ID NO: 274613 - DNA, 20 bp, Artificial Sequence
  Description of Artificial Sequence: Synthetic oligonucleotide
  Target: ATXN1; (+) strand; PAM type: YTN; PAM sequence: CTG
ccttagccgccaagtagctg

SEQ ID NO: 274614 - DNA, 20 bp, Artificial Sequence
  Description of Artificial Sequence: Synthetic oligonucleotide
  Target: ATXN1; (+) strand; PAM type: YTN; PAM sequence: CTT
agccgccaagtagctgggac

SEQ ID NO: 274615 - DNA, 20 bp, Artificial Sequence
  Description of Artificial Sequence: Synthetic oligonucleotide
  Target: ATXN1; (+) strand; PAM type: YTN; PAM sequence: TTA
gccgccaagtagctgggact

SEQ ID NO: 274616 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcatgtgccac

SEQ ID NO: 274617 - DNA, 20 bp, Artificial Sequence
  Description of Artificial Sequence: Synthetic oligonucleotide
  Target: ATXN1; (+) strand; PAM type: YTN; PAM sequence: CTA
caggcatgtgccaccacacc

SEQ ID NO: 274618 - DNA, 20 bp, Artificial Sequence
  Description of Artificial Sequence: Synthetic oligonucleotide
  Target: ATXN1; (+) strand; PAM type: YTN; PAM sequence: CTG
gattaaaatgttgtgttttt

SEQ ID NO: 274619 - DNA, 20 bp, Artificial Sequence
  Description of Artificial Sequence: Synthetic oligonucleotide
  Target: ATXN1; (+) strand; PAM type: YTN; PAM sequence: TTA
aaatgttgtgttttttcttt

SEQ ID NO: 274620 - DNA, 20 bp, Artificial Sequence
  Description of Artificial Sequence: Synthetic oligonucleotide
  Target: ATXN1; (+) strand; PAM type: YTN; PAM sequence: TTG
tgttttttctttatttgcgg

SEQ ID NO: 274621 - DNA, 20 bp, Artificial Sequence
  Description of Artificial Sequence: Synthetic oligonucleotide
  Target: ATXN1; (+) strand; PAM type: YTN; PAM sequence: TTT
tttctttatttgcggagatg

SEQ ID NO: 274622 - DNA, 20 bp, Artificial Sequence
  Description of Artificial Sequence: Synthetic oligonucleotide
  Target: ATXN1; (+) strand; PAM type: YTN; PAM sequence: TTT
ttctttatttgcggagatgg

SEQ ID NO: 274623 - DNA, 20 bp, Artificial Sequence
  Description of Artificial Sequence: Synthetic oligonucleotide
  Target: ATXN1; (+) strand; PAM type: YTN; PAM sequence: TTT
tctttatttgcggagatgga

SEQ ID NO: 274624 - DNA, 20 bp, Artificial Sequence
  Description of Artificial Sequence: Synthetic oligonucleotide
  Target: ATXN1; (+) strand; PAM type: YTN; PAM sequence: TTT
ctttatttgcggagatggag

SEQ ID NO: 274625 - DNA, 20 bp, Artificial Sequence
  Description of Artificial Sequence: Synthetic oligonucleotide
  Target: ATXN1; (+) strand; PAM type: YTN; PAM sequence: TTC
tttatttgcggagatggagt

SEQ ID NO: 274626 - DNA, 20 bp, Artificial Sequence
  Description of Artificial Sequence: Synthetic oligonucleotide
  Target: ATXN1; (+) strand; PAM type: YTN; PAM sequence: CTT
tatttgcggagatggagttt

SEQ ID NO: 274627 - DNA, 20 bp, Artificial Sequence
  Description of Artificial Sequence: Synthetic oligonucleotide
  Target: ATXN1; (+) strand; PAM type: YTN; PAM sequence: TTT
atttgcggagatggagtttt

SEQ ID NO: 274628 - DNA, 20 bp, Artificial Sequence
  Description of Artificial Sequence: Synthetic oligonucleotide
  Target: ATXN1; (+) strand; PAM type: YTN; PAM sequence: TTA
tttgcggagatggagttttg

SEQ ID NO: 274629 - DNA, 20 bp, Artificial Sequence
  Description of Artificial Sequence: Synthetic oligonucleotide
  Target: ATXN1; (+) strand; PAM type: YTN; PAM sequence: TTT
gcggagatggagttttgcta

SEQ ID NO: 274630 - DNA, 20 bp, Artificial Sequence
  Description of Artificial Sequence: Synthetic oligonucleotide
  Target: ATXN1; (+) strand; PAM type: YTN; PAM sequence: TTG
cggagatggagttttgctac

SEQ ID NO: 274631 - DNA, 20 bp, Artificial Sequence
  Description of Artificial Sequence: Synthetic oligonucleotide
  Target: ATXN1; (+) strand; PAM type: YTN; PAM sequence: TTT
tgctacattgccaggctgtg

SEQ ID NO: 274632 - DNA, 20 bp, Artificial Sequence
  Description of Artificial Sequence: Synthetic oligonucleotide
  Target: ATXN1; (+) strand; PAM type: YTN; PAM sequence: TTT
gctacattgccaggctgtga

SEQ ID NO: 274633 - DNA, 20 bp, Artificial Sequence
  Description of Artificial Sequence: Synthetic oligonucleotide
  Target: ATXN1; (+) strand; PAM type: YTN; PAM sequence: TTG
ctacattgccaggctgtgaa

SEQ ID NO: 274634 - DNA, 20 bp, Artificial Sequence
  Description of Artificial Sequence: Synthetic oligonucleotide
  Target: ATXN1; (+) strand; PAM type: YTN; PAM sequence: CTA
cattgccaggctgtgaagaa

SEQ ID NO: 274635 - DNA, 20 bp, Artificial Sequence
  Description of Artificial Sequence: Synthetic oligonucleotide
  Target: ATXN1; (+) strand; PAM type: YTN; PAM sequence: TTG
ccaggctgtgaagaagtctt

SEQ ID NO: 274636 - DNA, 20 bp, Artificial Sequence
  Description of Artificial Sequence: Synthetic oligonucleotide
  Target: ATXN1; (+) strand; PAM type: YTN; PAM sequence: CTG
tgaagaagtcttaataaata

SEQ ID NO: 274637 - DNA, 20 bp, Artificial Sequence
  Description of Artificial Sequence: Synthetic oligonucleotide
  Target: ATXN1; (+) strand; PAM type: YTN; PAM sequence: CTT
aataaataaccaaagtaccc

SEQ ID NO: 274638 - DNA, 20 bp, Artificial Sequence
  Description of Artificial Sequence: Synthetic oligonucleotide
  Target: ATXN1; (+) strand; PAM type: YTN; PAM sequence: TTA
ataaataaccaaagtacccc

SEQ ID NO: 274639 - DNA, 20 bp, Artificial Sequence
  Description of Artificial Sequence: Synthetic oligonucleotide
  Target: ATXN1; (+) strand; PAM type: YTN; PAM sequence: TTC
ctgcactttgctctttccca

SEQ ID NO: 274640 - DNA, 20 bp, Artificial Sequence
  Description of Artificial Sequence: Synthetic oligonucleotide
  Target: ATXN1; (+) strand; PAM type: YTN; PAM sequence: CTG
cactttgctctttcccaaaa

SEQ ID NO: 274641 - DNA, 20 bp, Artificial Sequence
  Description of Artificial Sequence: Synthetic oligonucleotide
  Target: ATXN1; (+) strand; PAM type: YTN; PAM sequence: CTT
tgctctttcccaaaatggta

SEQ ID NO: 274642 - DNA, 20 bp, Artificial Sequence
  Description of Artificial Sequence: Synthetic oligonucleotide
  Target: ATXN1; (+) strand; PAM type: YTN; PAM sequence: TTT
gctctttcccaaaatggtat

SEQ ID NO: 274643 - DNA, 20 bp, Artificial Sequence
  Description of Artificial Sequence: Synthetic oligonucleotide
  Target: ATXN1; (+) strand; PAM type: YTN; PAM sequence: TTG
ctctttcccaaaatggtata

SEQ ID NO: 274644 - DNA, 20 bp, Artificial Sequence
  Description of Artificial Sequence: Synthetic oligonucleotide
  Target: ATXN1; (+) strand; PAM type: YTN; PAM sequence: CTC
tttcccaaaatggtataccc

SEQ ID NO: 274645 - DNA, 20 bp, Artificial Sequence
  Description of Artificial Sequence: Synthetic oligonucleotide
  Target: ATXN1; (+) strand; PAM type: YTN; PAM sequence: CTT
tcccaaaatggtatacccac

SEQ ID NO: 274646 - DNA, 20 bp, Artificial Sequence
  Description of Artificial Sequence: Synthetic oligonucleotide
  Target: ATXN1; (+) strand; PAM type: YTN; PAM sequence: TTT
cccaaaatggtatacccaca

SEQ ID NO: 274647 - DNA, 20 bp, Artificial Sequence
  Description of Artificial Sequence: Synthetic oligonucleotide
  Target: ATXN1; (+) strand; PAM type: YTN; PAM sequence: TTC
ccaaaatggtatacccacag

SEQ ID NO: 274648 - DNA, 20 bp, Artificial Sequence
  Description of Artificial Sequence: Synthetic oligonucleotide
  Target: ATXN1; (+) strand; PAM type: YTN; PAM sequence: CTT
cactccctgcagtgatctgt

SEQ ID NO: 274649 - DNA, 20 bp, Artificial Sequence
  Description of Artificial Sequence: Synthetic oligonucleotide
  Target: ATXN1; (+) strand; PAM type: YTN; PAM sequence: TTC
actccctgcagtgatctgta

SEQ ID NO: 274650 - DNA, 20 bp, Artificial Sequence
  Description of Artificial Sequence: Synthetic oligonucleotide
  Target: ATXN1; (+) strand; PAM type: YTN; PAM sequence: CTC
cctgcagtgatctgtatgta

SEQ ID NO: 274651 - DNA, 20 bp, Artificial Sequence
  Description of Artificial Sequence: Synthetic oligonucleotide
  Target: ATXN1; (+) strand; PAM type: YTN; PAM sequence: CTG
cagtgatctgtatgtaatta

SEQ ID NO: 274652 - DNA, 20 bp, Artificial Sequence
  Description of Artificial Sequence: Synthetic oligonucleotide
  Target: ATXN1; (+) strand; PAM type: YTN; PAM sequence: CTG
tatgtaattaggctcatatg

SEQ ID NO: 274653 - DNA, 20 bp, Artificial Sequence
  Description of Artificial Sequence: Synthetic oligonucleotide
  Target: ATXN1; (+) strand; PAM type: YTN; PAM sequence: TTA
ggctcatatgggaatgtgga

SEQ ID NO: 274654 - DNA, 20 bp, Artificial Sequence
  Description of Artificial Sequence: Synthetic oligonucleotide
  Target: ATXN1; (+) strand; PAM type: YTN; PAM sequence: CTC
atatgggaatgtggacttgg

SEQ ID NO: 274655 - DNA, 20 bp, Artificial Sequence
  Description of Artificial Sequence: Synthetic oligonucleotide
  Target: ATXN1; (+) strand; PAM type: YTN; PAM sequence: CTT
ggcagaggggcgctggaggc

SEQ ID NO: 274656 - DNA, 20 bp, Artificial Sequence
  Description of Artificial Sequence: Synthetic oligonucleotide
  Target: ATXN1; (+) strand; PAM type: YTN; PAM sequence: TTG
gcagaggggcgctggaggcc

SEQ ID NO: 274657 - DNA, 20 bp, Artificial Sequence
  Description of Artificial Sequence: Synthetic oligonucleotide
  Target: ATXN1; (+) strand; PAM type: YTN; PAM sequence: CTG
gaggccacatatcaggctga

SEQ ID NO: 274658 - DNA, 20 bp, Artificial Sequence
  Description of Artificial Sequence: Synthetic oligonucleotide
  Target: ATXN1; (+) strand; PAM type: YTN; PAM sequence: CTG
actgagtaatcccgtgagga

SEQ ID NO: 274659 - DNA, 20 bp, Artificial Sequence
  Description of Artificial Sequence: Synthetic oligonucleotide
  Target: ATXN1; (+) strand; PAM type: YTN; PAM sequence: CTG
agtaatcccgtgaggaagcc

SEQ ID NO: 274660 - DNA, 20 bp, Artificial Sequence
  Description of Artificial Sequence: Synthetic oligonucleotide
  Target: ATXN1; (+) strand; PAM type: YTN; PAM sequence: CTG
agatactgacgggccaaaca

SEQ ID NO: 274661 - DNA, 20 bp, Artificial Sequence
  Description of Artificial Sequence: Synthetic oligonucleotide
  Target: ATXN1; (+) strand; PAM type: YTN; PAM sequence: CTG
acgggccaaacaaagtgtgg

SEQ ID NO: 274662 - DNA, 20 bp, Artificial Sequence
  Description of Artificial Sequence: Synthetic oligonucleotide
  Target: ATXN1; (+) strand; PAM type: YTN; PAM sequence: TTG
gacagaggaagcctgaaaga

SEQ ID NO: 274663 - DNA, 20 bp, Artificial Sequence
  Description of Artificial Sequence: Synthetic oligonucleotide
  Target: ATXN1; (+) strand; PAM type: YTN; PAM sequence: CTG
aaagaaagggagataaggga

SEQ ID NO: 274664 - DNA, 20 bp, Artificial Sequence
  Description of Artificial Sequence: Synthetic oligonucleotide
  Target: ATXN1; (+) strand; PAM type: YTN; PAM sequence: CTA
tttaatctacaccacacaag

SEQ ID NO: 274665 - DNA, 20 bp, Artificial Sequence
  Description of Artificial Sequence: Synthetic oligonucleotide
  Target: ATXN1; (+) strand; PAM type: YTN; PAM sequence: TTT
aatctacaccacacaaggaa

SEQ ID NO: 274666 - DNA, 20 bp, Artificial Sequence
  Description of Artificial Sequence: Synthetic oligonucleotide
  Target: ATXN1; (+) strand; PAM type: YTN; PAM sequence: TTA
atctacaccacacaaggaac

SEQ ID NO: 274667 - DNA, 20 bp, Artificial Sequence
  Description of Artificial Sequence: Synthetic oligonucleotide
  Target: ATXN1; (+) strand; PAM type: YTN; PAM sequence: CTA
caccacacaaggaactaagt

SEQ ID NO: 274668 - DNA, 20 bp, Artificial Sequence
  Description of Artificial Sequence: Synthetic oligonucleotide
  Target: ATXN1; (+) strand; PAM type: YTN; PAM sequence: CTA
agttcaagatccaactcaac

SEQ ID NO: 274669 - DNA, 20 bp, Artificial Sequence
  Description of Artificial Sequence: Synthetic oligonucleotide
  Target: ATXN1; (+) strand; PAM type: YTN; PAM sequence: TTC
aagatccaactcaacaataa

SEQ ID NO: 274670 - DNA, 20 bp, Artificial Sequence
  Description of Artificial Sequence: Synthetic oligonucleotide
  Target: ATXN1; (+) strand; PAM type: YTN; PAM sequence: CTC
aacaataatctccagagact

SEQ ID NO: 274671 - DNA, 20 bp, Artificial Sequence
  Description of Artificial Sequence: Synthetic oligonucleotide
  Target: ATXN1; (+) strand; PAM type: YTN; PAM sequence: CTC
cagagactattttaaagacg

SEQ ID NO: 274672 - DNA, 20 bp, Artificial Sequence
  Description of Artificial Sequence: Synthetic oligonucleotide
  Target: ATXN1; (+) strand; PAM type: YTN; PAM sequence: CTA
ttttaaagacgcctttgcag

SEQ ID NO: 274673 - DNA, 20 bp, Artificial Sequence
  Description of Artificial Sequence: Synthetic oligonucleotide
  Target: ATXN1; (+) strand; PAM type: YTN; PAM sequence: TTT
taaagacgcctttgcaggtt

SEQ ID NO: 274674 - DNA, 20 bp, Artificial Sequence
  Description of Artificial Sequence: Synthetic oligonucleotide
  Target: ATXN1; (+) strand; PAM type: YTN; PAM sequence: TTT
aaagacgcctttgcaggttt

SEQ ID NO: 274675 - DNA, 20 bp, Artificial Sequence
  Description of Artificial Sequence: Synthetic oligonucleotide
  Target: ATXN1; (+) strand; PAM type: YTN; PAM sequence: TTA
aagacgcctttgcaggttta

SEQ ID NO: 274676 - DNA, 20 bp, Artificial Sequence
  Description of Artificial Sequence: Synthetic oligonucleotide
  Target: ATXN1; (+) strand; PAM type: YTN; PAM sequence: CTT
tgcaggtttaagagaggctg

SEQ ID NO: 274677 - DNA, 20 bp, Artificial Sequence
  Description of Artificial Sequence: Synthetic oligonucleotide
  Target: ATXN1; (+) strand; PAM type: YTN; PAM sequence: TTT
gcaggtttaagagaggctgt

SEQ ID NO: 274678 - DNA, 20 bp, Artificial Sequence
  Description of Artificial Sequence: Synthetic oligonucleotide
  Target: ATXN1; (+) strand; PAM type: YTN; PAM sequence: TTG
caggtttaagagaggctgtg

SEQ ID NO: 274679 - DNA, 20 bp, Artificial Sequence
  Description of Artificial Sequence: Synthetic oligonucleotide
  Target: ATXN1; (+) strand; PAM type: YTN; PAM sequence: TTT
aagagaggctgtgaggcaaa

SEQ ID NO: 274680 - DNA, 20 bp, Artificial Sequence
  Description of Artificial Sequence: Synthetic oligonucleotide
  Target: ATXN1; (+) strand; PAM type: YTN; PAM sequence: TTA
agagaggctgtgaggcaaag

SEQ ID NO: 274681 - DNA, 20 bp, Artificial Sequence
  Description of Artificial Sequence: Synthetic oligonucleotide
  Target: ATXN1; (+) strand; PAM type: YTN; PAM sequence: CTG
tgaggcaaagctattccagc

SEQ ID NO: 274682 - DNA, 20 bp, Artificial Sequence
  Description of Artificial Sequence: Synthetic oligonucleotide
  Target: ATXN1; (+) strand; PAM type: YTN; PAM sequence: CTA
ttccagctcctgatgttctg

SEQ ID NO: 274683 - DNA, 20 bp, Artificial Sequence
  Description of Artificial Sequence: Synthetic oligonucleotide
  Target: ATXN1; (+) strand; PAM type: YTN; PAM sequence: TTC
cagctcctgatgttctgtgg

SEQ ID NO: 274684 - DNA, 20 bp, Artificial Sequence
  Description of Artificial Sequence: Synthetic oligonucleotide
  Target: ATXN1; (+) strand; PAM type: YTN; PAM sequence: CTC
ctgatgttctgtgggcaagt

SEQ ID NO: 274685 - DNA, 20 bp, Artificial Sequence
  Description of Artificial Sequence: Synthetic oligonucleotide
  Target: ATXN1; (+) strand; PAM type: YTN; PAM sequence: CTG
atgttctgtgggcaagtttc

SEQ ID NO: 274686 - DNA, 20 bp, Artificial Sequence
  Description of Artificial Sequence: Synthetic oligonucleotide
  Target: ATXN1; (+) strand; PAM type: YTN; PAM sequence: TTC
tgtgggcaagtttcccagga

SEQ ID NO: 274687 - DNA, 20 bp, Artificial Sequence
  Description of Artificial Sequence: Synthetic oligonucleotide
  Target: ATXN1; (+) strand; PAM type: YTN; PAM sequence: CTG
tgggcaagtttcccaggatt

SEQ ID NO: 274688 - DNA, 20 bp, Artificial Sequence
  Description of Artificial Sequence: Synthetic oligonucleotide
  Target: ATXN1; (+) strand; PAM type: YTN; PAM sequence: TTT
cccaggattccagcatcttt

SEQ ID NO: 274689 - DNA, 20 bp, Artificial Sequence
  Description of Artificial Sequence: Synthetic oligonucleotide
  Target: ATXN1; (+) strand; PAM type: YTN; PAM sequence: TTC
ccaggattccagcatctttg

SEQ ID NO: 274690 - DNA, 20 bp, Artificial Sequence
  Description of Artificial Sequence: Synthetic oligonucleotide
  Target: ATXN1; (+) strand; PAM type: YTN; PAM sequence: TTC
cagcatctttgggattcatt

SEQ ID NO: 274691 - DNA, 20 bp, Artificial Sequence
  Description of Artificial Sequence: Synthetic oligonucleotide
  Target: ATXN1; (+) strand; PAM type: YTN; PAM sequence: CTT
tgggattcattctatgagct

SEQ ID NO: 274692 - DNA, 20 bp, Artificial Sequence
  Description of Artificial Sequence: Synthetic oligonucleotide
  Target: ATXN1; (+) strand; PAM type: YTN; PAM sequence: TTT
gggattcattctatgagctg

SEQ ID NO: 274693 - DNA, 20 bp, Artificial Sequence
  Description of Artificial Sequence: Synthetic oligonucleotide
  Target: ATXN1; (+) strand; PAM type: YTN; PAM sequence: TTG
ggattcattctatgagctgt

SEQ ID NO: 274694 - DNA, 20 bp, Artificial Sequence
  Description of Artificial Sequence: Synthetic oligonucleotide
  Target: ATXN1; (+) strand; PAM type: YTN; PAM sequence: TTC
attctatgagctgtggaagg

SEQ ID NO: 274695 - DNA, 20 bp, Artificial Sequence
  Description of Artificial Sequence: Synthetic oligonucleotide
  Target: ATXN1; (+) strand; PAM type: YTN; PAM sequence: TTC
tatgagctgtggaaggccac

SEQ ID NO: 274696 - DNA, 20 bp, Artificial Sequence
  Description of Artificial Sequence: Synthetic oligonucleotide
  Target: ATXN1; (+) strand; PAM type: YTN; PAM sequence: CTA
tgagctgtggaaggccacag

SEQ ID NO: 274697 - DNA, 20 bp, Artificial Sequence
  Description of Artificial Sequence: Synthetic oligonucleotide
  Target: ATXN1; (+) strand; PAM type: YTN; PAM sequence: CTG
tggaaggccacagctttccc

SEQ ID NO: 274698 - DNA, 20 bp, Artificial Sequence
  Description of Artificial Sequence: Synthetic oligonucleotide
  Target: ATXN1; (+) strand; PAM type: YTN; PAM sequence: CTT
tcccgcccttttcatcagag

SEQ ID NO: 274699 - DNA, 20 bp, Artificial Sequence
  Description of Artificial Sequence: Synthetic oligonucleotide
  Target: ATXN1; (+) strand; PAM type: YTN; PAM sequence: TTT
cccgcccttttcatcagagg

SEQ ID NO: 274700 - DNA, 20 bp, Artificial Sequence
  Description of Artificial Sequence: Synthetic oligonucleotide
  Target: ATXN1; (+) strand; PAM type: YTN; PAM sequence: TTC
ccgcccttttcatcagagga

SEQ ID NO: 274701 - DNA, 20 bp, Artificial Sequence
  Description of Artificial Sequence: Synthetic oligonucleotide
  Target: ATXN1; (+) strand; PAM type: YTN; PAM sequence: CTT
ttcatcagaggacgtggacg

SEQ ID NO: 274702 - DNA, 20 bp, Artificial Sequence
  Description of Artificial Sequence: Synthetic oligonucleotide
  Target: ATXN1; (+) strand; PAM type: YTN; PAM sequence: TTT
tcatcagaggacgtggacgg

SEQ ID NO: 274703 - DNA, 20 bp, Artificial Sequence
  Description of Artificial Sequence: Synthetic oligonucleotide
  Target: ATXN1; (+) strand; PAM type: YTN; PAM sequence: TTT
catcagaggacgtggacggc

SEQ ID NO: 274704 - DNA, 20 bp, Artificial Sequence
  Description of Artificial Sequence: Synthetic oligonucleotide
  Target: ATXN1; (+) strand; PAM type: YTN; PAM sequence: TTC
atcagaggacgtggacggca

SEQ ID NO: 274705 - DNA, 20 bp, Artificial Sequence
  Description of Artificial Sequence: Synthetic oligonucleotide
  Target: ATXN1; (+) strand; PAM type: YTN; PAM sequence: CTT
tttcaggatggcccaccagc

SEQ ID NO: 274706 - DNA, 20 bp, Artificial Sequence
  Description of Artificial Sequence: Synthetic oligonucleotide
  Target: ATXN1; (+) strand; PAM type: YTN; PAM sequence: TTT
ttcaggatggcccaccagcc

SEQ ID NO: 274707 - DNA, 20 bp, Artificial Sequence
  Description of Artificial Sequence: Synthetic oligonucleotide
  Target: ATXN1; (+) strand; PAM type: YTN; PAM sequence: TTT
tcaggatggcccaccagcct

SEQ ID NO: 274708 - DNA, 20 bp, Artificial Sequence
  Description of Artificial Sequence: Synthetic oligonucleotide
  Target: ATXN1; (+) strand; PAM type: YTN; PAM sequence: TTT
caggatggcccaccagcctg

SEQ ID NO: 274709 - DNA, 20 bp, Artificial Sequence
  Description of Artificial Sequence: Synthetic oligonucleotide
  Target: ATXN1; (+) strand; PAM type: YTN; PAM sequence: TTC
aggatggcccaccagcctgc

SEQ ID NO: 274710 - DNA, 20 bp, Artificial Sequence
  Description of Artificial Sequence: Synthetic oligonucleotide
  Target: ATXN1; (+) strand; PAM type: YTN; PAM sequence: CTG
caggaagattcccagactca

SEQ ID NO: 274711 - DNA, 20 bp, Artificial Sequence
  Description of Artificial Sequence: Synthetic oligonucleotide
  Target: ATXN1; (+) strand; PAM type: YTN; PAM sequence: TTC
ccagactcagttcctcagaa

SEQ ID NO: 274712 - DNA, 20 bp, Artificial Sequence
  Description of Artificial Sequence: Synthetic oligonucleotide
  Target: ATXN1; (+) strand; PAM type: YTN; PAM sequence: CTC
agttcctcagaatctgaagg

SEQ ID NO: 274713 - DNA, 20 bp, Artificial Sequence
  Description of Artificial Sequence: Synthetic oligonucleotide
  Target: ATXN1; (+) strand; PAM type: YTN; PAM sequence: TTC
ctcagaatctgaagggcact

SEQ ID NO: 274714 - DNA, 20 bp, Artificial Sequence
  Description of Artificial Sequence: Synthetic oligonucleotide
  Target: ATXN1; (+) strand; PAM type: YTN; PAM sequence: CTC
agaatctgaagggcactcct

SEQ ID NO: 274715 - DNA, 20 bp, Artificial Sequence
  Description of Artificial Sequence: Synthetic oligonucleotide
  Target: ATXN1; (+) strand; PAM type: YTN; PAM sequence: CTG
aagggcactcctccaagtcc

SEQ ID NO: 274716 - DNA, 20 bp, Artificial Sequence
  Description of Artificial Sequence: Synthetic oligonucleotide
  Target: ATXN1; (+) strand; PAM type: YTN; PAM sequence: CTC
ctccaagtcccacagagcag

SEQ ID NO: 274717 - DNA, 20 bp, Artificial Sequence
  Description of Artificial Sequence: Synthetic oligonucleotide
  Target: ATXN1; (+) strand; PAM type: YTN; PAM sequence: CTC
caagtcccacagagcagccc

SEQ ID NO: 274718 - DNA, 20 bp, Artificial Sequence
  Description of Artificial Sequence: Synthetic oligonucleotide
  Target: ATXN1; (+) strand; PAM type: YTN; PAM sequence: TTT
aacatgacacttactatgca

SEQ ID NO: 274719 - DNA, 20 bp, Artificial Sequence
  Description of Artificial Sequence: Synthetic oligonucleotide
  Target: ATXN1; (+) strand; PAM type: YTN; PAM sequence: TTA
acatgacacttactatgcag

SEQ ID NO: 274720 - DNA, 20 bp, Artificial Sequence
  Description of Artificial Sequence: Synthetic oligonucleotide
  Target: ATXN1; (+) strand; PAM type: YTN; PAM sequence: CTT
actatgcagtcagactatcc

SEQ ID NO: 274721 - DNA, 20 bp, Artificial Sequence
  Description of Artificial Sequence: Synthetic oligonucleotide
  Target: ATXN1; (+) strand; PAM type: YTN; PAM sequence: TTA
ctatgcagtcagactatcct

SEQ ID NO: 274722 - DNA, 20 bp, Artificial Sequence
  Description of Artificial Sequence: Synthetic oligonucleotide
  Target: ATXN1; (+) strand; PAM type: YTN; PAM sequence: CTA
tgcagtcagactatcctagg

SEQ ID NO: 274723 - DNA, 20 bp, Artificial Sequence
  Description of Artificial Sequence: Synthetic oligonucleotide
  Target: ATXN1; (+) strand; PAM type: YTN; PAM sequence: CTA
tcctaggctaggtggggctg

SEQ ID NO: 274724 - DNA, 20 bp, Artificial Sequence
  Description of Artificial Sequence: Synthetic oligonucleotide
  Target: ATXN1; (+) strand; PAM type: YTN; PAM sequence: CTA
ggctaggtggggctgcaaag

SEQ ID NO: 274725 - DNA, 20 bp, Artificial Sequence
  Description of Artificial Sequence: Synthetic oligonucleotide
  Target: ATXN1; (+) strand; PAM type: YTN; PAM sequence: CTA
ggtggggctgcaaagacaaa

SEQ ID NO: 274726 - DNA, 20 bp, Artificial Sequence
  Description of Artificial Sequence: Synthetic oligonucleotide
  Target: ATXN1; (+) strand; PAM type: YTN; PAM sequence: CTG
caaagacaaaggttatgctc

SEQ ID NO: 274727 - DNA, 20 bp, Artificial Sequence
  Description of Artificial Sequence: Synthetic oligonucleotide
  Target: ATXN1; (+) strand; PAM type: YTN; PAM sequence: TTA
tgctccaattgaaaaaaact

SEQ ID NO: 274728 - DNA, 20 bp, Artificial Sequence
  Description of Artificial Sequence: Synthetic oligonucleotide
  Target: ATXN1; (+) strand; PAM type: YTN; PAM sequence: CTC
caattgaaaaaaactgccag

SEQ ID NO: 274729 - DNA, 20 bp, Artificial Sequence
  Description of Artificial Sequence: Synthetic oligonucleotide
  Target: ATXN1; (+) strand; PAM type: YTN; PAM sequence: TTG
aaaaaaactgccagaaagcc

SEQ ID NO: 274730 - DNA, 20 bp, Artificial Sequence
  Description of Artificial Sequence: Synthetic oligonucleotide
  Target: ATXN1; (+) strand; PAM type: YTN; PAM sequence: CTG
ccagaaagccatgcaaacat

SEQ ID NO: 274731 - DNA, 20 bp, Artificial Sequence
  Description of Artificial Sequence: Synthetic oligonucleotide
  Target: ATXN1; (+) strand; PAM type: YTN; PAM sequence: TTG
aaaaatggtagatactggca

SEQ ID NO: 274732 - DNA, 20 bp, Artificial Sequence
  Description of Artificial Sequence: Synthetic oligonucleotide
  Target: ATXN1; (+) strand; PAM type: YTN; PAM sequence: CTG
gcaaaatctctgagtatctt

SEQ ID NO: 274733 - DNA, 20 bp, Artificial Sequence
  Description of Artificial Sequence: Synthetic oligonucleotide
  Target: ATXN1; (+) strand; PAM type: YTN; PAM sequence: CTC
tgagtatcttcttcgtttta

SEQ ID NO: 274734 - DNA, 20 bp, Artificial Sequence
  Description of Artificial Sequence: Synthetic oligonucleotide
  Target: ATXN1; (+) strand; PAM type: YTN; PAM sequence: CTG
agtatcttcttcgttttaaa

SEQ ID NO: 274735 - DNA, 20 bp, Artificial Sequence
  Description of Artificial Sequence: Synthetic oligonucleotide
  Target: ATXN1; (+) strand; PAM type: YTN; PAM sequence: CTT
cttcgttttaaagcaacact

SEQ ID NO: 274736 - DNA, 20 bp, Artificial Sequence
  Description of Artificial Sequence: Synthetic oligonucleotide
  Target: ATXN1; (+) strand; PAM type: YTN; PAM sequence: TTC
ttcgttttaaagcaacactt

SEQ ID NO: 274737 - DNA, 20 bp, Artificial Sequence
  Description of Artificial Sequence: Synthetic oligonucleotide
  Target: ATXN1; (+) strand; PAM type: YTN; PAM sequence: CTT
cgttttaaagcaacacttta

SEQ ID NO: 274738 - DNA, 20 bp, Artificial Sequence
  Description of Artificial Sequence: Synthetic oligonucleotide
  Target: ATXN1; (+) strand; PAM type: YTN; PAM sequence: TTC
gttttaaagcaacactttat

SEQ ID NO: 274739 - DNA, 20 bp, Artificial Sequence
  Description of Artificial Sequence: Synthetic oligonucleotide
  Target: ATXN1; (+) strand; PAM type: YTN; PAM sequence: TTT
taaagcaacactttataatc

SEQ ID NO: 274740 - DNA, 20 bp, Artificial Sequence
  Description of Artificial Sequence: Synthetic oligonucleotide
  Target: ATXN1; (+) strand; PAM type: YTN; PAM sequence: TTT
aaagcaacactttataatcc

SEQ ID NO: 274741 - DNA, 20 bp, Artificial Sequence
  Description of Artificial Sequence: Synthetic oligonucleotide
  Target: ATXN1; (+) strand; PAM type: YTN; PAM sequence: TTA
aagcaacactttataatcca

SEQ ID NO: 274742 - DNA, 20 bp, Artificial Sequence
  Description of Artificial Sequence: Synthetic oligonucleotide
  Target: ATXN1; (+) strand; PAM type: YTN; PAM sequence: CTT
tataatccactcacacgcat

SEQ ID NO: 274743 - DNA, 20 bp, Artificial Sequence
  Description of Artificial Sequence: Synthetic oligonucleotide
  Target: ATXN1; (+) strand; PAM type: YTN; PAM sequence: TTT
ataatccactcacacgcatt

SEQ ID NO: 274744 - DNA, 20 bp, Artificial Sequence
  Description of Artificial Sequence: Synthetic oligonucleotide
  Target: ATXN1; (+) strand; PAM type: YTN; PAM sequence: TTA
taatccactcacacgcattg

SEQ ID NO: 274745 - DNA, 20 bp, Artificial Sequence
  Description of Artificial Sequence: Synthetic oligonucleotide
  Target: ATXN1; (+) strand; PAM type: YTN; PAM sequence: CTC
acacgcattgaccttttcat

SEQ ID NO: 274746 - DNA, 20 bp, Artificial Sequence
  Description of Artificial Sequence: Synthetic oligonucleotide
  Target: ATXN1; (+) strand; PAM type: YTN; PAM sequence: TTG
accttttcatcctaacaaca

SEQ ID NO: 274747 - DNA, 20 bp, Artificial Sequence
  Description of Artificial Sequence: Synthetic oligonucleotide
  Target: ATXN1; (+) strand; PAM type: YTN; PAM sequence: CTT
ttcatcctaacaacagacga

SEQ ID NO: 274748 - DNA, 20 bp, Artificial Sequence
  Description of Artificial Sequence: Synthetic oligonucleotide
  Target: ATXN1; (+) strand; PAM type: YTN; PAM sequence: TTT
tcatcctaacaacagacgag

SEQ ID NO: 274749 - DNA, 20 bp, Artificial Sequence
  Description of Artificial Sequence: Synthetic oligonucleotide
  Target: ATXN1; (+) strand; PAM type: YTN; PAM sequence: TTT
catcctaacaacagacgaga

SEQ ID NO: 274750 - DNA, 20 bp, Artificial Sequence
  Description of Artificial Sequence: Synthetic oligonucleotide
  Target: ATXN1; (+) strand; PAM type: YTN; PAM sequence: TTC
atcctaacaacagacgagac

SEQ ID NO: 274751 - DNA, 20 bp, Artificial Sequence
  Description of Artificial Sequence: Synthetic oligonucleotide
  Target: ATXN1; (+) strand; PAM type: YTN; PAM sequence: CTA
acaacagacgagacgtctac

SEQ ID NO: 274752 - DNA, 20 bp, Artificial Sequence
  Description of Artificial Sequence: Synthetic oligonucleotide
  Target: ATXN1; (+) strand; PAM type: YTN; PAM sequence: CTA
cagtacgaattcttgagacc

SEQ ID NO: 274753 - DNA, 20 bp, Artificial Sequence
  Description of Artificial Sequence: Synthetic oligonucleotide
  Target: ATXN1; (+) strand; PAM type: YTN; PAM sequence: TTC
ttgagaccacgaaaactgat

SEQ ID NO: 274754 - DNA, 20 bp, Artificial Sequence
  Description of Artificial Sequence: Synthetic oligonucleotide
  Target: ATXN1; (+) strand; PAM type: YTN; PAM sequence: CTT
gagaccacgaaaactgattt

SEQ ID NO: 274755 - DNA, 20 bp, Artificial Sequence
  Description of Artificial Sequence: Synthetic oligonucleotide
  Target: ATXN1; (+) strand; PAM type: YTN; PAM sequence: TTG
agaccacgaaaactgatttc

SEQ ID NO: 274756 - DNA, 20 bp, Artificial Sequence
  Description of Artificial Sequence: Synthetic oligonucleotide
  Target: ATXN1; (+) strand; PAM type: YTN; PAM sequence: CTG
atttcaaagtcagacctcag

SEQ ID NO: 274757 - DNA, 20 bp, Artificial Sequence
  Description of Artificial Sequence: Synthetic oligonucleotide
  Target: ATXN1; (+) strand; PAM type: YTN; PAM sequence: TTT
caaagtcagacctcagtctg

SEQ ID NO: 274758 - DNA, 20 bp, Artificial Sequence
  Description of Artificial Sequence: Synthetic oligonucleotide
  Target: ATXN1; (+) strand; PAM type: YTN; PAM sequence: TTC
aaagtcagacctcagtctga

SEQ ID NO: 274759 - DNA, 20 bp, Artificial Sequence
  Description of Artificial Sequence: Synthetic oligonucleotide
  Target: ATXN1; (+) strand; PAM type: YTN; PAM sequence: CTC
agtctgagcctcagctgagt

SEQ ID NO: 274760 - DNA, 20 bp, Artificial Sequence
  Description of Artificial Sequence: Synthetic oligonucleotide
  Target: ATXN1; (+) strand; PAM type: YTN; PAM sequence: CTG
agcctcagctgagtcacaga

SEQ ID NO: 274761 - DNA, 20 bp, Artificial Sequence
  Description of Artificial Sequence: Synthetic oligonucleotide
  Target: ATXN1; (+) strand; PAM type: YTN; PAM sequence: CTC
agctgagtcacagaggagct

SEQ ID NO: 274762 - DNA, 20 bp, Artificial Sequence
  Description of Artificial Sequence: Synthetic oligonucleotide
  Target: ATXN1; (+) strand; PAM type: YTN; PAM sequence: CTG
agtcacagaggagctgtgtg

SEQ ID NO: 274763 - DNA, 20 bp, Artificial Sequence
  Description of Artificial Sequence: Synthetic oligonucleotide
  Target: ATXN1; (+) strand; PAM type: YTN; PAM sequence: CTG
tgtggttccagttacttaaa

SEQ ID NO: 274764 - DNA, 20 bp, Artificial Sequence
  Description of Artificial Sequence: Synthetic oligonucleotide
  Target: ATXN1; (+) strand; PAM type: YTN; PAM sequence: TTC
cagttacttaaactctctga

SEQ ID NO: 274765 - DNA, 20 bp, Artificial Sequence
  Description of Artificial Sequence: Synthetic oligonucleotide
  Target: ATXN1; (+) strand; PAM type: YTN; PAM sequence: TTA
cttaaactctctgaaccctt

SEQ ID NO: 274766 - DNA, 20 bp, Artificial Sequence
  Description of Artificial Sequence: Synthetic oligonucleotide
  Target: ATXN1; (+) strand; PAM type: YTN; PAM sequence: CTT
aaactctctgaaccctttcc

SEQ ID NO: 274767 - DNA, 20 bp, Artificial Sequence
  Description of Artificial Sequence: Synthetic oligonucleotide
  Target: ATXN1; (+) strand; PAM type: YTN; PAM sequence: TTA
aactctctgaaccctttcct

SEQ ID NO: 274768 - DNA, 20 bp, Artificial Sequence
  Description of Artificial Sequence: Synthetic oligonucleotide
  Target: ATXN1; (+) strand; PAM type: YTN; PAM sequence: CTC
tctgaaccctttcctcattt

SEQ ID NO: 274769 - DNA, 20 bp, Artificial Sequence
  Description of Artificial Sequence: Synthetic oligonucleotide
  Target: ATXN1; (+) strand; PAM type: YTN; PAM sequence: CTC
tgaaccctttcctcatttgt

SEQ ID NO: 274770 - DNA, 20 bp, Artificial Sequence
  Description of Artificial Sequence: Synthetic oligonucleotide
  Target: ATXN1; (+) strand; PAM type: YTN; PAM sequence: CTG
aaccctttcctcatttgtat

SEQ ID NO: 274771 - DNA, 20 bp, Artificial Sequence
  Description of Artificial Sequence: Synthetic oligonucleotide
  Target: ATXN1; (+) strand; PAM type: YTN; PAM sequence: CTT
tcctcatttgtataatggca

SEQ ID NO: 274772 - DNA, 20 bp, Artificial Sequence
  Description of Artificial Sequence: Synthetic oligonucleotide
  Target: ATXN1; (+) strand; PAM type: YTN; PAM sequence: TTT
cctcatttgtataatggcaa

SEQ ID NO: 274773 - DNA, 20 bp, Artificial Sequence
  Description of Artificial Sequence: Synthetic oligonucleotide
  Target: ATXN1; (+) strand; PAM type: YTN; PAM sequence: TTC
ctcatttgtataatggcaat

SEQ ID NO: 274774 - DNA, 20 bp, Artificial Sequence
  Description of Artificial Sequence: Synthetic oligonucleotide
  Target: ATXN1; (+) strand; PAM type: YTN; PAM sequence: CTC
atttgtataatggcaataac

SEQ ID NO: 274775 - DNA, 20 bp, Artificial Sequence
  Description of Artificial Sequence: Synthetic oligonucleotide
  Target: ATXN1; (+) strand; PAM type: YTN; PAM sequence: TTT
gtataatggcaataacaata

SEQ ID NO: 274776 - DNA, 20 bp, Artificial Sequence
  Description of Artificial Sequence: Synthetic oligonucleotide
  Target: ATXN1; (+) strand; PAM type: YTN; PAM sequence: TTG
tataatggcaataacaatat

SEQ ID NO: 274777 - DNA, 20 bp, Artificial Sequence
  Description of Artificial Sequence: Synthetic oligonucleotide
  Target: ATXN1; (+) strand; PAM type: YTN; PAM sequence: CTT
catagaatgtttctagtttt

SEQ ID NO: 274778 - DNA, 20 bp, Artificial Sequence
  Description of Artificial Sequence: Synthetic oligonucleotide
  Target: ATXN1; (+) strand; PAM type: YTN; PAM sequence: TTC
atagaatgtttctagttttt

SEQ ID NO: 274779 - DNA, 20 bp, Artificial Sequence
  Description of Artificial Sequence: Synthetic oligonucleotide
  Target: ATXN1; (+) strand; PAM type: YTN; PAM sequence: TTT
ctagtttttagtgtggcgct

SEQ ID NO: 274780 - DNA, 20 bp, Artificial Sequence
  Description of Artificial Sequence: Synthetic oligonucleotide
  Target: ATXN1; (+) strand; PAM type: YTN; PAM sequence: TTC
tagtttttagtgtggcgctt

SEQ ID NO: 274781 - DNA, 20 bp, Artificial Sequence
  Description of Artificial Sequence: Synthetic oligonucleotide
  Target: ATXN1; (+) strand; PAM type: YTN; PAM sequence: CTA
gtttttagtgtggcgcttgg

SEQ ID NO: 274782 - DNA, 20 bp, Artificial Sequence
  Description of Artificial Sequence: Synthetic oligonucleotide
  Target: ATXN1; (+) strand; PAM type: YTN; PAM sequence: TTT
ttagtgtggcgcttggtaca

SEQ ID NO: 274783 - DNA, 20 bp, Artificial Sequence
  Description of Artificial Sequence: Synthetic oligonucleotide
  Target: ATXN1; (+) strand; PAM type: YTN; PAM sequence: TTT
tagtgtggcgcttggtacac

SEQ ID NO: 274784 - DNA, 20 bp, Artificial Sequence
  Description of Artificial Sequence: Synthetic oligonucleotide
  Target: ATXN1; (+) strand; PAM type: YTN; PAM sequence: TTT
agtgtggcgcttggtacaca

SEQ ID NO: 274785 - DNA, 20 bp, Artificial Sequence
  Description of Artificial Sequence: Synthetic oligonucleotide
  Target: ATXN1; (+) strand; PAM type: YTN; PAM sequence: TTA
gtgtggcgcttggtacacag

SEQ ID NO: 274786 - DNA, 20 bp, Artificial Sequence
  Description of Artificial Sequence: Synthetic oligonucleotide
  Target: ATXN1; (+) strand; PAM type: YTN; PAM sequence: CTT
ggtacacagaagagactgaa

SEQ ID NO: 274787 - DNA, 20 bp, Artificial Sequence
  Description of Artificial Sequence: Synthetic oligonucleotide
  Target: ATXN1; (+) strand; PAM type: YTN; PAM sequence: TTG
gtacacagaagagactgaat

SEQ ID NO: 274788 - DNA, 20 bp, Artificial Sequence
  Description of Artificial Sequence: Synthetic oligonucleotide
  Target: ATXN1; (+) strand; PAM type: YTN; PAM sequence: CTG
aataaaacaaaaaggcatta

SEQ ID NO: 274789 - DNA, 20 bp, Artificial Sequence
  Description of Artificial Sequence: Synthetic oligonucleotide
  Target: ATXN1; (+) strand; PAM type: YTN; PAM sequence: TTA
tcaccatttggcacacaaca

SEQ ID NO: 274790 - DNA, 20 bp, Artificial Sequence
  Description of Artificial Sequence: Synthetic oligonucleotide
  Target: ATXN1; (+) strand; PAM type: YTN; PAM sequence: TTT
ggcacacaacatgttcatat

SEQ ID NO: 274791 - DNA, 20 bp, Artificial Sequence
  Description of Artificial Sequence: Synthetic oligonucleotide
  Target: ATXN1; (+) strand; PAM type: YTN; PAM sequence: TTG
gcacacaacatgttcatata

SEQ ID NO: 274792 - DNA, 20 bp, Artificial Sequence
  Description of Artificial Sequence: Synthetic oligonucleotide
  Target: ATXN1; (+) strand; PAM type: YTN; PAM sequence: TTC
atatatctgtaacaatggag

SEQ ID NO: 274793 - DNA, 20 bp, Artificial Sequence
  Description of Artificial Sequence: Synthetic oligonucleotide
  Target: ATXN1; (+) strand; PAM type: YTN; PAM sequence: CTG
taacaatggaggaaagacac

SEQ ID NO: 274794 - DNA, 20 bp, Artificial Sequence
  Description of Artificial Sequence: Synthetic oligonucleotide
  Target: ATXN1; (+) strand; PAM type: YTN; PAM sequence: CTT
tggtgacttaataatttgcc

SEQ ID NO: 274795 - DNA, 20 bp, Artificial Sequence
  Description of Artificial Sequence: Synthetic oligonucleotide
  Target: ATXN1; (+) strand; PAM type: YTN; PAM sequence: TTT
ggtgacttaataatttgcca

SEQ ID NO: 274796 - DNA, 20 bp, Artificial Sequence
  Description of Artificial Sequence: Synthetic oligonucleotide
  Target: ATXN1; (+) strand; PAM type: YTN; PAM sequence: TTG
gtgacttaataatttgccag

SEQ ID NO: 274797 - DNA, 20 bp, Artificial Sequence
  Description of Artificial Sequence: Synthetic oligonucleotide
  Target: ATXN1; (+) strand; PAM type: YTN; PAM sequence: CTT
aataatttgccagaatgtga

SEQ ID NO: 274798 - DNA, 20 bp, Artificial Sequence
  Description of Artificial Sequence: Synthetic oligonucleotide
  Target: ATXN1; (+) strand; PAM type: YTN; PAM sequence: TTA
ataatttgccagaatgtgac

SEQ ID NO: 274799 - DNA, 20 bp, Artificial Sequence
  Description of Artificial Sequence: Synthetic oligonucleotide
  Target: ATXN1; (+) strand; PAM type: YTN; PAM sequence: TTT
gccagaatgtgactgggcgt

SEQ ID NO: 274800 - DNA, 20 bp, Artificial Sequence
  Description of Artificial Sequence: Synthetic oligonucleotide
  Target: ATXN1; (+) strand; PAM type: YTN; PAM sequence: TTG
ccagaatgtgactgggcgtg

SEQ ID NO: 274801 - DNA, 20 bp, Artificial Sequence
  Description of Artificial Sequence: Synthetic oligonucleotide
  Target: ATXN1; (+) strand; PAM type: YTN; PAM sequence: CTG
ggcgtggtggctcactccta

SEQ ID NO: 274802 - DNA, 20 bp, Artificial Sequence
  Description of Artificial Sequence: Synthetic oligonucleotide
  Target: ATXN1; (+) strand; PAM type: YTN; PAM sequence: CTC
actcctataatcccagcact

SEQ ID NO: 274803 - DNA, 20 bp, Artificial Sequence
  Description of Artificial Sequence: Synthetic oligonucleotide
  Target: ATXN1; (+) strand; PAM type: YTN; PAM sequence: CTC
ctataatcccagcactttgg

SEQ ID NO: 274804 - DNA, 20 bp, Artificial Sequence
  Description of Artificial Sequence: Synthetic oligonucleotide
  Target: ATXN1; (+) strand; PAM type: YTN; PAM sequence: CTA
taatcccagcactttgggag

SEQ ID NO: 274805 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaagccaggtgg

SEQ ID NO: 274806 - DNA, 20 bp, Artificial Sequence
  Description of Artificial Sequence: Synthetic oligonucleotide
  Target: ATXN1; (+) strand; PAM type: YTN; PAM sequence: TTT
gggaggccaagccaggtgga

SEQ ID NO: 274807 - DNA, 20 bp, Artificial Sequence
  Description of Artificial Sequence: Synthetic oligonucleotide
  Target: ATXN1; (+) strand; PAM type: YTN; PAM sequence: TTG
ggaggccaagccaggtggat

SEQ ID NO: 274808 - DNA, 20 bp, Artificial Sequence
  Description of Artificial Sequence: Synthetic oligonucleotide
  Target: ATXN1; (+) strand; PAM type: YTN; PAM sequence: CTG
aagtcaggagttcaagacca

SEQ ID NO: 274809 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaccat

SEQ ID NO: 274810 - DNA, 20 bp, Artificial Sequence
  Description of Artificial Sequence: Synthetic oligonucleotide
  Target: ATXN1; (+) strand; PAM type: YTN; PAM sequence: CTG
gccaccatggtaaaacccca

SEQ ID NO: 274811 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaattag

SEQ ID NO: 274812 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaattagcc

SEQ ID NO: 274813 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaattagccggg

SEQ ID NO: 274814 - DNA, 20 bp, Artificial Sequence
  Description of Artificial Sequence: Synthetic oligonucleotide
  Target: ATXN1; (+) strand; PAM type: YTN; PAM sequence: TTA
gccgggcatggtggcatgca

SEQ ID NO: 274815 - DNA, 20 bp, Artificial Sequence
  Description of Artificial Sequence: Synthetic oligonucleotide
  Target: ATXN1; (+) strand; PAM type: YTN; PAM sequence: CTG
taatcccagctatttgggaa

SEQ ID NO: 274816 - DNA, 20 bp, Artificial Sequence
  Description of Artificial Sequence: Synthetic oligonucleotide
  Target: ATXN1; (+) strand; PAM type: YTN; PAM sequence: CTA
tttgggaagctgaggcagga

SEQ ID NO: 274817 - DNA, 20 bp, Artificial Sequence
  Description of Artificial Sequence: Synthetic oligonucleotide
  Target: ATXN1; (+) strand; PAM type: YTN; PAM sequence: TTT
gggaagctgaggcaggaaaa

SEQ ID NO: 274818 - DNA, 20 bp, Artificial Sequence
  Description of Artificial Sequence: Synthetic oligonucleotide
  Target: ATXN1; (+) strand; PAM type: YTN; PAM sequence: TTG
ggaagctgaggcaggaaaat

SEQ ID NO: 274819 - DNA, 20 bp, Artificial Sequence
  Description of Artificial Sequence: Synthetic oligonucleotide
  Target: ATXN1; (+) strand; PAM type: YTN; PAM sequence: CTG
aggcaggaaaattgcttgaa

SEQ ID NO: 274820 - DNA, 20 bp, Artificial Sequence
  Description of Artificial Sequence: Synthetic oligonucleotide
  Target: ATXN1; (+) strand; PAM type: YTN; PAM sequence: TTG
cttgaactcgggaggcagaa

SEQ ID NO: 274821 - DNA, 20 bp, Artificial Sequence
  Description of Artificial Sequence: Synthetic oligonucleotide
  Target: ATXN1; (+) strand; PAM type: YTN; PAM sequence: CTT
gaactcgggaggcagaagtt

SEQ ID NO: 274822 - DNA, 20 bp, Artificial Sequence
  Description of Artificial Sequence: Synthetic oligonucleotide
  Target: ATXN1; (+) strand; PAM type: YTN; PAM sequence: TTG
aactcgggaggcagaagttg

SEQ ID NO: 274823 - DNA, 20 bp, Artificial Sequence
  Description of Artificial Sequence: Synthetic oligonucleotide
  Target: ATXN1; (+) strand; PAM type: YTN; PAM sequence: CTC
gggaggcagaagttgcagtg

SEQ ID NO: 274824 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcatgcc

SEQ ID NO: 274825 - DNA, 20 bp, Artificial Sequence
  Description of Artificial Sequence: Synthetic oligonucleotide
  Target: ATXN1; (+) strand; PAM type: YTN; PAM sequence: CTG
tactccagcctgggcaacaa

SEQ ID NO: 274826 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagagca

SEQ ID NO: 274827 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcaaaacaaa

SEQ ID NO: 274828 - DNA, 20 bp, Artificial Sequence
  Description of Artificial Sequence: Synthetic oligonucleotide
  Target: ATXN1; (+) strand; PAM type: YTN; PAM sequence: TTA
ccagaatgtgagtacctgta

SEQ ID NO: 274829 - DNA, 20 bp, Artificial Sequence
  Description of Artificial Sequence: Synthetic oligonucleotide
  Target: ATXN1; (+) strand; PAM type: YTN; PAM sequence: CTG
tactgtattccctttttcct

SEQ ID NO: 274830 - DNA, 20 bp, Artificial Sequence
  Description of Artificial Sequence: Synthetic oligonucleotide
  Target: ATXN1; (+) strand; PAM type: YTN; PAM sequence: CTG
tattccctttttcctcaccc

SEQ ID NO: 274831 - DNA, 20 bp, Artificial Sequence
  Description of Artificial Sequence: Synthetic oligonucleotide
  Target: ATXN1; (+) strand; PAM type: YTN; PAM sequence: TTC
cctttttcctcacccctcac

SEQ ID NO: 274832 - DNA, 20 bp, Artificial Sequence
  Description of Artificial Sequence: Synthetic oligonucleotide
  Target: ATXN1; (+) strand; PAM type: YTN; PAM sequence: CTT
tttcctcacccctcacaagt

SEQ ID NO: 274833 - DNA, 20 bp, Artificial Sequence
  Description of Artificial Sequence: Synthetic oligonucleotide
  Target: ATXN1; (+) strand; PAM type: YTN; PAM sequence: TTT
ttcctcacccctcacaagta

SEQ ID NO: 274834 - DNA, 20 bp, Artificial Sequence
  Description of Artificial Sequence: Synthetic oligonucleotide
  Target: ATXN1; (+) strand; PAM type: YTN; PAM sequence: TTT
tcctcacccctcacaagtaa

SEQ ID NO: 274835 - DNA, 20 bp, Artificial Sequence
  Description of Artificial Sequence: Synthetic oligonucleotide
  Target: ATXN1; (+) strand; PAM type: YTN; PAM sequence: TTT
cctcacccctcacaagtaaa

SEQ ID NO: 274836 - DNA, 20 bp, Artificial Sequence
  Description of Artificial Sequence: Synthetic oligonucleotide
  Target: ATXN1; (+) strand; PAM type: YTN; PAM sequence: TTC
ctcacccctcacaagtaaat

SEQ ID NO: 274837 - DNA, 20 bp, Artificial Sequence
  Description of Artificial Sequence: Synthetic oligonucleotide
  Target: ATXN1; (+) strand; PAM type: YTN; PAM sequence: CTC
acccctcacaagtaaatgag

SEQ ID NO: 274838 - DNA, 20 bp, Artificial Sequence
  Description of Artificial Sequence: Synthetic oligonucleotide
  Target: ATXN1; (+) strand; PAM type: YTN; PAM sequence: CTC
acaagtaaatgagacaagtt

SEQ ID NO: 274839 - DNA, 20 bp, Artificial Sequence
  Description of Artificial Sequence: Synthetic oligonucleotide
  Target: ATXN1; (+) strand; PAM type: YTN; PAM sequence: TTG
ccatatgatccagaaatccc

SEQ ID NO: 274840 - DNA, 20 bp, Artificial Sequence
  Description of Artificial Sequence: Synthetic oligonucleotide
  Target: ATXN1; (+) strand; PAM type: YTN; PAM sequence: CTG
ggtatatactcaaaagaaag

SEQ ID NO: 274841 - DNA, 20 bp, Artificial Sequence
  Description of Artificial Sequence: Synthetic oligonucleotide
  Target: ATXN1; (+) strand; PAM type: YTN; PAM sequence: CTC
aaaagaaaggaaatcagtat

SEQ ID NO: 274842 - DNA, 20 bp, Artificial Sequence
  Description of Artificial Sequence: Synthetic oligonucleotide
  Target: ATXN1; (+) strand; PAM type: YTN; PAM sequence: TTG
aggaaaaatctgcacttcct

SEQ ID NO: 274843 - DNA, 20 bp, Artificial Sequence
  Description of Artificial Sequence: Synthetic oligonucleotide
  Target: ATXN1; (+) strand; PAM type: YTN; PAM sequence: CTG
cacttcctctgtttgttaca

SEQ ID NO: 274844 - DNA, 20 bp, Artificial Sequence
  Description of Artificial Sequence: Synthetic oligonucleotide
  Target: ATXN1; (+) strand; PAM type: YTN; PAM sequence: CTT
cctctgtttgttacagcact

SEQ ID NO: 274845 - DNA, 20 bp, Artificial Sequence
  Description of Artificial Sequence: Synthetic oligonucleotide
  Target: ATXN1; (+) strand; PAM type: YTN; PAM sequence: TTC
ctctgtttgttacagcactg

SEQ ID NO: 274846 - DNA, 20 bp, Artificial Sequence
  Description of Artificial Sequence: Synthetic oligonucleotide
  Target: ATXN1; (+) strand; PAM type: YTN; PAM sequence: CTC
tgtttgttacagcactgttt

SEQ ID NO: 274847 - DNA, 20 bp, Artificial Sequence
  Description of Artificial Sequence: Synthetic oligonucleotide
  Target: ATXN1; (+) strand; PAM type: YTN; PAM sequence: CTG
tttgttacagcactgtttac

SEQ ID NO: 274848 - DNA, 20 bp, Artificial Sequence
  Description of Artificial Sequence: Synthetic oligonucleotide
  Target: ATXN1; (+) strand; PAM type: YTN; PAM sequence: TTT
gttacagcactgtttacaat

SEQ ID NO: 274849 - DNA, 20 bp, Artificial Sequence
  Description of Artificial Sequence: Synthetic oligonucleotide
  Target: ATXN1; (+) strand; PAM type: YTN; PAM sequence: TTG
ttacagcactgtttacaata

SEQ ID NO: 274850 - DNA, 20 bp, Artificial Sequence
  Description of Artificial Sequence: Synthetic oligonucleotide
  Target: ATXN1; (+) strand; PAM type: YTN; PAM sequence: TTA
cagcactgtttacaatagct

SEQ ID NO: 274851 - DNA, 20 bp, Artificial Sequence
  Description of Artificial Sequence: Synthetic oligonucleotide
  Target: ATXN1; (+) strand; PAM type: YTN; PAM sequence: CTG
tttacaatagctaagatttg

SEQ ID NO: 274852 - DNA, 20 bp, Artificial Sequence
  Description of Artificial Sequence: Synthetic oligonucleotide
  Target: ATXN1; (+) strand; PAM type: YTN; PAM sequence: TTT
acaatagctaagatttggaa

SEQ ID NO: 274853 - DNA, 20 bp, Artificial Sequence
  Description of Artificial Sequence: Synthetic oligonucleotide
  Target: ATXN1; (+) strand; PAM type: YTN; PAM sequence: TTA
caatagctaagatttggaag

SEQ ID NO: 274854 - DNA, 20 bp, Artificial Sequence
  Description of Artificial Sequence: Synthetic oligonucleotide
  Target: ATXN1; (+) strand; PAM type: YTN; PAM sequence: CTA
agatttggaagcaatctaaa

SEQ ID NO: 274855 - DNA, 20 bp, Artificial Sequence
  Description of Artificial Sequence: Synthetic oligonucleotide
  Target: ATXN1; (+) strand; PAM type: YTN; PAM sequence: TTT
ggaagcaatctaaatgtcta

SEQ ID NO: 274856 - DNA, 20 bp, Artificial Sequence
  Description of Artificial Sequence: Synthetic oligonucleotide
  Target: ATXN1; (+) strand; PAM type: YTN; PAM sequence: TTG
gaagcaatctaaatgtctac

SEQ ID NO: 274857 - DNA, 20 bp, Artificial Sequence
  Description of Artificial Sequence: Synthetic oligonucleotide
  Target: ATXN1; (+) strand; PAM type: YTN; PAM sequence: CTA
aatgtctaccaacagatgaa

SEQ ID NO: 274858 - DNA, 20 bp, Artificial Sequence
  Description of Artificial Sequence: Synthetic oligonucleotide
  Target: ATXN1; (+) strand; PAM type: YTN; PAM sequence: CTA
ccaacagatgaatggataaa

SEQ ID NO: 274859 - DNA, 20 bp, Artificial Sequence
  Description of Artificial Sequence: Synthetic oligonucleotide
  Target: ATXN1; (+) strand; PAM type: YTN; PAM sequence: TTA
ttcagccataaaaaagaatg

SEQ ID NO: 274860 - DNA, 20 bp, Artificial Sequence
  Description of Artificial Sequence: Synthetic oligonucleotide
  Target: ATXN1; (+) strand; PAM type: YTN; PAM sequence: TTC
agccataaaaaagaatgaga

SEQ ID NO: 274861 - DNA, 20 bp, Artificial Sequence
  Description of Artificial Sequence: Synthetic oligonucleotide
  Target: ATXN1; (+) strand; PAM type: YTN; PAM sequence: TTT
gcaacaacatggatggaacg

SEQ ID NO: 274862 - DNA, 20 bp, Artificial Sequence
  Description of Artificial Sequence: Synthetic oligonucleotide
  Target: ATXN1; (+) strand; PAM type: YTN; PAM sequence: TTG
caacaacatggatggaacga

SEQ ID NO: 274863 - DNA, 20 bp, Artificial Sequence
  Description of Artificial Sequence: Synthetic oligonucleotide
  Target: ATXN1; (+) strand; PAM type: YTN; PAM sequence: TTA
tgttaagtgaaaaaagccag

SEQ ID NO: 274864 - DNA, 20 bp, Artificial Sequence
  Description of Artificial Sequence: Synthetic oligonucleotide
  Target: ATXN1; (+) strand; PAM type: YTN; PAM sequence: TTA
agtgaaaaaagccaggcaca

SEQ ID NO: 274865 - DNA, 20 bp, Artificial Sequence
  Description of Artificial Sequence: Synthetic oligonucleotide
  Target: ATXN1; (+) strand; PAM type: YTN; PAM sequence: CTT
agcatgttctcacttatctg

SEQ ID NO: 274866 - DNA, 20 bp, Artificial Sequence
  Description of Artificial Sequence: Synthetic oligonucleotide
  Target: ATXN1; (+) strand; PAM type: YTN; PAM sequence: TTA
gcatgttctcacttatctgt

SEQ ID NO: 274867 - DNA, 20 bp, Artificial Sequence
  Description of Artificial Sequence: Synthetic oligonucleotide
  Target: ATXN1; (+) strand; PAM type: YTN; PAM sequence: TTC
tcacttatctgtgggattca

SEQ ID NO: 274868 - DNA, 20 bp, Artificial Sequence
  Description of Artificial Sequence: Synthetic oligonucleotide
  Target: ATXN1; (+) strand; PAM type: YTN; PAM sequence: CTC
acttatctgtgggattcaaa

SEQ ID NO: 274869 - DNA, 20 bp, Artificial Sequence
  Description of Artificial Sequence: Synthetic oligonucleotide
  Target: ATXN1; (+) strand; PAM type: YTN; PAM sequence: CTT
atctgtgggattcaaaaatc

SEQ ID NO: 274870 - DNA, 20 bp, Artificial Sequence
  Description of Artificial Sequence: Synthetic oligonucleotide
  Target: ATXN1; (+) strand; PAM type: YTN; PAM sequence: TTA
tctgtgggattcaaaaatca

SEQ ID NO: 274871 - DNA, 20 bp, Artificial Sequence
  Description of Artificial Sequence: Synthetic oligonucleotide
  Target: ATXN1; (+) strand; PAM type: YTN; PAM sequence: CTG
tgggattcaaaaatcaaacc

SEQ ID NO: 274872 - DNA, 20 bp, Artificial Sequence
  Description of Artificial Sequence: Synthetic oligonucleotide
  Target: ATXN1; (+) strand; PAM type: YTN; PAM sequence: TTC
aaaaatcaaacctactgaac

SEQ ID NO: 274873 - DNA, 20 bp, Artificial Sequence
  Description of Artificial Sequence: Synthetic oligonucleotide
  Target: ATXN1; (+) strand; PAM type: YTN; PAM sequence: CTA
ctgaactcatggacacagag

SEQ ID NO: 274874 - DNA, 20 bp, Artificial Sequence
  Description of Artificial Sequence: Synthetic oligonucleotide
  Target: ATXN1; (+) strand; PAM type: YTN; PAM sequence: CTG
aactcatggacacagagagt

SEQ ID NO: 274875 - DNA, 20 bp, Artificial Sequence
  Description of Artificial Sequence: Synthetic oligonucleotide
  Target: ATXN1; (+) strand; PAM type: YTN; PAM sequence: CTC
atggacacagagagtaggag

SEQ ID NO: 274876 - DNA, 20 bp, Artificial Sequence
  Description of Artificial Sequence: Synthetic oligonucleotide
  Target: ATXN1; (+) strand; PAM type: YTN; PAM sequence: CTA
ccaaaggctgggaagggtag

SEQ ID NO: 274877 - DNA, 20 bp, Artificial Sequence
  Description of Artificial Sequence: Synthetic oligonucleotide
  Target: ATXN1; (+) strand; PAM type: YTN; PAM sequence: CTG
ggaagggtagtagggggctg

SEQ ID NO: 274878 - DNA, 20 bp, Artificial Sequence
  Description of Artificial Sequence: Synthetic oligonucleotide
  Target: ATXN1; (+) strand; PAM type: YTN; PAM sequence: CTG
gaggggaggtggggatggtt

SEQ ID NO: 274879 - DNA, 20 bp, Artificial Sequence
  Description of Artificial Sequence: Synthetic oligonucleotide
  Target: ATXN1; (+) strand; PAM type: YTN; PAM sequence: TTA
atgggtacaaaaaaagtagt

SEQ ID NO: 274880 - DNA, 20 bp, Artificial Sequence
  Description of Artificial Sequence: Synthetic oligonucleotide
  Target: ATXN1; (+) strand; PAM type: YTN; PAM sequence: TTA
gaataaataagatctactat

SEQ ID NO: 274881 - DNA, 20 bp, Artificial Sequence
  Description of Artificial Sequence: Synthetic oligonucleotide
  Target: ATXN1; (+) strand; PAM type: YTN; PAM sequence: CTA
ctatttgatagcacaacaga

SEQ ID NO: 274882 - DNA, 20 bp, Artificial Sequence
  Description of Artificial Sequence: Synthetic oligonucleotide
  Target: ATXN1; (+) strand; PAM type: YTN; PAM sequence: CTA
tttgatagcacaacagagtg

SEQ ID NO: 274883 - DNA, 20 bp, Artificial Sequence
  Description of Artificial Sequence: Synthetic oligonucleotide
  Target: ATXN1; (+) strand; PAM type: YTN; PAM sequence: TTT
gatagcacaacagagtgact

SEQ ID NO: 274884 - DNA, 20 bp, Artificial Sequence
  Description of Artificial Sequence: Synthetic oligonucleotide
  Target: ATXN1; (+) strand; PAM type: YTN; PAM sequence: TTG
atagcacaacagagtgacta

SEQ ID NO: 274885 - DNA, 20 bp, Artificial Sequence
  Description of Artificial Sequence: Synthetic oligonucleotide
  Target: ATXN1; (+) strand; PAM type: YTN; PAM sequence: CTA
tagtcaataataactgtaca

SEQ ID NO: 274886 - DNA, 20 bp, Artificial Sequence
  Description of Artificial Sequence: Synthetic oligonucleotide
  Target: ATXN1; (+) strand; PAM type: YTN; PAM sequence: CTG
tacattttaaaataaagagt

SEQ ID NO: 274887 - DNA, 20 bp, Artificial Sequence
  Description of Artificial Sequence: Synthetic oligonucleotide
  Target: ATXN1; (+) strand; PAM type: YTN; PAM sequence: TTT
taaaataaagagtataactg

SEQ ID NO: 274888 - DNA, 20 bp, Artificial Sequence
  Description of Artificial Sequence: Synthetic oligonucleotide
  Target: ATXN1; (+) strand; PAM type: YTN; PAM sequence: TTT
aaaataaagagtataactgg

SEQ ID NO: 274889 - DNA, 20 bp, Artificial Sequence
  Description of Artificial Sequence: Synthetic oligonucleotide
  Target: ATXN1; (+) strand; PAM type: YTN; PAM sequence: TTA
aaataaagagtataactgga

SEQ ID NO: 274890 - DNA, 20 bp, Artificial Sequence
  Description of Artificial Sequence: Synthetic oligonucleotide
  Target: ATXN1; (+) strand; PAM type: YTN; PAM sequence: CTG
gagtgtttgttgtaatggat

SEQ ID NO: 274891 - DNA, 20 bp, Artificial Sequence
  Description of Artificial Sequence: Synthetic oligonucleotide
  Target: ATXN1; (+) strand; PAM type: YTN; PAM sequence: TTT
gttgtaatggataaatgctt

SEQ ID NO: 274892 - DNA, 20 bp, Artificial Sequence
  Description of Artificial Sequence: Synthetic oligonucleotide
  Target: ATXN1; (+) strand; PAM type: YTN; PAM sequence: TTG
ttgtaatggataaatgcttg

SEQ ID NO: 274893 - DNA, 20 bp, Artificial Sequence
  Description of Artificial Sequence: Synthetic oligonucleotide
  Target: ATXN1; (+) strand; PAM type: YTN; PAM sequence: TTG
taatggataaatgcttgagt

SEQ ID NO: 274894 - DNA, 20 bp, Artificial Sequence
  Description of Artificial Sequence: Synthetic oligonucleotide
  Target: ATXN1; (+) strand; PAM type: YTN; PAM sequence: CTT
gagtggatggataccccatt

SEQ ID NO: 274895 - DNA, 20 bp, Artificial Sequence
  Description of Artificial Sequence: Synthetic oligonucleotide
  Target: ATXN1; (+) strand; PAM type: YTN; PAM sequence: TTG
agtggatggataccccattc

SEQ ID NO: 274896 - DNA, 20 bp, Artificial Sequence
  Description of Artificial Sequence: Synthetic oligonucleotide
  Target: ATXN1; (+) strand; PAM type: YTN; PAM sequence: TTC
ttcatgatgtgtttatttta

SEQ ID NO: 274897 - DNA, 20 bp, Artificial Sequence
  Description of Artificial Sequence: Synthetic oligonucleotide
  Target: ATXN1; (+) strand; PAM type: YTN; PAM sequence: CTT
catgatgtgtttattttaca

SEQ ID NO: 274898 - DNA, 20 bp, Artificial Sequence
  Description of Artificial Sequence: Synthetic oligonucleotide
  Target: ATXN1; (+) strand; PAM type: YTN; PAM sequence: TTC
atgatgtgtttattttacat

SEQ ID NO: 274899 - DNA, 20 bp, Artificial Sequence
  Description of Artificial Sequence: Synthetic oligonucleotide
  Target: ATXN1; (+) strand; PAM type: YTN; PAM sequence: TTT
attttacatgtctgtatcaa

SEQ ID NO: 274900 - DNA, 20 bp, Artificial Sequence
  Description of Artificial Sequence: Synthetic oligonucleotide
  Target: ATXN1; (+) strand; PAM type: YTN; PAM sequence: TTA
ttttacatgtctgtatcaaa

SEQ ID NO: 274901 - DNA, 20 bp, Artificial Sequence
  Description of Artificial Sequence: Synthetic oligonucleotide
  Target: ATXN1; (+) strand; PAM type: YTN; PAM sequence: TTT
tacatgtctgtatcaaaaca

SEQ ID NO: 274902 - DNA, 20 bp, Artificial Sequence
  Description of Artificial Sequence: Synthetic oligonucleotide
  Target: ATXN1; (+) strand; PAM type: YTN; PAM sequence: TTT
acatgtctgtatcaaaacat

SEQ ID NO: 274903 - DNA, 20 bp, Artificial Sequence
  Description of Artificial Sequence: Synthetic oligonucleotide
  Target: ATXN1; (+) strand; PAM type: YTN; PAM sequence: TTA
catgtctgtatcaaaacatc

SEQ ID NO: 274904 - DNA, 20 bp, Artificial Sequence
  Description of Artificial Sequence: Synthetic oligonucleotide
  Target: ATXN1; (+) strand; PAM type: YTN; PAM sequence: CTG
tatcaaaacatctcatgtac

SEQ ID NO: 274905 - DNA, 20 bp, Artificial Sequence
  Description of Artificial Sequence: Synthetic oligonucleotide
  Target: ATXN1; (+) strand; PAM type: YTN; PAM sequence: CTC
atgtaccccatacatataca

SEQ ID NO: 274906 - DNA, 20 bp, Artificial Sequence
  Description of Artificial Sequence: Synthetic oligonucleotide
  Target: ATXN1; (+) strand; PAM type: YTN; PAM sequence: CTA
tgtacccacaaaaaaattaa

SEQ ID NO: 274907 - DNA, 20 bp, Artificial Sequence
  Description of Artificial Sequence: Synthetic oligonucleotide
  Target: ATXN1; (+) strand; PAM type: YTN; PAM sequence: TTA
aaaattaaaaaaaaattaca

SEQ ID NO: 274908 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaattacaggactat

SEQ ID NO: 274909 - DNA, 20 bp, Artificial Sequence
  Description of Artificial Sequence: Synthetic oligonucleotide
  Target: ATXN1; (+) strand; PAM type: YTN; PAM sequence: TTA
caggactatgcagtcaaaaa

SEQ ID NO: 274910 - DNA, 20 bp, Artificial Sequence
  Description of Artificial Sequence: Synthetic oligonucleotide
  Target: ATXN1; (+) strand; PAM type: YTN; PAM sequence: CTA
tgcagtcaaaaaaagtggat

SEQ ID NO: 274911 - DNA, 20 bp, Artificial Sequence
  Description of Artificial Sequence: Synthetic oligonucleotide
  Target: ATXN1; (+) strand; PAM type: YTN; PAM sequence: CTG
ttcactgtataataattaga

SEQ ID NO: 274912 - DNA, 20 bp, Artificial Sequence
  Description of Artificial Sequence: Synthetic oligonucleotide
  Target: ATXN1; (+) strand; PAM type: YTN; PAM sequence: TTC
actgtataataattagataa

SEQ ID NO: 274913 - DNA, 20 bp, Artificial Sequence
  Description of Artificial Sequence: Synthetic oligonucleotide
  Target: ATXN1; (+) strand; PAM type: YTN; PAM sequence: CTG
tataataattagataaatag

SEQ ID NO: 274914 - DNA, 20 bp, Artificial Sequence
  Description of Artificial Sequence: Synthetic oligonucleotide
  Target: ATXN1; (+) strand; PAM type: YTN; PAM sequence: TTA
gataaatagaaaaacccaag

SEQ ID NO: 274915 - DNA, 20 bp, Artificial Sequence
  Description of Artificial Sequence: Synthetic oligonucleotide
  Target: ATXN1; (+) strand; PAM type: YTN; PAM sequence: CTA
ataatcactattaacagtct

SEQ ID NO: 274916 - DNA, 20 bp, Artificial Sequence
  Description of Artificial Sequence: Synthetic oligonucleotide
  Target: ATXN1; (+) strand; PAM type: YTN; PAM sequence: CTA
ttaacagtctggttatatga

SEQ ID NO: 274917 - DNA, 20 bp, Artificial Sequence
  Description of Artificial Sequence: Synthetic oligonucleotide
  Target: ATXN1; (+) strand; PAM type: YTN; PAM sequence: TTA
acagtctggttatatgaccc

SEQ ID NO: 274918 - DNA, 20 bp, Artificial Sequence
  Description of Artificial Sequence: Synthetic oligonucleotide
  Target: ATXN1; (+) strand; PAM type: YTN; PAM sequence: CTG
gttatatgaccccagactct

SEQ ID NO: 274919 - DNA, 20 bp, Artificial Sequence
  Description of Artificial Sequence: Synthetic oligonucleotide
  Target: ATXN1; (+) strand; PAM type: YTN; PAM sequence: TTA
tatgaccccagactctctcc

SEQ ID NO: 274920 - DNA, 20 bp, Artificial Sequence
  Description of Artificial Sequence: Synthetic oligonucleotide
  Target: ATXN1; (+) strand; PAM type: YTN; PAM sequence: CTC
tctcctatgcccaagtatac

SEQ ID NO: 274921 - DNA, 20 bp, Artificial Sequence
  Description of Artificial Sequence: Synthetic oligonucleotide
  Target: ATXN1; (+) strand; PAM type: YTN; PAM sequence: CTC
tcctatgcccaagtatacag

SEQ ID NO: 274922 - DNA, 20 bp, Artificial Sequence
  Description of Artificial Sequence: Synthetic oligonucleotide
  Target: ATXN1; (+) strand; PAM type: YTN; PAM sequence: CTC
ctatgcccaagtatacagag

SEQ ID NO: 274923 - DNA, 20 bp, Artificial Sequence
  Description of Artificial Sequence: Synthetic oligonucleotide
  Target: ATXN1; (+) strand; PAM type: YTN; PAM sequence: CTA
tgcccaagtatacagagtat

SEQ ID NO: 274924 - DNA, 20 bp, Artificial Sequence
  Description of Artificial Sequence: Synthetic oligonucleotide
  Target: ATXN1; (+) strand; PAM type: YTN; PAM sequence: TTG
tacacatacatatagaaata

SEQ ID NO: 274925 - DNA, 20 bp, Artificial Sequence
  Description of Artificial Sequence: Synthetic oligonucleotide
  Target: ATXN1; (+) strand; PAM type: YTN; PAM sequence: CTA
tatatatatatatatatata

SEQ ID NO: 274926 - DNA, 20 bp, Artificial Sequence
  Description of Artificial Sequence: Synthetic oligonucleotide
  Target: ATXN1; (+) strand; PAM type: YTN; PAM sequence: CTA
tttataatgtactatgatag

SEQ ID NO: 274927 - DNA, 20 bp, Artificial Sequence
  Description of Artificial Sequence: Synthetic oligonucleotide
  Target: ATXN1; (+) strand; PAM type: YTN; PAM sequence: TTT
ataatgtactatgatagtat

SEQ ID NO: 274928 - DNA, 20 bp, Artificial Sequence
  Description of Artificial Sequence: Synthetic oligonucleotide
  Target: ATXN1; (+) strand; PAM type: YTN; PAM sequence: TTA
taatgtactatgatagtatt

SEQ ID NO: 274929 - DNA, 20 bp, Artificial Sequence
  Description of Artificial Sequence: Synthetic oligonucleotide
  Target: ATXN1; (+) strand; PAM type: YTN; PAM sequence: CTA
tgatagtattcatagtattt

SEQ ID NO: 274930 - DNA, 20 bp, Artificial Sequence
  Description of Artificial Sequence: Synthetic oligonucleotide
  Target: ATXN1; (+) strand; PAM type: YTN; PAM sequence: TTC
atagtattttgctgtctcat

SEQ ID NO: 274931 - DNA, 20 bp, Artificial Sequence
  Description of Artificial Sequence: Synthetic oligonucleotide
  Target: ATXN1; (+) strand; PAM type: YTN; PAM sequence: TTT
tgctgtctcattttttttac

SEQ ID NO: 274932 - DNA, 20 bp, Artificial Sequence
  Description of Artificial Sequence: Synthetic oligonucleotide
  Target: ATXN1; (+) strand; PAM type: YTN; PAM sequence: TTT
gctgtctcattttttttact

SEQ ID NO: 274933 - DNA, 20 bp, Artificial Sequence
  Description of Artificial Sequence: Synthetic oligonucleotide
  Target: ATXN1; (+) strand; PAM type: YTN; PAM sequence: TTG
ctgtctcattttttttactt

SEQ ID NO: 274934 - DNA, 20 bp, Artificial Sequence
  Description of Artificial Sequence: Synthetic oligonucleotide
  Target: ATXN1; (+) strand; PAM type: YTN; PAM sequence: CTG
tctcattttttttacttatt

SEQ ID NO: 274935 - DNA, 20 bp, Artificial Sequence
  Description of Artificial Sequence: Synthetic oligonucleotide
  Target: ATXN1; (+) strand; PAM type: YTN; PAM sequence: CTC
attttttttacttattaatt

SEQ ID NO: 274936 - DNA, 20 bp, Artificial Sequence
  Description of Artificial Sequence: Synthetic oligonucleotide
  Target: ATXN1; (+) strand; PAM type: YTN; PAM sequence: TTT
tttttacttattaattatat

SEQ ID NO: 274937 - DNA, 20 bp, Artificial Sequence
  Description of Artificial Sequence: Synthetic oligonucleotide
  Target: ATXN1; (+) strand; PAM type: YTN; PAM sequence: TTT
ttttacttattaattatatt

SEQ ID NO: 274938 - DNA, 20 bp, Artificial Sequence
  Description of Artificial Sequence: Synthetic oligonucleotide
  Target: ATXN1; (+) strand; PAM type: YTN; PAM sequence: TTT
tttacttattaattatattg

SEQ ID NO: 274939 - DNA, 20 bp, Artificial Sequence
  Description of Artificial Sequence: Synthetic oligonucleotide
  Target: ATXN1; (+) strand; PAM type: YTN; PAM sequence: TTT
ttacttattaattatattga

SEQ ID NO: 274940 - DNA, 20 bp, Artificial Sequence
  Description of Artificial Sequence: Synthetic oligonucleotide
  Target: ATXN1; (+) strand; PAM type: YTN; PAM sequence: TTT
tacttattaattatattgaa

SEQ ID NO: 274941 - DNA, 20 bp, Artificial Sequence
  Description of Artificial Sequence: Synthetic oligonucleotide
  Target: ATXN1; (+) strand; PAM type: YTN; PAM sequence: TTT
acttattaattatattgaaa

SEQ ID NO: 274942 - DNA, 20 bp, Artificial Sequence
  Description of Artificial Sequence: Synthetic oligonucleotide
  Target: ATXN1; (+) strand; PAM type: YTN; PAM sequence: TTA
cttattaattatattgaaaa

SEQ ID NO: 274943 - DNA, 20 bp, Artificial Sequence
  Description of Artificial Sequence: Synthetic oligonucleotide
  Target: ATXN1; (+) strand; PAM type: YTN; PAM sequence: CTT
attaattatattgaaaacct

SEQ ID NO: 274944 - DNA, 20 bp, Artificial Sequence
  Description of Artificial Sequence: Synthetic oligonucleotide
  Target: ATXN1; (+) strand; PAM type: YTN; PAM sequence: TTA
ttaattatattgaaaacctc

SEQ ID NO: 274945 - DNA, 20 bp, Artificial Sequence
  Description of Artificial Sequence: Synthetic oligonucleotide
  Target: ATXN1; (+) strand; PAM type: YTN; PAM sequence: TTA
attatattgaaaacctcctt

SEQ ID NO: 274946 - DNA, 20 bp, Artificial Sequence
  Description of Artificial Sequence: Synthetic oligonucleotide
  Target: ATXN1; (+) strand; PAM type: YTN; PAM sequence: TTA
tattgaaaacctcctttaac

SEQ ID NO: 274947 - DNA, 20 bp, Artificial Sequence
  Description of Artificial Sequence: Synthetic oligonucleotide
  Target: ATXN1; (+) strand; PAM type: YTN; PAM sequence: TTG
aaaacctcctttaacatcaa

SEQ ID NO: 274948 - DNA, 20 bp, Artificial Sequence
  Description of Artificial Sequence: Synthetic oligonucleotide
  Target: ATXN1; (+) strand; PAM type: YTN; PAM sequence: CTC
ctttaacatcaatagatgta

SEQ ID NO: 274949 - DNA, 20 bp, Artificial Sequence
  Description of Artificial Sequence: Synthetic oligonucleotide
  Target: ATXN1; (+) strand; PAM type: YTN; PAM sequence: CTT
taacatcaatagatgtatca

SEQ ID NO: 274950 - DNA, 20 bp, Artificial Sequence
  Description of Artificial Sequence: Synthetic oligonucleotide
  Target: ATXN1; (+) strand; PAM type: YTN; PAM sequence: TTT
aacatcaatagatgtatcaa

SEQ ID NO: 274951 - DNA, 20 bp, Artificial Sequence
  Description of Artificial Sequence: Synthetic oligonucleotide
  Target: ATXN1; (+) strand; PAM type: YTN; PAM sequence: TTA
acatcaatagatgtatcaac

SEQ ID NO: 274952 - DNA, 20 bp, Artificial Sequence
  Description of Artificial Sequence: Synthetic oligonucleotide
  Target: ATXN1; (+) strand; PAM type: YTN; PAM sequence: TTT
gaggactgaaagagtattac

SEQ ID NO: 274953 - DNA, 20 bp, Artificial Sequence
  Description of Artificial Sequence: Synthetic oligonucleotide
  Target: ATXN1; (+) strand; PAM type: YTN; PAM sequence: TTG
aggactgaaagagtattaca

SEQ ID NO: 274954 - DNA, 20 bp, Artificial Sequence
  Description of Artificial Sequence: Synthetic oligonucleotide
  Target: ATXN1; (+) strand; PAM type: YTN; PAM sequence: CTG
aaagagtattacattgaagg

SEQ ID NO: 274955 - DNA, 20 bp, Artificial Sequence
  Description of Artificial Sequence: Synthetic oligonucleotide
  Target: ATXN1; (+) strand; PAM type: YTN; PAM sequence: TTA
cattgaaggaatgaaccaat

SEQ ID NO: 274956 - DNA, 20 bp, Artificial Sequence
  Description of Artificial Sequence: Synthetic oligonucleotide
  Target: ATXN1; (+) strand; PAM type: YTN; PAM sequence: TTG
aaggaatgaaccaatacata

SEQ ID NO: 274957 - DNA, 20 bp, Artificial Sequence
  Description of Artificial Sequence: Synthetic oligonucleotide
  Target: ATXN1; (+) strand; PAM type: YTN; PAM sequence: TTT
atttgttgaatttacagagt

SEQ ID NO: 274958 - DNA, 20 bp, Artificial Sequence
  Description of Artificial Sequence: Synthetic oligonucleotide
  Target: ATXN1; (+) strand; PAM type: YTN; PAM sequence: TTA
tttgttgaatttacagagtc

SEQ ID NO: 274959 - DNA, 20 bp, Artificial Sequence
  Description of Artificial Sequence: Synthetic oligonucleotide
  Target: ATXN1; (+) strand; PAM type: YTN; PAM sequence: TTT
gttgaatttacagagtctac

SEQ ID NO: 274960 - DNA, 20 bp, Artificial Sequence
  Description of Artificial Sequence: Synthetic oligonucleotide
  Target: ATXN1; (+) strand; PAM type: YTN; PAM sequence: TTG
ttgaatttacagagtctacc

SEQ ID NO: 274961 - DNA, 20 bp, Artificial Sequence
  Description of Artificial Sequence: Synthetic oligonucleotide
  Target: ATXN1; (+) strand; PAM type: YTN; PAM sequence: TTG
aatttacagagtctaccaaa

SEQ ID NO: 274962 - DNA, 20 bp, Artificial Sequence
  Description of Artificial Sequence: Synthetic oligonucleotide
  Target: ATXN1; (+) strand; PAM type: YTN; PAM sequence: TTT
acagagtctaccaaagtgtc

SEQ ID NO: 274963 - DNA, 20 bp, Artificial Sequence
  Description of Artificial Sequence: Synthetic oligonucleotide
  Target: ATXN1; (+) strand; PAM type: YTN; PAM sequence: TTA
cagagtctaccaaagtgtcc

SEQ ID NO: 274964 - DNA, 20 bp, Artificial Sequence
  Description of Artificial Sequence: Synthetic oligonucleotide
  Target: ATXN1; (+) strand; PAM type: YTN; PAM sequence: CTA
ccaaagtgtcccaagtttat

SEQ ID NO: 274965 - DNA, 20 bp, Artificial Sequence
  Description of Artificial Sequence: Synthetic oligonucleotide
  Target: ATXN1; (+) strand; PAM type: YTN; PAM sequence: TTT
ataagaagtgactacatatt

SEQ ID NO: 274966 - DNA, 20 bp, Artificial Sequence
  Description of Artificial Sequence: Synthetic oligonucleotide
  Target: ATXN1; (+) strand; PAM type: YTN; PAM sequence: TTA
taagaagtgactacatattg

SEQ ID NO: 274967 - DNA, 20 bp, Artificial Sequence
  Description of Artificial Sequence: Synthetic oligonucleotide
  Target: ATXN1; (+) strand; PAM type: YTN; PAM sequence: CTA
catattgtggtagcatgtgg

SEQ ID NO: 274968 - DNA, 20 bp, Artificial Sequence
  Description of Artificial Sequence: Synthetic oligonucleotide
  Target: ATXN1; (+) strand; PAM type: YTN; PAM sequence: TTG
tggtagcatgtggttctttt

SEQ ID NO: 274969 - DNA, 20 bp, Artificial Sequence
  Description of Artificial Sequence: Synthetic oligonucleotide
  Target: ATXN1; (+) strand; PAM type: YTN; PAM sequence: TTC
tttttcttctacatttttca

SEQ ID NO: 274970 - DNA, 20 bp, Artificial Sequence
  Description of Artificial Sequence: Synthetic oligonucleotide
  Target: ATXN1; (+) strand; PAM type: YTN; PAM sequence: CTT
tttcttctacatttttcaag

SEQ ID NO: 274971 - DNA, 20 bp, Artificial Sequence
  Description of Artificial Sequence: Synthetic oligonucleotide
  Target: ATXN1; (+) strand; PAM type: YTN; PAM sequence: TTT
ttcttctacatttttcaaga

SEQ ID NO: 274972 - DNA, 20 bp, Artificial Sequence
  Description of Artificial Sequence: Synthetic oligonucleotide
  Target: ATXN1; (+) strand; PAM type: YTN; PAM sequence: TTT
tcttctacatttttcaagat

SEQ ID NO: 274973 - DNA, 20 bp, Artificial Sequence
  Description of Artificial Sequence: Synthetic oligonucleotide
  Target: ATXN1; (+) strand; PAM type: YTN; PAM sequence: TTT
cttctacatttttcaagatt

SEQ ID NO: 274974 - DNA, 20 bp, Artificial Sequence
  Description of Artificial Sequence: Synthetic oligonucleotide
  Target: ATXN1; (+) strand; PAM type: YTN; PAM sequence: TTC
ttctacatttttcaagattg

SEQ ID NO: 274975 - DNA, 20 bp, Artificial Sequence
  Description of Artificial Sequence: Synthetic oligonucleotide
  Target: ATXN1; (+) strand; PAM type: YTN; PAM sequence: CTT
ctacatttttcaagattgag

SEQ ID NO: 274976 - DNA, 20 bp, Artificial Sequence
  Description of Artificial Sequence: Synthetic oligonucleotide
  Target: ATXN1; (+) strand; PAM type: YTN; PAM sequence: TTC
tacatttttcaagattgaga

SEQ ID NO: 274977 - DNA, 20 bp, Artificial Sequence
  Description of Artificial Sequence: Synthetic oligonucleotide
  Target: ATXN1; (+) strand; PAM type: YTN; PAM sequence: CTA
catttttcaagattgagaaa

SEQ ID NO: 274978 - DNA, 20 bp, Artificial Sequence
  Description of Artificial Sequence: Synthetic oligonucleotide
  Target: ATXN1; (+) strand; PAM type: YTN; PAM sequence: TTT
ttcaagattgagaaaggcag

SEQ ID NO: 274979 - DNA, 20 bp, Artificial Sequence
  Description of Artificial Sequence: Synthetic oligonucleotide
  Target: ATXN1; (+) strand; PAM type: YTN; PAM sequence: TTT
tcaagattgagaaaggcagg

SEQ ID NO: 274980 - DNA, 20 bp, Artificial Sequence
  Description of Artificial Sequence: Synthetic oligonucleotide
  Target: ATXN1; (+) strand; PAM type: YTN; PAM sequence: TTT
caagattgagaaaggcaggc

SEQ ID NO: 274981 - DNA, 20 bp, Artificial Sequence
  Description of Artificial Sequence: Synthetic oligonucleotide
  Target: ATXN1; (+) strand; PAM type: YTN; PAM sequence: TTC
aagattgagaaaggcaggct

SEQ ID NO: 274982 - DNA, 20 bp, Artificial Sequence
  Description of Artificial Sequence: Synthetic oligonucleotide
  Target: ATXN1; (+) strand; PAM type: YTN; PAM sequence: TTG
agaaaggcaggctgaataaa

SEQ ID NO: 274983 - DNA, 20 bp, Artificial Sequence
  Description of Artificial Sequence: Synthetic oligonucleotide
  Target: ATXN1; (+) strand; PAM type: YTN; PAM sequence: CTG
aataaatataaaaagcctta

SEQ ID NO: 274984 - DNA, 20 bp, Artificial Sequence
  Description of Artificial Sequence: Synthetic oligonucleotide
  Target: ATXN1; (+) strand; PAM type: YTN; PAM sequence: CTT
aacagcaaaaagttgttttg

SEQ ID NO: 274985 - DNA, 20 bp, Artificial Sequence
  Description of Artificial Sequence: Synthetic oligonucleotide
  Target: ATXN1; (+) strand; PAM type: YTN; PAM sequence: TTA
acagcaaaaagttgttttgg

SEQ ID NO: 274986 - DNA, 20 bp, Artificial Sequence
  Description of Artificial Sequence: Synthetic oligonucleotide
  Target: ATXN1; (+) strand; PAM type: YTN; PAM sequence: TTG
ttttggtttgagtgggtgta

SEQ ID NO: 274987 - DNA, 20 bp, Artificial Sequence
  Description of Artificial Sequence: Synthetic oligonucleotide
  Target: ATXN1; (+) strand; PAM type: YTN; PAM sequence: TTT
tggtttgagtgggtgtagca

SEQ ID NO: 274988 - DNA, 20 bp, Artificial Sequence
  Description of Artificial Sequence: Synthetic oligonucleotide
  Target: ATXN1; (+) strand; PAM type: YTN; PAM sequence: TTT
ggtttgagtgggtgtagcat

SEQ ID NO: 274989 - DNA, 20 bp, Artificial Sequence
  Description of Artificial Sequence: Synthetic oligonucleotide
  Target: ATXN1; (+) strand; PAM type: YTN; PAM sequence: TTG
gtttgagtgggtgtagcata

SEQ ID NO: 274990 - DNA, 20 bp, Artificial Sequence
  Description of Artificial Sequence: Synthetic oligonucleotide
  Target: ATXN1; (+) strand; PAM type: YTN; PAM sequence: TTT
gagtgggtgtagcatagaag

SEQ ID NO: 274991 - DNA, 20 bp, Artificial Sequence
  Description of Artificial Sequence: Synthetic oligonucleotide
  Target: ATXN1; (+) strand; PAM type: YTN; PAM sequence: TTG
agtgggtgtagcatagaaga

SEQ ID NO: 274992 - DNA, 20 bp, Artificial Sequence
  Description of Artificial Sequence: Synthetic oligonucleotide
  Target: ATXN1; (+) strand; PAM type: YTN; PAM sequence: CTA
acacatataccacagggaat

SEQ ID NO: 274993 - DNA, 20 bp, Artificial Sequence
  Description of Artificial Sequence: Synthetic oligonucleotide
  Target: ATXN1; (+) strand; PAM type: YTN; PAM sequence: TTA
gaatattcagtaggtggccg

SEQ ID NO: 274994 - DNA, 20 bp, Artificial Sequence
  Description of Artificial Sequence: Synthetic oligonucleotide
  Target: ATXN1; (+) strand; PAM type: YTN; PAM sequence: TTC
agtaggtggccggacgcggt

SEQ ID NO: 274995 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 274996 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 274997 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcgggtgg

SEQ ID NO: 274998 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcgggtgga

SEQ ID NO: 274999 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcgggtggat

SEQ ID NO: 275000 - DNA, 20 bp, Artificial Sequence
  Description of Artificial Sequence: Synthetic oligonucleotide
  Target: ATXN1; (+) strand; PAM type: YTN; PAM sequence: TTA
cctgaggtcaggaggtcaag

SEQ ID NO: 275001 - DNA, 20 bp, Artificial Sequence
  Description of Artificial Sequence: Synthetic oligonucleotide
  Target: ATXN1; (+) strand; PAM type: YTN; PAM sequence: CTG
aggtcaggaggtcaagacca

SEQ ID NO: 275002 - DNA, 20 bp, Artificial Sequence
  Description of Artificial Sequence: Synthetic oligonucleotide
  Target: ATXN1; (+) strand; PAM type: YTN; PAM sequence: CTG
gccaaaatggtgaaaccctg

SEQ ID NO: 275003 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 275004 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 275005 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 275006 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 275007 - DNA, 20 bp, Artificial Sequence
  Description of Artificial Sequence: Synthetic oligonucleotide
  Target: ATXN1; (+) strand; PAM type: YTN; PAM sequence: TTA
gctgggcttggtggcaggtg

SEQ ID NO: 275008 - DNA, 20 bp, Artificial Sequence
  Description of Artificial Sequence: Synthetic oligonucleotide
  Target: ATXN1; (+) strand; PAM type: YTN; PAM sequence: CTG
ggcttggtggcaggtgcctg

SEQ ID NO: 275009 - DNA, 20 bp, Artificial Sequence
  Description of Artificial Sequence: Synthetic oligonucleotide
  Target: ATXN1; (+) strand; PAM type: YTN; PAM sequence: CTT
ggtggcaggtgcctgtaatc

SEQ ID NO: 275010 - DNA, 20 bp, Artificial Sequence
  Description of Artificial Sequence: Synthetic oligonucleotide
  Target: ATXN1; (+) strand; PAM type: YTN; PAM sequence: TTG
gtggcaggtgcctgtaatcc

SEQ ID NO: 275011 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcgggag

SEQ ID NO: 275012 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 275013 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagga

SEQ ID NO: 275014 - DNA, 20 bp, Artificial Sequence
  Description of Artificial Sequence: Synthetic oligonucleotide
  Target: ATXN1; (+) strand; PAM type: YTN; PAM sequence: CTG
aggcaggaggatcacttgaa

SEQ ID NO: 275015 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggtggaagct

SEQ ID NO: 275016 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggtggaagctg

SEQ ID NO: 275017 - DNA, 20 bp, Artificial Sequence
  Description of Artificial Sequence: Synthetic oligonucleotide
  Target: ATXN1; (+) strand; PAM type: YTN; PAM sequence: CTG
cagtgagtcgagaatgcacc

SEQ ID NO: 275018 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacaa

SEQ ID NO: 275019 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagagca

SEQ ID NO: 275020 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcaaaacttc

SEQ ID NO: 275021 - DNA, 20 bp, Artificial Sequence
  Description of Artificial Sequence: Synthetic oligonucleotide
  Target: ATXN1; (+) strand; PAM type: YTN; PAM sequence: CTT
catctcaaaaaaaaaaaaaa

SEQ ID NO: 275022 - DNA, 20 bp, Artificial Sequence
  Description of Artificial Sequence: Synthetic oligonucleotide
  Target: ATXN1; (+) strand; PAM type: YTN; PAM sequence: TTC
atctcaaaaaaaaaaaaaaa

SEQ ID NO: 275023 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaagaat

SEQ ID NO: 275024 - DNA, 20 bp, Artificial Sequence
  Description of Artificial Sequence: Synthetic oligonucleotide
  Target: ATXN1; (+) strand; PAM type: YTN; PAM sequence: TTC
agtgggtgttcaacatatcg

SEQ ID NO: 275025 - DNA, 20 bp, Artificial Sequence
  Description of Artificial Sequence: Synthetic oligonucleotide
  Target: ATXN1; (+) strand; PAM type: YTN; PAM sequence: TTC
aacatatcgaaaaaggactc

SEQ ID NO: 275026 - DNA, 20 bp, Artificial Sequence
  Description of Artificial Sequence: Synthetic oligonucleotide
  Target: ATXN1; (+) strand; PAM type: YTN; PAM sequence: CTC
aattttaaagactcgggata

SEQ ID NO: 275027 - DNA, 20 bp, Artificial Sequence
  Description of Artificial Sequence: Synthetic oligonucleotide
  Target: ATXN1; (+) strand; PAM type: YTN; PAM sequence: TTT
taaagactcgggataatggg

SEQ ID NO: 275028 - DNA, 20 bp, Artificial Sequence
  Description of Artificial Sequence: Synthetic oligonucleotide
  Target: ATXN1; (+) strand; PAM type: YTN; PAM sequence: TTT
aaagactcgggataatgggt

SEQ ID NO: 275029 - DNA, 20 bp, Artificial Sequence
  Description of Artificial Sequence: Synthetic oligonucleotide
  Target: ATXN1; (+) strand; PAM type: YTN; PAM sequence: TTA
aagactcgggataatgggtg

SEQ ID NO: 275030 - DNA, 20 bp, Artificial Sequence
  Description of Artificial Sequence: Synthetic oligonucleotide
  Target: ATXN1; (+) strand; PAM type: YTN; PAM sequence: CTC
gggataatgggtgaataggg

SEQ ID NO: 275031 - DNA, 20 bp, Artificial Sequence
  Description of Artificial Sequence: Synthetic oligonucleotide
  Target: ATXN1; (+) strand; PAM type: YTN; PAM sequence: CTA
gatcaagtattaaatcgcta

SEQ ID NO: 275032 - DNA, 20 bp, Artificial Sequence
  Description of Artificial Sequence: Synthetic oligonucleotide
  Target: ATXN1; (+) strand; PAM type: YTN; PAM sequence: TTA
aatcgctaagtctgaagtca

SEQ ID NO: 275033 - DNA, 20 bp, Artificial Sequence
  Description of Artificial Sequence: Synthetic oligonucleotide
  Target: ATXN1; (+) strand; PAM type: YTN; PAM sequence: CTA
agtctgaagtcaagcaaatg

SEQ ID NO: 275034 - DNA, 20 bp, Artificial Sequence
  Description of Artificial Sequence: Synthetic oligonucleotide
  Target: ATXN1; (+) strand; PAM type: YTN; PAM sequence: CTG
aagtcaagcaaatgtccttg

SEQ ID NO: 275035 - DNA, 20 bp, Artificial Sequence
  Description of Artificial Sequence: Synthetic oligonucleotide
  Target: ATXN1; (+) strand; PAM type: YTN; PAM sequence: CTT
gtttcagcccaatcatggta

SEQ ID NO: 275036 - DNA, 20 bp, Artificial Sequence
  Description of Artificial Sequence: Synthetic oligonucleotide
  Target: ATXN1; (+) strand; PAM type: YTN; PAM sequence: TTG
tttcagcccaatcatggtag

SEQ ID NO: 275037 - DNA, 20 bp, Artificial Sequence
  Description of Artificial Sequence: Synthetic oligonucleotide
  Target: ATXN1; (+) strand; PAM type: YTN; PAM sequence: TTT
cagcccaatcatggtagagt

SEQ ID NO: 275038 - DNA, 20 bp, Artificial Sequence
  Description of Artificial Sequence: Synthetic oligonucleotide
  Target: ATXN1; (+) strand; PAM type: YTN; PAM sequence: TTC
agcccaatcatggtagagtt

SEQ ID NO: 275039 - DNA, 20 bp, Artificial Sequence
  Description of Artificial Sequence: Synthetic oligonucleotide
  Target: ATXN1; (+) strand; PAM type: YTN; PAM sequence: TTA
cttaatgatacagaggaaag

SEQ ID NO: 275040 - DNA, 20 bp, Artificial Sequence
  Description of Artificial Sequence: Synthetic oligonucleotide
  Target: ATXN1; (+) strand; PAM type: YTN; PAM sequence: CTT
aatgatacagaggaaagtta

SEQ ID NO: 275041 - DNA, 20 bp, Artificial Sequence
  Description of Artificial Sequence: Synthetic oligonucleotide
  Target: ATXN1; (+) strand; PAM type: YTN; PAM sequence: TTA
atgatacagaggaaagttaa

SEQ ID NO: 275042 - DNA, 20 bp, Artificial Sequence
  Description of Artificial Sequence: Synthetic oligonucleotide
  Target: ATXN1; (+) strand; PAM type: YTN; PAM sequence: TTA
actgaaaaaactgtatgatc

SEQ ID NO: 275043 - DNA, 20 bp, Artificial Sequence
  Description of Artificial Sequence: Synthetic oligonucleotide
  Target: ATXN1; (+) strand; PAM type: YTN; PAM sequence: CTG
aaaaaactgtatgatcttga

SEQ ID NO: 275044 - DNA, 20 bp, Artificial Sequence
  Description of Artificial Sequence: Synthetic oligonucleotide
  Target: ATXN1; (+) strand; PAM type: YTN; PAM sequence: CTG
tatgatcttgagtgatccta

SEQ ID NO: 275045 - DNA, 20 bp, Artificial Sequence
  Description of Artificial Sequence: Synthetic oligonucleotide
  Target: ATXN1; (+) strand; PAM type: YTN; PAM sequence: CTT
gagtgatcctagaaattaaa

SEQ ID NO: 275046 - DNA, 20 bp, Artificial Sequence
  Description of Artificial Sequence: Synthetic oligonucleotide
  Target: ATXN1; (+) strand; PAM type: YTN; PAM sequence: TTG
agtgatcctagaaattaaat

SEQ ID NO: 275047 - DNA, 20 bp, Artificial Sequence
  Description of Artificial Sequence: Synthetic oligonucleotide
  Target: ATXN1; (+) strand; PAM type: YTN; PAM sequence: CTA
gaaattaaatcactatttga

SEQ ID NO: 275048 - DNA, 20 bp, Artificial Sequence
  Description of Artificial Sequence: Synthetic oligonucleotide
  Target: ATXN1; (+) strand; PAM type: YTN; PAM sequence: TTA
aatcactatttgaaggtgaa

SEQ ID NO: 275049 - DNA, 20 bp, Artificial Sequence
  Description of Artificial Sequence: Synthetic oligonucleotide
  Target: ATXN1; (+) strand; PAM type: YTN; PAM sequence: CTA
tttgaaggtgaaaacctaaa

SEQ ID NO: 275050 - DNA, 20 bp, Artificial Sequence
  Description of Artificial Sequence: Synthetic oligonucleotide
  Target: ATXN1; (+) strand; PAM type: YTN; PAM sequence: TTT
gaaggtgaaaacctaaaaaa

SEQ ID NO: 275051 - DNA, 20 bp, Artificial Sequence
  Description of Artificial Sequence: Synthetic oligonucleotide
  Target: ATXN1; (+) strand; PAM type: YTN; PAM sequence: TTG
aaggtgaaaacctaaaaaaa

SEQ ID NO: 275052 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaaaaaaaaatca

SEQ ID NO: 275053 - DNA, 20 bp, Artificial Sequence
  Description of Artificial Sequence: Synthetic oligonucleotide
  Target: ATXN1; (+) strand; PAM type: YTN; PAM sequence: CTT
accatatttctttagaaggt

SEQ ID NO: 275054 - DNA, 20 bp, Artificial Sequence
  Description of Artificial Sequence: Synthetic oligonucleotide
  Target: ATXN1; (+) strand; PAM type: YTN; PAM sequence: TTA
ccatatttctttagaaggta

SEQ ID NO: 275055 - DNA, 20 bp, Artificial Sequence
  Description of Artificial Sequence: Synthetic oligonucleotide
  Target: ATXN1; (+) strand; PAM type: YTN; PAM sequence: TTT
ctttagaaggtatcaaaaat

SEQ ID NO: 275056 - DNA, 20 bp, Artificial Sequence
  Description of Artificial Sequence: Synthetic oligonucleotide
  Target: ATXN1; (+) strand; PAM type: YTN; PAM sequence: TTC
tttagaaggtatcaaaaatt

SEQ ID NO: 275057 - DNA, 20 bp, Artificial Sequence
  Description of Artificial Sequence: Synthetic oligonucleotide
  Target: ATXN1; (+) strand; PAM type: YTN; PAM sequence: CTT
tagaaggtatcaaaaattaa

SEQ ID NO: 275058 - DNA, 20 bp, Artificial Sequence
  Description of Artificial Sequence: Synthetic oligonucleotide
  Target: ATXN1; (+) strand; PAM type: YTN; PAM sequence: TTT
agaaggtatcaaaaattaaa

SEQ ID NO: 275059 - DNA, 20 bp, Artificial Sequence
  Description of Artificial Sequence: Synthetic oligonucleotide
  Target: ATXN1; (+) strand; PAM type: YTN; PAM sequence: TTA
gaaggtatcaaaaattaaaa

SEQ ID NO: 275060 - DNA, 20 bp, Artificial Sequence
  Description of Artificial Sequence: Synthetic oligonucleotide
  Target: ATXN1; (+) strand; PAM type: YTN; PAM sequence: TTA
aaatattcattcagtgttaa

SEQ ID NO: 275061 - DNA, 20 bp, Artificial Sequence
  Description of Artificial Sequence: Synthetic oligonucleotide
  Target: ATXN1; (+) strand; PAM type: YTN; PAM sequence: TTC
attcagtgttaatatttcta

SEQ ID NO: 275062 - DNA, 20 bp, Artificial Sequence
  Description of Artificial Sequence: Synthetic oligonucleotide
  Target: ATXN1; (+) strand; PAM type: YTN; PAM sequence: TTC
agtgttaatatttctaatct

SEQ ID NO: 275063 - DNA, 20 bp, Artificial Sequence
  Description of Artificial Sequence: Synthetic oligonucleotide
  Target: ATXN1; (+) strand; PAM type: YTN; PAM sequence: TTA
atatttctaatctaagttcc

SEQ ID NO: 275064 - DNA, 20 bp, Artificial Sequence
  Description of Artificial Sequence: Synthetic oligonucleotide
  Target: ATXN1; (+) strand; PAM type: YTN; PAM sequence: TTT
ctaatctaagttccttctca

SEQ ID NO: 275065 - DNA, 20 bp, Artificial Sequence
  Description of Artificial Sequence: Synthetic oligonucleotide
  Target: ATXN1; (+) strand; PAM type: YTN; PAM sequence: TTC
taatctaagttccttctcaa

SEQ ID NO: 275066 - DNA, 20 bp, Artificial Sequence
  Description of Artificial Sequence: Synthetic oligonucleotide
  Target: ATXN1; (+) strand; PAM type: YTN; PAM sequence: CTA
atctaagttccttctcaaag

SEQ ID NO: 275067 - DNA, 20 bp, Artificial Sequence
  Description of Artificial Sequence: Synthetic oligonucleotide
  Target: ATXN1; (+) strand; PAM type: YTN; PAM sequence: CTA
agttccttctcaaagagaat

SEQ ID NO: 275068 - DNA, 20 bp, Artificial Sequence
  Description of Artificial Sequence: Synthetic oligonucleotide
  Target: ATXN1; (+) strand; PAM type: YTN; PAM sequence: TTC
cttctcaaagagaatggttg

SEQ ID NO: 275069 - DNA, 20 bp, Artificial Sequence
  Description of Artificial Sequence: Synthetic oligonucleotide
  Target: ATXN1; (+) strand; PAM type: YTN; PAM sequence: CTT
ctcaaagagaatggttggtt

SEQ ID NO: 275070 - DNA, 20 bp, Artificial Sequence
  Description of Artificial Sequence: Synthetic oligonucleotide
  Target: ATXN1; (+) strand; PAM type: YTN; PAM sequence: TTC
tcaaagagaatggttggttt

SEQ ID NO: 275071 - DNA, 20 bp, Artificial Sequence
  Description of Artificial Sequence: Synthetic oligonucleotide
  Target: ATXN1; (+) strand; PAM type: YTN; PAM sequence: CTC
aaagagaatggttggtttgg

SEQ ID NO: 275072 - DNA, 20 bp, Artificial Sequence
  Description of Artificial Sequence: Synthetic oligonucleotide
  Target: ATXN1; (+) strand; PAM type: YTN; PAM sequence: TTG
gtttggtaaaaatatatgtg

SEQ ID NO: 275073 - DNA, 20 bp, Artificial Sequence
  Description of Artificial Sequence: Synthetic oligonucleotide
  Target: ATXN1; (+) strand; PAM type: YTN; PAM sequence: TTT
ggtaaaaatatatgtgatag

SEQ ID NO: 275074 - DNA, 20 bp, Artificial Sequence
  Description of Artificial Sequence: Synthetic oligonucleotide
  Target: ATXN1; (+) strand; PAM type: YTN; PAM sequence: TTG
gtaaaaatatatgtgatagg

SEQ ID NO: 275075 - DNA, 20 bp, Artificial Sequence
  Description of Artificial Sequence: Synthetic oligonucleotide
  Target: ATXN1; (+) strand; PAM type: YTN; PAM sequence: TTT
gctgaagtcacatgacacat

SEQ ID NO: 275076 - DNA, 20 bp, Artificial Sequence
  Description of Artificial Sequence: Synthetic oligonucleotide
  Target: ATXN1; (+) strand; PAM type: YTN; PAM sequence: TTG
ctgaagtcacatgacacatc

SEQ ID NO: 275077 - DNA, 20 bp, Artificial Sequence
  Description of Artificial Sequence: Synthetic oligonucleotide
  Target: ATXN1; (+) strand; PAM type: YTN; PAM sequence: CTG
aagtcacatgacacatcctt

SEQ ID NO: 275078 - DNA, 20 bp, Artificial Sequence
  Description of Artificial Sequence: Synthetic oligonucleotide
  Target: ATXN1; (+) strand; PAM type: YTN; PAM sequence: CTT
gccctcaattaagggtgcca

SEQ ID NO: 275079 - DNA, 20 bp, Artificial Sequence
  Description of Artificial Sequence: Synthetic oligonucleotide
  Target: ATXN1; (+) strand; PAM type: YTN; PAM sequence: TTG
ccctcaattaagggtgccat

SEQ ID NO: 275080 - DNA, 20 bp, Artificial Sequence
  Description of Artificial Sequence: Synthetic oligonucleotide
  Target: ATXN1; (+) strand; PAM type: YTN; PAM sequence: CTC
aattaagggtgccatacctc

SEQ ID NO: 275081 - DNA, 20 bp, Artificial Sequence
  Description of Artificial Sequence: Synthetic oligonucleotide
  Target: ATXN1; (+) strand; PAM type: YTN; PAM sequence: TTA
agggtgccatacctcccccc

SEQ ID NO: 275082 - DNA, 20 bp, Artificial Sequence
  Description of Artificial Sequence: Synthetic oligonucleotide
  Target: ATXN1; (+) strand; PAM type: YTN; PAM sequence: CTC
cccccgcgactagtgacatt

SEQ ID NO: 275083 - DNA, 20 bp, Artificial Sequence
  Description of Artificial Sequence: Synthetic oligonucleotide
  Target: ATXN1; (+) strand; PAM type: YTN; PAM sequence: CTA
gtgacattccaggaaaatct

SEQ ID NO: 275084 - DNA, 20 bp, Artificial Sequence
  Description of Artificial Sequence: Synthetic oligonucleotide
  Target: ATXN1; (+) strand; PAM type: YTN; PAM sequence: TTC
caggaaaatctcacttttga

SEQ ID NO: 275085 - DNA, 20 bp, Artificial Sequence
  Description of Artificial Sequence: Synthetic oligonucleotide
  Target: ATXN1; (+) strand; PAM type: YTN; PAM sequence: CTC
acttttgaggggaggctggg

SEQ ID NO: 275086 - DNA, 20 bp, Artificial Sequence
  Description of Artificial Sequence: Synthetic oligonucleotide
  Target: ATXN1; (+) strand; PAM type: YTN; PAM sequence: CTT
ttgaggggaggctggggaag

SEQ ID NO: 275087 - DNA, 20 bp, Artificial Sequence
  Description of Artificial Sequence: Synthetic oligonucleotide
  Target: ATXN1; (+) strand; PAM type: YTN; PAM sequence: TTT
tgaggggaggctggggaagt

SEQ ID NO: 275088 - DNA, 20 bp, Artificial Sequence
  Description of Artificial Sequence: Synthetic oligonucleotide
  Target: ATXN1; (+) strand; PAM type: YTN; PAM sequence: TTT
gaggggaggctggggaagtg

SEQ ID NO: 275089 - DNA, 20 bp, Artificial Sequence
  Description of Artificial Sequence: Synthetic oligonucleotide
  Target: ATXN1; (+) strand; PAM type: YTN; PAM sequence: TTG
aggggaggctggggaagtga

SEQ ID NO: 275090 - DNA, 20 bp, Artificial Sequence
  Description of Artificial Sequence: Synthetic oligonucleotide
  Target: ATXN1; (+) strand; PAM type: YTN; PAM sequence: CTG
gggaagtgagcatatccccg

SEQ ID NO: 275091 - DNA, 20 bp, Artificial Sequence
  Description of Artificial Sequence: Synthetic oligonucleotide
  Target: ATXN1; (+) strand; PAM type: YTN; PAM sequence: CTC
cagccatggagacacgaatg

SEQ ID NO: 275092 - DNA, 20 bp, Artificial Sequence
  Description of Artificial Sequence: Synthetic oligonucleotide
  Target: ATXN1; (+) strand; PAM type: YTN; PAM sequence: TTA
accttttctaagtatccaac

SEQ ID NO: 275093 - DNA, 20 bp, Artificial Sequence
  Description of Artificial Sequence: Synthetic oligonucleotide
  Target: ATXN1; (+) strand; PAM type: YTN; PAM sequence: CTT
ttctaagtatccaacactgc

SEQ ID NO: 275094 - DNA, 20 bp, Artificial Sequence
  Description of Artificial Sequence: Synthetic oligonucleotide
  Target: ATXN1; (+) strand; PAM type: YTN; PAM sequence: TTT
tctaagtatccaacactgct

SEQ ID NO: 275095 - DNA, 20 bp, Artificial Sequence
  Description of Artificial Sequence: Synthetic oligonucleotide
  Target: ATXN1; (+) strand; PAM type: YTN; PAM sequence: TTT
ctaagtatccaacactgctc

SEQ ID NO: 275096 - DNA, 20 bp, Artificial Sequence
  Description of Artificial Sequence: Synthetic oligonucleotide
  Target: ATXN1; (+) strand; PAM type: YTN; PAM sequence: TTC
taagtatccaacactgctcc

SEQ ID NO: 275097 - DNA, 20 bp, Artificial Sequence
  Description of Artificial Sequence: Synthetic oligonucleotide
  Target: ATXN1; (+) strand; PAM type: YTN; PAM sequence: CTA
agtatccaacactgctccat

SEQ ID NO: 275098 - DNA, 20 bp, Artificial Sequence
  Description of Artificial Sequence: Synthetic oligonucleotide
  Target: ATXN1; (+) strand; PAM type: YTN; PAM sequence: CTG
ctccatgaatcaggcaggag

SEQ ID NO: 275099 - DNA, 20 bp, Artificial Sequence
  Description of Artificial Sequence: Synthetic oligonucleotide
  Target: ATXN1; (+) strand; PAM type: YTN; PAM sequence: CTC
catgaatcaggcaggagatg

SEQ ID NO: 275100 - DNA, 20 bp, Artificial Sequence
  Description of Artificial Sequence: Synthetic oligonucleotide
  Target: ATXN1; (+) strand; PAM type: YTN; PAM sequence: CTG
gcagagagcagcagagggag

SEQ ID NO: 275101 - DNA, 20 bp, Artificial Sequence
  Description of Artificial Sequence: Synthetic oligonucleotide
  Target: ATXN1; (+) strand; PAM type: YTN; PAM sequence: CTG
gctgcaaaatcccagcgaga

SEQ ID NO: 275102 - DNA, 20 bp, Artificial Sequence
  Description of Artificial Sequence: Synthetic oligonucleotide
  Target: ATXN1; (+) strand; PAM type: YTN; PAM sequence: CTG
caaaatcccagcgagatcaa

SEQ ID NO: 275103 - DNA, 20 bp, Artificial Sequence
  Description of Artificial Sequence: Synthetic oligonucleotide
  Target: ATXN1; (+) strand; PAM type: YTN; PAM sequence: CTG
atctgtgaaaccaaggtcca

SEQ ID NO: 275104 - DNA, 20 bp, Artificial Sequence
  Description of Artificial Sequence: Synthetic oligonucleotide
  Target: ATXN1; (+) strand; PAM type: YTN; PAM sequence: CTG
tgaaaccaaggtccataacc

SEQ ID NO: 275105 - DNA, 20 bp, Artificial Sequence
  Description of Artificial Sequence: Synthetic oligonucleotide
  Target: ATXN1; (+) strand; PAM type: YTN; PAM sequence: CTT
acaacaaatgctccctaaat

SEQ ID NO: 275106 - DNA, 20 bp, Artificial Sequence
  Description of Artificial Sequence: Synthetic oligonucleotide
  Target: ATXN1; (+) strand; PAM type: YTN; PAM sequence: TTA
caacaaatgctccctaaatg

SEQ ID NO: 275107 - DNA, 20 bp, Artificial Sequence
  Description of Artificial Sequence: Synthetic oligonucleotide
  Target: ATXN1; (+) strand; PAM type: YTN; PAM sequence: CTC
cctaaatgcttcatccctgg

SEQ ID NO: 275108 - DNA, 20 bp, Artificial Sequence
  Description of Artificial Sequence: Synthetic oligonucleotide
  Target: ATXN1; (+) strand; PAM type: YTN; PAM sequence: CTA
aatgcttcatccctggtcca

SEQ ID NO: 275109 - DNA, 20 bp, Artificial Sequence
  Description of Artificial Sequence: Synthetic oligonucleotide
  Target: ATXN1; (+) strand; PAM type: YTN; PAM sequence: CTT
catccctggtccagccgatg

SEQ ID NO: 275110 - DNA, 20 bp, Artificial Sequence
  Description of Artificial Sequence: Synthetic oligonucleotide
  Target: ATXN1; (+) strand; PAM type: YTN; PAM sequence: TTC
atccctggtccagccgatgc

SEQ ID NO: 275111 - DNA, 20 bp, Artificial Sequence
  Description of Artificial Sequence: Synthetic oligonucleotide
  Target: ATXN1; (+) strand; PAM type: YTN; PAM sequence: CTG
gtccagccgatgcaattttt

SEQ ID NO: 275112 - DNA, 20 bp, Artificial Sequence
  Description of Artificial Sequence: Synthetic oligonucleotide
  Target: ATXN1; (+) strand; PAM type: YTN; PAM sequence: TTT
ttaaggggagtggtaatttg

SEQ ID NO: 275113 - DNA, 20 bp, Artificial Sequence
  Description of Artificial Sequence: Synthetic oligonucleotide
  Target: ATXN1; (+) strand; PAM type: YTN; PAM sequence: TTT
taaggggagtggtaatttgt

SEQ ID NO: 275114 - DNA, 20 bp, Artificial Sequence
  Description of Artificial Sequence: Synthetic oligonucleotide
  Target: ATXN1; (+) strand; PAM type: YTN; PAM sequence: TTT
aaggggagtggtaatttgtg

SEQ ID NO: 275115 - DNA, 20 bp, Artificial Sequence
  Description of Artificial Sequence: Synthetic oligonucleotide
  Target: ATXN1; (+) strand; PAM type: YTN; PAM sequence: TTA
aggggagtggtaatttgtgg

SEQ ID NO: 275116 - DNA, 20 bp, Artificial Sequence
  Description of Artificial Sequence: Synthetic oligonucleotide
  Target: ATXN1; (+) strand; PAM type: YTN; PAM sequence: TTT
gtggtgggggtcatgctctt

SEQ ID NO: 275117 - DNA, 20 bp, Artificial Sequence
  Description of Artificial Sequence: Synthetic oligonucleotide
  Target: ATXN1; (+) strand; PAM type: YTN; PAM sequence: TTG
tggtgggggtcatgctctta

SEQ ID NO: 275118 - DNA, 20 bp, Artificial Sequence
  Description of Artificial Sequence: Synthetic oligonucleotide
  Target: ATXN1; (+) strand; PAM type: YTN; PAM sequence: CTC
ttagaaaaaacatgtctatt

SEQ ID NO: 275119 - DNA, 20 bp, Artificial Sequence
  Description of Artificial Sequence: Synthetic oligonucleotide
  Target: ATXN1; (+) strand; PAM type: YTN; PAM sequence: CTT
agaaaaaacatgtctattac

SEQ ID NO: 275120 - DNA, 20 bp, Artificial Sequence
  Description of Artificial Sequence: Synthetic oligonucleotide
  Target: ATXN1; (+) strand; PAM type: YTN; PAM sequence: TTA
gaaaaaacatgtctattaca

SEQ ID NO: 275121 - DNA, 20 bp, Artificial Sequence
  Description of Artificial Sequence: Synthetic oligonucleotide
  Target: ATXN1; (+) strand; PAM type: YTN; PAM sequence: CTA
ttacattttgaccatgtgaa

SEQ ID NO: 275122 - DNA, 20 bp, Artificial Sequence
  Description of Artificial Sequence: Synthetic oligonucleotide
  Target: ATXN1; (+) strand; PAM type: YTN; PAM sequence: TTA
cattttgaccatgtgaaata

SEQ ID NO: 275123 - DNA, 20 bp, Artificial Sequence
  Description of Artificial Sequence: Synthetic oligonucleotide
  Target: ATXN1; (+) strand; PAM type: YTN; PAM sequence: TTT
tgaccatgtgaaatagaatc

SEQ ID NO: 275124 - DNA, 20 bp, Artificial Sequence
  Description of Artificial Sequence: Synthetic oligonucleotide
  Target: ATXN1; (+) strand; PAM type: YTN; PAM sequence: TTT
gaccatgtgaaatagaatca

SEQ ID NO: 275125 - DNA, 20 bp, Artificial Sequence
  Description of Artificial Sequence: Synthetic oligonucleotide
  Target: ATXN1; (+) strand; PAM type: YTN; PAM sequence: TTG
accatgtgaaatagaatcaa

SEQ ID NO: 275126 - DNA, 20 bp, Artificial Sequence
  Description of Artificial Sequence: Synthetic oligonucleotide
  Target: ATXN1; (+) strand; PAM type: YTN; PAM sequence: TTG
ggaactaagaacacagacct

SEQ ID NO: 275127 - DNA, 20 bp, Artificial Sequence
  Description of Artificial Sequence: Synthetic oligonucleotide
  Target: ATXN1; (+) strand; PAM type: YTN; PAM sequence: CTA
agaacacagaccttaaatgt

SEQ ID NO: 275128 - DNA, 20 bp, Artificial Sequence
  Description of Artificial Sequence: Synthetic oligonucleotide
  Target: ATXN1; (+) strand; PAM type: YTN; PAM sequence: CTT
aaatgtcagcagtggatgga

SEQ ID NO: 275129 - DNA, 20 bp, Artificial Sequence
  Description of Artificial Sequence: Synthetic oligonucleotide
  Target: ATXN1; (+) strand; PAM type: YTN; PAM sequence: TTA
aatgtcagcagtggatggag

SEQ ID NO: 275130 - DNA, 20 bp, Artificial Sequence
  Description of Artificial Sequence: Synthetic oligonucleotide
  Target: ATXN1; (+) strand; PAM type: YTN; PAM sequence: TTT
ctttgacaattcactctagg

SEQ ID NO: 275131 - DNA, 20 bp, Artificial Sequence
  Description of Artificial Sequence: Synthetic oligonucleotide
  Target: ATXN1; (+) strand; PAM type: YTN; PAM sequence: TTC
tttgacaattcactctaggc

SEQ ID NO: 275132 - DNA, 20 bp, Artificial Sequence
  Description of Artificial Sequence: Synthetic oligonucleotide
  Target: ATXN1; (+) strand; PAM type: YTN; PAM sequence: CTT
tgacaattcactctaggcat

SEQ ID NO: 275133 - DNA, 20 bp, Artificial Sequence
  Description of Artificial Sequence: Synthetic oligonucleotide
  Target: ATXN1; (+) strand; PAM type: YTN; PAM sequence: TTT
gacaattcactctaggcatt

SEQ ID NO: 275134 - DNA, 20 bp, Artificial Sequence
  Description of Artificial Sequence: Synthetic oligonucleotide
  Target: ATXN1; (+) strand; PAM type: YTN; PAM sequence: TTG
acaattcactctaggcattt

SEQ ID NO: 275135 - DNA, 20 bp, Artificial Sequence
  Description of Artificial Sequence: Synthetic oligonucleotide
  Target: ATXN1; (+) strand; PAM type: YTN; PAM sequence: TTC
actctaggcatttgcaatat

SEQ ID NO: 275136 - DNA, 20 bp, Artificial Sequence
  Description of Artificial Sequence: Synthetic oligonucleotide
  Target: ATXN1; (+) strand; PAM type: YTN; PAM sequence: CTC
taggcatttgcaatatcatg

SEQ ID NO: 275137 - DNA, 20 bp, Artificial Sequence
  Description of Artificial Sequence: Synthetic oligonucleotide
  Target: ATXN1; (+) strand; PAM type: YTN; PAM sequence: CTA
ggcatttgcaatatcatgga

SEQ ID NO: 275138 - DNA, 20 bp, Artificial Sequence
  Description of Artificial Sequence: Synthetic oligonucleotide
  Target: ATXN1; (+) strand; PAM type: YTN; PAM sequence: TTT
gcaatatcatggaatatgaa

SEQ ID NO: 275139 - DNA, 20 bp, Artificial Sequence
  Description of Artificial Sequence: Synthetic oligonucleotide
  Target: ATXN1; (+) strand; PAM type: YTN; PAM sequence: TTG
caatatcatggaatatgaac

SEQ ID NO: 275140 - DNA, 20 bp, Artificial Sequence
  Description of Artificial Sequence: Synthetic oligonucleotide
  Target: ATXN1; (+) strand; PAM type: YTN; PAM sequence: CTG
agctacttttaacaaatctc

SEQ ID NO: 275141 - DNA, 20 bp, Artificial Sequence
  Description of Artificial Sequence: Synthetic oligonucleotide
  Target: ATXN1; (+) strand; PAM type: YTN; PAM sequence: CTA
cttttaacaaatctcttttc

SEQ ID NO: 275142 - DNA, 20 bp, Artificial Sequence
  Description of Artificial Sequence: Synthetic oligonucleotide
  Target: ATXN1; (+) strand; PAM type: YTN; PAM sequence: CTT
ttaacaaatctcttttcata

SEQ ID NO: 275143 - DNA, 20 bp, Artificial Sequence
  Description of Artificial Sequence: Synthetic oligonucleotide
  Target: ATXN1; (+) strand; PAM type: YTN; PAM sequence: TTT
taacaaatctcttttcatag

SEQ ID NO: 275144 - DNA, 20 bp, Artificial Sequence
  Description of Artificial Sequence: Synthetic oligonucleotide
  Target: ATXN1; (+) strand; PAM type: YTN; PAM sequence: TTT
aacaaatctcttttcatagt

SEQ ID NO: 275145 - DNA, 20 bp, Artificial Sequence
  Description of Artificial Sequence: Synthetic oligonucleotide
  Target: ATXN1; (+) strand; PAM type: YTN; PAM sequence: TTA
acaaatctcttttcatagta

SEQ ID NO: 275146 - DNA, 20 bp, Artificial Sequence
  Description of Artificial Sequence: Synthetic oligonucleotide
  Target: ATXN1; (+) strand; PAM type: YTN; PAM sequence: CTC
ttttcatagtacaattcagg

SEQ ID NO: 275147 - DNA, 20 bp, Artificial Sequence
  Description of Artificial Sequence: Synthetic oligonucleotide
  Target: ATXN1; (+) strand; PAM type: YTN; PAM sequence: CTT
ttcatagtacaattcaggac

SEQ ID NO: 275148 - DNA, 20 bp, Artificial Sequence
  Description of Artificial Sequence: Synthetic oligonucleotide
  Target: ATXN1; (+) strand; PAM type: YTN; PAM sequence: TTT
tcatagtacaattcaggacc

SEQ ID NO: 275149 - DNA, 20 bp, Artificial Sequence
  Description of Artificial Sequence: Synthetic oligonucleotide
  Target: ATXN1; (+) strand; PAM type: YTN; PAM sequence: TTT
catagtacaattcaggacct

SEQ ID NO: 275150 - DNA, 20 bp, Artificial Sequence
  Description of Artificial Sequence: Synthetic oligonucleotide
  Target: ATXN1; (+) strand; PAM type: YTN; PAM sequence: TTC
atagtacaattcaggacctg

SEQ ID NO: 275151 - DNA, 20 bp, Artificial Sequence
  Description of Artificial Sequence: Synthetic oligonucleotide
  Target: ATXN1; (+) strand; PAM type: YTN; PAM sequence: TTC
aggacctggtgagatgtttc

SEQ ID NO: 275152 - DNA, 20 bp, Artificial Sequence
  Description of Artificial Sequence: Synthetic oligonucleotide
  Target: ATXN1; (+) strand; PAM type: YTN; PAM sequence: CTG
gtgagatgtttccagatcta

SEQ ID NO: 275153 - DNA, 20 bp, Artificial Sequence
  Description of Artificial Sequence: Synthetic oligonucleotide
  Target: ATXN1; (+) strand; PAM type: YTN; PAM sequence: TTT
ccagatctaacaatgcactt

SEQ ID NO: 275154 - DNA, 20 bp, Artificial Sequence
  Description of Artificial Sequence: Synthetic oligonucleotide
  Target: ATXN1; (+) strand; PAM type: YTN; PAM sequence: TTC
cagatctaacaatgcacttc

SEQ ID NO: 275155 - DNA, 20 bp, Artificial Sequence
  Description of Artificial Sequence: Synthetic oligonucleotide
  Target: ATXN1; (+) strand; PAM type: YTN; PAM sequence: CTA
acaatgcacttcttataggg

SEQ ID NO: 275156 - DNA, 20 bp, Artificial Sequence
  Description of Artificial Sequence: Synthetic oligonucleotide
  Target: ATXN1; (+) strand; PAM type: YTN; PAM sequence: CTT
cttatagggacagagttttt

SEQ ID NO: 275157 - DNA, 20 bp, Artificial Sequence
  Description of Artificial Sequence: Synthetic oligonucleotide
  Target: ATXN1; (+) strand; PAM type: YTN; PAM sequence: TTC
ttatagggacagagtttttg

SEQ ID NO: 275158 - DNA, 20 bp, Artificial Sequence
  Description of Artificial Sequence: Synthetic oligonucleotide
  Target: ATXN1; (+) strand; PAM type: YTN; PAM sequence: CTT
atagggacagagtttttgct

SEQ ID NO: 275159 - DNA, 20 bp, Artificial Sequence
  Description of Artificial Sequence: Synthetic oligonucleotide
  Target: ATXN1; (+) strand; PAM type: YTN; PAM sequence: TTA
tagggacagagtttttgctt

SEQ ID NO: 275160 - DNA, 20 bp, Artificial Sequence
  Description of Artificial Sequence: Synthetic oligonucleotide
  Target: ATXN1; (+) strand; PAM type: YTN; PAM sequence: TTT
ttgctttgcccaactctctc

SEQ ID NO: 275161 - DNA, 20 bp, Artificial Sequence
  Description of Artificial Sequence: Synthetic oligonucleotide
  Target: ATXN1; (+) strand; PAM type: YTN; PAM sequence: TTT
tgctttgcccaactctctcg

SEQ ID NO: 275162 - DNA, 20 bp, Artificial Sequence
  Description of Artificial Sequence: Synthetic oligonucleotide
  Target: ATXN1; (+) strand; PAM type: YTN; PAM sequence: TTT
gctttgcccaactctctcgt

SEQ ID NO: 275163 - DNA, 20 bp, Artificial Sequence
  Description of Artificial Sequence: Synthetic oligonucleotide
  Target: ATXN1; (+) strand; PAM type: YTN; PAM sequence: TTG
ctttgcccaactctctcgtg

SEQ ID NO: 275164 - DNA, 20 bp, Artificial Sequence
  Description of Artificial Sequence: Synthetic oligonucleotide
  Target: ATXN1; (+) strand; PAM type: YTN; PAM sequence: CTT
tgcccaactctctcgtggtc

SEQ ID NO: 275165 - DNA, 20 bp, Artificial Sequence
  Description of Artificial Sequence: Synthetic oligonucleotide
  Target: ATXN1; (+) strand; PAM type: YTN; PAM sequence: TTT
gcccaactctctcgtggtca

SEQ ID NO: 275166 - DNA, 20 bp, Artificial Sequence
  Description of Artificial Sequence: Synthetic oligonucleotide
  Target: ATXN1; (+) strand; PAM type: YTN; PAM sequence: TTG
cccaactctctcgtggtcac

SEQ ID NO: 275167 - DNA, 20 bp, Artificial Sequence
  Description of Artificial Sequence: Synthetic oligonucleotide
  Target: ATXN1; (+) strand; PAM type: YTN; PAM sequence: CTC
tctcgtggtcaccgctttta

SEQ ID NO: 275168 - DNA, 20 bp, Artificial Sequence
  Description of Artificial Sequence: Synthetic oligonucleotide
  Target: ATXN1; (+) strand; PAM type: YTN; PAM sequence: CTC
tcgtggtcaccgcttttaca

SEQ ID NO: 275169 - DNA, 20 bp, Artificial Sequence
  Description of Artificial Sequence: Synthetic oligonucleotide
  Target: ATXN1; (+) strand; PAM type: YTN; PAM sequence: CTC
gtggtcaccgcttttacatg

SEQ ID NO: 275170 - DNA, 20 bp, Artificial Sequence
  Description of Artificial Sequence: Synthetic oligonucleotide
  Target: ATXN1; (+) strand; PAM type: YTN; PAM sequence: CTT
ttacatgagtgagcattaga

SEQ ID NO: 275171 - DNA, 20 bp, Artificial Sequence
  Description of Artificial Sequence: Synthetic oligonucleotide
  Target: ATXN1; (+) strand; PAM type: YTN; PAM sequence: TTT
tacatgagtgagcattagat

SEQ ID NO: 275172 - DNA, 20 bp, Artificial Sequence
  Description of Artificial Sequence: Synthetic oligonucleotide
  Target: ATXN1; (+) strand; PAM type: YTN; PAM sequence: TTT
acatgagtgagcattagatg

SEQ ID NO: 275173 - DNA, 20 bp, Artificial Sequence
  Description of Artificial Sequence: Synthetic oligonucleotide
  Target: ATXN1; (+) strand; PAM type: YTN; PAM sequence: TTA
catgagtgagcattagatgg

SEQ ID NO: 275174 - DNA, 20 bp, Artificial Sequence
  Description of Artificial Sequence: Synthetic oligonucleotide
  Target: ATXN1; (+) strand; PAM type: YTN; PAM sequence: TTA
gatggtcaggctgtgttgtg

SEQ ID NO: 275175 - DNA, 20 bp, Artificial Sequence
  Description of Artificial Sequence: Synthetic oligonucleotide
  Target: ATXN1; (+) strand; PAM type: YTN; PAM sequence: CTG
tgttgtgtgctatacaatgg

SEQ ID NO: 275176 - DNA, 20 bp, Artificial Sequence
  Description of Artificial Sequence: Synthetic oligonucleotide
  Target: ATXN1; (+) strand; PAM type: YTN; PAM sequence: TTG
tgtgctatacaatggctttt

SEQ ID NO: 275177 - DNA, 20 bp, Artificial Sequence
  Description of Artificial Sequence: Synthetic oligonucleotide
  Target: ATXN1; (+) strand; PAM type: YTN; PAM sequence: CTA
tacaatggcttttttacacc

SEQ ID NO: 275178 - DNA, 20 bp, Artificial Sequence
  Description of Artificial Sequence: Synthetic oligonucleotide
  Target: ATXN1; (+) strand; PAM type: YTN; PAM sequence: CTT
ttttacaccatcaagactaa

SEQ ID NO: 275179 - DNA, 20 bp, Artificial Sequence
  Description of Artificial Sequence: Synthetic oligonucleotide
  Target: ATXN1; (+) strand; PAM type: YTN; PAM sequence: TTT
tttacaccatcaagactaaa

SEQ ID NO: 275180 - DNA, 20 bp, Artificial Sequence
  Description of Artificial Sequence: Synthetic oligonucleotide
  Target: ATXN1; (+) strand; PAM type: YTN; PAM sequence: TTT
ttacaccatcaagactaaat

SEQ ID NO: 275181 - DNA, 20 bp, Artificial Sequence
  Description of Artificial Sequence: Synthetic oligonucleotide
  Target: ATXN1; (+) strand; PAM type: YTN; PAM sequence: TTT
tacaccatcaagactaaatc

SEQ ID NO: 275182 - DNA, 20 bp, Artificial Sequence
  Description of Artificial Sequence: Synthetic oligonucleotide
  Target: ATXN1; (+) strand; PAM type: YTN; PAM sequence: TTT
acaccatcaagactaaatct

SEQ ID NO: 275183 - DNA, 20 bp, Artificial Sequence
  Description of Artificial Sequence: Synthetic oligonucleotide
  Target: ATXN1; (+) strand; PAM type: YTN; PAM sequence: TTA
caccatcaagactaaatctg

SEQ ID NO: 275184 - DNA, 20 bp, Artificial Sequence
  Description of Artificial Sequence: Synthetic oligonucleotide
  Target: ATXN1; (+) strand; PAM type: YTN; PAM sequence: CTA
aatctgctgggtgctgtggc

SEQ ID NO: 275185 - DNA, 20 bp, Artificial Sequence
  Description of Artificial Sequence: Synthetic oligonucleotide
  Target: ATXN1; (+) strand; PAM type: YTN; PAM sequence: CTG
ctgggtgctgtggctcatgc

SEQ ID NO: 275186 - DNA, 20 bp, Artificial Sequence
  Description of Artificial Sequence: Synthetic oligonucleotide
  Target: ATXN1; (+) strand; PAM type: YTN; PAM sequence: CTG
ggtgctgtggctcatgcctg

SEQ ID NO: 275187 - DNA, 20 bp, Artificial Sequence
  Description of Artificial Sequence: Synthetic oligonucleotide
  Target: ATXN1; (+) strand; PAM type: YTN; PAM sequence: CTG
tggctcatgcctgtaatccc

SEQ ID NO: 275188 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 275189 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttcggag

SEQ ID NO: 275190 - DNA, 20 bp, Artificial Sequence
  Description of Artificial Sequence: Synthetic oligonucleotide
  Target: ATXN1; (+) strand; PAM type: YTN; PAM sequence: CTT
tcggaggccaaggcaggaag

SEQ ID NO: 275191 - DNA, 20 bp, Artificial Sequence
  Description of Artificial Sequence: Synthetic oligonucleotide
  Target: ATXN1; (+) strand; PAM type: YTN; PAM sequence: TTT
cggaggccaaggcaggaaga

SEQ ID NO: 275192 - DNA, 20 bp, Artificial Sequence
  Description of Artificial Sequence: Synthetic oligonucleotide
  Target: ATXN1; (+) strand; PAM type: YTN; PAM sequence: TTC
ggaggccaaggcaggaagat

SEQ ID NO: 275193 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcaagaca

SEQ ID NO: 275194 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacaa

SEQ ID NO: 275195 - DNA, 20 bp, Artificial Sequence
  Description of Artificial Sequence: Synthetic oligonucleotide
  Target: ATXN1; (+) strand; PAM type: YTN; PAM sequence: TTC
aagacaagcctgggcaacat

SEQ ID NO: 275196 - DNA, 20 bp, Artificial Sequence
  Description of Artificial Sequence: Synthetic oligonucleotide
  Target: ATXN1; (+) strand; PAM type: YTN; PAM sequence: CTG
ggcaacatggcaaaaccccg

SEQ ID NO: 275197 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 275198 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 275199 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 275200 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtcctggtgcacg

SEQ ID NO: 275201 - DNA, 20 bp, Artificial Sequence
  Description of Artificial Sequence: Synthetic oligonucleotide
  Target: ATXN1; (+) strand; PAM type: YTN; PAM sequence: CTG
gtgcacgcctgtaatcccag

SEQ ID NO: 275202 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcgggag

SEQ ID NO: 275203 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagca

SEQ ID NO: 275204 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcagcagaa

SEQ ID NO: 275205 - DNA, 20 bp, Artificial Sequence
  Description of Artificial Sequence: Synthetic oligonucleotide
  Target: ATXN1; (+) strand; PAM type: YTN; PAM sequence: CTG
aggcagcagaatctctttaa

SEQ ID NO: 275206 - DNA, 20 bp, Artificial Sequence
  Description of Artificial Sequence: Synthetic oligonucleotide
  Target: ATXN1; (+) strand; PAM type: YTN; PAM sequence: CTC
tttaacccgggaggtggagg

SEQ ID NO: 275207 - DNA, 20 bp, Artificial Sequence
  Description of Artificial Sequence: Synthetic oligonucleotide
  Target: ATXN1; (+) strand; PAM type: YTN; PAM sequence: CTT
taacccgggaggtggaggtt

SEQ ID NO: 275208 - DNA, 20 bp, Artificial Sequence
  Description of Artificial Sequence: Synthetic oligonucleotide
  Target: ATXN1; (+) strand; PAM type: YTN; PAM sequence: TTT
aacccgggaggtggaggttg

SEQ ID NO: 275209 - DNA, 20 bp, Artificial Sequence
  Description of Artificial Sequence: Synthetic oligonucleotide
  Target: ATXN1; (+) strand; PAM type: YTN; PAM sequence: TTA
acccgggaggtggaggttgc

SEQ ID NO: 275210 - DNA, 20 bp, Artificial Sequence
  Description of Artificial Sequence: Synthetic oligonucleotide
  Target: ATXN1; (+) strand; PAM type: YTN; PAM sequence: TTG
cagatagctgagatcgcacc

SEQ ID NO: 275211 - DNA, 20 bp, Artificial Sequence
  Description of Artificial Sequence: Synthetic oligonucleotide
  Target: ATXN1; (+) strand; PAM type: YTN; PAM sequence: CTG
agatcgcaccactgcactcc

SEQ ID NO: 275212 - DNA, 20 bp, Artificial Sequence
  Description of Artificial Sequence: Synthetic oligonucleotide
  Target: ATXN1; (+) strand; PAM type: YTN; PAM sequence: CTG
cactccaacctgggcaacag

SEQ ID NO: 275213 - DNA, 20 bp, Artificial Sequence
  Description of Artificial Sequence: Synthetic oligonucleotide
  Target: ATXN1; (+) strand; PAM type: YTN; PAM sequence: CTC
caacctgggcaacagagtga

SEQ ID NO: 275214 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagtgagactccc

SEQ ID NO: 275215 - DNA, 20 bp, Artificial Sequence
  Description of Artificial Sequence: Synthetic oligonucleotide
  Target: ATXN1; (+) strand; PAM type: YTN; PAM sequence: CTC
cctctcaaaaaaaaaaaaaa

SEQ ID NO: 275216 - DNA, 20 bp, Artificial Sequence
  Description of Artificial Sequence: Synthetic oligonucleotide
  Target: ATXN1; (+) strand; PAM type: YTN; PAM sequence: CTC
tcaaaaaaaaaaaaaaaaag

SEQ ID NO: 275217 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaagaa

SEQ ID NO: 275218 - DNA, 20 bp, Artificial Sequence
  Description of Artificial Sequence: Synthetic oligonucleotide
  Target: ATXN1; (+) strand; PAM type: YTN; PAM sequence: CTA
aatcatacattgcttccaaa

SEQ ID NO: 275219 - DNA, 20 bp, Artificial Sequence
  Description of Artificial Sequence: Synthetic oligonucleotide
  Target: ATXN1; (+) strand; PAM type: YTN; PAM sequence: TTG
cttccaaaggtagctccata

SEQ ID NO: 275220 - DNA, 20 bp, Artificial Sequence
  Description of Artificial Sequence: Synthetic oligonucleotide
  Target: ATXN1; (+) strand; PAM type: YTN; PAM sequence: CTT
ccaaaggtagctccatatcc

SEQ ID NO: 275221 - DNA, 20 bp, Artificial Sequence
  Description of Artificial Sequence: Synthetic oligonucleotide
  Target: ATXN1; (+) strand; PAM type: YTN; PAM sequence: TTC
caaaggtagctccatatcct

SEQ ID NO: 275222 - DNA, 20 bp, Artificial Sequence
  Description of Artificial Sequence: Synthetic oligonucleotide
  Target: ATXN1; (+) strand; PAM type: YTN; PAM sequence: CTC
catatcctctgaaggtatac

SEQ ID NO: 275223 - DNA, 20 bp, Artificial Sequence
  Description of Artificial Sequence: Synthetic oligonucleotide
  Target: ATXN1; (+) strand; PAM type: YTN; PAM sequence: CTC
tgaaggtatacatgggaggg

SEQ ID NO: 275224 - DNA, 20 bp, Artificial Sequence
  Description of Artificial Sequence: Synthetic oligonucleotide
  Target: ATXN1; (+) strand; PAM type: YTN; PAM sequence: CTG
aaggtatacatgggagggcc

SEQ ID NO: 275225 - DNA, 20 bp, Artificial Sequence
  Description of Artificial Sequence: Synthetic oligonucleotide
  Target: ATXN1; (+) strand; PAM type: YTN; PAM sequence: TTC
cagatctagccataaaacca

SEQ ID NO: 275226 - DNA, 20 bp, Artificial Sequence
  Description of Artificial Sequence: Synthetic oligonucleotide
  Target: ATXN1; (+) strand; PAM type: YTN; PAM sequence: CTA
gccataaaaccatgcggttt

SEQ ID NO: 275227 - DNA, 20 bp, Artificial Sequence
  Description of Artificial Sequence: Synthetic oligonucleotide
  Target: ATXN1; (+) strand; PAM type: YTN; PAM sequence: TTT
agattttaacatccaaatcc

SEQ ID NO: 275228 - DNA, 20 bp, Artificial Sequence
  Description of Artificial Sequence: Synthetic oligonucleotide
  Target: ATXN1; (+) strand; PAM type: YTN; PAM sequence: TTA
gattttaacatccaaatcca

SEQ ID NO: 275229 - DNA, 20 bp, Artificial Sequence
  Description of Artificial Sequence: Synthetic oligonucleotide
  Target: ATXN1; (+) strand; PAM type: YTN; PAM sequence: TTT
taacatccaaatccaattgt

SEQ ID NO: 275230 - DNA, 20 bp, Artificial Sequence
  Description of Artificial Sequence: Synthetic oligonucleotide
  Target: ATXN1; (+) strand; PAM type: YTN; PAM sequence: TTT
aacatccaaatccaattgtg

SEQ ID NO: 275231 - DNA, 20 bp, Artificial Sequence
  Description of Artificial Sequence: Synthetic oligonucleotide
  Target: ATXN1; (+) strand; PAM type: YTN; PAM sequence: TTA
acatccaaatccaattgtgt

SEQ ID NO: 275232 - DNA, 20 bp, Artificial Sequence
  Description of Artificial Sequence: Synthetic oligonucleotide
  Target: ATXN1; (+) strand; PAM type: YTN; PAM sequence: TTG
tgtgtctctggtaaacatga

SEQ ID NO: 275233 - DNA, 20 bp, Artificial Sequence
  Description of Artificial Sequence: Synthetic oligonucleotide
  Target: ATXN1; (+) strand; PAM type: YTN; PAM sequence: CTC
tggtaaacatgacttgccca

SEQ ID NO: 275234 - DNA, 20 bp, Artificial Sequence
  Description of Artificial Sequence: Synthetic oligonucleotide
  Target: ATXN1; (+) strand; PAM type: YTN; PAM sequence: CTG
gtaaacatgacttgcccagt

SEQ ID NO: 275235 - DNA, 20 bp, Artificial Sequence
  Description of Artificial Sequence: Synthetic oligonucleotide
  Target: ATXN1; (+) strand; PAM type: YTN; PAM sequence: CTT
gcccagtaaaaccgtgctga

SEQ ID NO: 275236 - DNA, 20 bp, Artificial Sequence
  Description of Artificial Sequence: Synthetic oligonucleotide
  Target: ATXN1; (+) strand; PAM type: YTN; PAM sequence: TTG
cccagtaaaaccgtgctgat

SEQ ID NO: 275237 - DNA, 20 bp, Artificial Sequence
  Description of Artificial Sequence: Synthetic oligonucleotide
  Target: ATXN1; (+) strand; PAM type: YTN; PAM sequence: CTG
atactacatgttccacagtt

SEQ ID NO: 275238 - DNA, 20 bp, Artificial Sequence
  Description of Artificial Sequence: Synthetic oligonucleotide
  Target: ATXN1; (+) strand; PAM type: YTN; PAM sequence: CTA
catgttccacagttacgtta

SEQ ID NO: 275239 - DNA, 20 bp, Artificial Sequence
  Description of Artificial Sequence: Synthetic oligonucleotide
  Target: ATXN1; (+) strand; PAM type: YTN; PAM sequence: TTC
cacagttacgttatcattat

SEQ ID NO: 275240 - DNA, 20 bp, Artificial Sequence
  Description of Artificial Sequence: Synthetic oligonucleotide
  Target: ATXN1; (+) strand; PAM type: YTN; PAM sequence: TTA
cgttatcattatattttcgg

SEQ ID NO: 275241 - DNA, 20 bp, Artificial Sequence
  Description of Artificial Sequence: Synthetic oligonucleotide
  Target: ATXN1; (+) strand; PAM type: YTN; PAM sequence: TTA
tcattatattttcggactaa

SEQ ID NO: 275242 - DNA, 20 bp, Artificial Sequence
  Description of Artificial Sequence: Synthetic oligonucleotide
  Target: ATXN1; (+) strand; PAM type: YTN; PAM sequence: TTA
tattttcggactaacttttg

SEQ ID NO: 275243 - DNA, 20 bp, Artificial Sequence
  Description of Artificial Sequence: Synthetic oligonucleotide
  Target: ATXN1; (+) strand; PAM type: YTN; PAM sequence: TTT
tcggactaacttttggaaat

SEQ ID NO: 275244 - DNA, 20 bp, Artificial Sequence
  Description of Artificial Sequence: Synthetic oligonucleotide
  Target: ATXN1; (+) strand; PAM type: YTN; PAM sequence: TTT
cggactaacttttggaaatg

SEQ ID NO: 275245 - DNA, 20 bp, Artificial Sequence
  Description of Artificial Sequence: Synthetic oligonucleotide
  Target: ATXN1; (+) strand; PAM type: YTN; PAM sequence: TTC
ggactaacttttggaaatgt

SEQ ID NO: 275246 - DNA, 20 bp, Artificial Sequence
  Description of Artificial Sequence: Synthetic oligonucleotide
  Target: ATXN1; (+) strand; PAM type: YTN; PAM sequence: CTA
acttttggaaatgttgtctt

SEQ ID NO: 275247 - DNA, 20 bp, Artificial Sequence
  Description of Artificial Sequence: Synthetic oligonucleotide
  Target: ATXN1; (+) strand; PAM type: YTN; PAM sequence: CTT
ttggaaatgttgtcttgtcg

SEQ ID NO: 275248 - DNA, 20 bp, Artificial Sequence
  Description of Artificial Sequence: Synthetic oligonucleotide
  Target: ATXN1; (+) strand; PAM type: YTN; PAM sequence: TTT
tggaaatgttgtcttgtcgt

SEQ ID NO: 275249 - DNA, 20 bp, Artificial Sequence
  Description of Artificial Sequence: Synthetic oligonucleotide
  Target: ATXN1; (+) strand; PAM type: YTN; PAM sequence: TTT
ggaaatgttgtcttgtcgtt

SEQ ID NO: 275250 - DNA, 20 bp, Artificial Sequence
  Description of Artificial Sequence: Synthetic oligonucleotide
  Target: ATXN1; (+) strand; PAM type: YTN; PAM sequence: TTG
gaaatgttgtcttgtcgttg

SEQ ID NO: 275251 - DNA, 20 bp, Artificial Sequence
  Description of Artificial Sequence: Synthetic oligonucleotide
  Target: ATXN1; (+) strand; PAM type: YTN; PAM sequence: TTG
tcttgtcgttgtattgtatc

SEQ ID NO: 275252 - DNA, 20 bp, Artificial Sequence
  Description of Artificial Sequence: Synthetic oligonucleotide
  Target: ATXN1; (+) strand; PAM type: YTN; PAM sequence: CTT
gtcgttgtattgtatcatcc

SEQ ID NO: 275253 - DNA, 20 bp, Artificial Sequence
  Description of Artificial Sequence: Synthetic oligonucleotide
  Target: ATXN1; (+) strand; PAM type: YTN; PAM sequence: TTG
tcgttgtattgtatcatcct

SEQ ID NO: 275254 - DNA, 20 bp, Artificial Sequence
  Description of Artificial Sequence: Synthetic oligonucleotide
  Target: ATXN1; (+) strand; PAM type: YTN; PAM sequence: TTG
tattgtatcatcctgagtaa

SEQ ID NO: 275255 - DNA, 20 bp, Artificial Sequence
  Description of Artificial Sequence: Synthetic oligonucleotide
  Target: ATXN1; (+) strand; PAM type: YTN; PAM sequence: TTG
tatcatcctgagtaagtatt

SEQ ID NO: 275256 - DNA, 20 bp, Artificial Sequence
  Description of Artificial Sequence: Synthetic oligonucleotide
  Target: ATXN1; (+) strand; PAM type: YTN; PAM sequence: CTG
agtaagtattaaattcctta

SEQ ID NO: 275257 - DNA, 20 bp, Artificial Sequence
  Description of Artificial Sequence: Synthetic oligonucleotide
  Target: ATXN1; (+) strand; PAM type: YTN; PAM sequence: TTA
aattccttaatatttgccac

SEQ ID NO: 275258 - DNA, 20 bp, Artificial Sequence
  Description of Artificial Sequence: Synthetic oligonucleotide
  Target: ATXN1; (+) strand; PAM type: YTN; PAM sequence: TTC
cttaatatttgccacaacca

SEQ ID NO: 275259 - DNA, 20 bp, Artificial Sequence
  Description of Artificial Sequence: Synthetic oligonucleotide
  Target: ATXN1; (+) strand; PAM type: YTN; PAM sequence: CTT
aatatttgccacaaccattt

SEQ ID NO: 275260 - DNA, 20 bp, Artificial Sequence
  Description of Artificial Sequence: Synthetic oligonucleotide
  Target: ATXN1; (+) strand; PAM type: YTN; PAM sequence: TTA
atatttgccacaaccatttg

SEQ ID NO: 275261 - DNA, 20 bp, Artificial Sequence
  Description of Artificial Sequence: Synthetic oligonucleotide
  Target: ATXN1; (+) strand; PAM type: YTN; PAM sequence: TTT
gccacaaccatttgctgagt

SEQ ID NO: 275262 - DNA, 20 bp, Artificial Sequence
  Description of Artificial Sequence: Synthetic oligonucleotide
  Target: ATXN1; (+) strand; PAM type: YTN; PAM sequence: TTG
ccacaaccatttgctgagtg

SEQ ID NO: 275263 - DNA, 20 bp, Artificial Sequence
  Description of Artificial Sequence: Synthetic oligonucleotide
  Target: ATXN1; (+) strand; PAM type: YTN; PAM sequence: TTT
gctgagtggctaatttgtat

SEQ ID NO: 275264 - DNA, 20 bp, Artificial Sequence
  Description of Artificial Sequence: Synthetic oligonucleotide
  Target: ATXN1; (+) strand; PAM type: YTN; PAM sequence: TTG
ctgagtggctaatttgtatg

SEQ ID NO: 275265 - DNA, 20 bp, Artificial Sequence
  Description of Artificial Sequence: Synthetic oligonucleotide
  Target: ATXN1; (+) strand; PAM type: YTN; PAM sequence: CTG
agtggctaatttgtatggac

SEQ ID NO: 275266 - DNA, 20 bp, Artificial Sequence
  Description of Artificial Sequence: Synthetic oligonucleotide
  Target: ATXN1; (+) strand; PAM type: YTN; PAM sequence: CTA
atttgtatggacacattttt

SEQ ID NO: 275267 - DNA, 20 bp, Artificial Sequence
  Description of Artificial Sequence: Synthetic oligonucleotide
  Target: ATXN1; (+) strand; PAM type: YTN; PAM sequence: TTT
gtatggacacatttttatct

SEQ ID NO: 275268 - DNA, 20 bp, Artificial Sequence
  Description of Artificial Sequence: Synthetic oligonucleotide
  Target: ATXN1; (+) strand; PAM type: YTN; PAM sequence: TTG
tatggacacatttttatcta

SEQ ID NO: 275269 - DNA, 20 bp, Artificial Sequence
  Description of Artificial Sequence: Synthetic oligonucleotide
  Target: ATXN1; (+) strand; PAM type: YTN; PAM sequence: TTT
ttatctattatctttaatcc

SEQ ID NO: 275270 - DNA, 20 bp, Artificial Sequence
  Description of Artificial Sequence: Synthetic oligonucleotide
  Target: ATXN1; (+) strand; PAM type: YTN; PAM sequence: TTT
tatctattatctttaatcct

SEQ ID NO: 275271 - DNA, 20 bp, Artificial Sequence
  Description of Artificial Sequence: Synthetic oligonucleotide
  Target: ATXN1; (+) strand; PAM type: YTN; PAM sequence: TTT
atctattatctttaatcctg

SEQ ID NO: 275272 - DNA, 20 bp, Artificial Sequence
  Description of Artificial Sequence: Synthetic oligonucleotide
  Target: ATXN1; (+) strand; PAM type: YTN; PAM sequence: TTA
tctattatctttaatcctga

SEQ ID NO: 275273 - DNA, 20 bp, Artificial Sequence
  Description of Artificial Sequence: Synthetic oligonucleotide
  Target: ATXN1; (+) strand; PAM type: YTN; PAM sequence: CTA
ttatctttaatcctgacaaa

SEQ ID NO: 275274 - DNA, 20 bp, Artificial Sequence
  Description of Artificial Sequence: Synthetic oligonucleotide
  Target: ATXN1; (+) strand; PAM type: YTN; PAM sequence: TTA
tctttaatcctgacaaaatc

SEQ ID NO: 275275 - DNA, 20 bp, Artificial Sequence
  Description of Artificial Sequence: Synthetic oligonucleotide
  Target: ATXN1; (+) strand; PAM type: YTN; PAM sequence: CTT
taatcctgacaaaatctctg

SEQ ID NO: 275276 - DNA, 20 bp, Artificial Sequence
  Description of Artificial Sequence: Synthetic oligonucleotide
  Target: ATXN1; (+) strand; PAM type: YTN; PAM sequence: TTT
aatcctgacaaaatctctgt

SEQ ID NO: 275277 - DNA, 20 bp, Artificial Sequence
  Description of Artificial Sequence: Synthetic oligonucleotide
  Target: ATXN1; (+) strand; PAM type: YTN; PAM sequence: TTA
atcctgacaaaatctctgta

SEQ ID NO: 275278 - DNA, 20 bp, Artificial Sequence
  Description of Artificial Sequence: Synthetic oligonucleotide
  Target: ATXN1; (+) strand; PAM type: YTN; PAM sequence: CTG
acaaaatctctgtaaaatag

SEQ ID NO: 275279 - DNA, 20 bp, Artificial Sequence
  Description of Artificial Sequence: Synthetic oligonucleotide
  Target: ATXN1; (+) strand; PAM type: YTN; PAM sequence: CTC
tgtaaaataggttttattgg

SEQ ID NO: 275280 - DNA, 20 bp, Artificial Sequence
  Description of Artificial Sequence: Synthetic oligonucleotide
  Target: ATXN1; (+) strand; PAM type: YTN; PAM sequence: CTG
taaaataggttttattggcc

SEQ ID NO: 275281 - DNA, 20 bp, Artificial Sequence
  Description of Artificial Sequence: Synthetic oligonucleotide
  Target: ATXN1; (+) strand; PAM type: YTN; PAM sequence: TTT
tattggcctcattgtacaga

SEQ ID NO: 275282 - DNA, 20 bp, Artificial Sequence
  Description of Artificial Sequence: Synthetic oligonucleotide
  Target: ATXN1; (+) strand; PAM type: YTN; PAM sequence: TTT
attggcctcattgtacagat

SEQ ID NO: 275283 - DNA, 20 bp, Artificial Sequence
  Description of Artificial Sequence: Synthetic oligonucleotide
  Target: ATXN1; (+) strand; PAM type: YTN; PAM sequence: TTA
ttggcctcattgtacagatg

SEQ ID NO: 275284 - DNA, 20 bp, Artificial Sequence
  Description of Artificial Sequence: Synthetic oligonucleotide
  Target: ATXN1; (+) strand; PAM type: YTN; PAM sequence: TTG
gcctcattgtacagatgagg

SEQ ID NO: 275285 - DNA, 20 bp, Artificial Sequence
  Description of Artificial Sequence: Synthetic oligonucleotide
  Target: ATXN1; (+) strand; PAM type: YTN; PAM sequence: CTC
attgtacagatgaggaaaat

SEQ ID NO: 275286 - DNA, 20 bp, Artificial Sequence
  Description of Artificial Sequence: Synthetic oligonucleotide
  Target: ATXN1; (+) strand; PAM type: YTN; PAM sequence: TTG
tacagatgaggaaaataagg

SEQ ID NO: 275287 - DNA, 20 bp, Artificial Sequence
  Description of Artificial Sequence: Synthetic oligonucleotide
  Target: ATXN1; (+) strand; PAM type: YTN; PAM sequence: CTC
aagaaaagtaacctaaccaa

SEQ ID NO: 275288 - DNA, 20 bp, Artificial Sequence
  Description of Artificial Sequence: Synthetic oligonucleotide
  Target: ATXN1; (+) strand; PAM type: YTN; PAM sequence: CTA
accaaggtcaccagtaagtg

SEQ ID NO: 275289 - DNA, 20 bp, Artificial Sequence
  Description of Artificial Sequence: Synthetic oligonucleotide
  Target: ATXN1; (+) strand; PAM type: YTN; PAM sequence: CTA
ggtttgtctgggtttcacgg

SEQ ID NO: 275290 - DNA, 20 bp, Artificial Sequence
  Description of Artificial Sequence: Synthetic oligonucleotide
  Target: ATXN1; (+) strand; PAM type: YTN; PAM sequence: TTT
gtctgggtttcacggtcaaa

SEQ ID NO: 275291 - DNA, 20 bp, Artificial Sequence
  Description of Artificial Sequence: Synthetic oligonucleotide
  Target: ATXN1; (+) strand; PAM type: YTN; PAM sequence: TTG
tctgggtttcacggtcaaag

SEQ ID NO: 275292 - DNA, 20 bp, Artificial Sequence
  Description of Artificial Sequence: Synthetic oligonucleotide
  Target: ATXN1; (+) strand; PAM type: YTN; PAM sequence: CTG
ggtttcacggtcaaagagaa

SEQ ID NO: 275293 - DNA, 20 bp, Artificial Sequence
  Description of Artificial Sequence: Synthetic oligonucleotide
  Target: ATXN1; (+) strand; PAM type: YTN; PAM sequence: TTT
cacggtcaaagagaaaagat

SEQ ID NO: 275294 - DNA, 20 bp, Artificial Sequence
  Description of Artificial Sequence: Synthetic oligonucleotide
  Target: ATXN1; (+) strand; PAM type: YTN; PAM sequence: TTC
acggtcaaagagaaaagatg

SEQ ID NO: 275295 - DNA, 20 bp, Artificial Sequence
  Description of Artificial Sequence: Synthetic oligonucleotide
  Target: ATXN1; (+) strand; PAM type: YTN; PAM sequence: CTC
cctggcaacatgcacgagag

SEQ ID NO: 275296 - DNA, 20 bp, Artificial Sequence
  Description of Artificial Sequence: Synthetic oligonucleotide
  Target: ATXN1; (+) strand; PAM type: YTN; PAM sequence: CTG
gcaacatgcacgagagatta

SEQ ID NO: 275297 - DNA, 20 bp, Artificial Sequence
  Description of Artificial Sequence: Synthetic oligonucleotide
  Target: ATXN1; (+) strand; PAM type: YTN; PAM sequence: TTA
aagtctcaatacataagcat

SEQ ID NO: 275298 - DNA, 20 bp, Artificial Sequence
  Description of Artificial Sequence: Synthetic oligonucleotide
  Target: ATXN1; (+) strand; PAM type: YTN; PAM sequence: CTC
aatacataagcattctgaca

SEQ ID NO: 275299 - DNA, 20 bp, Artificial Sequence
  Description of Artificial Sequence: Synthetic oligonucleotide
  Target: ATXN1; (+) strand; PAM type: YTN; PAM sequence: TTC
tgacaaacaaaaaataagca

SEQ ID NO: 275300 - DNA, 20 bp, Artificial Sequence
  Description of Artificial Sequence: Synthetic oligonucleotide
  Target: ATXN1; (+) strand; PAM type: YTN; PAM sequence: CTG
acaaacaaaaaataagcact

SEQ ID NO: 275301 - DNA, 20 bp, Artificial Sequence
  Description of Artificial Sequence: Synthetic oligonucleotide
  Target: ATXN1; (+) strand; PAM type: YTN; PAM sequence: CTT
gcagccgggcacagtggctc

SEQ ID NO: 275302 - DNA, 20 bp, Artificial Sequence
  Description of Artificial Sequence: Synthetic oligonucleotide
  Target: ATXN1; (+) strand; PAM type: YTN; PAM sequence: TTG
cagccgggcacagtggctca

SEQ ID NO: 275303 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatctcagcact

SEQ ID NO: 275304 - DNA, 20 bp, Artificial Sequence
  Description of Artificial Sequence: Synthetic oligonucleotide
  Target: ATXN1; (+) strand; PAM type: YTN; PAM sequence: CTG
taatctcagcactttgggaa

SEQ ID NO: 275305 - DNA, 20 bp, Artificial Sequence
  Description of Artificial Sequence: Synthetic oligonucleotide
  Target: ATXN1; (+) strand; PAM type: YTN; PAM sequence: CTC
agcactttgggaagccgagg

SEQ ID NO: 275306 - DNA, 20 bp, Artificial Sequence
  Description of Artificial Sequence: Synthetic oligonucleotide
  Target: ATXN1; (+) strand; PAM type: YTN; PAM sequence: CTT
tgggaagccgagggaggtgg

SEQ ID NO: 275307 - DNA, 20 bp, Artificial Sequence
  Description of Artificial Sequence: Synthetic oligonucleotide
  Target: ATXN1; (+) strand; PAM type: YTN; PAM sequence: TTT
gggaagccgagggaggtgga

SEQ ID NO: 275308 - DNA, 20 bp, Artificial Sequence
  Description of Artificial Sequence: Synthetic oligonucleotide
  Target: ATXN1; (+) strand; PAM type: YTN; PAM sequence: TTG
ggaagccgagggaggtggat

SEQ ID NO: 275309 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 275310 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgggcaacat

SEQ ID NO: 275311 - DNA, 20 bp, Artificial Sequence
  Description of Artificial Sequence: Synthetic oligonucleotide
  Target: ATXN1; (+) strand; PAM type: YTN; PAM sequence: CTG
ggcaacatggtgaaacccca

SEQ ID NO: 275312 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacagaaatta

SEQ ID NO: 275313 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacagaaattagc

SEQ ID NO: 275314 - DNA, 20 bp, Artificial Sequence
  Description of Artificial Sequence: Synthetic oligonucleotide
  Target: ATXN1; (+) strand; PAM type: YTN; PAM sequence: CTA
aaaatacagaaattagctgg

SEQ ID NO: 275315 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggcggtgtgtg

SEQ ID NO: 275316 - DNA, 20 bp, Artificial Sequence
  Description of Artificial Sequence: Synthetic oligonucleotide
  Target: ATXN1; (+) strand; PAM type: YTN; PAM sequence: CTG
ggcatggcggtgtgtgcctg

SEQ ID NO: 275317 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 275318 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 275319 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 275320 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 275321 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttaaa

SEQ ID NO: 275322 - DNA, 20 bp, Artificial Sequence
  Description of Artificial Sequence: Synthetic oligonucleotide
  Target: ATXN1; (+) strand; PAM type: YTN; PAM sequence: TTG
cttaaacctgggaggtggag

SEQ ID NO: 275323 - DNA, 20 bp, Artificial Sequence
  Description of Artificial Sequence: Synthetic oligonucleotide
  Target: ATXN1; (+) strand; PAM type: YTN; PAM sequence: CTT
aaacctgggaggtggaggtt

SEQ ID NO: 275324 - DNA, 20 bp, Artificial Sequence
  Description of Artificial Sequence: Synthetic oligonucleotide
  Target: ATXN1; (+) strand; PAM type: YTN; PAM sequence: TTA
aacctgggaggtggaggttg

SEQ ID NO: 275325 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggttgcagtaa

SEQ ID NO: 275326 - DNA, 20 bp, Artificial Sequence
  Description of Artificial Sequence: Synthetic oligonucleotide
  Target: ATXN1; (+) strand; PAM type: YTN; PAM sequence: TTG
cagtaagctgagactgtgcc

SEQ ID NO: 275327 - DNA, 20 bp, Artificial Sequence
  Description of Artificial Sequence: Synthetic oligonucleotide
  Target: ATXN1; (+) strand; PAM type: YTN; PAM sequence: CTG
agactgtgccactgcactcc

SEQ ID NO: 275328 - DNA, 20 bp, Artificial Sequence
  Description of Artificial Sequence: Synthetic oligonucleotide
  Target: ATXN1; (+) strand; PAM type: YTN; PAM sequence: CTG
tgccactgcactccagcctg

SEQ ID NO: 275329 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggacaacac

SEQ ID NO: 275330 - DNA, 20 bp, Artificial Sequence
  Description of Artificial Sequence: Synthetic oligonucleotide
  Target: ATXN1; (+) strand; PAM type: YTN; PAM sequence: CTC
cagcctggacaacacatcaa

SEQ ID NO: 275331 - DNA, 20 bp, Artificial Sequence
  Description of Artificial Sequence: Synthetic oligonucleotide
  Target: ATXN1; (+) strand; PAM type: YTN; PAM sequence: CTG
gacaacacatcaagactctg

SEQ ID NO: 275332 - DNA, 20 bp, Artificial Sequence
  Description of Artificial Sequence: Synthetic oligonucleotide
  Target: ATXN1; (+) strand; PAM type: YTN; PAM sequence: CTC
tgtcaaaaaaaaaaaaatct

SEQ ID NO: 275333 - DNA, 20 bp, Artificial Sequence
  Description of Artificial Sequence: Synthetic oligonucleotide
  Target: ATXN1; (+) strand; PAM type: YTN; PAM sequence: CTG
tcaaaaaaaaaaaaatcttt

SEQ ID NO: 275334 - DNA, 20 bp, Artificial Sequence
  Description of Artificial Sequence: Synthetic oligonucleotide
  Target: ATXN1; (+) strand; PAM type: YTN; PAM sequence: CTT
tgtcagggttttttgttttt

SEQ ID NO: 275335 - DNA, 20 bp, Artificial Sequence
  Description of Artificial Sequence: Synthetic oligonucleotide
  Target: ATXN1; (+) strand; PAM type: YTN; PAM sequence: TTT
gtcagggttttttgtttttt

SEQ ID NO: 275336 - DNA, 20 bp, Artificial Sequence
  Description of Artificial Sequence: Synthetic oligonucleotide
  Target: ATXN1; (+) strand; PAM type: YTN; PAM sequence: TTG
tcagggttttttgttttttt

SEQ ID NO: 275337 - DNA, 20 bp, Artificial Sequence
  Description of Artificial Sequence: Synthetic oligonucleotide
  Target: ATXN1; (+) strand; PAM type: YTN; PAM sequence: TTT
tttgtttttttttttttttt

SEQ ID NO: 275338 - DNA, 20 bp, Artificial Sequence
  Description of Artificial Sequence: Synthetic oligonucleotide
  Target: ATXN1; (+) strand; PAM type: YTN; PAM sequence: TTT
ttgttttttttttttttttg

SEQ ID NO: 275339 - DNA, 20 bp, Artificial Sequence
  Description of Artificial Sequence: Synthetic oligonucleotide
  Target: ATXN1; (+) strand; PAM type: YTN; PAM sequence: TTT
tgttttttttttttttttgt

SEQ ID NO: 275340 - DNA, 20 bp, Artificial Sequence
  Description of Artificial Sequence: Synthetic oligonucleotide
  Target: ATXN1; (+) strand; PAM type: YTN; PAM sequence: TTT
gttttttttttttttttgtg

SEQ ID NO: 275341 - DNA, 20 bp, Artificial Sequence
  Description of Artificial Sequence: Synthetic oligonucleotide
  Target: ATXN1; (+) strand; PAM type: YTN; PAM sequence: TTG
ttttttttttttttttgtga

SEQ ID NO: 275342 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgtgaaga

SEQ ID NO: 275343 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgtgaagat

SEQ ID NO: 275344 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgtgaagata

SEQ ID NO: 275345 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgtgaagatag

SEQ ID NO: 275346 - DNA, 20 bp, Artificial Sequence
  Description of Artificial Sequence: Synthetic oligonucleotide
  Target: ATXN1; (+) strand; PAM type: YTN; PAM sequence: TTT
tttttttttgtgaagatagc

SEQ ID NO: 275347 - DNA, 20 bp, Artificial Sequence
  Description of Artificial Sequence: Synthetic oligonucleotide
  Target: ATXN1; (+) strand; PAM type: YTN; PAM sequence: TTT
ttttttttgtgaagatagca

SEQ ID NO: 275348 - DNA, 20 bp, Artificial Sequence
  Description of Artificial Sequence: Synthetic oligonucleotide
  Target: ATXN1; (+) strand; PAM type: YTN; PAM sequence: TTT
tttttttgtgaagatagcaa

SEQ ID NO: 275349 - DNA, 20 bp, Artificial Sequence
  Description of Artificial Sequence: Synthetic oligonucleotide
  Target: ATXN1; (+) strand; PAM type: YTN; PAM sequence: TTT
ttttttgtgaagatagcaag

SEQ ID NO: 275350 - DNA, 20 bp, Artificial Sequence
  Description of Artificial Sequence: Synthetic oligonucleotide
  Target: ATXN1; (+) strand; PAM type: YTN; PAM sequence: TTT
tttttgtgaagatagcaagc

SEQ ID NO: 275351 - DNA, 20 bp, Artificial Sequence
  Description of Artificial Sequence: Synthetic oligonucleotide
  Target: ATXN1; (+) strand; PAM type: YTN; PAM sequence: TTT
ttttgtgaagatagcaagcg

SEQ ID NO: 275352 - DNA, 20 bp, Artificial Sequence
  Description of Artificial Sequence: Synthetic oligonucleotide
  Target: ATXN1; (+) strand; PAM type: YTN; PAM sequence: TTT
tttgtgaagatagcaagcga

SEQ ID NO: 275353 - DNA, 20 bp, Artificial Sequence
  Description of Artificial Sequence: Synthetic oligonucleotide
  Target: ATXN1; (+) strand; PAM type: YTN; PAM sequence: TTT
ttgtgaagatagcaagcgag

SEQ ID NO: 275354 - DNA, 20 bp, Artificial Sequence
  Description of Artificial Sequence: Synthetic oligonucleotide
  Target: ATXN1; (+) strand; PAM type: YTN; PAM sequence: TTT
tgtgaagatagcaagcgagg

SEQ ID NO: 275355 - DNA, 20 bp, Artificial Sequence
  Description of Artificial Sequence: Synthetic oligonucleotide
  Target: ATXN1; (+) strand; PAM type: YTN; PAM sequence: TTT
gtgaagatagcaagcgagga

SEQ ID NO: 275356 - DNA, 20 bp, Artificial Sequence
  Description of Artificial Sequence: Synthetic oligonucleotide
  Target: ATXN1; (+) strand; PAM type: YTN; PAM sequence: TTG
tgaagatagcaagcgaggat

SEQ ID NO: 275357 - DNA, 20 bp, Artificial Sequence
  Description of Artificial Sequence: Synthetic oligonucleotide
  Target: ATXN1; (+) strand; PAM type: YTN; PAM sequence: TTA
cccatgacattcagtggaaa

SEQ ID NO: 275358 - DNA, 20 bp, Artificial Sequence
  Description of Artificial Sequence: Synthetic oligonucleotide
  Target: ATXN1; (+) strand; PAM type: YTN; PAM sequence: TTC
agtggaaagttgtgtattag

SEQ ID NO: 275359 - DNA, 20 bp, Artificial Sequence
  Description of Artificial Sequence: Synthetic oligonucleotide
  Target: ATXN1; (+) strand; PAM type: YTN; PAM sequence: TTG
tgtattagtgcccaacaggt

SEQ ID NO: 275360 - DNA, 20 bp, Artificial Sequence
  Description of Artificial Sequence: Synthetic oligonucleotide
  Target: ATXN1; (+) strand; PAM type: YTN; PAM sequence: TTA
gtgcccaacaggtgccaggc

SEQ ID NO: 275361 - DNA, 20 bp, Artificial Sequence
  Description of Artificial Sequence: Synthetic oligonucleotide
  Target: ATXN1; (+) strand; PAM type: YTN; PAM sequence: TTC
ttcaggcagcacagcgggac

SEQ ID NO: 275362 - DNA, 20 bp, Artificial Sequence
  Description of Artificial Sequence: Synthetic oligonucleotide
  Target: ATXN1; (+) strand; PAM type: YTN; PAM sequence: CTT
caggcagcacagcgggacca

SEQ ID NO: 275363 - DNA, 20 bp, Artificial Sequence
  Description of Artificial Sequence: Synthetic oligonucleotide
  Target: ATXN1; (+) strand; PAM type: YTN; PAM sequence: TTC
aggcagcacagcgggaccaa

SEQ ID NO: 275364 - DNA, 20 bp, Artificial Sequence
  Description of Artificial Sequence: Synthetic oligonucleotide
  Target: ATXN1; (+) strand; PAM type: YTN; PAM sequence: CTG
acagtggcaacgacacaaaa

SEQ ID NO: 275365 - DNA, 20 bp, Artificial Sequence
  Description of Artificial Sequence: Synthetic oligonucleotide
  Target: ATXN1; (+) strand; PAM type: YTN; PAM sequence: CTT
ggcaagtcagtctaacaatt

SEQ ID NO: 275366 - DNA, 20 bp, Artificial Sequence
  Description of Artificial Sequence: Synthetic oligonucleotide
  Target: ATXN1; (+) strand; PAM type: YTN; PAM sequence: TTG
gcaagtcagtctaacaatta

SEQ ID NO: 275367 - DNA, 20 bp, Artificial Sequence
  Description of Artificial Sequence: Synthetic oligonucleotide
  Target: ATXN1; (+) strand; PAM type: YTN; PAM sequence: CTA
acaattactttgcatcattc

SEQ ID NO: 275368 - DNA, 20 bp, Artificial Sequence
  Description of Artificial Sequence: Synthetic oligonucleotide
  Target: ATXN1; (+) strand; PAM type: YTN; PAM sequence: TTA
ctttgcatcattctgattat

SEQ ID NO: 275369 - DNA, 20 bp, Artificial Sequence
  Description of Artificial Sequence: Synthetic oligonucleotide
  Target: ATXN1; (+) strand; PAM type: YTN; PAM sequence: CTT
tgcatcattctgattatgag

SEQ ID NO: 275370 - DNA, 20 bp, Artificial Sequence
  Description of Artificial Sequence: Synthetic oligonucleotide
  Target: ATXN1; (+) strand; PAM type: YTN; PAM sequence: TTT
gcatcattctgattatgagc

SEQ ID NO: 275371 - DNA, 20 bp, Artificial Sequence
  Description of Artificial Sequence: Synthetic oligonucleotide
  Target: ATXN1; (+) strand; PAM type: YTN; PAM sequence: TTG
catcattctgattatgagcc

SEQ ID NO: 275372 - DNA, 20 bp, Artificial Sequence
  Description of Artificial Sequence: Synthetic oligonucleotide
  Target: ATXN1; (+) strand; PAM type: YTN; PAM sequence: TTC
tgattatgagccacaagcat

SEQ ID NO: 275373 - DNA, 20 bp, Artificial Sequence
  Description of Artificial Sequence: Synthetic oligonucleotide
  Target: ATXN1; (+) strand; PAM type: YTN; PAM sequence: CTG
attatgagccacaagcatgc

SEQ ID NO: 275374 - DNA, 20 bp, Artificial Sequence
  Description of Artificial Sequence: Synthetic oligonucleotide
  Target: ATXN1; (+) strand; PAM type: YTN; PAM sequence: TTA
tgagccacaagcatgcaatc

SEQ ID NO: 275375 - DNA, 20 bp, Artificial Sequence
  Description of Artificial Sequence: Synthetic oligonucleotide
  Target: ATXN1; (+) strand; PAM type: YTN; PAM sequence: CTT
aaatgatctccatcagcatt

SEQ ID NO: 275376 - DNA, 20 bp, Artificial Sequence
  Description of Artificial Sequence: Synthetic oligonucleotide
  Target: ATXN1; (+) strand; PAM type: YTN; PAM sequence: TTA
aatgatctccatcagcattt

SEQ ID NO: 275377 - DNA, 20 bp, Artificial Sequence
  Description of Artificial Sequence: Synthetic oligonucleotide
  Target: ATXN1; (+) strand; PAM type: YTN; PAM sequence: CTC
catcagcattttactttagt

SEQ ID NO: 275378 - DNA, 20 bp, Artificial Sequence
  Description of Artificial Sequence: Synthetic oligonucleotide
  Target: ATXN1; (+) strand; PAM type: YTN; PAM sequence: TTT
tactttagttatcaaagtgt

SEQ ID NO: 275379 - DNA, 20 bp, Artificial Sequence
  Description of Artificial Sequence: Synthetic oligonucleotide
  Target: ATXN1; (+) strand; PAM type: YTN; PAM sequence: TTT
actttagttatcaaagtgtg

SEQ ID NO: 275380 - DNA, 20 bp, Artificial Sequence
  Description of Artificial Sequence: Synthetic oligonucleotide
  Target: ATXN1; (+) strand; PAM type: YTN; PAM sequence: TTA
ctttagttatcaaagtgtgg

SEQ ID NO: 275381 - DNA, 20 bp, Artificial Sequence
  Description of Artificial Sequence: Synthetic oligonucleotide
  Target: ATXN1; (+) strand; PAM type: YTN; PAM sequence: CTT
tagttatcaaagtgtggcag

SEQ ID NO: 275382 - DNA, 20 bp, Artificial Sequence
  Description of Artificial Sequence: Synthetic oligonucleotide
  Target: ATXN1; (+) strand; PAM type: YTN; PAM sequence: TTT
agttatcaaagtgtggcaga

SEQ ID NO: 275383 - DNA, 20 bp, Artificial Sequence
  Description of Artificial Sequence: Synthetic oligonucleotide
  Target: ATXN1; (+) strand; PAM type: YTN; PAM sequence: TTA
gttatcaaagtgtggcagat

SEQ ID NO: 275384 - DNA, 20 bp, Artificial Sequence
  Description of Artificial Sequence: Synthetic oligonucleotide
  Target: ATXN1; (+) strand; PAM type: YTN; PAM sequence: TTA
tcaaagtgtggcagattgaa

SEQ ID NO: 275385 - DNA, 20 bp, Artificial Sequence
  Description of Artificial Sequence: Synthetic oligonucleotide
  Target: ATXN1; (+) strand; PAM type: YTN; PAM sequence: TTG
aacacccgctcatctgacct

SEQ ID NO: 275386 - DNA, 20 bp, Artificial Sequence
  Description of Artificial Sequence: Synthetic oligonucleotide
  Target: ATXN1; (+) strand; PAM type: YTN; PAM sequence: CTC
atctgacctaagcgcaatgt

SEQ ID NO: 275387 - DNA, 20 bp, Artificial Sequence
  Description of Artificial Sequence: Synthetic oligonucleotide
  Target: ATXN1; (+) strand; PAM type: YTN; PAM sequence: CTG
acctaagcgcaatgttaata

SEQ ID NO: 275388 - DNA, 20 bp, Artificial Sequence
  Description of Artificial Sequence: Synthetic oligonucleotide
  Target: ATXN1; (+) strand; PAM type: YTN; PAM sequence: CTA
agcgcaatgttaataaccca

SEQ ID NO: 275389 - DNA, 20 bp, Artificial Sequence
  Description of Artificial Sequence: Synthetic oligonucleotide
  Target: ATXN1; (+) strand; PAM type: YTN; PAM sequence: TTA
ataacccaaacacaaagaat

SEQ ID NO: 275390 - DNA, 20 bp, Artificial Sequence
  Description of Artificial Sequence: Synthetic oligonucleotide
  Target: ATXN1; (+) strand; PAM type: YTN; PAM sequence: CTC
aagagcactggccttgctgg

SEQ ID NO: 275391 - DNA, 20 bp, Artificial Sequence
  Description of Artificial Sequence: Synthetic oligonucleotide
  Target: ATXN1; (+) strand; PAM type: YTN; PAM sequence: CTG
gccttgctgggggccattgg

SEQ ID NO: 275392 - DNA, 20 bp, Artificial Sequence
  Description of Artificial Sequence: Synthetic oligonucleotide
  Target: ATXN1; (+) strand; PAM type: YTN; PAM sequence: CTT
gctgggggccattggttata

SEQ ID NO: 275393 - DNA, 20 bp, Artificial Sequence
  Description of Artificial Sequence: Synthetic oligonucleotide
  Target: ATXN1; (+) strand; PAM type: YTN; PAM sequence: TTG
ctgggggccattggttataa

SEQ ID NO: 275394 - DNA, 20 bp, Artificial Sequence
  Description of Artificial Sequence: Synthetic oligonucleotide
  Target: ATXN1; (+) strand; PAM type: YTN; PAM sequence: CTG
ggggccattggttataacag

SEQ ID NO: 275395 - DNA, 20 bp, Artificial Sequence
  Description of Artificial Sequence: Synthetic oligonucleotide
  Target: ATXN1; (+) strand; PAM type: YTN; PAM sequence: TTG
gttataacagatgtatttta

SEQ ID NO: 275396 - DNA, 20 bp, Artificial Sequence
  Description of Artificial Sequence: Synthetic oligonucleotide
  Target: ATXN1; (+) strand; PAM type: YTN; PAM sequence: TTA
taacagatgtattttatttt

SEQ ID NO: 275397 - DNA, 20 bp, Artificial Sequence
  Description of Artificial Sequence: Synthetic oligonucleotide
  Target: ATXN1; (+) strand; PAM type: YTN; PAM sequence: TTT
tattttatccaacttttttc

SEQ ID NO: 275398 - DNA, 20 bp, Artificial Sequence
  Description of Artificial Sequence: Synthetic oligonucleotide
  Target: ATXN1; (+) strand; PAM type: YTN; PAM sequence: TTT
attttatccaacttttttca

SEQ ID NO: 275399 - DNA, 20 bp, Artificial Sequence
  Description of Artificial Sequence: Synthetic oligonucleotide
  Target: ATXN1; (+) strand; PAM type: YTN; PAM sequence: TTA
ttttatccaacttttttcat

SEQ ID NO: 275400 - DNA, 20 bp, Artificial Sequence
  Description of Artificial Sequence: Synthetic oligonucleotide
  Target: ATXN1; (+) strand; PAM type: YTN; PAM sequence: TTT
tatccaacttttttcattta

SEQ ID NO: 275401 - DNA, 20 bp, Artificial Sequence
  Description of Artificial Sequence: Synthetic oligonucleotide
  Target: ATXN1; (+) strand; PAM type: YTN; PAM sequence: TTT
atccaacttttttcatttat

SEQ ID NO: 275402 - DNA, 20 bp, Artificial Sequence
  Description of Artificial Sequence: Synthetic oligonucleotide
  Target: ATXN1; (+) strand; PAM type: YTN; PAM sequence: TTA
tccaacttttttcatttatt

SEQ ID NO: 275403 - DNA, 20 bp, Artificial Sequence
  Description of Artificial Sequence: Synthetic oligonucleotide
  Target: ATXN1; (+) strand; PAM type: YTN; PAM sequence: CTT
ttttcatttattacctcaga

SEQ ID NO: 275404 - DNA, 20 bp, Artificial Sequence
  Description of Artificial Sequence: Synthetic oligonucleotide
  Target: ATXN1; (+) strand; PAM type: YTN; PAM sequence: TTT
tttcatttattacctcagag

SEQ ID NO: 275405 - DNA, 20 bp, Artificial Sequence
  Description of Artificial Sequence: Synthetic oligonucleotide
  Target: ATXN1; (+) strand; PAM type: YTN; PAM sequence: TTT
ttcatttattacctcagagt

SEQ ID NO: 275406 - DNA, 20 bp, Artificial Sequence
  Description of Artificial Sequence: Synthetic oligonucleotide
  Target: ATXN1; (+) strand; PAM type: YTN; PAM sequence: TTT
tcatttattacctcagagta

SEQ ID NO: 275407 - DNA, 20 bp, Artificial Sequence
  Description of Artificial Sequence: Synthetic oligonucleotide
  Target: ATXN1; (+) strand; PAM type: YTN; PAM sequence: TTT
catttattacctcagagtag

SEQ ID NO: 275408 - DNA, 20 bp, Artificial Sequence
  Description of Artificial Sequence: Synthetic oligonucleotide
  Target: ATXN1; (+) strand; PAM type: YTN; PAM sequence: TTC
atttattacctcagagtaga

SEQ ID NO: 275409 - DNA, 20 bp, Artificial Sequence
  Description of Artificial Sequence: Synthetic oligonucleotide
  Target: ATXN1; (+) strand; PAM type: YTN; PAM sequence: TTT
attacctcagagtagataca

SEQ ID NO: 275410 - DNA, 20 bp, Artificial Sequence
  Description of Artificial Sequence: Synthetic oligonucleotide
  Target: ATXN1; (+) strand; PAM type: YTN; PAM sequence: TTA
ttacctcagagtagatacat

SEQ ID NO: 275411 - DNA, 20 bp, Artificial Sequence
  Description of Artificial Sequence: Synthetic oligonucleotide
  Target: ATXN1; (+) strand; PAM type: YTN; PAM sequence: TTA
cctcagagtagatacatatt

SEQ ID NO: 275412 - DNA, 20 bp, Artificial Sequence
  Description of Artificial Sequence: Synthetic oligonucleotide
  Target: ATXN1; (+) strand; PAM type: YTN; PAM sequence: CTC
agagtagatacatattatta

SEQ ID NO: 275413 - DNA, 20 bp, Artificial Sequence
  Description of Artificial Sequence: Synthetic oligonucleotide
  Target: ATXN1; (+) strand; PAM type: YTN; PAM sequence: TTA
ttatgtgtttctcgtcggat

SEQ ID NO: 275414 - DNA, 20 bp, Artificial Sequence
  Description of Artificial Sequence: Synthetic oligonucleotide
  Target: ATXN1; (+) strand; PAM type: YTN; PAM sequence: TTA
tgtgtttctcgtcggataaa

SEQ ID NO: 275415 - DNA, 20 bp, Artificial Sequence
  Description of Artificial Sequence: Synthetic oligonucleotide
  Target: ATXN1; (+) strand; PAM type: YTN; PAM sequence: TTT
ctcgtcggataaatttatcc

SEQ ID NO: 275416 - DNA, 20 bp, Artificial Sequence
  Description of Artificial Sequence: Synthetic oligonucleotide
  Target: ATXN1; (+) strand; PAM type: YTN; PAM sequence: TTC
tcgtcggataaatttatcca

SEQ ID NO: 275417 - DNA, 20 bp, Artificial Sequence
  Description of Artificial Sequence: Synthetic oligonucleotide
  Target: ATXN1; (+) strand; PAM type: YTN; PAM sequence: CTC
gtcggataaatttatccaca

SEQ ID NO: 275418 - DNA, 20 bp, Artificial Sequence
  Description of Artificial Sequence: Synthetic oligonucleotide
  Target: ATXN1; (+) strand; PAM type: YTN; PAM sequence: TTT
atccacagtctaacacaatt

SEQ ID NO: 275419 - DNA, 20 bp, Artificial Sequence
  Description of Artificial Sequence: Synthetic oligonucleotide
  Target: ATXN1; (+) strand; PAM type: YTN; PAM sequence: TTA
tccacagtctaacacaattt

SEQ ID NO: 275420 - DNA, 20 bp, Artificial Sequence
  Description of Artificial Sequence: Synthetic oligonucleotide
  Target: ATXN1; (+) strand; PAM type: YTN; PAM sequence: CTA
acacaatttaaattgagtta

SEQ ID NO: 275421 - DNA, 20 bp, Artificial Sequence
  Description of Artificial Sequence: Synthetic oligonucleotide
  Target: ATXN1; (+) strand; PAM type: YTN; PAM sequence: TTT
aaattgagttaggacttaag

SEQ ID NO: 275422 - DNA, 20 bp, Artificial Sequence
  Description of Artificial Sequence: Synthetic oligonucleotide
  Target: ATXN1; (+) strand; PAM type: YTN; PAM sequence: TTA
aattgagttaggacttaagt

SEQ ID NO: 275423 - DNA, 20 bp, Artificial Sequence
  Description of Artificial Sequence: Synthetic oligonucleotide
  Target: ATXN1; (+) strand; PAM type: YTN; PAM sequence: TTG
agttaggacttaagtgagtt

SEQ ID NO: 275424 - DNA, 20 bp, Artificial Sequence
  Description of Artificial Sequence: Synthetic oligonucleotide
  Target: ATXN1; (+) strand; PAM type: YTN; PAM sequence: TTA
ggacttaagtgagtttccaa

SEQ ID NO: 275425 - DNA, 20 bp, Artificial Sequence
  Description of Artificial Sequence: Synthetic oligonucleotide
  Target: ATXN1; (+) strand; PAM type: YTN; PAM sequence: CTT
aagtgagtttccaaattccc

SEQ ID NO: 275426 - DNA, 20 bp, Artificial Sequence
  Description of Artificial Sequence: Synthetic oligonucleotide
  Target: ATXN1; (+) strand; PAM type: YTN; PAM sequence: TTA
agtgagtttccaaattccct

SEQ ID NO: 275427 - DNA, 20 bp, Artificial Sequence
  Description of Artificial Sequence: Synthetic oligonucleotide
  Target: ATXN1; (+) strand; PAM type: YTN; PAM sequence: TTT
ccaaattccctaaacttact

SEQ ID NO: 275428 - DNA, 20 bp, Artificial Sequence
  Description of Artificial Sequence: Synthetic oligonucleotide
  Target: ATXN1; (+) strand; PAM type: YTN; PAM sequence: TTC
caaattccctaaacttacta

SEQ ID NO: 275429 - DNA, 20 bp, Artificial Sequence
  Description of Artificial Sequence: Synthetic oligonucleotide
  Target: ATXN1; (+) strand; PAM type: YTN; PAM sequence: TTC
cctaaacttactatggcatg

SEQ ID NO: 275430 - DNA, 20 bp, Artificial Sequence
  Description of Artificial Sequence: Synthetic oligonucleotide
  Target: ATXN1; (+) strand; PAM type: YTN; PAM sequence: CTA
aacttactatggcatgatgt

SEQ ID NO: 275431 - DNA, 20 bp, Artificial Sequence
  Description of Artificial Sequence: Synthetic oligonucleotide
  Target: ATXN1; (+) strand; PAM type: YTN; PAM sequence: CTT
actatggcatgatgtacatg

SEQ ID NO: 275432 - DNA, 20 bp, Artificial Sequence
  Description of Artificial Sequence: Synthetic oligonucleotide
  Target: ATXN1; (+) strand; PAM type: YTN; PAM sequence: TTA
ctatggcatgatgtacatgt

SEQ ID NO: 275433 - DNA, 20 bp, Artificial Sequence
  Description of Artificial Sequence: Synthetic oligonucleotide
  Target: ATXN1; (+) strand; PAM type: YTN; PAM sequence: CTA
tggcatgatgtacatgtctc

SEQ ID NO: 275434 - DNA, 20 bp, Artificial Sequence
  Description of Artificial Sequence: Synthetic oligonucleotide
  Target: ATXN1; (+) strand; PAM type: YTN; PAM sequence: CTC
tatgaggagcacttttcaca

SEQ ID NO: 275435 - DNA, 20 bp, Artificial Sequence
  Description of Artificial Sequence: Synthetic oligonucleotide
  Target: ATXN1; (+) strand; PAM type: YTN; PAM sequence: CTA
tgaggagcacttttcacact

SEQ ID NO: 275436 - DNA, 20 bp, Artificial Sequence
  Description of Artificial Sequence: Synthetic oligonucleotide
  Target: ATXN1; (+) strand; PAM type: YTN; PAM sequence: CTT
ttcacactccatggtaaatt

SEQ ID NO: 275437 - DNA, 20 bp, Artificial Sequence
  Description of Artificial Sequence: Synthetic oligonucleotide
  Target: ATXN1; (+) strand; PAM type: YTN; PAM sequence: TTT
tcacactccatggtaaattt

SEQ ID NO: 275438 - DNA, 20 bp, Artificial Sequence
  Description of Artificial Sequence: Synthetic oligonucleotide
  Target: ATXN1; (+) strand; PAM type: YTN; PAM sequence: TTT
cacactccatggtaaatttt

SEQ ID NO: 275439 - DNA, 20 bp, Artificial Sequence
  Description of Artificial Sequence: Synthetic oligonucleotide
  Target: ATXN1; (+) strand; PAM type: YTN; PAM sequence: TTC
acactccatggtaaattttt

SEQ ID NO: 275440 - DNA, 20 bp, Artificial Sequence
  Description of Artificial Sequence: Synthetic oligonucleotide
  Target: ATXN1; (+) strand; PAM type: YTN; PAM sequence: CTC
catggtaaatttttgtcgta

SEQ ID NO: 275441 - DNA, 20 bp, Artificial Sequence
  Description of Artificial Sequence: Synthetic oligonucleotide
  Target: ATXN1; (+) strand; PAM type: YTN; PAM sequence: TTT
ttgtcgtactcatcttctcc

SEQ ID NO: 275442 - DNA, 20 bp, Artificial Sequence
  Description of Artificial Sequence: Synthetic oligonucleotide
  Target: ATXN1; (+) strand; PAM type: YTN; PAM sequence: TTT
tgtcgtactcatcttctcca

SEQ ID NO: 275443 - DNA, 20 bp, Artificial Sequence
  Description of Artificial Sequence: Synthetic oligonucleotide
  Target: ATXN1; (+) strand; PAM type: YTN; PAM sequence: TTT
gtcgtactcatcttctccac

SEQ ID NO: 275444 - DNA, 20 bp, Artificial Sequence
  Description of Artificial Sequence: Synthetic oligonucleotide
  Target: ATXN1; (+) strand; PAM type: YTN; PAM sequence: TTG
tcgtactcatcttctccact

SEQ ID NO: 275445 - DNA, 20 bp, Artificial Sequence
  Description of Artificial Sequence: Synthetic oligonucleotide
  Target: ATXN1; (+) strand; PAM type: YTN; PAM sequence: CTC
atcttctccactaaattgtg

SEQ ID NO: 275446 - DNA, 20 bp, Artificial Sequence
  Description of Artificial Sequence: Synthetic oligonucleotide
  Target: ATXN1; (+) strand; PAM type: YTN; PAM sequence: CTT
ctccactaaattgtgaccca

SEQ ID NO: 275447 - DNA, 20 bp, Artificial Sequence
  Description of Artificial Sequence: Synthetic oligonucleotide
  Target: ATXN1; (+) strand; PAM type: YTN; PAM sequence: TTC
tccactaaattgtgacccag

SEQ ID NO: 275448 - DNA, 20 bp, Artificial Sequence
  Description of Artificial Sequence: Synthetic oligonucleotide
  Target: ATXN1; (+) strand; PAM type: YTN; PAM sequence: CTC
cactaaattgtgacccagct

SEQ ID NO: 275449 - DNA, 20 bp, Artificial Sequence
  Description of Artificial Sequence: Synthetic oligonucleotide
  Target: ATXN1; (+) strand; PAM type: YTN; PAM sequence: CTA
aattgtgacccagctctgat

SEQ ID NO: 275450 - DNA, 20 bp, Artificial Sequence
  Description of Artificial Sequence: Synthetic oligonucleotide
  Target: ATXN1; (+) strand; PAM type: YTN; PAM sequence: TTG
tgacccagctctgatagcct

SEQ ID NO: 275451 - DNA, 20 bp, Artificial Sequence
  Description of Artificial Sequence: Synthetic oligonucleotide
  Target: ATXN1; (+) strand; PAM type: YTN; PAM sequence: CTC
tgatagcctggattttacat

SEQ ID NO: 275452 - DNA, 20 bp, Artificial Sequence
  Description of Artificial Sequence: Synthetic oligonucleotide
  Target: ATXN1; (+) strand; PAM type: YTN; PAM sequence: CTG
atagcctggattttacatca

SEQ ID NO: 275453 - DNA, 20 bp, Artificial Sequence
  Description of Artificial Sequence: Synthetic oligonucleotide
  Target: ATXN1; (+) strand; PAM type: YTN; PAM sequence: CTG
gattttacatcatttatctc

SEQ ID NO: 275454 - DNA, 20 bp, Artificial Sequence
  Description of Artificial Sequence: Synthetic oligonucleotide
  Target: ATXN1; (+) strand; PAM type: YTN; PAM sequence: TTT
tacatcatttatctctgtgt

SEQ ID NO: 275455 - DNA, 20 bp, Artificial Sequence
  Description of Artificial Sequence: Synthetic oligonucleotide
  Target: ATXN1; (+) strand; PAM type: YTN; PAM sequence: TTT
acatcatttatctctgtgta

SEQ ID NO: 275456 - DNA, 20 bp, Artificial Sequence
  Description of Artificial Sequence: Synthetic oligonucleotide
  Target: ATXN1; (+) strand; PAM type: YTN; PAM sequence: TTA
catcatttatctctgtgtag

SEQ ID NO: 275457 - DNA, 20 bp, Artificial Sequence
  Description of Artificial Sequence: Synthetic oligonucleotide
  Target: ATXN1; (+) strand; PAM type: YTN; PAM sequence: TTT
atctctgtgtagcagacatt

SEQ ID NO: 275458 - DNA, 20 bp, Artificial Sequence
  Description of Artificial Sequence: Synthetic oligonucleotide
  Target: ATXN1; (+) strand; PAM type: YTN; PAM sequence: TTA
tctctgtgtagcagacattc

SEQ ID NO: 275459 - DNA, 20 bp, Artificial Sequence
  Description of Artificial Sequence: Synthetic oligonucleotide
  Target: ATXN1; (+) strand; PAM type: YTN; PAM sequence: CTC
tgtgtagcagacattcaaaa

SEQ ID NO: 275460 - DNA, 20 bp, Artificial Sequence
  Description of Artificial Sequence: Synthetic oligonucleotide
  Target: ATXN1; (+) strand; PAM type: YTN; PAM sequence: CTG
tgtagcagacattcaaaata

SEQ ID NO: 275461 - DNA, 20 bp, Artificial Sequence
  Description of Artificial Sequence: Synthetic oligonucleotide
  Target: ATXN1; (+) strand; PAM type: YTN; PAM sequence: TTC
aaaatatgcagaaatgaatg

SEQ ID NO: 275462 - DNA, 20 bp, Artificial Sequence
  Description of Artificial Sequence: Synthetic oligonucleotide
  Target: ATXN1; (+) strand; PAM type: YTN; PAM sequence: CTC
agagaatcataaataaaagg

SEQ ID NO: 275463 - DNA, 20 bp, Artificial Sequence
  Description of Artificial Sequence: Synthetic oligonucleotide
  Target: ATXN1; (+) strand; PAM type: YTN; PAM sequence: CTT
attgagtccgtgaatgtccc

SEQ ID NO: 275464 - DNA, 20 bp, Artificial Sequence
  Description of Artificial Sequence: Synthetic oligonucleotide
  Target: ATXN1; (+) strand; PAM type: YTN; PAM sequence: TTA
ttgagtccgtgaatgtcccc

SEQ ID NO: 275465 - DNA, 20 bp, Artificial Sequence
  Description of Artificial Sequence: Synthetic oligonucleotide
  Target: ATXN1; (+) strand; PAM type: YTN; PAM sequence: TTG
agtccgtgaatgtccccaag

SEQ ID NO: 275466 - DNA, 20 bp, Artificial Sequence
  Description of Artificial Sequence: Synthetic oligonucleotide
  Target: ATXN1; (+) strand; PAM type: YTN; PAM sequence: TTG
gagaagtcaccagcatttca

SEQ ID NO: 275467 - DNA, 20 bp, Artificial Sequence
  Description of Artificial Sequence: Synthetic oligonucleotide
  Target: ATXN1; (+) strand; PAM type: YTN; PAM sequence: TTT
caaagagcaacatctgaatt

SEQ ID NO: 275468 - DNA, 20 bp, Artificial Sequence
  Description of Artificial Sequence: Synthetic oligonucleotide
  Target: ATXN1; (+) strand; PAM type: YTN; PAM sequence: TTC
aaagagcaacatctgaattc

SEQ ID NO: 275469 - DNA, 20 bp, Artificial Sequence
  Description of Artificial Sequence: Synthetic oligonucleotide
  Target: ATXN1; (+) strand; PAM type: YTN; PAM sequence: CTG
aattccaaaatttgtctaaa

SEQ ID NO: 275470 - DNA, 20 bp, Artificial Sequence
  Description of Artificial Sequence: Synthetic oligonucleotide
  Target: ATXN1; (+) strand; PAM type: YTN; PAM sequence: TTC
caaaatttgtctaaaattga

SEQ ID NO: 275471 - DNA, 20 bp, Artificial Sequence
  Description of Artificial Sequence: Synthetic oligonucleotide
  Target: ATXN1; (+) strand; PAM type: YTN; PAM sequence: TTT
gtctaaaattgaaaagatga

SEQ ID NO: 275472 - DNA, 20 bp, Artificial Sequence
  Description of Artificial Sequence: Synthetic oligonucleotide
  Target: ATXN1; (+) strand; PAM type: YTN; PAM sequence: TTG
tctaaaattgaaaagatgat

SEQ ID NO: 275473 - DNA, 20 bp, Artificial Sequence
  Description of Artificial Sequence: Synthetic oligonucleotide
  Target: ATXN1; (+) strand; PAM type: YTN; PAM sequence: CTA
aaattgaaaagatgattata

SEQ ID NO: 275474 - DNA, 20 bp, Artificial Sequence
  Description of Artificial Sequence: Synthetic oligonucleotide
  Target: ATXN1; (+) strand; PAM type: YTN; PAM sequence: TTG
aaaagatgattataaatcta

SEQ ID NO: 275475 - DNA, 20 bp, Artificial Sequence
  Description of Artificial Sequence: Synthetic oligonucleotide
  Target: ATXN1; (+) strand; PAM type: YTN; PAM sequence: TTA
taaatctataccatgaaatt

SEQ ID NO: 275476 - DNA, 20 bp, Artificial Sequence
  Description of Artificial Sequence: Synthetic oligonucleotide
  Target: ATXN1; (+) strand; PAM type: YTN; PAM sequence: CTA
taccatgaaatttggtagat

SEQ ID NO: 275477 - DNA, 20 bp, Artificial Sequence
  Description of Artificial Sequence: Synthetic oligonucleotide
  Target: ATXN1; (+) strand; PAM type: YTN; PAM sequence: TTT
ggtagatatctgttcttaag

SEQ ID NO: 275478 - DNA, 20 bp, Artificial Sequence
  Description of Artificial Sequence: Synthetic oligonucleotide
  Target: ATXN1; (+) strand; PAM type: YTN; PAM sequence: TTG
gtagatatctgttcttaagg

SEQ ID NO: 275479 - DNA, 20 bp, Artificial Sequence
  Description of Artificial Sequence: Synthetic oligonucleotide
  Target: ATXN1; (+) strand; PAM type: YTN; PAM sequence: CTG
ttcttaaggaattaaaacat

SEQ ID NO: 275480 - DNA, 20 bp, Artificial Sequence
  Description of Artificial Sequence: Synthetic oligonucleotide
  Target: ATXN1; (+) strand; PAM type: YTN; PAM sequence: TTC
ttaaggaattaaaacatata

SEQ ID NO: 275481 - DNA, 20 bp, Artificial Sequence
  Description of Artificial Sequence: Synthetic oligonucleotide
  Target: ATXN1; (+) strand; PAM type: YTN; PAM sequence: CTT
aaggaattaaaacatataaa

SEQ ID NO: 275482 - DNA, 20 bp, Artificial Sequence
  Description of Artificial Sequence: Synthetic oligonucleotide
  Target: ATXN1; (+) strand; PAM type: YTN; PAM sequence: TTA
aggaattaaaacatataaat

SEQ ID NO: 275483 - DNA, 20 bp, Artificial Sequence
  Description of Artificial Sequence: Synthetic oligonucleotide
  Target: ATXN1; (+) strand; PAM type: YTN; PAM sequence: TTA
aaacatataaatataaaaat

SEQ ID NO: 275484 - DNA, 20 bp, Artificial Sequence
  Description of Artificial Sequence: Synthetic oligonucleotide
  Target: ATXN1; (+) strand; PAM type: YTN; PAM sequence: CTC
ctctgatattggctgaagaa

SEQ ID NO: 275485 - DNA, 20 bp, Artificial Sequence
  Description of Artificial Sequence: Synthetic oligonucleotide
  Target: ATXN1; (+) strand; PAM type: YTN; PAM sequence: CTC
tgatattggctgaagaaaat

SEQ ID NO: 275486 - DNA, 20 bp, Artificial Sequence
  Description of Artificial Sequence: Synthetic oligonucleotide
  Target: ATXN1; (+) strand; PAM type: YTN; PAM sequence: CTG
atattggctgaagaaaatca

SEQ ID NO: 275487 - DNA, 20 bp, Artificial Sequence
  Description of Artificial Sequence: Synthetic oligonucleotide
  Target: ATXN1; (+) strand; PAM type: YTN; PAM sequence: TTG
gctgaagaaaatcattttca

SEQ ID NO: 275488 - DNA, 20 bp, Artificial Sequence
  Description of Artificial Sequence: Synthetic oligonucleotide
  Target: ATXN1; (+) strand; PAM type: YTN; PAM sequence: CTG
aagaaaatcattttcaagga

SEQ ID NO: 275489 - DNA, 20 bp, Artificial Sequence
  Description of Artificial Sequence: Synthetic oligonucleotide
  Target: ATXN1; (+) strand; PAM type: YTN; PAM sequence: TTT
tcaaggagactcttaccaaa

SEQ ID NO: 275490 - DNA, 20 bp, Artificial Sequence
  Description of Artificial Sequence: Synthetic oligonucleotide
  Target: ATXN1; (+) strand; PAM type: YTN; PAM sequence: TTT
caaggagactcttaccaaag

SEQ ID NO: 275491 - DNA, 20 bp, Artificial Sequence
  Description of Artificial Sequence: Synthetic oligonucleotide
  Target: ATXN1; (+) strand; PAM type: YTN; PAM sequence: TTC
aaggagactcttaccaaagc

SEQ ID NO: 275492 - DNA, 20 bp, Artificial Sequence
  Description of Artificial Sequence: Synthetic oligonucleotide
  Target: ATXN1; (+) strand; PAM type: YTN; PAM sequence: CTC
ttaccaaagctctattttca

SEQ ID NO: 275493 - DNA, 20 bp, Artificial Sequence
  Description of Artificial Sequence: Synthetic oligonucleotide
  Target: ATXN1; (+) strand; PAM type: YTN; PAM sequence: CTT
accaaagctctattttcaac

SEQ ID NO: 275494 - DNA, 20 bp, Artificial Sequence
  Description of Artificial Sequence: Synthetic oligonucleotide
  Target: ATXN1; (+) strand; PAM type: YTN; PAM sequence: TTA
ccaaagctctattttcaaca

SEQ ID NO: 275495 - DNA, 20 bp, Artificial Sequence
  Description of Artificial Sequence: Synthetic oligonucleotide
  Target: ATXN1; (+) strand; PAM type: YTN; PAM sequence: CTC
tattttcaacattaaagctt

SEQ ID NO: 275496 - DNA, 20 bp, Artificial Sequence
  Description of Artificial Sequence: Synthetic oligonucleotide
  Target: ATXN1; (+) strand; PAM type: YTN; PAM sequence: CTA
ttttcaacattaaagcttaa

SEQ ID NO: 275497 - DNA, 20 bp, Artificial Sequence
  Description of Artificial Sequence: Synthetic oligonucleotide
  Target: ATXN1; (+) strand; PAM type: YTN; PAM sequence: TTT
tcaacattaaagcttaaaat

SEQ ID NO: 275498 - DNA, 20 bp, Artificial Sequence
  Description of Artificial Sequence: Synthetic oligonucleotide
  Target: ATXN1; (+) strand; PAM type: YTN; PAM sequence: TTT
caacattaaagcttaaaatg

SEQ ID NO: 275499 - DNA, 20 bp, Artificial Sequence
  Description of Artificial Sequence: Synthetic oligonucleotide
  Target: ATXN1; (+) strand; PAM type: YTN; PAM sequence: TTC
aacattaaagcttaaaatgt

SEQ ID NO: 275500 - DNA, 20 bp, Artificial Sequence
  Description of Artificial Sequence: Synthetic oligonucleotide
  Target: ATXN1; (+) strand; PAM type: YTN; PAM sequence: TTA
aagcttaaaatgtaaggggc

SEQ ID NO: 275501 - DNA, 20 bp, Artificial Sequence
  Description of Artificial Sequence: Synthetic oligonucleotide
  Target: ATXN1; (+) strand; PAM type: YTN; PAM sequence: CTT
aaaatgtaaggggcagagag

SEQ ID NO: 275502 - DNA, 20 bp, Artificial Sequence
  Description of Artificial Sequence: Synthetic oligonucleotide
  Target: ATXN1; (+) strand; PAM type: YTN; PAM sequence: TTA
aaatgtaaggggcagagagt

SEQ ID NO: 275503 - DNA, 20 bp, Artificial Sequence
  Description of Artificial Sequence: Synthetic oligonucleotide
  Target: ATXN1; (+) strand; PAM type: YTN; PAM sequence: TTT
tgagaatggttttcaaggaa

SEQ ID NO: 275504 - DNA, 20 bp, Artificial Sequence
  Description of Artificial Sequence: Synthetic oligonucleotide
  Target: ATXN1; (+) strand; PAM type: YTN; PAM sequence: TTT
gagaatggttttcaaggaaa

SEQ ID NO: 275505 - DNA, 20 bp, Artificial Sequence
  Description of Artificial Sequence: Synthetic oligonucleotide
  Target: ATXN1; (+) strand; PAM type: YTN; PAM sequence: TTG
agaatggttttcaaggaaag

SEQ ID NO: 275506 - DNA, 20 bp, Artificial Sequence
  Description of Artificial Sequence: Synthetic oligonucleotide
  Target: ATXN1; (+) strand; PAM type: YTN; PAM sequence: TTT
tcaaggaaagtaattaaaat

SEQ ID NO: 275507 - DNA, 20 bp, Artificial Sequence
  Description of Artificial Sequence: Synthetic oligonucleotide
  Target: ATXN1; (+) strand; PAM type: YTN; PAM sequence: TTT
caaggaaagtaattaaaatc

SEQ ID NO: 275508 - DNA, 20 bp, Artificial Sequence
  Description of Artificial Sequence: Synthetic oligonucleotide
  Target: ATXN1; (+) strand; PAM type: YTN; PAM sequence: TTC
aaggaaagtaattaaaatca

SEQ ID NO: 275509 - DNA, 20 bp, Artificial Sequence
  Description of Artificial Sequence: Synthetic oligonucleotide
  Target: ATXN1; (+) strand; PAM type: YTN; PAM sequence: TTA
aaatcaacgtaggttgtaga

SEQ ID NO: 275510 - DNA, 20 bp, Artificial Sequence
  Description of Artificial Sequence: Synthetic oligonucleotide
  Target: ATXN1; (+) strand; PAM type: YTN; PAM sequence: TTG
tagaaccagatccagaagag

SEQ ID NO: 275511 - DNA, 20 bp, Artificial Sequence
  Description of Artificial Sequence: Synthetic oligonucleotide
  Target: ATXN1; (+) strand; PAM type: YTN; PAM sequence: CTG
attgctatatttcaggggtg

SEQ ID NO: 275512 - DNA, 20 bp, Artificial Sequence
  Description of Artificial Sequence: Synthetic oligonucleotide
  Target: ATXN1; (+) strand; PAM type: YTN; PAM sequence: TTG
ctatatttcaggggtgaaaa

SEQ ID NO: 275513 - DNA, 20 bp, Artificial Sequence
  Description of Artificial Sequence: Synthetic oligonucleotide
  Target: ATXN1; (+) strand; PAM type: YTN; PAM sequence: CTA
tatttcaggggtgaaaaaag

SEQ ID NO: 275514 - DNA, 20 bp, Artificial Sequence
  Description of Artificial Sequence: Synthetic oligonucleotide
  Target: ATXN1; (+) strand; PAM type: YTN; PAM sequence: TTT
caggggtgaaaaaaggtcaa

SEQ ID NO: 275515 - DNA, 20 bp, Artificial Sequence
  Description of Artificial Sequence: Synthetic oligonucleotide
  Target: ATXN1; (+) strand; PAM type: YTN; PAM sequence: TTC
aggggtgaaaaaaggtcaaa

SEQ ID NO: 275516 - DNA, 20 bp, Artificial Sequence
  Description of Artificial Sequence: Synthetic oligonucleotide
  Target: ATXN1; (+) strand; PAM type: YTN; PAM sequence: TTG
tcaaaaagtaaagaaaaggg

SEQ ID NO: 275517 - DNA, 20 bp, Artificial Sequence
  Description of Artificial Sequence: Synthetic oligonucleotide
  Target: ATXN1; (+) strand; PAM type: YTN; PAM sequence: CTG
aaagttttcaatactgtatc

SEQ ID NO: 275518 - DNA, 20 bp, Artificial Sequence
  Description of Artificial Sequence: Synthetic oligonucleotide
  Target: ATXN1; (+) strand; PAM type: YTN; PAM sequence: TTT
tcaatactgtatcaatgccc

SEQ ID NO: 275519 - DNA, 20 bp, Artificial Sequence
  Description of Artificial Sequence: Synthetic oligonucleotide
  Target: ATXN1; (+) strand; PAM type: YTN; PAM sequence: TTT
caatactgtatcaatgccca

SEQ ID NO: 275520 - DNA, 20 bp, Artificial Sequence
  Description of Artificial Sequence: Synthetic oligonucleotide
  Target: ATXN1; (+) strand; PAM type: YTN; PAM sequence: TTC
aatactgtatcaatgcccat

SEQ ID NO: 275521 - DNA, 20 bp, Artificial Sequence
  Description of Artificial Sequence: Synthetic oligonucleotide
  Target: ATXN1; (+) strand; PAM type: YTN; PAM sequence: CTG
tatcaatgcccatcacttca

SEQ ID NO: 275522 - DNA, 20 bp, Artificial Sequence
  Description of Artificial Sequence: Synthetic oligonucleotide
  Target: ATXN1; (+) strand; PAM type: YTN; PAM sequence: CTT
cactcaaaaagttagtgaag

SEQ ID NO: 275523 - DNA, 20 bp, Artificial Sequence
  Description of Artificial Sequence: Synthetic oligonucleotide
  Target: ATXN1; (+) strand; PAM type: YTN; PAM sequence: TTC
actcaaaaagttagtgaagc

SEQ ID NO: 275524 - DNA, 20 bp, Artificial Sequence
  Description of Artificial Sequence: Synthetic oligonucleotide
  Target: ATXN1; (+) strand; PAM type: YTN; PAM sequence: CTC
aaaaagttagtgaagcagta

SEQ ID NO: 275525 - DNA, 20 bp, Artificial Sequence
  Description of Artificial Sequence: Synthetic oligonucleotide
  Target: ATXN1; (+) strand; PAM type: YTN; PAM sequence: TTA
gtgaagcagtacgattccat

SEQ ID NO: 275526 - DNA, 20 bp, Artificial Sequence
  Description of Artificial Sequence: Synthetic oligonucleotide
  Target: ATXN1; (+) strand; PAM type: YTN; PAM sequence: TTC
catggaagggttaagggttc

SEQ ID NO: 275527 - DNA, 20 bp, Artificial Sequence
  Description of Artificial Sequence: Synthetic oligonucleotide
  Target: ATXN1; (+) strand; PAM type: YTN; PAM sequence: TTA
agggttcattttccttttag

SEQ ID NO: 275528 - DNA, 20 bp, Artificial Sequence
  Description of Artificial Sequence: Synthetic oligonucleotide
  Target: ATXN1; (+) strand; PAM type: YTN; PAM sequence: TTC
attttccttttagataaata

SEQ ID NO: 275529 - DNA, 20 bp, Artificial Sequence
  Description of Artificial Sequence: Synthetic oligonucleotide
  Target: ATXN1; (+) strand; PAM type: YTN; PAM sequence: TTT
tccttttagataaatattgt

SEQ ID NO: 275530 - DNA, 20 bp, Artificial Sequence
  Description of Artificial Sequence: Synthetic oligonucleotide
  Target: ATXN1; (+) strand; PAM type: YTN; PAM sequence: TTT
ccttttagataaatattgta

SEQ ID NO: 275531 - DNA, 20 bp, Artificial Sequence
  Description of Artificial Sequence: Synthetic oligonucleotide
  Target: ATXN1; (+) strand; PAM type: YTN; PAM sequence: TTC
cttttagataaatattgtat

SEQ ID NO: 275532 - DNA, 20 bp, Artificial Sequence
  Description of Artificial Sequence: Synthetic oligonucleotide
  Target: ATXN1; (+) strand; PAM type: YTN; PAM sequence: CTT
ttagataaatattgtatctg

SEQ ID NO: 275533 - DNA, 20 bp, Artificial Sequence
  Description of Artificial Sequence: Synthetic oligonucleotide
  Target: ATXN1; (+) strand; PAM type: YTN; PAM sequence: TTT
tagataaatattgtatctgg

SEQ ID NO: 275534 - DNA, 20 bp, Artificial Sequence
  Description of Artificial Sequence: Synthetic oligonucleotide
  Target: ATXN1; (+) strand; PAM type: YTN; PAM sequence: TTT
agataaatattgtatctgga

SEQ ID NO: 275535 - DNA, 20 bp, Artificial Sequence
  Description of Artificial Sequence: Synthetic oligonucleotide
  Target: ATXN1; (+) strand; PAM type: YTN; PAM sequence: TTA
gataaatattgtatctggag

SEQ ID NO: 275536 - DNA, 20 bp, Artificial Sequence
  Description of Artificial Sequence: Synthetic oligonucleotide
  Target: ATXN1; (+) strand; PAM type: YTN; PAM sequence: TTG
tatctggagcaaaaggtaac

SEQ ID NO: 275537 - DNA, 20 bp, Artificial Sequence
  Description of Artificial Sequence: Synthetic oligonucleotide
  Target: ATXN1; (+) strand; PAM type: YTN; PAM sequence: CTG
gagcaaaaggtaacctctta

SEQ ID NO: 275538 - DNA, 20 bp, Artificial Sequence
  Description of Artificial Sequence: Synthetic oligonucleotide
  Target: ATXN1; (+) strand; PAM type: YTN; PAM sequence: CTC
ttagcagattcatccattgt

SEQ ID NO: 275539 - DNA, 20 bp, Artificial Sequence
  Description of Artificial Sequence: Synthetic oligonucleotide
  Target: ATXN1; (+) strand; PAM type: YTN; PAM sequence: CTT
agcagattcatccattgtcg

SEQ ID NO: 275540 - DNA, 20 bp, Artificial Sequence
  Description of Artificial Sequence: Synthetic oligonucleotide
  Target: ATXN1; (+) strand; PAM type: YTN; PAM sequence: TTA
gcagattcatccattgtcgg

SEQ ID NO: 275541 - DNA, 20 bp, Artificial Sequence
  Description of Artificial Sequence: Synthetic oligonucleotide
  Target: ATXN1; (+) strand; PAM type: YTN; PAM sequence: TTC
atccattgtcggaatcttat

SEQ ID NO: 275542 - DNA, 20 bp, Artificial Sequence
  Description of Artificial Sequence: Synthetic oligonucleotide
  Target: ATXN1; (+) strand; PAM type: YTN; PAM sequence: TTG
tcggaatcttatttggactg

SEQ ID NO: 275543 - DNA, 20 bp, Artificial Sequence
  Description of Artificial Sequence: Synthetic oligonucleotide
  Target: ATXN1; (+) strand; PAM type: YTN; PAM sequence: CTT
atttggactgtacaaaacga

SEQ ID NO: 275544 - DNA, 20 bp, Artificial Sequence
  Description of Artificial Sequence: Synthetic oligonucleotide
  Target: ATXN1; (+) strand; PAM type: YTN; PAM sequence: TTA
tttggactgtacaaaacgac

SEQ ID NO: 275545 - DNA, 20 bp, Artificial Sequence
  Description of Artificial Sequence: Synthetic oligonucleotide
  Target: ATXN1; (+) strand; PAM type: YTN; PAM sequence: TTT
ggactgtacaaaacgactac

SEQ ID NO: 275546 - DNA, 20 bp, Artificial Sequence
  Description of Artificial Sequence: Synthetic oligonucleotide
  Target: ATXN1; (+) strand; PAM type: YTN; PAM sequence: TTG
gactgtacaaaacgactacc

SEQ ID NO: 275547 - DNA, 20 bp, Artificial Sequence
  Description of Artificial Sequence: Synthetic oligonucleotide
  Target: ATXN1; (+) strand; PAM type: YTN; PAM sequence: CTG
tacaaaacgactaccccatc

SEQ ID NO: 275548 - DNA, 20 bp, Artificial Sequence
  Description of Artificial Sequence: Synthetic oligonucleotide
  Target: ATXN1; (+) strand; PAM type: YTN; PAM sequence: CTA
ccccatcgttttacttaaga

SEQ ID NO: 275549 - DNA, 20 bp, Artificial Sequence
  Description of Artificial Sequence: Synthetic oligonucleotide
  Target: ATXN1; (+) strand; PAM type: YTN; PAM sequence: TTT
tacttaagagaacatctaca

SEQ ID NO: 275550 - DNA, 20 bp, Artificial Sequence
  Description of Artificial Sequence: Synthetic oligonucleotide
  Target: ATXN1; (+) strand; PAM type: YTN; PAM sequence: TTT
acttaagagaacatctacac

SEQ ID NO: 275551 - DNA, 20 bp, Artificial Sequence
  Description of Artificial Sequence: Synthetic oligonucleotide
  Target: ATXN1; (+) strand; PAM type: YTN; PAM sequence: TTA
cttaagagaacatctacact

SEQ ID NO: 275552 - DNA, 20 bp, Artificial Sequence
  Description of Artificial Sequence: Synthetic oligonucleotide
  Target: ATXN1; (+) strand; PAM type: YTN; PAM sequence: CTT
aagagaacatctacactgga

SEQ ID NO: 275553 - DNA, 20 bp, Artificial Sequence
  Description of Artificial Sequence: Synthetic oligonucleotide
  Target: ATXN1; (+) strand; PAM type: YTN; PAM sequence: TTA
agagaacatctacactggaa

SEQ ID NO: 275554 - DNA, 20 bp, Artificial Sequence
  Description of Artificial Sequence: Synthetic oligonucleotide
  Target: ATXN1; (+) strand; PAM type: YTN; PAM sequence: CTA
cactggaatctactggaggg

SEQ ID NO: 275555 - DNA, 20 bp, Artificial Sequence
  Description of Artificial Sequence: Synthetic oligonucleotide
  Target: ATXN1; (+) strand; PAM type: YTN; PAM sequence: CTG
gaatctactggagggtggag

SEQ ID NO: 275556 - DNA, 20 bp, Artificial Sequence
  Description of Artificial Sequence: Synthetic oligonucleotide
  Target: ATXN1; (+) strand; PAM type: YTN; PAM sequence: CTA
ctggagggtggaggtgggag

SEQ ID NO: 275557 - DNA, 20 bp, Artificial Sequence
  Description of Artificial Sequence: Synthetic oligonucleotide
  Target: ATXN1; (+) strand; PAM type: YTN; PAM sequence: CTG
gagggtggaggtgggaggac

SEQ ID NO: 275558 - DNA, 20 bp, Artificial Sequence
  Description of Artificial Sequence: Synthetic oligonucleotide
  Target: ATXN1; (+) strand; PAM type: YTN; PAM sequence: CTA
atggttactaggcttagtac

SEQ ID NO: 275559 - DNA, 20 bp, Artificial Sequence
  Description of Artificial Sequence: Synthetic oligonucleotide
  Target: ATXN1; (+) strand; PAM type: YTN; PAM sequence: TTA
ctaggcttagtacctggtga

SEQ ID NO: 275560 - DNA, 20 bp, Artificial Sequence
  Description of Artificial Sequence: Synthetic oligonucleotide
  Target: ATXN1; (+) strand; PAM type: YTN; PAM sequence: CTA
ggcttagtacctggtgacaa

SEQ ID NO: 275561 - DNA, 20 bp, Artificial Sequence
  Description of Artificial Sequence: Synthetic oligonucleotide
  Target: ATXN1; (+) strand; PAM type: YTN; PAM sequence: CTT
agtacctggtgacaaaataa

SEQ ID NO: 275562 - DNA, 20 bp, Artificial Sequence
  Description of Artificial Sequence: Synthetic oligonucleotide
  Target: ATXN1; (+) strand; PAM type: YTN; PAM sequence: TTA
gtacctggtgacaaaataat

SEQ ID NO: 275563 - DNA, 20 bp, Artificial Sequence
  Description of Artificial Sequence: Synthetic oligonucleotide
  Target: ATXN1; (+) strand; PAM type: YTN; PAM sequence: CTG
gtgacaaaataatctgtaaa

SEQ ID NO: 275564 - DNA, 20 bp, Artificial Sequence
  Description of Artificial Sequence: Synthetic oligonucleotide
  Target: ATXN1; (+) strand; PAM type: YTN; PAM sequence: CTG
taaaacaaacccccatgaca

SEQ ID NO: 275565 - DNA, 20 bp, Artificial Sequence
  Description of Artificial Sequence: Synthetic oligonucleotide
  Target: ATXN1; (+) strand; PAM type: YTN; PAM sequence: TTT
acctatataacgaacctgca

SEQ ID NO: 275566 - DNA, 20 bp, Artificial Sequence
  Description of Artificial Sequence: Synthetic oligonucleotide
  Target: ATXN1; (+) strand; PAM type: YTN; PAM sequence: TTA
cctatataacgaacctgcac

SEQ ID NO: 275567 - DNA, 20 bp, Artificial Sequence
  Description of Artificial Sequence: Synthetic oligonucleotide
  Target: ATXN1; (+) strand; PAM type: YTN; PAM sequence: CTA
tataacgaacctgcacacgt

SEQ ID NO: 275568 - DNA, 20 bp, Artificial Sequence
  Description of Artificial Sequence: Synthetic oligonucleotide
  Target: ATXN1; (+) strand; PAM type: YTN; PAM sequence: CTG
cacacgtacatctgaactta

SEQ ID NO: 275569 - DNA, 20 bp, Artificial Sequence
  Description of Artificial Sequence: Synthetic oligonucleotide
  Target: ATXN1; (+) strand; PAM type: YTN; PAM sequence: CTG
aacttaaaatataagttaaa

SEQ ID NO: 275570 - DNA, 20 bp, Artificial Sequence
  Description of Artificial Sequence: Synthetic oligonucleotide
  Target: ATXN1; (+) strand; PAM type: YTN; PAM sequence: CTT
aaaatataagttaaatgaat

SEQ ID NO: 275571 - DNA, 20 bp, Artificial Sequence
  Description of Artificial Sequence: Synthetic oligonucleotide
  Target: ATXN1; (+) strand; PAM type: YTN; PAM sequence: TTA
aaatataagttaaatgaata

SEQ ID NO: 275572 - DNA, 20 bp, Artificial Sequence
  Description of Artificial Sequence: Synthetic oligonucleotide
  Target: ATXN1; (+) strand; PAM type: YTN; PAM sequence: TTA
aatgaataaaaaaagaaaac

SEQ ID NO: 275573 - DNA, 20 bp, Artificial Sequence
  Description of Artificial Sequence: Synthetic oligonucleotide
  Target: ATXN1; (+) strand; PAM type: YTN; PAM sequence: TTT
tatgatttcctgggtgtctg

SEQ ID NO: 275574 - DNA, 20 bp, Artificial Sequence
  Description of Artificial Sequence: Synthetic oligonucleotide
  Target: ATXN1; (+) strand; PAM type: YTN; PAM sequence: TTT
atgatttcctgggtgtctgt

SEQ ID NO: 275575 - DNA, 20 bp, Artificial Sequence
  Description of Artificial Sequence: Synthetic oligonucleotide
  Target: ATXN1; (+) strand; PAM type: YTN; PAM sequence: TTA
tgatttcctgggtgtctgtg

SEQ ID NO: 275576 - DNA, 20 bp, Artificial Sequence
  Description of Artificial Sequence: Synthetic oligonucleotide
  Target: ATXN1; (+) strand; PAM type: YTN; PAM sequence: TTT
cctgggtgtctgtgttcacg

SEQ ID NO: 275577 - DNA, 20 bp, Artificial Sequence
  Description of Artificial Sequence: Synthetic oligonucleotide
  Target: ATXN1; (+) strand; PAM type: YTN; PAM sequence: TTC
ctgggtgtctgtgttcacgg

SEQ ID NO: 275578 - DNA, 20 bp, Artificial Sequence
  Description of Artificial Sequence: Synthetic oligonucleotide
  Target: ATXN1; (+) strand; PAM type: YTN; PAM sequence: CTG
ggtgtctgtgttcacgggtg

SEQ ID NO: 275579 - DNA, 20 bp, Artificial Sequence
  Description of Artificial Sequence: Synthetic oligonucleotide
  Target: ATXN1; (+) strand; PAM type: YTN; PAM sequence: CTG
tgttcacgggtgggtatgcg

SEQ ID NO: 275580 - DNA, 20 bp, Artificial Sequence
  Description of Artificial Sequence: Synthetic oligonucleotide
  Target: ATXN1; (+) strand; PAM type: YTN; PAM sequence: TTC
acgggtgggtatgcgtgtgt

SEQ ID NO: 275581 - DNA, 20 bp, Artificial Sequence
  Description of Artificial Sequence: Synthetic oligonucleotide
  Target: ATXN1; (+) strand; PAM type: YTN; PAM sequence: TTT
ctttcccattatctcaatgc

SEQ ID NO: 275582 - DNA, 20 bp, Artificial Sequence
  Description of Artificial Sequence: Synthetic oligonucleotide
  Target: ATXN1; (+) strand; PAM type: YTN; PAM sequence: TTC
tttcccattatctcaatgct

SEQ ID NO: 275583 - DNA, 20 bp, Artificial Sequence
  Description of Artificial Sequence: Synthetic oligonucleotide
  Target: ATXN1; (+) strand; PAM type: YTN; PAM sequence: CTT
tcccattatctcaatgctta

SEQ ID NO: 275584 - DNA, 20 bp, Artificial Sequence
  Description of Artificial Sequence: Synthetic oligonucleotide
  Target: ATXN1; (+) strand; PAM type: YTN; PAM sequence: TTT
cccattatctcaatgcttat

SEQ ID NO: 275585 - DNA, 20 bp, Artificial Sequence
  Description of Artificial Sequence: Synthetic oligonucleotide
  Target: ATXN1; (+) strand; PAM type: YTN; PAM sequence: TTC
ccattatctcaatgcttatt

SEQ ID NO: 275586 - DNA, 20 bp, Artificial Sequence
  Description of Artificial Sequence: Synthetic oligonucleotide
  Target: ATXN1; (+) strand; PAM type: YTN; PAM sequence: TTA
tctcaatgcttattatacat

SEQ ID NO: 275587 - DNA, 20 bp, Artificial Sequence
  Description of Artificial Sequence: Synthetic oligonucleotide
  Target: ATXN1; (+) strand; PAM type: YTN; PAM sequence: CTC
aatgcttattatacataatt

SEQ ID NO: 275588 - DNA, 20 bp, Artificial Sequence
  Description of Artificial Sequence: Synthetic oligonucleotide
  Target: ATXN1; (+) strand; PAM type: YTN; PAM sequence: CTT
attatacataattttttaag

SEQ ID NO: 275589 - DNA, 20 bp, Artificial Sequence
  Description of Artificial Sequence: Synthetic oligonucleotide
  Target: ATXN1; (+) strand; PAM type: YTN; PAM sequence: TTA
ttatacataattttttaagt

SEQ ID NO: 275590 - DNA, 20 bp, Artificial Sequence
  Description of Artificial Sequence: Synthetic oligonucleotide
  Target: ATXN1; (+) strand; PAM type: YTN; PAM sequence: TTA
tacataattttttaagtcaa

SEQ ID NO: 275591 - DNA, 20 bp, Artificial Sequence
  Description of Artificial Sequence: Synthetic oligonucleotide
  Target: ATXN1; (+) strand; PAM type: YTN; PAM sequence: TTT
tttaagtcaatgcttaatac

SEQ ID NO: 275592 - DNA, 20 bp, Artificial Sequence
  Description of Artificial Sequence: Synthetic oligonucleotide
  Target: ATXN1; (+) strand; PAM type: YTN; PAM sequence: TTT
ttaagtcaatgcttaatact

SEQ ID NO: 275593 - DNA, 20 bp, Artificial Sequence
  Description of Artificial Sequence: Synthetic oligonucleotide
  Target: ATXN1; (+) strand; PAM type: YTN; PAM sequence: TTT
taagtcaatgcttaatactc

SEQ ID NO: 275594 - DNA, 20 bp, Artificial Sequence
  Description of Artificial Sequence: Synthetic oligonucleotide
  Target: ATXN1; (+) strand; PAM type: YTN; PAM sequence: TTT
aagtcaatgcttaatactct

SEQ ID NO: 275595 - DNA, 20 bp, Artificial Sequence
  Description of Artificial Sequence: Synthetic oligonucleotide
  Target: ATXN1; (+) strand; PAM type: YTN; PAM sequence: TTA
agtcaatgcttaatactctt

SEQ ID NO: 275596 - DNA, 20 bp, Artificial Sequence
  Description of Artificial Sequence: Synthetic oligonucleotide
  Target: ATXN1; (+) strand; PAM type: YTN; PAM sequence: CTT
aatactcttcaactgccaaa

SEQ ID NO: 275597 - DNA, 20 bp, Artificial Sequence
  Description of Artificial Sequence: Synthetic oligonucleotide
  Target: ATXN1; (+) strand; PAM type: YTN; PAM sequence: TTA
atactcttcaactgccaaaa

SEQ ID NO: 275598 - DNA, 20 bp, Artificial Sequence
  Description of Artificial Sequence: Synthetic oligonucleotide
  Target: ATXN1; (+) strand; PAM type: YTN; PAM sequence: CTC
ttcaactgccaaaacatacc

SEQ ID NO: 275599 - DNA, 20 bp, Artificial Sequence
  Description of Artificial Sequence: Synthetic oligonucleotide
  Target: ATXN1; (+) strand; PAM type: YTN; PAM sequence: CTT
caactgccaaaacataccat

SEQ ID NO: 275600 - DNA, 20 bp, Artificial Sequence
  Description of Artificial Sequence: Synthetic oligonucleotide
  Target: ATXN1; (+) strand; PAM type: YTN; PAM sequence: TTC
aactgccaaaacataccata

SEQ ID NO: 275601 - DNA, 20 bp, Artificial Sequence
  Description of Artificial Sequence: Synthetic oligonucleotide
  Target: ATXN1; (+) strand; PAM type: YTN; PAM sequence: CTG
ccaaaacataccatataaac

SEQ ID NO: 275602 - DNA, 20 bp, Artificial Sequence
  Description of Artificial Sequence: Synthetic oligonucleotide
  Target: ATXN1; (+) strand; PAM type: YTN; PAM sequence: CTC
ttcaaagacagtgtccatac

SEQ ID NO: 275603 - DNA, 20 bp, Artificial Sequence
  Description of Artificial Sequence: Synthetic oligonucleotide
  Target: ATXN1; (+) strand; PAM type: YTN; PAM sequence: CTT
caaagacagtgtccatacac

SEQ ID NO: 275604 - DNA, 20 bp, Artificial Sequence
  Description of Artificial Sequence: Synthetic oligonucleotide
  Target: ATXN1; (+) strand; PAM type: YTN; PAM sequence: TTC
aaagacagtgtccatacacc

SEQ ID NO: 275605 - DNA, 20 bp, Artificial Sequence
  Description of Artificial Sequence: Synthetic oligonucleotide
  Target: ATXN1; (+) strand; PAM type: YTN; PAM sequence: CTT
aataagtcctctaacagcta

SEQ ID NO: 275606 - DNA, 20 bp, Artificial Sequence
  Description of Artificial Sequence: Synthetic oligonucleotide
  Target: ATXN1; (+) strand; PAM type: YTN; PAM sequence: TTA
ataagtcctctaacagctag

SEQ ID NO: 275607 - DNA, 20 bp, Artificial Sequence
  Description of Artificial Sequence: Synthetic oligonucleotide
  Target: ATXN1; (+) strand; PAM type: YTN; PAM sequence: CTC
taacagctagcataagttta

SEQ ID NO: 275608 - DNA, 20 bp, Artificial Sequence
  Description of Artificial Sequence: Synthetic oligonucleotide
  Target: ATXN1; (+) strand; PAM type: YTN; PAM sequence: CTA
acagctagcataagtttact

SEQ ID NO: 275609 - DNA, 20 bp, Artificial Sequence
  Description of Artificial Sequence: Synthetic oligonucleotide
  Target: ATXN1; (+) strand; PAM type: YTN; PAM sequence: CTA
gcataagtttactgtataca

SEQ ID NO: 275610 - DNA, 20 bp, Artificial Sequence
  Description of Artificial Sequence: Synthetic oligonucleotide
  Target: ATXN1; (+) strand; PAM type: YTN; PAM sequence: TTT
actgtatacatggtcaaggt

SEQ ID NO: 275611 - DNA, 20 bp, Artificial Sequence
  Description of Artificial Sequence: Synthetic oligonucleotide
  Target: ATXN1; (+) strand; PAM type: YTN; PAM sequence: TTA
ctgtatacatggtcaaggta

SEQ ID NO: 275612 - DNA, 20 bp, Artificial Sequence
  Description of Artificial Sequence: Synthetic oligonucleotide
  Target: ATXN1; (+) strand; PAM type: YTN; PAM sequence: CTG
tatacatggtcaaggtattg

SEQ ID NO: 275613 - DNA, 20 bp, Artificial Sequence
  Description of Artificial Sequence: Synthetic oligonucleotide
  Target: ATXN1; (+) strand; PAM type: YTN; PAM sequence: TTG
aagagaatttgtacaaaaca

SEQ ID NO: 275614 - DNA, 20 bp, Artificial Sequence
  Description of Artificial Sequence: Synthetic oligonucleotide
  Target: ATXN1; (+) strand; PAM type: YTN; PAM sequence: TTT
gtacaaaacaatcagcacat

SEQ ID NO: 275615 - DNA, 20 bp, Artificial Sequence
  Description of Artificial Sequence: Synthetic oligonucleotide
  Target: ATXN1; (+) strand; PAM type: YTN; PAM sequence: TTG
tacaaaacaatcagcacatc

SEQ ID NO: 275616 - DNA, 20 bp, Artificial Sequence
  Description of Artificial Sequence: Synthetic oligonucleotide
  Target: ATXN1; (+) strand; PAM type: YTN; PAM sequence: CTC
aaaattcccaaattggcaat

SEQ ID NO: 275617 - DNA, 20 bp, Artificial Sequence
  Description of Artificial Sequence: Synthetic oligonucleotide
  Target: ATXN1; (+) strand; PAM type: YTN; PAM sequence: TTC
ccaaattggcaatcactgcc

SEQ ID NO: 275618 - DNA, 20 bp, Artificial Sequence
  Description of Artificial Sequence: Synthetic oligonucleotide
  Target: ATXN1; (+) strand; PAM type: YTN; PAM sequence: TTG
gcaatcactgccttagcaaa

SEQ ID NO: 275619 - DNA, 20 bp, Artificial Sequence
  Description of Artificial Sequence: Synthetic oligonucleotide
  Target: ATXN1; (+) strand; PAM type: YTN; PAM sequence: CTG
ccttagcaaagctgcatctc

SEQ ID NO: 275620 - DNA, 20 bp, Artificial Sequence
  Description of Artificial Sequence: Synthetic oligonucleotide
  Target: ATXN1; (+) strand; PAM type: YTN; PAM sequence: CTT
agcaaagctgcatctctgac

SEQ ID NO: 275621 - DNA, 20 bp, Artificial Sequence
  Description of Artificial Sequence: Synthetic oligonucleotide
  Target: ATXN1; (+) strand; PAM type: YTN; PAM sequence: TTA
gcaaagctgcatctctgacc

SEQ ID NO: 275622 - DNA, 20 bp, Artificial Sequence
  Description of Artificial Sequence: Synthetic oligonucleotide
  Target: ATXN1; (+) strand; PAM type: YTN; PAM sequence: CTG
catctctgacctggagatag

SEQ ID NO: 275623 - DNA, 20 bp, Artificial Sequence
  Description of Artificial Sequence: Synthetic oligonucleotide
  Target: ATXN1; (+) strand; PAM type: YTN; PAM sequence: CTC
tgacctggagatagagggga

SEQ ID NO: 275624 - DNA, 20 bp, Artificial Sequence
  Description of Artificial Sequence: Synthetic oligonucleotide
  Target: ATXN1; (+) strand; PAM type: YTN; PAM sequence: CTG
acctggagatagaggggaag

SEQ ID NO: 275625 - DNA, 20 bp, Artificial Sequence
  Description of Artificial Sequence: Synthetic oligonucleotide
  Target: ATXN1; (+) strand; PAM type: YTN; PAM sequence: CTG
gagatagaggggaagagaag

SEQ ID NO: 275626 - DNA, 20 bp, Artificial Sequence
  Description of Artificial Sequence: Synthetic oligonucleotide
  Target: ATXN1; (+) strand; PAM type: YTN; PAM sequence: CTT
tagggtgccaggcagcaagt

SEQ ID NO: 275627 - DNA, 20 bp, Artificial Sequence
  Description of Artificial Sequence: Synthetic oligonucleotide
  Target: ATXN1; (+) strand; PAM type: YTN; PAM sequence: TTT
agggtgccaggcagcaagtt

SEQ ID NO: 275628 - DNA, 20 bp, Artificial Sequence
  Description of Artificial Sequence: Synthetic oligonucleotide
  Target: ATXN1; (+) strand; PAM type: YTN; PAM sequence: TTA
gggtgccaggcagcaagttg

SEQ ID NO: 275629 - DNA, 20 bp, Artificial Sequence
  Description of Artificial Sequence: Synthetic oligonucleotide
  Target: ATXN1; (+) strand; PAM type: YTN; PAM sequence: TTG
cctgtggtctacgtttcggg

SEQ ID NO: 275630 - DNA, 20 bp, Artificial Sequence
  Description of Artificial Sequence: Synthetic oligonucleotide
  Target: ATXN1; (+) strand; PAM type: YTN; PAM sequence: CTG
tggtctacgtttcggggcag

SEQ ID NO: 275631 - DNA, 20 bp, Artificial Sequence
  Description of Artificial Sequence: Synthetic oligonucleotide
  Target: ATXN1; (+) strand; PAM type: YTN; PAM sequence: CTA
cgtttcggggcaggtccctc

SEQ ID NO: 275632 - DNA, 20 bp, Artificial Sequence
  Description of Artificial Sequence: Synthetic oligonucleotide
  Target: ATXN1; (+) strand; PAM type: YTN; PAM sequence: TTT
cggggcaggtccctcttcca

SEQ ID NO: 275633 - DNA, 20 bp, Artificial Sequence
  Description of Artificial Sequence: Synthetic oligonucleotide
  Target: ATXN1; (+) strand; PAM type: YTN; PAM sequence: TTC
ggggcaggtccctcttccat

SEQ ID NO: 275634 - DNA, 20 bp, Artificial Sequence
  Description of Artificial Sequence: Synthetic oligonucleotide
  Target: ATXN1; (+) strand; PAM type: YTN; PAM sequence: CTC
ttccataactcctctcacca

SEQ ID NO: 275635 - DNA, 20 bp, Artificial Sequence
  Description of Artificial Sequence: Synthetic oligonucleotide
  Target: ATXN1; (+) strand; PAM type: YTN; PAM sequence: CTT
ccataactcctctcaccaca

SEQ ID NO: 275636 - DNA, 20 bp, Artificial Sequence
  Description of Artificial Sequence: Synthetic oligonucleotide
  Target: ATXN1; (+) strand; PAM type: YTN; PAM sequence: TTC
cataactcctctcaccacag

SEQ ID NO: 275637 - DNA, 20 bp, Artificial Sequence
  Description of Artificial Sequence: Synthetic oligonucleotide
  Target: ATXN1; (+) strand; PAM type: YTN; PAM sequence: CTC
ctctcaccacagctaaagat

SEQ ID NO: 275638 - DNA, 20 bp, Artificial Sequence
  Description of Artificial Sequence: Synthetic oligonucleotide
  Target: ATXN1; (+) strand; PAM type: YTN; PAM sequence: CTC
tcaccacagctaaagatcag

SEQ ID NO: 275639 - DNA, 20 bp, Artificial Sequence
  Description of Artificial Sequence: Synthetic oligonucleotide
  Target: ATXN1; (+) strand; PAM type: YTN; PAM sequence: CTC
accacagctaaagatcagag

SEQ ID NO: 275640 - DNA, 20 bp, Artificial Sequence
  Description of Artificial Sequence: Synthetic oligonucleotide
  Target: ATXN1; (+) strand; PAM type: YTN; PAM sequence: CTA
aagatcagagctacttcacc

SEQ ID NO: 275641 - DNA, 20 bp, Artificial Sequence
  Description of Artificial Sequence: Synthetic oligonucleotide
  Target: ATXN1; (+) strand; PAM type: YTN; PAM sequence: CTA
cttcaccaaagtttagtacg

SEQ ID NO: 275642 - DNA, 20 bp, Artificial Sequence
  Description of Artificial Sequence: Synthetic oligonucleotide
  Target: ATXN1; (+) strand; PAM type: YTN; PAM sequence: CTT
caccaaagtttagtacgaat

SEQ ID NO: 275643 - DNA, 20 bp, Artificial Sequence
  Description of Artificial Sequence: Synthetic oligonucleotide
  Target: ATXN1; (+) strand; PAM type: YTN; PAM sequence: TTC
accaaagtttagtacgaata

SEQ ID NO: 275644 - DNA, 20 bp, Artificial Sequence
  Description of Artificial Sequence: Synthetic oligonucleotide
  Target: ATXN1; (+) strand; PAM type: YTN; PAM sequence: TTT
agtacgaataggaaatatca

SEQ ID NO: 275645 - DNA, 20 bp, Artificial Sequence
  Description of Artificial Sequence: Synthetic oligonucleotide
  Target: ATXN1; (+) strand; PAM type: YTN; PAM sequence: TTA
gtacgaataggaaatatcac

SEQ ID NO: 275646 - DNA, 20 bp, Artificial Sequence
  Description of Artificial Sequence: Synthetic oligonucleotide
  Target: ATXN1; (+) strand; PAM type: YTN; PAM sequence: TTC
agattctgtgactttaaaaa

SEQ ID NO: 275647 - DNA, 20 bp, Artificial Sequence
  Description of Artificial Sequence: Synthetic oligonucleotide
  Target: ATXN1; (+) strand; PAM type: YTN; PAM sequence: TTC
tgtgactttaaaaagtgcaa

SEQ ID NO: 275648 - DNA, 20 bp, Artificial Sequence
  Description of Artificial Sequence: Synthetic oligonucleotide
  Target: ATXN1; (+) strand; PAM type: YTN; PAM sequence: CTG
tgactttaaaaagtgcaacc

SEQ ID NO: 275649 - DNA, 20 bp, Artificial Sequence
  Description of Artificial Sequence: Synthetic oligonucleotide
  Target: ATXN1; (+) strand; PAM type: YTN; PAM sequence: CTT
taaaaagtgcaacccaggca

SEQ ID NO: 275650 - DNA, 20 bp, Artificial Sequence
  Description of Artificial Sequence: Synthetic oligonucleotide
  Target: ATXN1; (+) strand; PAM type: YTN; PAM sequence: TTT
aaaaagtgcaacccaggcag

SEQ ID NO: 275651 - DNA, 20 bp, Artificial Sequence
  Description of Artificial Sequence: Synthetic oligonucleotide
  Target: ATXN1; (+) strand; PAM type: YTN; PAM sequence: TTA
aaaagtgcaacccaggcagg

SEQ ID NO: 275652 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcctaacact

SEQ ID NO: 275653 - DNA, 20 bp, Artificial Sequence
  Description of Artificial Sequence: Synthetic oligonucleotide
  Target: ATXN1; (+) strand; PAM type: YTN; PAM sequence: CTG
taatcctaacactttgggag

SEQ ID NO: 275654 - DNA, 20 bp, Artificial Sequence
  Description of Artificial Sequence: Synthetic oligonucleotide
  Target: ATXN1; (+) strand; PAM type: YTN; PAM sequence: CTA
acactttgggaggccgaggc

SEQ ID NO: 275655 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggccagtgg

SEQ ID NO: 275656 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggccagtgga

SEQ ID NO: 275657 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggccagtggat

SEQ ID NO: 275658 - DNA, 20 bp, Artificial Sequence
  Description of Artificial Sequence: Synthetic oligonucleotide
  Target: ATXN1; (+) strand; PAM type: YTN; PAM sequence: CTG
aggtcagaagttcaagacca

SEQ ID NO: 275659 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacat

SEQ ID NO: 275660 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcgaaaccctg

SEQ ID NO: 275661 - DNA, 20 bp, Artificial Sequence
  Description of Artificial Sequence: Synthetic oligonucleotide
  Target: ATXN1; (+) strand; PAM type: YTN; PAM sequence: CTG
tctctactaaatatacaaaa

SEQ ID NO: 275662 - DNA, 20 bp, Artificial Sequence
  Description of Artificial Sequence: Synthetic oligonucleotide
  Target: ATXN1; (+) strand; PAM type: YTN; PAM sequence: CTC
tactaaatatacaaaaatga

SEQ ID NO: 275663 - DNA, 20 bp, Artificial Sequence
  Description of Artificial Sequence: Synthetic oligonucleotide
  Target: ATXN1; (+) strand; PAM type: YTN; PAM sequence: CTA
ctaaatatacaaaaatgagc

SEQ ID NO: 275664 - DNA, 20 bp, Artificial Sequence
  Description of Artificial Sequence: Synthetic oligonucleotide
  Target: ATXN1; (+) strand; PAM type: YTN; PAM sequence: CTA
aatatacaaaaatgagctgg

SEQ ID NO: 275665 - DNA, 20 bp, Artificial Sequence
  Description of Artificial Sequence: Synthetic oligonucleotide
  Target: ATXN1; (+) strand; PAM type: YTN; PAM sequence: CTG
ggcgtggtggcagacacctg

SEQ ID NO: 275666 - DNA, 20 bp, Artificial Sequence
  Description of Artificial Sequence: Synthetic oligonucleotide
  Target: ATXN1; (+) strand; PAM type: YTN; PAM sequence: CTG
taatctcagctactcaggag

SEQ ID NO: 275667 - DNA, 20 bp, Artificial Sequence
  Description of Artificial Sequence: Synthetic oligonucleotide
  Target: ATXN1; (+) strand; PAM type: YTN; PAM sequence: CTC
agctactcaggaggctgagg

SEQ ID NO: 275668 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 275669 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 275670 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 275671 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggatgtggag

SEQ ID NO: 275672 - DNA, 20 bp, Artificial Sequence
  Description of Artificial Sequence: Synthetic oligonucleotide
  Target: ATXN1; (+) strand; PAM type: YTN; PAM sequence: CTT
gaacctgggatgtggaggtt

SEQ ID NO: 275673 - DNA, 20 bp, Artificial Sequence
  Description of Artificial Sequence: Synthetic oligonucleotide
  Target: ATXN1; (+) strand; PAM type: YTN; PAM sequence: TTG
aacctgggatgtggaggttg

SEQ ID NO: 275674 - DNA, 20 bp, Artificial Sequence
  Description of Artificial Sequence: Synthetic oligonucleotide
  Target: ATXN1; (+) strand; PAM type: YTN; PAM sequence: CTG
ggatgtggaggttgcagtga

SEQ ID NO: 275675 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcatgcc

SEQ ID NO: 275676 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggaaacaa

SEQ ID NO: 275677 - DNA, 20 bp, Artificial Sequence
  Description of Artificial Sequence: Synthetic oligonucleotide
  Target: ATXN1; (+) strand; PAM type: YTN; PAM sequence: CTC
cagcctgggaaacaagagcg

SEQ ID NO: 275678 - DNA, 20 bp, Artificial Sequence
  Description of Artificial Sequence: Synthetic oligonucleotide
  Target: ATXN1; (+) strand; PAM type: YTN; PAM sequence: CTG
ggaaacaagagcgaaactgt

SEQ ID NO: 275679 - DNA, 20 bp, Artificial Sequence
  Description of Artificial Sequence: Synthetic oligonucleotide
  Target: ATXN1; (+) strand; PAM type: YTN; PAM sequence: CTG
tgtctcaaaaaaaaaaaaaa

SEQ ID NO: 275680 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaag

SEQ ID NO: 275681 - DNA, 20 bp, Artificial Sequence
  Description of Artificial Sequence: Synthetic oligonucleotide
  Target: ATXN1; (+) strand; PAM type: YTN; PAM sequence: CTA
cccatgttagaaaccttttg

SEQ ID NO: 275682 - DNA, 20 bp, Artificial Sequence
  Description of Artificial Sequence: Synthetic oligonucleotide
  Target: ATXN1; (+) strand; PAM type: YTN; PAM sequence: TTA
gaaaccttttggtcacatct

SEQ ID NO: 275683 - DNA, 20 bp, Artificial Sequence
  Description of Artificial Sequence: Synthetic oligonucleotide
  Target: ATXN1; (+) strand; PAM type: YTN; PAM sequence: CTT
ttggtcacatctggtaacag

SEQ ID NO: 275684 - DNA, 20 bp, Artificial Sequence
  Description of Artificial Sequence: Synthetic oligonucleotide
  Target: ATXN1; (+) strand; PAM type: YTN; PAM sequence: TTT
tggtcacatctggtaacagc

SEQ ID NO: 275685 - DNA, 20 bp, Artificial Sequence
  Description of Artificial Sequence: Synthetic oligonucleotide
  Target: ATXN1; (+) strand; PAM type: YTN; PAM sequence: TTT
ggtcacatctggtaacagcc

SEQ ID NO: 275686 - DNA, 20 bp, Artificial Sequence
  Description of Artificial Sequence: Synthetic oligonucleotide
  Target: ATXN1; (+) strand; PAM type: YTN; PAM sequence: TTG
gtcacatctggtaacagccc

SEQ ID NO: 275687 - DNA, 20 bp, Artificial Sequence
  Description of Artificial Sequence: Synthetic oligonucleotide
  Target: ATXN1; (+) strand; PAM type: YTN; PAM sequence: CTG
gtaacagccccagtggtgct

SEQ ID NO: 275688 - DNA, 20 bp, Artificial Sequence
  Description of Artificial Sequence: Synthetic oligonucleotide
  Target: ATXN1; (+) strand; PAM type: YTN; PAM sequence: CTA
aggacatgaaagccattgcc

SEQ ID NO: 275689 - DNA, 20 bp, Artificial Sequence
  Description of Artificial Sequence: Synthetic oligonucleotide
  Target: ATXN1; (+) strand; PAM type: YTN; PAM sequence: TTG
ccccaatcaaaaaacaaagg

SEQ ID NO: 275690 - DNA, 20 bp, Artificial Sequence
  Description of Artificial Sequence: Synthetic oligonucleotide
  Target: ATXN1; (+) strand; PAM type: YTN; PAM sequence: CTC
tggacacaaaattggaattc

SEQ ID NO: 275691 - DNA, 20 bp, Artificial Sequence
  Description of Artificial Sequence: Synthetic oligonucleotide
  Target: ATXN1; (+) strand; PAM type: YTN; PAM sequence: CTG
gacacaaaattggaattcag

SEQ ID NO: 275692 - DNA, 20 bp, Artificial Sequence
  Description of Artificial Sequence: Synthetic oligonucleotide
  Target: ATXN1; (+) strand; PAM type: YTN; PAM sequence: TTG
gaattcagtaaatacttaaa

SEQ ID NO: 275693 - DNA, 20 bp, Artificial Sequence
  Description of Artificial Sequence: Synthetic oligonucleotide
  Target: ATXN1; (+) strand; PAM type: YTN; PAM sequence: TTC
agtaaatacttaaaagcagt

SEQ ID NO: 275694 - DNA, 20 bp, Artificial Sequence
  Description of Artificial Sequence: Synthetic oligonucleotide
  Target: ATXN1; (+) strand; PAM type: YTN; PAM sequence: CTT
aaaagcagtaatgtaacagg

SEQ ID NO: 275695 - DNA, 20 bp, Artificial Sequence
  Description of Artificial Sequence: Synthetic oligonucleotide
  Target: ATXN1; (+) strand; PAM type: YTN; PAM sequence: TTA
aaagcagtaatgtaacaggg

SEQ ID NO: 275696 - DNA, 20 bp, Artificial Sequence
  Description of Artificial Sequence: Synthetic oligonucleotide
  Target: ATXN1; (+) strand; PAM type: YTN; PAM sequence: CTA
tcttattcagtaaatactta

SEQ ID NO: 275697 - DNA, 20 bp, Artificial Sequence
  Description of Artificial Sequence: Synthetic oligonucleotide
  Target: ATXN1; (+) strand; PAM type: YTN; PAM sequence: CTT
attcagtaaatacttaaaac

SEQ ID NO: 275698 - DNA, 20 bp, Artificial Sequence
  Description of Artificial Sequence: Synthetic oligonucleotide
  Target: ATXN1; (+) strand; PAM type: YTN; PAM sequence: TTA
ttcagtaaatacttaaaaca

SEQ ID NO: 275699 - DNA, 20 bp, Artificial Sequence
  Description of Artificial Sequence: Synthetic oligonucleotide
  Target: ATXN1; (+) strand; PAM type: YTN; PAM sequence: TTC
agtaaatacttaaaacagta

SEQ ID NO: 275700 - DNA, 20 bp, Artificial Sequence
  Description of Artificial Sequence: Synthetic oligonucleotide
  Target: ATXN1; (+) strand; PAM type: YTN; PAM sequence: CTT
aaaacagtaatatctactac

SEQ ID NO: 275701 - DNA, 20 bp, Artificial Sequence
  Description of Artificial Sequence: Synthetic oligonucleotide
  Target: ATXN1; (+) strand; PAM type: YTN; PAM sequence: TTA
aaacagtaatatctactaca

SEQ ID NO: 275702 - DNA, 20 bp, Artificial Sequence
  Description of Artificial Sequence: Synthetic oligonucleotide
  Target: ATXN1; (+) strand; PAM type: YTN; PAM sequence: CTA
ctacataagctttattgttt

SEQ ID NO: 275703 - DNA, 20 bp, Artificial Sequence
  Description of Artificial Sequence: Synthetic oligonucleotide
  Target: ATXN1; (+) strand; PAM type: YTN; PAM sequence: CTA
cataagctttattgttttca

SEQ ID NO: 275704 - DNA, 20 bp, Artificial Sequence
  Description of Artificial Sequence: Synthetic oligonucleotide
  Target: ATXN1; (+) strand; PAM type: YTN; PAM sequence: CTT
tattgttttcaaagtgaata

SEQ ID NO: 275705 - DNA, 20 bp, Artificial Sequence
  Description of Artificial Sequence: Synthetic oligonucleotide
  Target: ATXN1; (+) strand; PAM type: YTN; PAM sequence: TTT
attgttttcaaagtgaatag

SEQ ID NO: 275706 - DNA, 20 bp, Artificial Sequence
  Description of Artificial Sequence: Synthetic oligonucleotide
  Target: ATXN1; (+) strand; PAM type: YTN; PAM sequence: TTA
ttgttttcaaagtgaatagc

SEQ ID NO: 275707 - DNA, 20 bp, Artificial Sequence
  Description of Artificial Sequence: Synthetic oligonucleotide
  Target: ATXN1; (+) strand; PAM type: YTN; PAM sequence: TTG
ttttcaaagtgaatagcttg

SEQ ID NO: 275708 - DNA, 20 bp, Artificial Sequence
  Description of Artificial Sequence: Synthetic oligonucleotide
  Target: ATXN1; (+) strand; PAM type: YTN; PAM sequence: TTT
tcaaagtgaatagcttgcag

SEQ ID NO: 275709 - DNA, 20 bp, Artificial Sequence
  Description of Artificial Sequence: Synthetic oligonucleotide
  Target: ATXN1; (+) strand; PAM type: YTN; PAM sequence: TTT
caaagtgaatagcttgcagt

SEQ ID NO: 275710 - DNA, 20 bp, Artificial Sequence
  Description of Artificial Sequence: Synthetic oligonucleotide
  Target: ATXN1; (+) strand; PAM type: YTN; PAM sequence: TTC
aaagtgaatagcttgcagtc

SEQ ID NO: 275711 - DNA, 20 bp, Artificial Sequence
  Description of Artificial Sequence: Synthetic oligonucleotide
  Target: ATXN1; (+) strand; PAM type: YTN; PAM sequence: CTT
gcagtcaacatcactacatt

SEQ ID NO: 275712 - DNA, 20 bp, Artificial Sequence
  Description of Artificial Sequence: Synthetic oligonucleotide
  Target: ATXN1; (+) strand; PAM type: YTN; PAM sequence: TTG
cagtcaacatcactacatta

SEQ ID NO: 275713 - DNA, 20 bp, Artificial Sequence
  Description of Artificial Sequence: Synthetic oligonucleotide
  Target: ATXN1; (+) strand; PAM type: YTN; PAM sequence: CTA
cattatatatacggttctaa

SEQ ID NO: 275714 - DNA, 20 bp, Artificial Sequence
  Description of Artificial Sequence: Synthetic oligonucleotide
  Target: ATXN1; (+) strand; PAM type: YTN; PAM sequence: TTA
tatatacggttctaaaaata

SEQ ID NO: 275715 - DNA, 20 bp, Artificial Sequence
  Description of Artificial Sequence: Synthetic oligonucleotide
  Target: ATXN1; (+) strand; PAM type: YTN; PAM sequence: TTC
taaaaatagtatttcttaaa

SEQ ID NO: 275716 - DNA, 20 bp, Artificial Sequence
  Description of Artificial Sequence: Synthetic oligonucleotide
  Target: ATXN1; (+) strand; PAM type: YTN; PAM sequence: CTA
aaaatagtatttcttaaaca

SEQ ID NO: 275717 - DNA, 20 bp, Artificial Sequence
  Description of Artificial Sequence: Synthetic oligonucleotide
  Target: ATXN1; (+) strand; PAM type: YTN; PAM sequence: TTT
cttaaacacctagaacagcc

SEQ ID NO: 275718 - DNA, 20 bp, Artificial Sequence
  Description of Artificial Sequence: Synthetic oligonucleotide
  Target: ATXN1; (+) strand; PAM type: YTN; PAM sequence: TTC
ttaaacacctagaacagcca

SEQ ID NO: 275719 - DNA, 20 bp, Artificial Sequence
  Description of Artificial Sequence: Synthetic oligonucleotide
  Target: ATXN1; (+) strand; PAM type: YTN; PAM sequence: CTT
aaacacctagaacagccaaa

SEQ ID NO: 275720 - DNA, 20 bp, Artificial Sequence
  Description of Artificial Sequence: Synthetic oligonucleotide
  Target: ATXN1; (+) strand; PAM type: YTN; PAM sequence: TTA
aacacctagaacagccaaag

SEQ ID NO: 275721 - DNA, 20 bp, Artificial Sequence
  Description of Artificial Sequence: Synthetic oligonucleotide
  Target: ATXN1; (+) strand; PAM type: YTN; PAM sequence: CTA
gaacagccaaaggttggcaa

SEQ ID NO: 275722 - DNA, 20 bp, Artificial Sequence
  Description of Artificial Sequence: Synthetic oligonucleotide
  Target: ATXN1; (+) strand; PAM type: YTN; PAM sequence: TTG
gcaaactttttctataaagg

SEQ ID NO: 275723 - DNA, 20 bp, Artificial Sequence
  Description of Artificial Sequence: Synthetic oligonucleotide
  Target: ATXN1; (+) strand; PAM type: YTN; PAM sequence: CTT
tttctataaaggaccaggga

SEQ ID NO: 275724 - DNA, 20 bp, Artificial Sequence
  Description of Artificial Sequence: Synthetic oligonucleotide
  Target: ATXN1; (+) strand; PAM type: YTN; PAM sequence: TTT
ttctataaaggaccagggag

SEQ ID NO: 275725 - DNA, 20 bp, Artificial Sequence
  Description of Artificial Sequence: Synthetic oligonucleotide
  Target: ATXN1; (+) strand; PAM type: YTN; PAM sequence: TTT
tctataaaggaccagggagc

SEQ ID NO: 275726 - DNA, 20 bp, Artificial Sequence
  Description of Artificial Sequence: Synthetic oligonucleotide
  Target: ATXN1; (+) strand; PAM type: YTN; PAM sequence: TTT
ctataaaggaccagggagca

SEQ ID NO: 275727 - DNA, 20 bp, Artificial Sequence
  Description of Artificial Sequence: Synthetic oligonucleotide
  Target: ATXN1; (+) strand; PAM type: YTN; PAM sequence: TTC
tataaaggaccagggagcaa

SEQ ID NO: 275728 - DNA, 20 bp, Artificial Sequence
  Description of Artificial Sequence: Synthetic oligonucleotide
  Target: ATXN1; (+) strand; PAM type: YTN; PAM sequence: CTA
taaaggaccagggagcaaat

SEQ ID NO: 275729 - DNA, 20 bp, Artificial Sequence
  Description of Artificial Sequence: Synthetic oligonucleotide
  Target: ATXN1; (+) strand; PAM type: YTN; PAM sequence: CTT
taggctgtgtgggccagaca

SEQ ID NO: 275730 - DNA, 20 bp, Artificial Sequence
  Description of Artificial Sequence: Synthetic oligonucleotide
  Target: ATXN1; (+) strand; PAM type: YTN; PAM sequence: TTT
aggctgtgtgggccagacat

SEQ ID NO: 275731 - DNA, 20 bp, Artificial Sequence
  Description of Artificial Sequence: Synthetic oligonucleotide
  Target: ATXN1; (+) strand; PAM type: YTN; PAM sequence: TTA
ggctgtgtgggccagacatc

SEQ ID NO: 275732 - DNA, 20 bp, Artificial Sequence
  Description of Artificial Sequence: Synthetic oligonucleotide
  Target: ATXN1; (+) strand; PAM type: YTN; PAM sequence: CTG
tgtgggccagacatctccat

SEQ ID NO: 275733 - DNA, 20 bp, Artificial Sequence
  Description of Artificial Sequence: Synthetic oligonucleotide
  Target: ATXN1; (+) strand; PAM type: YTN; PAM sequence: CTC
cattgcaactactcaatctg

SEQ ID NO: 275734 - DNA, 20 bp, Artificial Sequence
  Description of Artificial Sequence: Synthetic oligonucleotide
  Target: ATXN1; (+) strand; PAM type: YTN; PAM sequence: TTG
caactactcaatctgtcatt

SEQ ID NO: 275735 - DNA, 20 bp, Artificial Sequence
  Description of Artificial Sequence: Synthetic oligonucleotide
  Target: ATXN1; (+) strand; PAM type: YTN; PAM sequence: CTA
ctcaatctgtcattgtcgtg

SEQ ID NO: 275736 - DNA, 20 bp, Artificial Sequence
  Description of Artificial Sequence: Synthetic oligonucleotide
  Target: ATXN1; (+) strand; PAM type: YTN; PAM sequence: CTC
aatctgtcattgtcgtgcaa

SEQ ID NO: 275737 - DNA, 20 bp, Artificial Sequence
  Description of Artificial Sequence: Synthetic oligonucleotide
  Target: ATXN1; (+) strand; PAM type: YTN; PAM sequence: CTG
tcattgtcgtgcaaaagcag

SEQ ID NO: 275738 - DNA, 20 bp, Artificial Sequence
  Description of Artificial Sequence: Synthetic oligonucleotide
  Target: ATXN1; (+) strand; PAM type: YTN; PAM sequence: TTG
tcgtgcaaaagcagcaattg

SEQ ID NO: 275739 - DNA, 20 bp, Artificial Sequence
  Description of Artificial Sequence: Synthetic oligonucleotide
  Target: ATXN1; (+) strand; PAM type: YTN; PAM sequence: TTG
aagatactcatacaaacagg

SEQ ID NO: 275740 - DNA, 20 bp, Artificial Sequence
  Description of Artificial Sequence: Synthetic oligonucleotide
  Target: ATXN1; (+) strand; PAM type: YTN; PAM sequence: CTC
atacaaacaggcatgtcggt

SEQ ID NO: 275741 - DNA, 20 bp, Artificial Sequence
  Description of Artificial Sequence: Synthetic oligonucleotide
  Target: ATXN1; (+) strand; PAM type: YTN; PAM sequence: TTC
caataaaacttaatttacag

SEQ ID NO: 275742 - DNA, 20 bp, Artificial Sequence
  Description of Artificial Sequence: Synthetic oligonucleotide
  Target: ATXN1; (+) strand; PAM type: YTN; PAM sequence: CTT
aatttacagaaacaggctgg

SEQ ID NO: 275743 - DNA, 20 bp, Artificial Sequence
  Description of Artificial Sequence: Synthetic oligonucleotide
  Target: ATXN1; (+) strand; PAM type: YTN; PAM sequence: TTA
atttacagaaacaggctggg

SEQ ID NO: 275744 - DNA, 20 bp, Artificial Sequence
  Description of Artificial Sequence: Synthetic oligonucleotide
  Target: ATXN1; (+) strand; PAM type: YTN; PAM sequence: TTT
acagaaacaggctggggtga

SEQ ID NO: 275745 - DNA, 20 bp, Artificial Sequence
  Description of Artificial Sequence: Synthetic oligonucleotide
  Target: ATXN1; (+) strand; PAM type: YTN; PAM sequence: TTA
cagaaacaggctggggtgat

SEQ ID NO: 275746 - DNA, 20 bp, Artificial Sequence
  Description of Artificial Sequence: Synthetic oligonucleotide
  Target: ATXN1; (+) strand; PAM type: YTN; PAM sequence: CTG
gggtgatatttggcccatgg

SEQ ID NO: 275747 - DNA, 20 bp, Artificial Sequence
  Description of Artificial Sequence: Synthetic oligonucleotide
  Target: ATXN1; (+) strand; PAM type: YTN; PAM sequence: TTT
ggcccatggtccagtttgtc

SEQ ID NO: 275748 - DNA, 20 bp, Artificial Sequence
  Description of Artificial Sequence: Synthetic oligonucleotide
  Target: ATXN1; (+) strand; PAM type: YTN; PAM sequence: TTG
gcccatggtccagtttgtca

SEQ ID NO: 275749 - DNA, 20 bp, Artificial Sequence
  Description of Artificial Sequence: Synthetic oligonucleotide
  Target: ATXN1; (+) strand; PAM type: YTN; PAM sequence: TTT
gtcaatacctggtctagaat

SEQ ID NO: 275750 - DNA, 20 bp, Artificial Sequence
  Description of Artificial Sequence: Synthetic oligonucleotide
  Target: ATXN1; (+) strand; PAM type: YTN; PAM sequence: TTG
tcaatacctggtctagaata

SEQ ID NO: 275751 - DNA, 20 bp, Artificial Sequence
  Description of Artificial Sequence: Synthetic oligonucleotide
  Target: ATXN1; (+) strand; PAM type: YTN; PAM sequence: CTG
gtctagaatattattacact

SEQ ID NO: 275752 - DNA, 20 bp, Artificial Sequence
  Description of Artificial Sequence: Synthetic oligonucleotide
  Target: ATXN1; (+) strand; PAM type: YTN; PAM sequence: CTA
gaatattattacactgaaaa

SEQ ID NO: 275753 - DNA, 20 bp, Artificial Sequence
  Description of Artificial Sequence: Synthetic oligonucleotide
  Target: ATXN1; (+) strand; PAM type: YTN; PAM sequence: TTA
ttacactgaaaaattataag

SEQ ID NO: 275754 - DNA, 20 bp, Artificial Sequence
  Description of Artificial Sequence: Synthetic oligonucleotide
  Target: ATXN1; (+) strand; PAM type: YTN; PAM sequence: TTA
cactgaaaaattataagatg

SEQ ID NO: 275755 - DNA, 20 bp, Artificial Sequence
  Description of Artificial Sequence: Synthetic oligonucleotide
  Target: ATXN1; (+) strand; PAM type: YTN; PAM sequence: CTG
aaaaattataagatggactc

SEQ ID NO: 275756 - DNA, 20 bp, Artificial Sequence
  Description of Artificial Sequence: Synthetic oligonucleotide
  Target: ATXN1; (+) strand; PAM type: YTN; PAM sequence: TTA
taagatggactctcaacttc

SEQ ID NO: 275757 - DNA, 20 bp, Artificial Sequence
  Description of Artificial Sequence: Synthetic oligonucleotide
  Target: ATXN1; (+) strand; PAM type: YTN; PAM sequence: CTC
tcaacttccttcctttcctc

SEQ ID NO: 275758 - DNA, 20 bp, Artificial Sequence
  Description of Artificial Sequence: Synthetic oligonucleotide
  Target: ATXN1; (+) strand; PAM type: YTN; PAM sequence: CTC
aacttccttcctttcctcta

SEQ ID NO: 275759 - DNA, 20 bp, Artificial Sequence
  Description of Artificial Sequence: Synthetic oligonucleotide
  Target: ATXN1; (+) strand; PAM type: YTN; PAM sequence: CTT
ccttcctttcctctaaagag

SEQ ID NO: 275760 - DNA, 20 bp, Artificial Sequence
  Description of Artificial Sequence: Synthetic oligonucleotide
  Target: ATXN1; (+) strand; PAM type: YTN; PAM sequence: TTC
cttcctttcctctaaagaga

SEQ ID NO: 275761 - DNA, 20 bp, Artificial Sequence
  Description of Artificial Sequence: Synthetic oligonucleotide
  Target: ATXN1; (+) strand; PAM type: YTN; PAM sequence: CTT
cctttcctctaaagagatta

SEQ ID NO: 275762 - DNA, 20 bp, Artificial Sequence
  Description of Artificial Sequence: Synthetic oligonucleotide
  Target: ATXN1; (+) strand; PAM type: YTN; PAM sequence: TTC
ctttcctctaaagagattat

SEQ ID NO: 275763 - DNA, 20 bp, Artificial Sequence
  Description of Artificial Sequence: Synthetic oligonucleotide
  Target: ATXN1; (+) strand; PAM type: YTN; PAM sequence: CTT
tcctctaaagagattatttt

SEQ ID NO: 275764 - DNA, 20 bp, Artificial Sequence
  Description of Artificial Sequence: Synthetic oligonucleotide
  Target: ATXN1; (+) strand; PAM type: YTN; PAM sequence: TTT
cctctaaagagattattttt

SEQ ID NO: 275765 - DNA, 20 bp, Artificial Sequence
  Description of Artificial Sequence: Synthetic oligonucleotide
  Target: ATXN1; (+) strand; PAM type: YTN; PAM sequence: TTC
ctctaaagagattatttttc

SEQ ID NO: 275766 - DNA, 20 bp, Artificial Sequence
  Description of Artificial Sequence: Synthetic oligonucleotide
  Target: ATXN1; (+) strand; PAM type: YTN; PAM sequence: CTC
taaagagattatttttctta

SEQ ID NO: 275767 - DNA, 20 bp, Artificial Sequence
  Description of Artificial Sequence: Synthetic oligonucleotide
  Target: ATXN1; (+) strand; PAM type: YTN; PAM sequence: CTA
aagagattatttttcttagt

SEQ ID NO: 275768 - DNA, 20 bp, Artificial Sequence
  Description of Artificial Sequence: Synthetic oligonucleotide
  Target: ATXN1; (+) strand; PAM type: YTN; PAM sequence: TTA
tttttcttagtgaaaagtta

SEQ ID NO: 275769 - DNA, 20 bp, Artificial Sequence
  Description of Artificial Sequence: Synthetic oligonucleotide
  Target: ATXN1; (+) strand; PAM type: YTN; PAM sequence: TTT
ttcttagtgaaaagttagat

SEQ ID NO: 275770 - DNA, 20 bp, Artificial Sequence
  Description of Artificial Sequence: Synthetic oligonucleotide
  Target: ATXN1; (+) strand; PAM type: YTN; PAM sequence: TTT
tcttagtgaaaagttagatg

SEQ ID NO: 275771 - DNA, 20 bp, Artificial Sequence
  Description of Artificial Sequence: Synthetic oligonucleotide
  Target: ATXN1; (+) strand; PAM type: YTN; PAM sequence: TTT
cttagtgaaaagttagatga

SEQ ID NO: 275772 - DNA, 20 bp, Artificial Sequence
  Description of Artificial Sequence: Synthetic oligonucleotide
  Target: ATXN1; (+) strand; PAM type: YTN; PAM sequence: TTC
ttagtgaaaagttagatgac

SEQ ID NO: 275773 - DNA, 20 bp, Artificial Sequence
  Description of Artificial Sequence: Synthetic oligonucleotide
  Target: ATXN1; (+) strand; PAM type: YTN; PAM sequence: CTT
agtgaaaagttagatgacaa

SEQ ID NO: 275774 - DNA, 20 bp, Artificial Sequence
  Description of Artificial Sequence: Synthetic oligonucleotide
  Target: ATXN1; (+) strand; PAM type: YTN; PAM sequence: TTA
gtgaaaagttagatgacaat

SEQ ID NO: 275775 - DNA, 20 bp, Artificial Sequence
  Description of Artificial Sequence: Synthetic oligonucleotide
  Target: ATXN1; (+) strand; PAM type: YTN; PAM sequence: TTA
gatgacaatgtcacacagta

SEQ ID NO: 275776 - DNA, 20 bp, Artificial Sequence
  Description of Artificial Sequence: Synthetic oligonucleotide
  Target: ATXN1; (+) strand; PAM type: YTN; PAM sequence: TTC
tgcagcatccaccactgaac

SEQ ID NO: 275777 - DNA, 20 bp, Artificial Sequence
  Description of Artificial Sequence: Synthetic oligonucleotide
  Target: ATXN1; (+) strand; PAM type: YTN; PAM sequence: CTG
cagcatccaccactgaacct

SEQ ID NO: 275778 - DNA, 20 bp, Artificial Sequence
  Description of Artificial Sequence: Synthetic oligonucleotide
  Target: ATXN1; (+) strand; PAM type: YTN; PAM sequence: CTG
aacctcgtccatgataagca

SEQ ID NO: 275779 - DNA, 20 bp, Artificial Sequence
  Description of Artificial Sequence: Synthetic oligonucleotide
  Target: ATXN1; (+) strand; PAM type: YTN; PAM sequence: CTC
gtccatgataagcagatatg

SEQ ID NO: 275780 - DNA, 20 bp, Artificial Sequence
  Description of Artificial Sequence: Synthetic oligonucleotide
  Target: ATXN1; (+) strand; PAM type: YTN; PAM sequence: CTG
agaattccaggtgcagtttt

SEQ ID NO: 275781 - DNA, 20 bp, Artificial Sequence
  Description of Artificial Sequence: Synthetic oligonucleotide
  Target: ATXN1; (+) strand; PAM type: YTN; PAM sequence: TTC
caggtgcagttttccagtgg

SEQ ID NO: 275782 - DNA, 20 bp, Artificial Sequence
  Description of Artificial Sequence: Synthetic oligonucleotide
  Target: ATXN1; (+) strand; PAM type: YTN; PAM sequence: TTT
tccagtggtaagtctctaca

SEQ ID NO: 275783 - DNA, 20 bp, Artificial Sequence
  Description of Artificial Sequence: Synthetic oligonucleotide
  Target: ATXN1; (+) strand; PAM type: YTN; PAM sequence: TTT
ccagtggtaagtctctacat

SEQ ID NO: 275784 - DNA, 20 bp, Artificial Sequence
  Description of Artificial Sequence: Synthetic oligonucleotide
  Target: ATXN1; (+) strand; PAM type: YTN; PAM sequence: TTC
cagtggtaagtctctacata

SEQ ID NO: 275785 - DNA, 20 bp, Artificial Sequence
  Description of Artificial Sequence: Synthetic oligonucleotide
  Target: ATXN1; (+) strand; PAM type: YTN; PAM sequence: CTC
tacatattcatctctgcatt

SEQ ID NO: 275786 - DNA, 20 bp, Artificial Sequence
  Description of Artificial Sequence: Synthetic oligonucleotide
  Target: ATXN1; (+) strand; PAM type: YTN; PAM sequence: CTA
catattcatctctgcattac

SEQ ID NO: 275787 - DNA, 20 bp, Artificial Sequence
  Description of Artificial Sequence: Synthetic oligonucleotide
  Target: ATXN1; (+) strand; PAM type: YTN; PAM sequence: TTC
atctctgcattacatatgtg

SEQ ID NO: 275788 - DNA, 20 bp, Artificial Sequence
  Description of Artificial Sequence: Synthetic oligonucleotide
  Target: ATXN1; (+) strand; PAM type: YTN; PAM sequence: CTC
tgcattacatatgtgcaaag

SEQ ID NO: 275789 - DNA, 20 bp, Artificial Sequence
  Description of Artificial Sequence: Synthetic oligonucleotide
  Target: ATXN1; (+) strand; PAM type: YTN; PAM sequence: CTG
cattacatatgtgcaaaggg

SEQ ID NO: 275790 - DNA, 20 bp, Artificial Sequence
  Description of Artificial Sequence: Synthetic oligonucleotide
  Target: ATXN1; (+) strand; PAM type: YTN; PAM sequence: TTA
catatgtgcaaagggaacag

SEQ ID NO: 275791 - DNA, 20 bp, Artificial Sequence
  Description of Artificial Sequence: Synthetic oligonucleotide
  Target: ATXN1; (+) strand; PAM type: YTN; PAM sequence: CTG
ccccatggaaccccagataa

SEQ ID NO: 275792 - DNA, 20 bp, Artificial Sequence
  Description of Artificial Sequence: Synthetic oligonucleotide
  Target: ATXN1; (+) strand; PAM type: YTN; PAM sequence: CTA
aatagcctcttgaagtagtg

SEQ ID NO: 275793 - DNA, 20 bp, Artificial Sequence
  Description of Artificial Sequence: Synthetic oligonucleotide
  Target: ATXN1; (+) strand; PAM type: YTN; PAM sequence: CTC
ttgaagtagtgtactatcta

SEQ ID NO: 275794 - DNA, 20 bp, Artificial Sequence
  Description of Artificial Sequence: Synthetic oligonucleotide
  Target: ATXN1; (+) strand; PAM type: YTN; PAM sequence: CTT
gaagtagtgtactatctagg

SEQ ID NO: 275795 - DNA, 20 bp, Artificial Sequence
  Description of Artificial Sequence: Synthetic oligonucleotide
  Target: ATXN1; (+) strand; PAM type: YTN; PAM sequence: TTG
aagtagtgtactatctaggc

SEQ ID NO: 275796 - DNA, 20 bp, Artificial Sequence
  Description of Artificial Sequence: Synthetic oligonucleotide
  Target: ATXN1; (+) strand; PAM type: YTN; PAM sequence: CTA
tctaggcatgcaagaagact

SEQ ID NO: 275797 - DNA, 20 bp, Artificial Sequence
  Description of Artificial Sequence: Synthetic oligonucleotide
  Target: ATXN1; (+) strand; PAM type: YTN; PAM sequence: CTA
ggcatgcaagaagactcttg

SEQ ID NO: 275798 - DNA, 20 bp, Artificial Sequence
  Description of Artificial Sequence: Synthetic oligonucleotide
  Target: ATXN1; (+) strand; PAM type: YTN; PAM sequence: CTC
ttgagcaacaacaaaaaaca

SEQ ID NO: 275799 - DNA, 20 bp, Artificial Sequence
  Description of Artificial Sequence: Synthetic oligonucleotide
  Target: ATXN1; (+) strand; PAM type: YTN; PAM sequence: CTT
gagcaacaacaaaaaacaaa

SEQ ID NO: 275800 - DNA, 20 bp, Artificial Sequence
  Description of Artificial Sequence: Synthetic oligonucleotide
  Target: ATXN1; (+) strand; PAM type: YTN; PAM sequence: TTG
agcaacaacaaaaaacaaat

SEQ ID NO: 275801 - DNA, 20 bp, Artificial Sequence
  Description of Artificial Sequence: Synthetic oligonucleotide
  Target: ATXN1; (+) strand; PAM type: YTN; PAM sequence: CTT
gattaaaaaatgggcaaagg

SEQ ID NO: 275802 - DNA, 20 bp, Artificial Sequence
  Description of Artificial Sequence: Synthetic oligonucleotide
  Target: ATXN1; (+) strand; PAM type: YTN; PAM sequence: TTG
attaaaaaatgggcaaagga

SEQ ID NO: 275803 - DNA, 20 bp, Artificial Sequence
  Description of Artificial Sequence: Synthetic oligonucleotide
  Target: ATXN1; (+) strand; PAM type: YTN; PAM sequence: TTA
aaaaatgggcaaaggacttg

SEQ ID NO: 275804 - DNA, 20 bp, Artificial Sequence
  Description of Artificial Sequence: Synthetic oligonucleotide
  Target: ATXN1; (+) strand; PAM type: YTN; PAM sequence: CTT
gaattgacatttcttcaaag

SEQ ID NO: 275805 - DNA, 20 bp, Artificial Sequence
  Description of Artificial Sequence: Synthetic oligonucleotide
  Target: ATXN1; (+) strand; PAM type: YTN; PAM sequence: TTG
aattgacatttcttcaaaga

SEQ ID NO: 275806 - DNA, 20 bp, Artificial Sequence
  Description of Artificial Sequence: Synthetic oligonucleotide
  Target: ATXN1; (+) strand; PAM type: YTN; PAM sequence: TTG
acatttcttcaaagaaaata

SEQ ID NO: 275807 - DNA, 20 bp, Artificial Sequence
  Description of Artificial Sequence: Synthetic oligonucleotide
  Target: ATXN1; (+) strand; PAM type: YTN; PAM sequence: TTT
cttcaaagaaaatatgcaaa

SEQ ID NO: 275808 - DNA, 20 bp, Artificial Sequence
  Description of Artificial Sequence: Synthetic oligonucleotide
  Target: ATXN1; (+) strand; PAM type: YTN; PAM sequence: TTC
ttcaaagaaaatatgcaaat

SEQ ID NO: 275809 - DNA, 20 bp, Artificial Sequence
  Description of Artificial Sequence: Synthetic oligonucleotide
  Target: ATXN1; (+) strand; PAM type: YTN; PAM sequence: CTT
caaagaaaatatgcaaatga

SEQ ID NO: 275810 - DNA, 20 bp, Artificial Sequence
  Description of Artificial Sequence: Synthetic oligonucleotide
  Target: ATXN1; (+) strand; PAM type: YTN; PAM sequence: TTC
aaagaaaatatgcaaatgac

SEQ ID NO: 275811 - DNA, 20 bp, Artificial Sequence
  Description of Artificial Sequence: Synthetic oligonucleotide
  Target: ATXN1; (+) strand; PAM type: YTN; PAM sequence: TTA
agcacacgaaaagacactca

SEQ ID NO: 275812 - DNA, 20 bp, Artificial Sequence
  Description of Artificial Sequence: Synthetic oligonucleotide
  Target: ATXN1; (+) strand; PAM type: YTN; PAM sequence: CTC
aacatcactaatcattagga

SEQ ID NO: 275813 - DNA, 20 bp, Artificial Sequence
  Description of Artificial Sequence: Synthetic oligonucleotide
  Target: ATXN1; (+) strand; PAM type: YTN; PAM sequence: CTA
atcattaggaaaatgcaaat

SEQ ID NO: 275814 - DNA, 20 bp, Artificial Sequence
  Description of Artificial Sequence: Synthetic oligonucleotide
  Target: ATXN1; (+) strand; PAM type: YTN; PAM sequence: TTA
ggaaaatgcaaatcaaaacc

SEQ ID NO: 275815 - DNA, 20 bp, Artificial Sequence
  Description of Artificial Sequence: Synthetic oligonucleotide
  Target: ATXN1; (+) strand; PAM type: YTN; PAM sequence: TTT
cactcacattaagatggctc

SEQ ID NO: 275816 - DNA, 20 bp, Artificial Sequence
  Description of Artificial Sequence: Synthetic oligonucleotide
  Target: ATXN1; (+) strand; PAM type: YTN; PAM sequence: TTC
actcacattaagatggctct

SEQ ID NO: 275817 - DNA, 20 bp, Artificial Sequence
  Description of Artificial Sequence: Synthetic oligonucleotide
  Target: ATXN1; (+) strand; PAM type: YTN; PAM sequence: CTC
acattaagatggctctgatt

SEQ ID NO: 275818 - DNA, 20 bp, Artificial Sequence
  Description of Artificial Sequence: Synthetic oligonucleotide
  Target: ATXN1; (+) strand; PAM type: YTN; PAM sequence: TTA
agatggctctgattaacaac

SEQ ID NO: 275819 - DNA, 20 bp, Artificial Sequence
  Description of Artificial Sequence: Synthetic oligonucleotide
  Target: ATXN1; (+) strand; PAM type: YTN; PAM sequence: CTC
tgattaacaacaaaaaaaac

SEQ ID NO: 275820 - DNA, 20 bp, Artificial Sequence
  Description of Artificial Sequence: Synthetic oligonucleotide
  Target: ATXN1; (+) strand; PAM type: YTN; PAM sequence: CTG
attaacaacaaaaaaaacaa

SEQ ID NO: 275821 - DNA, 20 bp, Artificial Sequence
  Description of Artificial Sequence: Synthetic oligonucleotide
  Target: ATXN1; (+) strand; PAM type: YTN; PAM sequence: TTA
acaacaaaaaaaacaacccc

SEQ ID NO: 275822 - DNA, 20 bp, Artificial Sequence
  Description of Artificial Sequence: Synthetic oligonucleotide
  Target: ATXN1; (+) strand; PAM type: YTN; PAM sequence: TTG
gcaaggatgtggacaaattg

SEQ ID NO: 275823 - DNA, 20 bp, Artificial Sequence
  Description of Artificial Sequence: Synthetic oligonucleotide
  Target: ATXN1; (+) strand; PAM type: YTN; PAM sequence: TTG
gaactctgtgtacattactg

SEQ ID NO: 275824 - DNA, 20 bp, Artificial Sequence
  Description of Artificial Sequence: Synthetic oligonucleotide
  Target: ATXN1; (+) strand; PAM type: YTN; PAM sequence: CTC
tgtgtacattactgatagaa

SEQ ID NO: 275825 - DNA, 20 bp, Artificial Sequence
  Description of Artificial Sequence: Synthetic oligonucleotide
  Target: ATXN1; (+) strand; PAM type: YTN; PAM sequence: CTG
tgtacattactgatagaaat

SEQ ID NO: 275826 - DNA, 20 bp, Artificial Sequence
  Description of Artificial Sequence: Synthetic oligonucleotide
  Target: ATXN1; (+) strand; PAM type: YTN; PAM sequence: TTA
ctgatagaaatgcaaaatgg

SEQ ID NO: 275827 - DNA, 20 bp, Artificial Sequence
  Description of Artificial Sequence: Synthetic oligonucleotide
  Target: ATXN1; (+) strand; PAM type: YTN; PAM sequence: CTG
atagaaatgcaaaatggtac

SEQ ID NO: 275828 - DNA, 20 bp, Artificial Sequence
  Description of Artificial Sequence: Synthetic oligonucleotide
  Target: ATXN1; (+) strand; PAM type: YTN; PAM sequence: CTG
ctgtgaaaaataccatgatg

SEQ ID NO: 275829 - DNA, 20 bp, Artificial Sequence
  Description of Artificial Sequence: Synthetic oligonucleotide
  Target: ATXN1; (+) strand; PAM type: YTN; PAM sequence: CTG
tgaaaaataccatgatggtt

SEQ ID NO: 275830 - DNA, 20 bp, Artificial Sequence
  Description of Artificial Sequence: Synthetic oligonucleotide
  Target: ATXN1; (+) strand; PAM type: YTN; PAM sequence: TTC
ctcaaaaaatttaaaaaata

SEQ ID NO: 275831 - DNA, 20 bp, Artificial Sequence
  Description of Artificial Sequence: Synthetic oligonucleotide
  Target: ATXN1; (+) strand; PAM type: YTN; PAM sequence: CTC
aaaaaatttaaaaaatacta

SEQ ID NO: 275832 - DNA, 20 bp, Artificial Sequence
  Description of Artificial Sequence: Synthetic oligonucleotide
  Target: ATXN1; (+) strand; PAM type: YTN; PAM sequence: TTT
aaaaaatactacatgattca

SEQ ID NO: 275833 - DNA, 20 bp, Artificial Sequence
  Description of Artificial Sequence: Synthetic oligonucleotide
  Target: ATXN1; (+) strand; PAM type: YTN; PAM sequence: TTA
aaaaatactacatgattcac

SEQ ID NO: 275834 - DNA, 20 bp, Artificial Sequence
  Description of Artificial Sequence: Synthetic oligonucleotide
  Target: ATXN1; (+) strand; PAM type: YTN; PAM sequence: CTA
catgattcaccaattccact

SEQ ID NO: 275835 - DNA, 20 bp, Artificial Sequence
  Description of Artificial Sequence: Synthetic oligonucleotide
  Target: ATXN1; (+) strand; PAM type: YTN; PAM sequence: TTC
accaattccacttctaggta

SEQ ID NO: 275836 - DNA, 20 bp, Artificial Sequence
  Description of Artificial Sequence: Synthetic oligonucleotide
  Target: ATXN1; (+) strand; PAM type: YTN; PAM sequence: TTC
cacttctaggtatataccca

SEQ ID NO: 275837 - DNA, 20 bp, Artificial Sequence
  Description of Artificial Sequence: Synthetic oligonucleotide
  Target: ATXN1; (+) strand; PAM type: YTN; PAM sequence: CTT
ctaggtatatacccaaaaaa

SEQ ID NO: 275838 - DNA, 20 bp, Artificial Sequence
  Description of Artificial Sequence: Synthetic oligonucleotide
  Target: ATXN1; (+) strand; PAM type: YTN; PAM sequence: TTC
taggtatatacccaaaaaaa

SEQ ID NO: 275839 - DNA, 20 bp, Artificial Sequence
  Description of Artificial Sequence: Synthetic oligonucleotide
  Target: ATXN1; (+) strand; PAM type: YTN; PAM sequence: CTA
ggtatatacccaaaaaaact

SEQ ID NO: 275840 - DNA, 20 bp, Artificial Sequence
  Description of Artificial Sequence: Synthetic oligonucleotide
  Target: ATXN1; (+) strand; PAM type: YTN; PAM sequence: CTG
aaaggaggcacttgaacaga

SEQ ID NO: 275841 - DNA, 20 bp, Artificial Sequence
  Description of Artificial Sequence: Synthetic oligonucleotide
  Target: ATXN1; (+) strand; PAM type: YTN; PAM sequence: CTT
gaacagatatttgtatacca

SEQ ID NO: 275842 - DNA, 20 bp, Artificial Sequence
  Description of Artificial Sequence: Synthetic oligonucleotide
  Target: ATXN1; (+) strand; PAM type: YTN; PAM sequence: TTG
aacagatatttgtataccag

SEQ ID NO: 275843 - DNA, 20 bp, Artificial Sequence
  Description of Artificial Sequence: Synthetic oligonucleotide
  Target: ATXN1; (+) strand; PAM type: YTN; PAM sequence: TTT
gtataccagtgttcatagcc

SEQ ID NO: 275844 - DNA, 20 bp, Artificial Sequence
  Description of Artificial Sequence: Synthetic oligonucleotide
  Target: ATXN1; (+) strand; PAM type: YTN; PAM sequence: TTG
tataccagtgttcatagcca

SEQ ID NO: 275845 - DNA, 20 bp, Artificial Sequence
  Description of Artificial Sequence: Synthetic oligonucleotide
  Target: ATXN1; (+) strand; PAM type: YTN; PAM sequence: TTC
atagccacataattcacaat

SEQ ID NO: 275846 - DNA, 20 bp, Artificial Sequence
  Description of Artificial Sequence: Synthetic oligonucleotide
  Target: ATXN1; (+) strand; PAM type: YTN; PAM sequence: TTC
acaataacctaaagtggaag

SEQ ID NO: 275847 - DNA, 20 bp, Artificial Sequence
  Description of Artificial Sequence: Synthetic oligonucleotide
  Target: ATXN1; (+) strand; PAM type: YTN; PAM sequence: CTA
aagtggaagcaacctaagtg

SEQ ID NO: 275848 - DNA, 20 bp, Artificial Sequence
  Description of Artificial Sequence: Synthetic oligonucleotide
  Target: ATXN1; (+) strand; PAM type: YTN; PAM sequence: CTA
agtgtccatcaatggatgaa

SEQ ID NO: 275849 - DNA, 20 bp, Artificial Sequence
  Description of Artificial Sequence: Synthetic oligonucleotide
  Target: ATXN1; (+) strand; PAM type: YTN; PAM sequence: TTA
ttcagccctaaagaggaagg

SEQ ID NO: 275850 - DNA, 20 bp, Artificial Sequence
  Description of Artificial Sequence: Synthetic oligonucleotide
  Target: ATXN1; (+) strand; PAM type: YTN; PAM sequence: TTC
agccctaaagaggaaggaga

SEQ ID NO: 275851 - DNA, 20 bp, Artificial Sequence
  Description of Artificial Sequence: Synthetic oligonucleotide
  Target: ATXN1; (+) strand; PAM type: YTN; PAM sequence: CTA
aagaggaaggagattctgac

SEQ ID NO: 275852 - DNA, 20 bp, Artificial Sequence
  Description of Artificial Sequence: Synthetic oligonucleotide
  Target: ATXN1; (+) strand; PAM type: YTN; PAM sequence: TTC
tgacacatgctacaacatgg

SEQ ID NO: 275853 - DNA, 20 bp, Artificial Sequence
  Description of Artificial Sequence: Synthetic oligonucleotide
  Target: ATXN1; (+) strand; PAM type: YTN; PAM sequence: CTG
acacatgctacaacatggat

SEQ ID NO: 275854 - DNA, 20 bp, Artificial Sequence
  Description of Artificial Sequence: Synthetic oligonucleotide
  Target: ATXN1; (+) strand; PAM type: YTN; PAM sequence: CTA
caacatggatatgcagtttt

SEQ ID NO: 275855 - DNA, 20 bp, Artificial Sequence
  Description of Artificial Sequence: Synthetic oligonucleotide
  Target: ATXN1; (+) strand; PAM type: YTN; PAM sequence: TTT
tgctttgggaagatgaaaac

SEQ ID NO: 275856 - DNA, 20 bp, Artificial Sequence
  Description of Artificial Sequence: Synthetic oligonucleotide
  Target: ATXN1; (+) strand; PAM type: YTN; PAM sequence: TTT
gctttgggaagatgaaaacg

SEQ ID NO: 275857 - DNA, 20 bp, Artificial Sequence
  Description of Artificial Sequence: Synthetic oligonucleotide
  Target: ATXN1; (+) strand; PAM type: YTN; PAM sequence: TTG
ctttgggaagatgaaaacgt

SEQ ID NO: 275858 - DNA, 20 bp, Artificial Sequence
  Description of Artificial Sequence: Synthetic oligonucleotide
  Target: ATXN1; (+) strand; PAM type: YTN; PAM sequence: CTT
tgggaagatgaaaacgttct

SEQ ID NO: 275859 - DNA, 20 bp, Artificial Sequence
  Description of Artificial Sequence: Synthetic oligonucleotide
  Target: ATXN1; (+) strand; PAM type: YTN; PAM sequence: TTT
gggaagatgaaaacgttctg

SEQ ID NO: 275860 - DNA, 20 bp, Artificial Sequence
  Description of Artificial Sequence: Synthetic oligonucleotide
  Target: ATXN1; (+) strand; PAM type: YTN; PAM sequence: TTG
ggaagatgaaaacgttctga

SEQ ID NO: 275861 - DNA, 20 bp, Artificial Sequence
  Description of Artificial Sequence: Synthetic oligonucleotide
  Target: ATXN1; (+) strand; PAM type: YTN; PAM sequence: TTC
tgaagatggatcgtggtgat

SEQ ID NO: 275862 - DNA, 20 bp, Artificial Sequence
  Description of Artificial Sequence: Synthetic oligonucleotide
  Target: ATXN1; (+) strand; PAM type: YTN; PAM sequence: CTG
aagatggatcgtggtgatga

SEQ ID NO: 275863 - DNA, 20 bp, Artificial Sequence
  Description of Artificial Sequence: Synthetic oligonucleotide
  Target: ATXN1; (+) strand; PAM type: YTN; PAM sequence: CTG
caatataatgtgaatgtact

SEQ ID NO: 275864 - DNA, 20 bp, Artificial Sequence
  Description of Artificial Sequence: Synthetic oligonucleotide
  Target: ATXN1; (+) strand; PAM type: YTN; PAM sequence: CTT
aatgccactgaactgtacac

SEQ ID NO: 275865 - DNA, 20 bp, Artificial Sequence
  Description of Artificial Sequence: Synthetic oligonucleotide
  Target: ATXN1; (+) strand; PAM type: YTN; PAM sequence: TTA
atgccactgaactgtacact

SEQ ID NO: 275866 - DNA, 20 bp, Artificial Sequence
  Description of Artificial Sequence: Synthetic oligonucleotide
  Target: ATXN1; (+) strand; PAM type: YTN; PAM sequence: CTG
aactgtacacttaaaaatgg

SEQ ID NO: 275867 - DNA, 20 bp, Artificial Sequence
  Description of Artificial Sequence: Synthetic oligonucleotide
  Target: ATXN1; (+) strand; PAM type: YTN; PAM sequence: CTG
tacacttaaaaatgggaaaa

SEQ ID NO: 275868 - DNA, 20 bp, Artificial Sequence
  Description of Artificial Sequence: Synthetic oligonucleotide
  Target: ATXN1; (+) strand; PAM type: YTN; PAM sequence: CTT
aaaaatgggaaaaatgatga

SEQ ID NO: 275869 - DNA, 20 bp, Artificial Sequence
  Description of Artificial Sequence: Synthetic oligonucleotide
  Target: ATXN1; (+) strand; PAM type: YTN; PAM sequence: TTA
aaaatgggaaaaatgatgaa

SEQ ID NO: 275870 - DNA, 20 bp, Artificial Sequence
  Description of Artificial Sequence: Synthetic oligonucleotide
  Target: ATXN1; (+) strand; PAM type: YTN; PAM sequence: TTT
tatcacaataaaaagaagaa

SEQ ID NO: 275871 - DNA, 20 bp, Artificial Sequence
  Description of Artificial Sequence: Synthetic oligonucleotide
  Target: ATXN1; (+) strand; PAM type: YTN; PAM sequence: TTT
atcacaataaaaagaagaag

SEQ ID NO: 275872 - DNA, 20 bp, Artificial Sequence
  Description of Artificial Sequence: Synthetic oligonucleotide
  Target: ATXN1; (+) strand; PAM type: YTN; PAM sequence: TTA
tcacaataaaaagaagaaga

SEQ ID NO: 275873 - DNA, 20 bp, Artificial Sequence
  Description of Artificial Sequence: Synthetic oligonucleotide
  Target: ATXN1; (+) strand; PAM type: YTN; PAM sequence: CTG
tgatcacttgaccttataag

SEQ ID NO: 275874 - DNA, 20 bp, Artificial Sequence
  Description of Artificial Sequence: Synthetic oligonucleotide
  Target: ATXN1; (+) strand; PAM type: YTN; PAM sequence: CTT
gaccttataagggagctttt

SEQ ID NO: 275875 - DNA, 20 bp, Artificial Sequence
  Description of Artificial Sequence: Synthetic oligonucleotide
  Target: ATXN1; (+) strand; PAM type: YTN; PAM sequence: TTG
accttataagggagcttttc

SEQ ID NO: 275876 - DNA, 20 bp, Artificial Sequence
  Description of Artificial Sequence: Synthetic oligonucleotide
  Target: ATXN1; (+) strand; PAM type: YTN; PAM sequence: CTT
ataagggagcttttcaggtg

SEQ ID NO: 275877 - DNA, 20 bp, Artificial Sequence
  Description of Artificial Sequence: Synthetic oligonucleotide
  Target: ATXN1; (+) strand; PAM type: YTN; PAM sequence: TTA
taagggagcttttcaggtga

SEQ ID NO: 275878 - DNA, 20 bp, Artificial Sequence
  Description of Artificial Sequence: Synthetic oligonucleotide
  Target: ATXN1; (+) strand; PAM type: YTN; PAM sequence: CTT
ttcaggtgatctgtttggat

SEQ ID NO: 275879 - DNA, 20 bp, Artificial Sequence
  Description of Artificial Sequence: Synthetic oligonucleotide
  Target: ATXN1; (+) strand; PAM type: YTN; PAM sequence: TTT
tcaggtgatctgtttggatc

SEQ ID NO: 275880 - DNA, 20 bp, Artificial Sequence
  Description of Artificial Sequence: Synthetic oligonucleotide
  Target: ATXN1; (+) strand; PAM type: YTN; PAM sequence: TTT
caggtgatctgtttggatca

SEQ ID NO: 275881 - DNA, 20 bp, Artificial Sequence
  Description of Artificial Sequence: Synthetic oligonucleotide
  Target: ATXN1; (+) strand; PAM type: YTN; PAM sequence: TTC
aggtgatctgtttggatcaa

SEQ ID NO: 275882 - DNA, 20 bp, Artificial Sequence
  Description of Artificial Sequence: Synthetic oligonucleotide
  Target: ATXN1; (+) strand; PAM type: YTN; PAM sequence: CTG
tttggatcaagatatcccaa

SEQ ID NO: 275883 - DNA, 20 bp, Artificial Sequence
  Description of Artificial Sequence: Synthetic oligonucleotide
  Target: ATXN1; (+) strand; PAM type: YTN; PAM sequence: TTT
ggatcaagatatcccaagaa

SEQ ID NO: 275884 - DNA, 20 bp, Artificial Sequence
  Description of Artificial Sequence: Synthetic oligonucleotide
  Target: ATXN1; (+) strand; PAM type: YTN; PAM sequence: TTG
gatcaagatatcccaagaag

SEQ ID NO: 275885 - DNA, 20 bp, Artificial Sequence
  Description of Artificial Sequence: Synthetic oligonucleotide
  Target: ATXN1; (+) strand; PAM type: YTN; PAM sequence: TTT
caaatgagagttgaaacttg

SEQ ID NO: 275886 - DNA, 20 bp, Artificial Sequence
  Description of Artificial Sequence: Synthetic oligonucleotide
  Target: ATXN1; (+) strand; PAM type: YTN; PAM sequence: TTC
aaatgagagttgaaacttga

SEQ ID NO: 275887 - DNA, 20 bp, Artificial Sequence
  Description of Artificial Sequence: Synthetic oligonucleotide
  Target: ATXN1; (+) strand; PAM type: YTN; PAM sequence: TTG
aaacttgagagggttggttt

SEQ ID NO: 275888 - DNA, 20 bp, Artificial Sequence
  Description of Artificial Sequence: Synthetic oligonucleotide
  Target: ATXN1; (+) strand; PAM type: YTN; PAM sequence: CTT
gagagggttggtttatggga

SEQ ID NO: 275889 - DNA, 20 bp, Artificial Sequence
  Description of Artificial Sequence: Synthetic oligonucleotide
  Target: ATXN1; (+) strand; PAM type: YTN; PAM sequence: TTG
agagggttggtttatgggag

SEQ ID NO: 275890 - DNA, 20 bp, Artificial Sequence
  Description of Artificial Sequence: Synthetic oligonucleotide
  Target: ATXN1; (+) strand; PAM type: YTN; PAM sequence: TTG
gtttatgggaggcagctgat

SEQ ID NO: 275891 - DNA, 20 bp, Artificial Sequence
  Description of Artificial Sequence: Synthetic oligonucleotide
  Target: ATXN1; (+) strand; PAM type: YTN; PAM sequence: TTT
atgggaggcagctgatgaac

SEQ ID NO: 275892 - DNA, 20 bp, Artificial Sequence
  Description of Artificial Sequence: Synthetic oligonucleotide
  Target: ATXN1; (+) strand; PAM type: YTN; PAM sequence: TTA
tgggaggcagctgatgaact

SEQ ID NO: 275893 - DNA, 20 bp, Artificial Sequence
  Description of Artificial Sequence: Synthetic oligonucleotide
  Target: ATXN1; (+) strand; PAM type: YTN; PAM sequence: CTG
atgaactgtgacctcgtttg

SEQ ID NO: 275894 - DNA, 20 bp, Artificial Sequence
  Description of Artificial Sequence: Synthetic oligonucleotide
  Target: ATXN1; (+) strand; PAM type: YTN; PAM sequence: CTG
tgacctcgtttgagtgttcc

SEQ ID NO: 275895 - DNA, 20 bp, Artificial Sequence
  Description of Artificial Sequence: Synthetic oligonucleotide
  Target: ATXN1; (+) strand; PAM type: YTN; PAM sequence: CTC
gtttgagtgttccaggaaat

SEQ ID NO: 275896 - DNA, 20 bp, Artificial Sequence
  Description of Artificial Sequence: Synthetic oligonucleotide
  Target: ATXN1; (+) strand; PAM type: YTN; PAM sequence: TTT
gagtgttccaggaaatcggc

SEQ ID NO: 275897 - DNA, 20 bp, Artificial Sequence
  Description of Artificial Sequence: Synthetic oligonucleotide
  Target: ATXN1; (+) strand; PAM type: YTN; PAM sequence: TTG
agtgttccaggaaatcggct

SEQ ID NO: 275898 - DNA, 20 bp, Artificial Sequence
  Description of Artificial Sequence: Synthetic oligonucleotide
  Target: ATXN1; (+) strand; PAM type: YTN; PAM sequence: TTC
caggaaatcggcttccacat

SEQ ID NO: 275899 - DNA, 20 bp, Artificial Sequence
  Description of Artificial Sequence: Synthetic oligonucleotide
  Target: ATXN1; (+) strand; PAM type: YTN; PAM sequence: CTT
ccacatctaggaatcacttg

SEQ ID NO: 275900 - DNA, 20 bp, Artificial Sequence
  Description of Artificial Sequence: Synthetic oligonucleotide
  Target: ATXN1; (+) strand; PAM type: YTN; PAM sequence: TTC
cacatctaggaatcacttgg

SEQ ID NO: 275901 - DNA, 20 bp, Artificial Sequence
  Description of Artificial Sequence: Synthetic oligonucleotide
  Target: ATXN1; (+) strand; PAM type: YTN; PAM sequence: CTA
ggaatcacttggactaaaaa

SEQ ID NO: 275902 - DNA, 20 bp, Artificial Sequence
  Description of Artificial Sequence: Synthetic oligonucleotide
  Target: ATXN1; (+) strand; PAM type: YTN; PAM sequence: CTT
ggactaaaaaagaatgtgag

SEQ ID NO: 275903 - DNA, 20 bp, Artificial Sequence
  Description of Artificial Sequence: Synthetic oligonucleotide
  Target: ATXN1; (+) strand; PAM type: YTN; PAM sequence: TTG
gactaaaaaagaatgtgaga

SEQ ID NO: 275904 - DNA, 20 bp, Artificial Sequence
  Description of Artificial Sequence: Synthetic oligonucleotide
  Target: ATXN1; (+) strand; PAM type: YTN; PAM sequence: CTA
aaaaagaatgtgagagctcc

SEQ ID NO: 275905 - DNA, 20 bp, Artificial Sequence
  Description of Artificial Sequence: Synthetic oligonucleotide
  Target: ATXN1; (+) strand; PAM type: YTN; PAM sequence: CTC
ctttgattcagagtgagctc

SEQ ID NO: 275906 - DNA, 20 bp, Artificial Sequence
  Description of Artificial Sequence: Synthetic oligonucleotide
  Target: ATXN1; (+) strand; PAM type: YTN; PAM sequence: CTT
tgattcagagtgagctctca

SEQ ID NO: 275907 - DNA, 20 bp, Artificial Sequence
  Description of Artificial Sequence: Synthetic oligonucleotide
  Target: ATXN1; (+) strand; PAM type: YTN; PAM sequence: TTT
gattcagagtgagctctcac

SEQ ID NO: 275908 - DNA, 20 bp, Artificial Sequence
  Description of Artificial Sequence: Synthetic oligonucleotide
  Target: ATXN1; (+) strand; PAM type: YTN; PAM sequence: TTG
attcagagtgagctctcaca

SEQ ID NO: 275909 - DNA, 20 bp, Artificial Sequence
  Description of Artificial Sequence: Synthetic oligonucleotide
  Target: ATXN1; (+) strand; PAM type: YTN; PAM sequence: TTC
agagtgagctctcacatgag

SEQ ID NO: 275910 - DNA, 20 bp, Artificial Sequence
  Description of Artificial Sequence: Synthetic oligonucleotide
  Target: ATXN1; (+) strand; PAM type: YTN; PAM sequence: CTC
tcacatgagatttgtaatat

SEQ ID NO: 275911 - DNA, 20 bp, Artificial Sequence
  Description of Artificial Sequence: Synthetic oligonucleotide
  Target: ATXN1; (+) strand; PAM type: YTN; PAM sequence: CTC
acatgagatttgtaatatgg

SEQ ID NO: 275912 - DNA, 20 bp, Artificial Sequence
  Description of Artificial Sequence: Synthetic oligonucleotide
  Target: ATXN1; (+) strand; PAM type: YTN; PAM sequence: TTT
gtaatatggccagaatgctt

SEQ ID NO: 275913 - DNA, 20 bp, Artificial Sequence
  Description of Artificial Sequence: Synthetic oligonucleotide
  Target: ATXN1; (+) strand; PAM type: YTN; PAM sequence: TTG
taatatggccagaatgcttg

SEQ ID NO: 275914 - DNA, 20 bp, Artificial Sequence
  Description of Artificial Sequence: Synthetic oligonucleotide
  Target: ATXN1; (+) strand; PAM type: YTN; PAM sequence: CTT
gcaatatccttttctgagtt

SEQ ID NO: 275915 - DNA, 20 bp, Artificial Sequence
  Description of Artificial Sequence: Synthetic oligonucleotide
  Target: ATXN1; (+) strand; PAM type: YTN; PAM sequence: TTG
caatatccttttctgagttt

SEQ ID NO: 275916 - DNA, 20 bp, Artificial Sequence
  Description of Artificial Sequence: Synthetic oligonucleotide
  Target: ATXN1; (+) strand; PAM type: YTN; PAM sequence: CTT
ttctgagttttacaacctca

SEQ ID NO: 275917 - DNA, 20 bp, Artificial Sequence
  Description of Artificial Sequence: Synthetic oligonucleotide
  Target: ATXN1; (+) strand; PAM type: YTN; PAM sequence: TTT
tctgagttttacaacctcag

SEQ ID NO: 275918 - DNA, 20 bp, Artificial Sequence
  Description of Artificial Sequence: Synthetic oligonucleotide
  Target: ATXN1; (+) strand; PAM type: YTN; PAM sequence: TTT
ctgagttttacaacctcaga

SEQ ID NO: 275919 - DNA, 20 bp, Artificial Sequence
  Description of Artificial Sequence: Synthetic oligonucleotide
  Target: ATXN1; (+) strand; PAM type: YTN; PAM sequence: TTC
tgagttttacaacctcagag

SEQ ID NO: 275920 - DNA, 20 bp, Artificial Sequence
  Description of Artificial Sequence: Synthetic oligonucleotide
  Target: ATXN1; (+) strand; PAM type: YTN; PAM sequence: CTG
agttttacaacctcagagac

SEQ ID NO: 275921 - DNA, 20 bp, Artificial Sequence
  Description of Artificial Sequence: Synthetic oligonucleotide
  Target: ATXN1; (+) strand; PAM type: YTN; PAM sequence: TTT
tacaacctcagagacccaat

SEQ ID NO: 275922 - DNA, 20 bp, Artificial Sequence
  Description of Artificial Sequence: Synthetic oligonucleotide
  Target: ATXN1; (+) strand; PAM type: YTN; PAM sequence: TTT
acaacctcagagacccaatt

SEQ ID NO: 275923 - DNA, 20 bp, Artificial Sequence
  Description of Artificial Sequence: Synthetic oligonucleotide
  Target: ATXN1; (+) strand; PAM type: YTN; PAM sequence: TTA
caacctcagagacccaattt

SEQ ID NO: 275924 - DNA, 20 bp, Artificial Sequence
  Description of Artificial Sequence: Synthetic oligonucleotide
  Target: ATXN1; (+) strand; PAM type: YTN; PAM sequence: CTC
agagacccaatttggcagtg

SEQ ID NO: 275925 - DNA, 20 bp, Artificial Sequence
  Description of Artificial Sequence: Synthetic oligonucleotide
  Target: ATXN1; (+) strand; PAM type: YTN; PAM sequence: TTT
ggcagtggatcaggagtaaa

SEQ ID NO: 275926 - DNA, 20 bp, Artificial Sequence
  Description of Artificial Sequence: Synthetic oligonucleotide
  Target: ATXN1; (+) strand; PAM type: YTN; PAM sequence: TTG
gcagtggatcaggagtaaag

SEQ ID NO: 275927 - DNA, 20 bp, Artificial Sequence
  Description of Artificial Sequence: Synthetic oligonucleotide
  Target: ATXN1; (+) strand; PAM type: YTN; PAM sequence: CTA
ataggaacaaaagctaggaa

SEQ ID NO: 275928 - DNA, 20 bp, Artificial Sequence
  Description of Artificial Sequence: Synthetic oligonucleotide
  Target: ATXN1; (+) strand; PAM type: YTN; PAM sequence: CTA
ggaaaatttaccatacctga

SEQ ID NO: 275929 - DNA, 20 bp, Artificial Sequence
  Description of Artificial Sequence: Synthetic oligonucleotide
  Target: ATXN1; (+) strand; PAM type: YTN; PAM sequence: TTT
accatacctgatggagggac

SEQ ID NO: 275930 - DNA, 20 bp, Artificial Sequence
  Description of Artificial Sequence: Synthetic oligonucleotide
  Target: ATXN1; (+) strand; PAM type: YTN; PAM sequence: TTA
ccatacctgatggagggaca

SEQ ID NO: 275931 - DNA, 20 bp, Artificial Sequence
  Description of Artificial Sequence: Synthetic oligonucleotide
  Target: ATXN1; (+) strand; PAM type: YTN; PAM sequence: CTG
atggagggacataggaaagg

SEQ ID NO: 275932 - DNA, 20 bp, Artificial Sequence
  Description of Artificial Sequence: Synthetic oligonucleotide
  Target: ATXN1; (+) strand; PAM type: YTN; PAM sequence: CTG
taattaaggcaaagccaacc

SEQ ID NO: 275933 - DNA, 20 bp, Artificial Sequence
  Description of Artificial Sequence: Synthetic oligonucleotide
  Target: ATXN1; (+) strand; PAM type: YTN; PAM sequence: TTA
aggcaaagccaacctatctt

SEQ ID NO: 275934 - DNA, 20 bp, Artificial Sequence
  Description of Artificial Sequence: Synthetic oligonucleotide
  Target: ATXN1; (+) strand; PAM type: YTN; PAM sequence: CTA
tctttcaggatcacagtgaa

SEQ ID NO: 275935 - DNA, 20 bp, Artificial Sequence
  Description of Artificial Sequence: Synthetic oligonucleotide
  Target: ATXN1; (+) strand; PAM type: YTN; PAM sequence: CTT
tcaggatcacagtgaaaact

SEQ ID NO: 275936 - DNA, 20 bp, Artificial Sequence
  Description of Artificial Sequence: Synthetic oligonucleotide
  Target: ATXN1; (+) strand; PAM type: YTN; PAM sequence: TTT
caggatcacagtgaaaactc

SEQ ID NO: 275937 - DNA, 20 bp, Artificial Sequence
  Description of Artificial Sequence: Synthetic oligonucleotide
  Target: ATXN1; (+) strand; PAM type: YTN; PAM sequence: TTC
aggatcacagtgaaaactca

SEQ ID NO: 275938 - DNA, 20 bp, Artificial Sequence
  Description of Artificial Sequence: Synthetic oligonucleotide
  Target: ATXN1; (+) strand; PAM type: YTN; PAM sequence: CTC
acaatctccagttatgagta

SEQ ID NO: 275939 - DNA, 20 bp, Artificial Sequence
  Description of Artificial Sequence: Synthetic oligonucleotide
  Target: ATXN1; (+) strand; PAM type: YTN; PAM sequence: CTC
cagttatgagtaagagaagt

SEQ ID NO: 275940 - DNA, 20 bp, Artificial Sequence
  Description of Artificial Sequence: Synthetic oligonucleotide
  Target: ATXN1; (+) strand; PAM type: YTN; PAM sequence: TTA
tgagtaagagaagtcttctt

SEQ ID NO: 275941 - DNA, 20 bp, Artificial Sequence
  Description of Artificial Sequence: Synthetic oligonucleotide
  Target: ATXN1; (+) strand; PAM type: YTN; PAM sequence: CTT
cttctttccctaaccattct

SEQ ID NO: 275942 - DNA, 20 bp, Artificial Sequence
  Description of Artificial Sequence: Synthetic oligonucleotide
  Target: ATXN1; (+) strand; PAM type: YTN; PAM sequence: TTC
ttctttccctaaccattctc

SEQ ID NO: 275943 - DNA, 20 bp, Artificial Sequence
  Description of Artificial Sequence: Synthetic oligonucleotide
  Target: ATXN1; (+) strand; PAM type: YTN; PAM sequence: CTT
ctttccctaaccattctcct

SEQ ID NO: 275944 - DNA, 20 bp, Artificial Sequence
  Description of Artificial Sequence: Synthetic oligonucleotide
  Target: ATXN1; (+) strand; PAM type: YTN; PAM sequence: TTC
tttccctaaccattctcctt

SEQ ID NO: 275945 - DNA, 20 bp, Artificial Sequence
  Description of Artificial Sequence: Synthetic oligonucleotide
  Target: ATXN1; (+) strand; PAM type: YTN; PAM sequence: CTT
tccctaaccattctccttcg

SEQ ID NO: 275946 - DNA, 20 bp, Artificial Sequence
  Description of Artificial Sequence: Synthetic oligonucleotide
  Target: ATXN1; (+) strand; PAM type: YTN; PAM sequence: TTT
ccctaaccattctccttcgt

SEQ ID NO: 275947 - DNA, 20 bp, Artificial Sequence
  Description of Artificial Sequence: Synthetic oligonucleotide
  Target: ATXN1; (+) strand; PAM type: YTN; PAM sequence: TTC
cctaaccattctccttcgtc

SEQ ID NO: 275948 - DNA, 20 bp, Artificial Sequence
  Description of Artificial Sequence: Synthetic oligonucleotide
  Target: ATXN1; (+) strand; PAM type: YTN; PAM sequence: CTA
accattctccttcgtcacgc

SEQ ID NO: 275949 - DNA, 20 bp, Artificial Sequence
  Description of Artificial Sequence: Synthetic oligonucleotide
  Target: ATXN1; (+) strand; PAM type: YTN; PAM sequence: TTC
tccttcgtcacgcatataac

SEQ ID NO: 275950 - DNA, 20 bp, Artificial Sequence
  Description of Artificial Sequence: Synthetic oligonucleotide
  Target: ATXN1; (+) strand; PAM type: YTN; PAM sequence: CTC
cttcgtcacgcatataactg

SEQ ID NO: 275951 - DNA, 20 bp, Artificial Sequence
  Description of Artificial Sequence: Synthetic oligonucleotide
  Target: ATXN1; (+) strand; PAM type: YTN; PAM sequence: CTT
cgtcacgcatataactgctt

SEQ ID NO: 275952 - DNA, 20 bp, Artificial Sequence
  Description of Artificial Sequence: Synthetic oligonucleotide
  Target: ATXN1; (+) strand; PAM type: YTN; PAM sequence: TTC
gtcacgcatataactgcttt

SEQ ID NO: 275953 - DNA, 20 bp, Artificial Sequence
  Description of Artificial Sequence: Synthetic oligonucleotide
  Target: ATXN1; (+) strand; PAM type: YTN; PAM sequence: CTG
cttttaggtgactcgtttga

SEQ ID NO: 275954 - DNA, 20 bp, Artificial Sequence
  Description of Artificial Sequence: Synthetic oligonucleotide
  Target: ATXN1; (+) strand; PAM type: YTN; PAM sequence: CTT
ttaggtgactcgtttgaaat

SEQ ID NO: 275955 - DNA, 20 bp, Artificial Sequence
  Description of Artificial Sequence: Synthetic oligonucleotide
  Target: ATXN1; (+) strand; PAM type: YTN; PAM sequence: TTT
taggtgactcgtttgaaatg

SEQ ID NO: 275956 - DNA, 20 bp, Artificial Sequence
  Description of Artificial Sequence: Synthetic oligonucleotide
  Target: ATXN1; (+) strand; PAM type: YTN; PAM sequence: TTT
aggtgactcgtttgaaatgt

SEQ ID NO: 275957 - DNA, 20 bp, Artificial Sequence
  Description of Artificial Sequence: Synthetic oligonucleotide
  Target: ATXN1; (+) strand; PAM type: YTN; PAM sequence: TTA
ggtgactcgtttgaaatgta

SEQ ID NO: 275958 - DNA, 20 bp, Artificial Sequence
  Description of Artificial Sequence: Synthetic oligonucleotide
  Target: ATXN1; (+) strand; PAM type: YTN; PAM sequence: CTC
gtttgaaatgtaagctgctc

SEQ ID NO: 275959 - DNA, 20 bp, Artificial Sequence
  Description of Artificial Sequence: Synthetic oligonucleotide
  Target: ATXN1; (+) strand; PAM type: YTN; PAM sequence: TTT
gaaatgtaagctgctctgag

SEQ ID NO: 275960 - DNA, 20 bp, Artificial Sequence
  Description of Artificial Sequence: Synthetic oligonucleotide
  Target: ATXN1; (+) strand; PAM type: YTN; PAM sequence: TTG
aaatgtaagctgctctgagt

SEQ ID NO: 275961 - DNA, 20 bp, Artificial Sequence
  Description of Artificial Sequence: Synthetic oligonucleotide
  Target: ATXN1; (+) strand; PAM type: YTN; PAM sequence: CTG
ctctgagtctaattcggcat

SEQ ID NO: 275962 - DNA, 20 bp, Artificial Sequence
  Description of Artificial Sequence: Synthetic oligonucleotide
  Target: ATXN1; (+) strand; PAM type: YTN; PAM sequence: CTC
tgagtctaattcggcataac

SEQ ID NO: 275963 - DNA, 20 bp, Artificial Sequence
  Description of Artificial Sequence: Synthetic oligonucleotide
  Target: ATXN1; (+) strand; PAM type: YTN; PAM sequence: CTG
agtctaattcggcataacac

SEQ ID NO: 275964 - DNA, 20 bp, Artificial Sequence
  Description of Artificial Sequence: Synthetic oligonucleotide
  Target: ATXN1; (+) strand; PAM type: YTN; PAM sequence: CTA
attcggcataacacttaaca

SEQ ID NO: 275965 - DNA, 20 bp, Artificial Sequence
  Description of Artificial Sequence: Synthetic oligonucleotide
  Target: ATXN1; (+) strand; PAM type: YTN; PAM sequence: TTC
ggcataacacttaacaccat

SEQ ID NO: 275966 - DNA, 20 bp, Artificial Sequence
  Description of Artificial Sequence: Synthetic oligonucleotide
  Target: ATXN1; (+) strand; PAM type: YTN; PAM sequence: CTT
aacaccatataccatgcaca

SEQ ID NO: 275967 - DNA, 20 bp, Artificial Sequence
  Description of Artificial Sequence: Synthetic oligonucleotide
  Target: ATXN1; (+) strand; PAM type: YTN; PAM sequence: TTA
acaccatataccatgcacaa

SEQ ID NO: 275968 - DNA, 20 bp, Artificial Sequence
  Description of Artificial Sequence: Synthetic oligonucleotide
  Target: ATXN1; (+) strand; PAM type: YTN; PAM sequence: CTT
catggaaactgtccctattt

SEQ ID NO: 275969 - DNA, 20 bp, Artificial Sequence
  Description of Artificial Sequence: Synthetic oligonucleotide
  Target: ATXN1; (+) strand; PAM type: YTN; PAM sequence: TTC
atggaaactgtccctatttg

SEQ ID NO: 275970 - DNA, 20 bp, Artificial Sequence
  Description of Artificial Sequence: Synthetic oligonucleotide
  Target: ATXN1; (+) strand; PAM type: YTN; PAM sequence: CTG
tccctatttgcatagcacta

SEQ ID NO: 275971 - DNA, 20 bp, Artificial Sequence
  Description of Artificial Sequence: Synthetic oligonucleotide
  Target: ATXN1; (+) strand; PAM type: YTN; PAM sequence: CTA
tttgcatagcactattccct

SEQ ID NO: 275972 - DNA, 20 bp, Artificial Sequence
  Description of Artificial Sequence: Synthetic oligonucleotide
  Target: ATXN1; (+) strand; PAM type: YTN; PAM sequence: TTT
gcatagcactattccctgga

SEQ ID NO: 275973 - DNA, 20 bp, Artificial Sequence
  Description of Artificial Sequence: Synthetic oligonucleotide
  Target: ATXN1; (+) strand; PAM type: YTN; PAM sequence: TTG
catagcactattccctggat

SEQ ID NO: 275974 - DNA, 20 bp, Artificial Sequence
  Description of Artificial Sequence: Synthetic oligonucleotide
  Target: ATXN1; (+) strand; PAM type: YTN; PAM sequence: CTA
ttccctggattactcaggta

SEQ ID NO: 275975 - DNA, 20 bp, Artificial Sequence
  Description of Artificial Sequence: Synthetic oligonucleotide
  Target: ATXN1; (+) strand; PAM type: YTN; PAM sequence: TTC
cctggattactcaggtatca

SEQ ID NO: 275976 - DNA, 20 bp, Artificial Sequence
  Description of Artificial Sequence: Synthetic oligonucleotide
  Target: ATXN1; (+) strand; PAM type: YTN; PAM sequence: CTG
gattactcaggtatcatcct

SEQ ID NO: 275977 - DNA, 20 bp, Artificial Sequence
  Description of Artificial Sequence: Synthetic oligonucleotide
  Target: ATXN1; (+) strand; PAM type: YTN; PAM sequence: TTA
ctcaggtatcatccttgcaa

SEQ ID NO: 275978 - DNA, 20 bp, Artificial Sequence
  Description of Artificial Sequence: Synthetic oligonucleotide
  Target: ATXN1; (+) strand; PAM type: YTN; PAM sequence: CTC
aggtatcatccttgcaaaag

SEQ ID NO: 275979 - DNA, 20 bp, Artificial Sequence
  Description of Artificial Sequence: Synthetic oligonucleotide
  Target: ATXN1; (+) strand; PAM type: YTN; PAM sequence: CTT
gcaaaagtcaaactgataca

SEQ ID NO: 275980 - DNA, 20 bp, Artificial Sequence
  Description of Artificial Sequence: Synthetic oligonucleotide
  Target: ATXN1; (+) strand; PAM type: YTN; PAM sequence: TTG
caaaagtcaaactgatacag

SEQ ID NO: 275981 - DNA, 20 bp, Artificial Sequence
  Description of Artificial Sequence: Synthetic oligonucleotide
  Target: ATXN1; (+) strand; PAM type: YTN; PAM sequence: CTG
atacagggttgcattgccta

SEQ ID NO: 275982 - DNA, 20 bp, Artificial Sequence
  Description of Artificial Sequence: Synthetic oligonucleotide
  Target: ATXN1; (+) strand; PAM type: YTN; PAM sequence: TTG
cattgcctactacaagcaga

SEQ ID NO: 275983 - DNA, 20 bp, Artificial Sequence
  Description of Artificial Sequence: Synthetic oligonucleotide
  Target: ATXN1; (+) strand; PAM type: YTN; PAM sequence: TTG
cctactacaagcagaataac

SEQ ID NO: 275984 - DNA, 20 bp, Artificial Sequence
  Description of Artificial Sequence: Synthetic oligonucleotide
  Target: ATXN1; (+) strand; PAM type: YTN; PAM sequence: CTA
ctacaagcagaataacgttg

SEQ ID NO: 275985 - DNA, 20 bp, Artificial Sequence
  Description of Artificial Sequence: Synthetic oligonucleotide
  Target: ATXN1; (+) strand; PAM type: YTN; PAM sequence: CTA
caagcagaataacgttgagt

SEQ ID NO: 275986 - DNA, 20 bp, Artificial Sequence
  Description of Artificial Sequence: Synthetic oligonucleotide
  Target: ATXN1; (+) strand; PAM type: YTN; PAM sequence: TTG
agtcatggtttctcagctga

SEQ ID NO: 275987 - DNA, 20 bp, Artificial Sequence
  Description of Artificial Sequence: Synthetic oligonucleotide
  Target: ATXN1; (+) strand; PAM type: YTN; PAM sequence: TTT
ctcagctgaaagaaaatgat

SEQ ID NO: 275988 - DNA, 20 bp, Artificial Sequence
  Description of Artificial Sequence: Synthetic oligonucleotide
  Target: ATXN1; (+) strand; PAM type: YTN; PAM sequence: TTC
tcagctgaaagaaaatgata

SEQ ID NO: 275989 - DNA, 20 bp, Artificial Sequence
  Description of Artificial Sequence: Synthetic oligonucleotide
  Target: ATXN1; (+) strand; PAM type: YTN; PAM sequence: CTC
agctgaaagaaaatgatatc

SEQ ID NO: 275990 - DNA, 20 bp, Artificial Sequence
  Description of Artificial Sequence: Synthetic oligonucleotide
  Target: ATXN1; (+) strand; PAM type: YTN; PAM sequence: CTG
aaagaaaatgatatcgtttt

SEQ ID NO: 275991 - DNA, 20 bp, Artificial Sequence
  Description of Artificial Sequence: Synthetic oligonucleotide
  Target: ATXN1; (+) strand; PAM type: YTN; PAM sequence: TTT
tttcctatattcttggtaag

SEQ ID NO: 275992 - DNA, 20 bp, Artificial Sequence
  Description of Artificial Sequence: Synthetic oligonucleotide
  Target: ATXN1; (+) strand; PAM type: YTN; PAM sequence: TTT
ttcctatattcttggtaaga

SEQ ID NO: 275993 - DNA, 20 bp, Artificial Sequence
  Description of Artificial Sequence: Synthetic oligonucleotide
  Target: ATXN1; (+) strand; PAM type: YTN; PAM sequence: TTT
tcctatattcttggtaagaa

SEQ ID NO: 275994 - DNA, 20 bp, Artificial Sequence
  Description of Artificial Sequence: Synthetic oligonucleotide
  Target: ATXN1; (+) strand; PAM type: YTN; PAM sequence: TTT
cctatattcttggtaagaat

SEQ ID NO: 275995 - DNA, 20 bp, Artificial Sequence
  Description of Artificial Sequence: Synthetic oligonucleotide
  Target: ATXN1; (+) strand; PAM type: YTN; PAM sequence: TTC
ctatattcttggtaagaatc

SEQ ID NO: 275996 - DNA, 20 bp, Artificial Sequence
  Description of Artificial Sequence: Synthetic oligonucleotide
  Target: ATXN1; (+) strand; PAM type: YTN; PAM sequence: CTA
tattcttggtaagaatcaga

SEQ ID NO: 275997 - DNA, 20 bp, Artificial Sequence
  Description of Artificial Sequence: Synthetic oligonucleotide
  Target: ATXN1; (+) strand; PAM type: YTN; PAM sequence: TTC
ttggtaagaatcagaagata

SEQ ID NO: 275998 - DNA, 20 bp, Artificial Sequence
  Description of Artificial Sequence: Synthetic oligonucleotide
  Target: ATXN1; (+) strand; PAM type: YTN; PAM sequence: CTT
ggtaagaatcagaagatacc

SEQ ID NO: 275999 - DNA, 20 bp, Artificial Sequence
  Description of Artificial Sequence: Synthetic oligonucleotide
  Target: ATXN1; (+) strand; PAM type: YTN; PAM sequence: TTG
gtaagaatcagaagatacct

SEQ ID NO: 276000 - DNA, 20 bp, Artificial Sequence
  Description of Artificial Sequence: Synthetic oligonucleotide
  Target: ATXN1; (+) strand; PAM type: YTN; PAM sequence: CTC
caagccagcccaaccataaa

SEQ ID NO: 276001 - DNA, 20 bp, Artificial Sequence
  Description of Artificial Sequence: Synthetic oligonucleotide
  Target: ATXN1; (+) strand; PAM type: YTN; PAM sequence: CTA
tgaccacatatatatgacac

SEQ ID NO: 276002 - DNA, 20 bp, Artificial Sequence
  Description of Artificial Sequence: Synthetic oligonucleotide
  Target: ATXN1; (+) strand; PAM type: YTN; PAM sequence: CTG
atgactaccttcaggtgaca

SEQ ID NO: 276003 - DNA, 20 bp, Artificial Sequence
  Description of Artificial Sequence: Synthetic oligonucleotide
  Target: ATXN1; (+) strand; PAM type: YTN; PAM sequence: CTA
ccttcaggtgacaacaggtt

SEQ ID NO: 276004 - DNA, 20 bp, Artificial Sequence
  Description of Artificial Sequence: Synthetic oligonucleotide
  Target: ATXN1; (+) strand; PAM type: YTN; PAM sequence: CTT
caggtgacaacaggtttccc

SEQ ID NO: 276005 - DNA, 20 bp, Artificial Sequence
  Description of Artificial Sequence: Synthetic oligonucleotide
  Target: ATXN1; (+) strand; PAM type: YTN; PAM sequence: TTC
aggtgacaacaggtttcccc

SEQ ID NO: 276006 - DNA, 20 bp, Artificial Sequence
  Description of Artificial Sequence: Synthetic oligonucleotide
  Target: ATXN1; (+) strand; PAM type: YTN; PAM sequence: TTT
ccccatgctgccaaaataaa

SEQ ID NO: 276007 - DNA, 20 bp, Artificial Sequence
  Description of Artificial Sequence: Synthetic oligonucleotide
  Target: ATXN1; (+) strand; PAM type: YTN; PAM sequence: TTC
cccatgctgccaaaataaag

SEQ ID NO: 276008 - DNA, 20 bp, Artificial Sequence
  Description of Artificial Sequence: Synthetic oligonucleotide
  Target: ATXN1; (+) strand; PAM type: YTN; PAM sequence: CTG
ccaaaataaagtagaaggct

SEQ ID NO: 276009 - DNA, 20 bp, Artificial Sequence
  Description of Artificial Sequence: Synthetic oligonucleotide
  Target: ATXN1; (+) strand; PAM type: YTN; PAM sequence: CTG
ggtaatggtttagtacattt

SEQ ID NO: 276010 - DNA, 20 bp, Artificial Sequence
  Description of Artificial Sequence: Synthetic oligonucleotide
  Target: ATXN1; (+) strand; PAM type: YTN; PAM sequence: TTT
agtacatttgaatcatgcac

SEQ ID NO: 276011 - DNA, 20 bp, Artificial Sequence
  Description of Artificial Sequence: Synthetic oligonucleotide
  Target: ATXN1; (+) strand; PAM type: YTN; PAM sequence: TTA
gtacatttgaatcatgcact

SEQ ID NO: 276012 - DNA, 20 bp, Artificial Sequence
  Description of Artificial Sequence: Synthetic oligonucleotide
  Target: ATXN1; (+) strand; PAM type: YTN; PAM sequence: TTT
gaatcatgcacttttccaac

SEQ ID NO: 276013 - DNA, 20 bp, Artificial Sequence
  Description of Artificial Sequence: Synthetic oligonucleotide
  Target: ATXN1; (+) strand; PAM type: YTN; PAM sequence: TTG
aatcatgcacttttccaact

SEQ ID NO: 276014 - DNA, 20 bp, Artificial Sequence
  Description of Artificial Sequence: Synthetic oligonucleotide
  Target: ATXN1; (+) strand; PAM type: YTN; PAM sequence: CTT
ttccaactcagttattgaga

SEQ ID NO: 276015 - DNA, 20 bp, Artificial Sequence
  Description of Artificial Sequence: Synthetic oligonucleotide
  Target: ATXN1; (+) strand; PAM type: YTN; PAM sequence: TTT
tccaactcagttattgagaa

SEQ ID NO: 276016 - DNA, 20 bp, Artificial Sequence
  Description of Artificial Sequence: Synthetic oligonucleotide
  Target: ATXN1; (+) strand; PAM type: YTN; PAM sequence: TTT
ccaactcagttattgagaat

SEQ ID NO: 276017 - DNA, 20 bp, Artificial Sequence
  Description of Artificial Sequence: Synthetic oligonucleotide
  Target: ATXN1; (+) strand; PAM type: YTN; PAM sequence: TTC
caactcagttattgagaatg

SEQ ID NO: 276018 - DNA, 20 bp, Artificial Sequence
  Description of Artificial Sequence: Synthetic oligonucleotide
  Target: ATXN1; (+) strand; PAM type: YTN; PAM sequence: CTC
agttattgagaatggccatt

SEQ ID NO: 276019 - DNA, 20 bp, Artificial Sequence
  Description of Artificial Sequence: Synthetic oligonucleotide
  Target: ATXN1; (+) strand; PAM type: YTN; PAM sequence: TTA
ttgagaatggccattagagg

SEQ ID NO: 276020 - DNA, 20 bp, Artificial Sequence
  Description of Artificial Sequence: Synthetic oligonucleotide
  Target: ATXN1; (+) strand; PAM type: YTN; PAM sequence: TTG
agaatggccattagagggtc

SEQ ID NO: 276021 - DNA, 20 bp, Artificial Sequence
  Description of Artificial Sequence: Synthetic oligonucleotide
  Target: ATXN1; (+) strand; PAM type: YTN; PAM sequence: TTA
gagggtcccaaataacccag

SEQ ID NO: 276022 - DNA, 20 bp, Artificial Sequence
  Description of Artificial Sequence: Synthetic oligonucleotide
  Target: ATXN1; (+) strand; PAM type: YTN; PAM sequence: TTA
accaaaaaattttctgaccg

SEQ ID NO: 276023 - DNA, 20 bp, Artificial Sequence
  Description of Artificial Sequence: Synthetic oligonucleotide
  Target: ATXN1; (+) strand; PAM type: YTN; PAM sequence: TTT
tctgaccgttaagagtttta

SEQ ID NO: 276024 - DNA, 20 bp, Artificial Sequence
  Description of Artificial Sequence: Synthetic oligonucleotide
  Target: ATXN1; (+) strand; PAM type: YTN; PAM sequence: TTT
ctgaccgttaagagttttaa

SEQ ID NO: 276025 - DNA, 20 bp, Artificial Sequence
  Description of Artificial Sequence: Synthetic oligonucleotide
  Target: ATXN1; (+) strand; PAM type: YTN; PAM sequence: TTC
tgaccgttaagagttttaac

SEQ ID NO: 276026 - DNA, 20 bp, Artificial Sequence
  Description of Artificial Sequence: Synthetic oligonucleotide
  Target: ATXN1; (+) strand; PAM type: YTN; PAM sequence: CTG
accgttaagagttttaacca

SEQ ID NO: 276027 - DNA, 20 bp, Artificial Sequence
  Description of Artificial Sequence: Synthetic oligonucleotide
  Target: ATXN1; (+) strand; PAM type: YTN; PAM sequence: TTA
agagttttaaccaatatgca

SEQ ID NO: 276028 - DNA, 20 bp, Artificial Sequence
  Description of Artificial Sequence: Synthetic oligonucleotide
  Target: ATXN1; (+) strand; PAM type: YTN; PAM sequence: TTT
taaccaatatgcagtaaaat

SEQ ID NO: 276029 - DNA, 20 bp, Artificial Sequence
  Description of Artificial Sequence: Synthetic oligonucleotide
  Target: ATXN1; (+) strand; PAM type: YTN; PAM sequence: TTT
aaccaatatgcagtaaaatg

SEQ ID NO: 276030 - DNA, 20 bp, Artificial Sequence
  Description of Artificial Sequence: Synthetic oligonucleotide
  Target: ATXN1; (+) strand; PAM type: YTN; PAM sequence: TTA
accaatatgcagtaaaatgc

SEQ ID NO: 276031 - DNA, 20 bp, Artificial Sequence
  Description of Artificial Sequence: Synthetic oligonucleotide
  Target: ATXN1; (+) strand; PAM type: YTN; PAM sequence: TTT
tcaatcaggggcacacatct

SEQ ID NO: 276032 - DNA, 20 bp, Artificial Sequence
  Description of Artificial Sequence: Synthetic oligonucleotide
  Target: ATXN1; (+) strand; PAM type: YTN; PAM sequence: TTT
caatcaggggcacacatctc

SEQ ID NO: 276033 - DNA, 20 bp, Artificial Sequence
  Description of Artificial Sequence: Synthetic oligonucleotide
  Target: ATXN1; (+) strand; PAM type: YTN; PAM sequence: TTC
aatcaggggcacacatctct

SEQ ID NO: 276034 - DNA, 20 bp, Artificial Sequence
  Description of Artificial Sequence: Synthetic oligonucleotide
  Target: ATXN1; (+) strand; PAM type: YTN; PAM sequence: CTC
tactgtaaccattttttgac

SEQ ID NO: 276035 - DNA, 20 bp, Artificial Sequence
  Description of Artificial Sequence: Synthetic oligonucleotide
  Target: ATXN1; (+) strand; PAM type: YTN; PAM sequence: CTA
ctgtaaccattttttgacag

SEQ ID NO: 276036 - DNA, 20 bp, Artificial Sequence
  Description of Artificial Sequence: Synthetic oligonucleotide
  Target: ATXN1; (+) strand; PAM type: YTN; PAM sequence: CTG
taaccattttttgacagttt

SEQ ID NO: 276037 - DNA, 20 bp, Artificial Sequence
  Description of Artificial Sequence: Synthetic oligonucleotide
  Target: ATXN1; (+) strand; PAM type: YTN; PAM sequence: TTT
tttgacagttttgttagaga

SEQ ID NO: 276038 - DNA, 20 bp, Artificial Sequence
  Description of Artificial Sequence: Synthetic oligonucleotide
  Target: ATXN1; (+) strand; PAM type: YTN; PAM sequence: TTT
ttgacagttttgttagagaa

SEQ ID NO: 276039 - DNA, 20 bp, Artificial Sequence
  Description of Artificial Sequence: Synthetic oligonucleotide
  Target: ATXN1; (+) strand; PAM type: YTN; PAM sequence: TTT
tgacagttttgttagagaat

SEQ ID NO: 276040 - DNA, 20 bp, Artificial Sequence
  Description of Artificial Sequence: Synthetic oligonucleotide
  Target: ATXN1; (+) strand; PAM type: YTN; PAM sequence: TTT
gacagttttgttagagaatt

SEQ ID NO: 276041 - DNA, 20 bp, Artificial Sequence
  Description of Artificial Sequence: Synthetic oligonucleotide
  Target: ATXN1; (+) strand; PAM type: YTN; PAM sequence: TTG
acagttttgttagagaattc

SEQ ID NO: 276042 - DNA, 20 bp, Artificial Sequence
  Description of Artificial Sequence: Synthetic oligonucleotide
  Target: ATXN1; (+) strand; PAM type: YTN; PAM sequence: TTT
tgttagagaattcaaagcac

SEQ ID NO: 276043 - DNA, 20 bp, Artificial Sequence
  Description of Artificial Sequence: Synthetic oligonucleotide
  Target: ATXN1; (+) strand; PAM type: YTN; PAM sequence: TTT
gttagagaattcaaagcacc

SEQ ID NO: 276044 - DNA, 20 bp, Artificial Sequence
  Description of Artificial Sequence: Synthetic oligonucleotide
  Target: ATXN1; (+) strand; PAM type: YTN; PAM sequence: TTG
ttagagaattcaaagcacca

SEQ ID NO: 276045 - DNA, 20 bp, Artificial Sequence
  Description of Artificial Sequence: Synthetic oligonucleotide
  Target: ATXN1; (+) strand; PAM type: YTN; PAM sequence: TTA
gagaattcaaagcaccaaat

SEQ ID NO: 276046 - DNA, 20 bp, Artificial Sequence
  Description of Artificial Sequence: Synthetic oligonucleotide
  Target: ATXN1; (+) strand; PAM type: YTN; PAM sequence: TTC
aaagcaccaaataaaaatgt

SEQ ID NO: 276047 - DNA, 20 bp, Artificial Sequence
  Description of Artificial Sequence: Synthetic oligonucleotide
  Target: ATXN1; (+) strand; PAM type: YTN; PAM sequence: CTG
aaaaagactactagaggaaa

SEQ ID NO: 276048 - DNA, 20 bp, Artificial Sequence
  Description of Artificial Sequence: Synthetic oligonucleotide
  Target: ATXN1; (+) strand; PAM type: YTN; PAM sequence: CTA
ctagaggaaaaaaaaataaa

SEQ ID NO: 276049 - DNA, 20 bp, Artificial Sequence
  Description of Artificial Sequence: Synthetic oligonucleotide
  Target: ATXN1; (+) strand; PAM type: YTN; PAM sequence: CTA
gaggaaaaaaaaataaattc

SEQ ID NO: 276050 - DNA, 20 bp, Artificial Sequence
  Description of Artificial Sequence: Synthetic oligonucleotide
  Target: ATXN1; (+) strand; PAM type: YTN; PAM sequence: TTC
agggtaagggtacatactag

SEQ ID NO: 276051 - DNA, 20 bp, Artificial Sequence
  Description of Artificial Sequence: Synthetic oligonucleotide
  Target: ATXN1; (+) strand; PAM type: YTN; PAM sequence: CTA
gatatttagacagctgaagc

SEQ ID NO: 276052 - DNA, 20 bp, Artificial Sequence
  Description of Artificial Sequence: Synthetic oligonucleotide
  Target: ATXN1; (+) strand; PAM type: YTN; PAM sequence: TTT
agacagctgaagccagtggt

SEQ ID NO: 276053 - DNA, 20 bp, Artificial Sequence
  Description of Artificial Sequence: Synthetic oligonucleotide
  Target: ATXN1; (+) strand; PAM type: YTN; PAM sequence: TTA
gacagctgaagccagtggtg

SEQ ID NO: 276054 - DNA, 20 bp, Artificial Sequence
  Description of Artificial Sequence: Synthetic oligonucleotide
  Target: ATXN1; (+) strand; PAM type: YTN; PAM sequence: CTG
aagccagtggtgtgtgcaga

SEQ ID NO: 276055 - DNA, 20 bp, Artificial Sequence
  Description of Artificial Sequence: Synthetic oligonucleotide
  Target: ATXN1; (+) strand; PAM type: YTN; PAM sequence: TTT
aataaaagtgggaggggaga

SEQ ID NO: 276056 - DNA, 20 bp, Artificial Sequence
  Description of Artificial Sequence: Synthetic oligonucleotide
  Target: ATXN1; (+) strand; PAM type: YTN; PAM sequence: TTA
ataaaagtgggaggggagag

SEQ ID NO: 276057 - DNA, 20 bp, Artificial Sequence
  Description of Artificial Sequence: Synthetic oligonucleotide
  Target: ATXN1; (+) strand; PAM type: YTN; PAM sequence: CTG
atgtgtagcatttgcagact

SEQ ID NO: 276058 - DNA, 20 bp, Artificial Sequence
  Description of Artificial Sequence: Synthetic oligonucleotide
  Target: ATXN1; (+) strand; PAM type: YTN; PAM sequence: TTT
gcagacttctgtagtgtaaa

SEQ ID NO: 276059 - DNA, 20 bp, Artificial Sequence
  Description of Artificial Sequence: Synthetic oligonucleotide
  Target: ATXN1; (+) strand; PAM type: YTN; PAM sequence: TTG
cagacttctgtagtgtaaac

SEQ ID NO: 276060 - DNA, 20 bp, Artificial Sequence
  Description of Artificial Sequence: Synthetic oligonucleotide
  Target: ATXN1; (+) strand; PAM type: YTN; PAM sequence: CTT
ctgtagtgtaaacactccca

SEQ ID NO: 276061 - DNA, 20 bp, Artificial Sequence
  Description of Artificial Sequence: Synthetic oligonucleotide
  Target: ATXN1; (+) strand; PAM type: YTN; PAM sequence: TTC
tgtagtgtaaacactcccac

SEQ ID NO: 276062 - DNA, 20 bp, Artificial Sequence
  Description of Artificial Sequence: Synthetic oligonucleotide
  Target: ATXN1; (+) strand; PAM type: YTN; PAM sequence: CTG
tagtgtaaacactcccacca

SEQ ID NO: 276063 - DNA, 20 bp, Artificial Sequence
  Description of Artificial Sequence: Synthetic oligonucleotide
  Target: ATXN1; (+) strand; PAM type: YTN; PAM sequence: CTC
ccaccatggccaatttcaag

SEQ ID NO: 276064 - DNA, 20 bp, Artificial Sequence
  Description of Artificial Sequence: Synthetic oligonucleotide
  Target: ATXN1; (+) strand; PAM type: YTN; PAM sequence: TTT
caaggtaataacatgatgtc

SEQ ID NO: 276065 - DNA, 20 bp, Artificial Sequence
  Description of Artificial Sequence: Synthetic oligonucleotide
  Target: ATXN1; (+) strand; PAM type: YTN; PAM sequence: TTC
aaggtaataacatgatgtca

SEQ ID NO: 276066 - DNA, 20 bp, Artificial Sequence
  Description of Artificial Sequence: Synthetic oligonucleotide
  Target: ATXN1; (+) strand; PAM type: YTN; PAM sequence: CTC
cccaaatttctgaacattta

SEQ ID NO: 276067 - DNA, 20 bp, Artificial Sequence
  Description of Artificial Sequence: Synthetic oligonucleotide
  Target: ATXN1; (+) strand; PAM type: YTN; PAM sequence: TTT
ctgaacatttaacacttggc

SEQ ID NO: 276068 - DNA, 20 bp, Artificial Sequence
  Description of Artificial Sequence: Synthetic oligonucleotide
  Target: ATXN1; (+) strand; PAM type: YTN; PAM sequence: TTC
tgaacatttaacacttggct

SEQ ID NO: 276069 - DNA, 20 bp, Artificial Sequence
  Description of Artificial Sequence: Synthetic oligonucleotide
  Target: ATXN1; (+) strand; PAM type: YTN; PAM sequence: CTG
aacatttaacacttggctca

SEQ ID NO: 276070 - DNA, 20 bp, Artificial Sequence
  Description of Artificial Sequence: Synthetic oligonucleotide
  Target: ATXN1; (+) strand; PAM type: YTN; PAM sequence: TTT
aacacttggctcataaaagt

SEQ ID NO: 276071 - DNA, 20 bp, Artificial Sequence
  Description of Artificial Sequence: Synthetic oligonucleotide
  Target: ATXN1; (+) strand; PAM type: YTN; PAM sequence: TTA
acacttggctcataaaagtg

SEQ ID NO: 276072 - DNA, 20 bp, Artificial Sequence
  Description of Artificial Sequence: Synthetic oligonucleotide
  Target: ATXN1; (+) strand; PAM type: YTN; PAM sequence: CTT
ggctcataaaagtgcaagct

SEQ ID NO: 276073 - DNA, 20 bp, Artificial Sequence
  Description of Artificial Sequence: Synthetic oligonucleotide
  Target: ATXN1; (+) strand; PAM type: YTN; PAM sequence: TTG
gctcataaaagtgcaagctg

SEQ ID NO: 276074 - DNA, 20 bp, Artificial Sequence
  Description of Artificial Sequence: Synthetic oligonucleotide
  Target: ATXN1; (+) strand; PAM type: YTN; PAM sequence: CTC
ataaaagtgcaagctggctc

SEQ ID NO: 276075 - DNA, 20 bp, Artificial Sequence
  Description of Artificial Sequence: Synthetic oligonucleotide
  Target: ATXN1; (+) strand; PAM type: YTN; PAM sequence: CTG
gctccactacaccactggtc

SEQ ID NO: 276076 - DNA, 20 bp, Artificial Sequence
  Description of Artificial Sequence: Synthetic oligonucleotide
  Target: ATXN1; (+) strand; PAM type: YTN; PAM sequence: CTC
cactacaccactggtccatt

SEQ ID NO: 276077 - DNA, 20 bp, Artificial Sequence
  Description of Artificial Sequence: Synthetic oligonucleotide
  Target: ATXN1; (+) strand; PAM type: YTN; PAM sequence: CTA
caccactggtccatttcctc

SEQ ID NO: 276078 - DNA, 20 bp, Artificial Sequence
  Description of Artificial Sequence: Synthetic oligonucleotide
  Target: ATXN1; (+) strand; PAM type: YTN; PAM sequence: CTG
gtccatttcctcatcccacc

SEQ ID NO: 276079 - DNA, 20 bp, Artificial Sequence
  Description of Artificial Sequence: Synthetic oligonucleotide
  Target: ATXN1; (+) strand; PAM type: YTN; PAM sequence: TTT
cctcatcccaccaagatcag

SEQ ID NO: 276080 - DNA, 20 bp, Artificial Sequence
  Description of Artificial Sequence: Synthetic oligonucleotide
  Target: ATXN1; (+) strand; PAM type: YTN; PAM sequence: TTC
ctcatcccaccaagatcagt

SEQ ID NO: 276081 - DNA, 20 bp, Artificial Sequence
  Description of Artificial Sequence: Synthetic oligonucleotide
  Target: ATXN1; (+) strand; PAM type: YTN; PAM sequence: CTC
atcccaccaagatcagtaaa

SEQ ID NO: 276082 - DNA, 20 bp, Artificial Sequence
  Description of Artificial Sequence: Synthetic oligonucleotide
  Target: ATXN1; (+) strand; PAM type: YTN; PAM sequence: CTA
cttcctacctaaaataaacc

SEQ ID NO: 276083 - DNA, 20 bp, Artificial Sequence
  Description of Artificial Sequence: Synthetic oligonucleotide
  Target: ATXN1; (+) strand; PAM type: YTN; PAM sequence: CTT
cctacctaaaataaacccaa

SEQ ID NO: 276084 - DNA, 20 bp, Artificial Sequence
  Description of Artificial Sequence: Synthetic oligonucleotide
  Target: ATXN1; (+) strand; PAM type: YTN; PAM sequence: TTC
ctacctaaaataaacccaag

SEQ ID NO: 276085 - DNA, 20 bp, Artificial Sequence
  Description of Artificial Sequence: Synthetic oligonucleotide
  Target: ATXN1; (+) strand; PAM type: YTN; PAM sequence: CTA
cctaaaataaacccaagaag

SEQ ID NO: 276086 - DNA, 20 bp, Artificial Sequence
  Description of Artificial Sequence: Synthetic oligonucleotide
  Target: ATXN1; (+) strand; PAM type: YTN; PAM sequence: CTA
aaataaacccaagaagcaaa

SEQ ID NO: 276087 - DNA, 20 bp, Artificial Sequence
  Description of Artificial Sequence: Synthetic oligonucleotide
  Target: ATXN1; (+) strand; PAM type: YTN; PAM sequence: CTT
cattattttcggctttcttc

SEQ ID NO: 276088 - DNA, 20 bp, Artificial Sequence
  Description of Artificial Sequence: Synthetic oligonucleotide
  Target: ATXN1; (+) strand; PAM type: YTN; PAM sequence: TTC
attattttcggctttcttct

SEQ ID NO: 276089 - DNA, 20 bp, Artificial Sequence
  Description of Artificial Sequence: Synthetic oligonucleotide
  Target: ATXN1; (+) strand; PAM type: YTN; PAM sequence: TTA
ttttcggctttcttcttatc

SEQ ID NO: 276090 - DNA, 20 bp, Artificial Sequence
  Description of Artificial Sequence: Synthetic oligonucleotide
  Target: ATXN1; (+) strand; PAM type: YTN; PAM sequence: TTT
tcggctttcttcttatccat

SEQ ID NO: 276091 - DNA, 20 bp, Artificial Sequence
  Description of Artificial Sequence: Synthetic oligonucleotide
  Target: ATXN1; (+) strand; PAM type: YTN; PAM sequence: TTT
cggctttcttcttatccata

SEQ ID NO: 276092 - DNA, 20 bp, Artificial Sequence
  Description of Artificial Sequence: Synthetic oligonucleotide
  Target: ATXN1; (+) strand; PAM type: YTN; PAM sequence: TTC
ggctttcttcttatccatag

SEQ ID NO: 276093 - DNA, 20 bp, Artificial Sequence
  Description of Artificial Sequence: Synthetic oligonucleotide
  Target: ATXN1; (+) strand; PAM type: YTN; PAM sequence: CTT
tcttcttatccatagatatt

SEQ ID NO: 276094 - DNA, 20 bp, Artificial Sequence
  Description of Artificial Sequence: Synthetic oligonucleotide
  Target: ATXN1; (+) strand; PAM type: YTN; PAM sequence: TTT
cttcttatccatagatattt

SEQ ID NO: 276095 - DNA, 20 bp, Artificial Sequence
  Description of Artificial Sequence: Synthetic oligonucleotide
  Target: ATXN1; (+) strand; PAM type: YTN; PAM sequence: TTC
ttcttatccatagatattta

SEQ ID NO: 276096 - DNA, 20 bp, Artificial Sequence
  Description of Artificial Sequence: Synthetic oligonucleotide
  Target: ATXN1; (+) strand; PAM type: YTN; PAM sequence: CTT
cttatccatagatatttaag

SEQ ID NO: 276097 - DNA, 20 bp, Artificial Sequence
  Description of Artificial Sequence: Synthetic oligonucleotide
  Target: ATXN1; (+) strand; PAM type: YTN; PAM sequence: TTC
ttatccatagatatttaaga

SEQ ID NO: 276098 - DNA, 20 bp, Artificial Sequence
  Description of Artificial Sequence: Synthetic oligonucleotide
  Target: ATXN1; (+) strand; PAM type: YTN; PAM sequence: CTT
atccatagatatttaagaga

SEQ ID NO: 276099 - DNA, 20 bp, Artificial Sequence
  Description of Artificial Sequence: Synthetic oligonucleotide
  Target: ATXN1; (+) strand; PAM type: YTN; PAM sequence: TTA
tccatagatatttaagagac

SEQ ID NO: 276100 - DNA, 20 bp, Artificial Sequence
  Description of Artificial Sequence: Synthetic oligonucleotide
  Target: ATXN1; (+) strand; PAM type: YTN; PAM sequence: TTT
aagagactatctgttcccac

SEQ ID NO: 276101 - DNA, 20 bp, Artificial Sequence
  Description of Artificial Sequence: Synthetic oligonucleotide
  Target: ATXN1; (+) strand; PAM type: YTN; PAM sequence: TTA
agagactatctgttcccact

SEQ ID NO: 276102 - DNA, 20 bp, Artificial Sequence
  Description of Artificial Sequence: Synthetic oligonucleotide
  Target: ATXN1; (+) strand; PAM type: YTN; PAM sequence: CTA
tctgttcccacttccatgtc

SEQ ID NO: 276103 - DNA, 20 bp, Artificial Sequence
  Description of Artificial Sequence: Synthetic oligonucleotide
  Target: ATXN1; (+) strand; PAM type: YTN; PAM sequence: CTG
ttcccacttccatgtctttg

SEQ ID NO: 276104 - DNA, 20 bp, Artificial Sequence
  Description of Artificial Sequence: Synthetic oligonucleotide
  Target: ATXN1; (+) strand; PAM type: YTN; PAM sequence: TTC
ccacttccatgtctttgctt

SEQ ID NO: 276105 - DNA, 20 bp, Artificial Sequence
  Description of Artificial Sequence: Synthetic oligonucleotide
  Target: ATXN1; (+) strand; PAM type: YTN; PAM sequence: CTT
ccatgtctttgcttctagcc

SEQ ID NO: 276106 - DNA, 20 bp, Artificial Sequence
  Description of Artificial Sequence: Synthetic oligonucleotide
  Target: ATXN1; (+) strand; PAM type: YTN; PAM sequence: TTC
catgtctttgcttctagcct

SEQ ID NO: 276107 - DNA, 20 bp, Artificial Sequence
  Description of Artificial Sequence: Synthetic oligonucleotide
  Target: ATXN1; (+) strand; PAM type: YTN; PAM sequence: CTT
tgcttctagcctcctcatct

SEQ ID NO: 276108 - DNA, 20 bp, Artificial Sequence
  Description of Artificial Sequence: Synthetic oligonucleotide
  Target: ATXN1; (+) strand; PAM type: YTN; PAM sequence: TTT
gcttctagcctcctcatctg

SEQ ID NO: 276109 - DNA, 20 bp, Artificial Sequence
  Description of Artificial Sequence: Synthetic oligonucleotide
  Target: ATXN1; (+) strand; PAM type: YTN; PAM sequence: TTG
cttctagcctcctcatctgg

SEQ ID NO: 276110 - DNA, 20 bp, Artificial Sequence
  Description of Artificial Sequence: Synthetic oligonucleotide
  Target: ATXN1; (+) strand; PAM type: YTN; PAM sequence: CTT
ctagcctcctcatctggaat

SEQ ID NO: 276111 - DNA, 20 bp, Artificial Sequence
  Description of Artificial Sequence: Synthetic oligonucleotide
  Target: ATXN1; (+) strand; PAM type: YTN; PAM sequence: TTC
tagcctcctcatctggaata

SEQ ID NO: 276112 - DNA, 20 bp, Artificial Sequence
  Description of Artificial Sequence: Synthetic oligonucleotide
  Target: ATXN1; (+) strand; PAM type: YTN; PAM sequence: CTA
gcctcctcatctggaataaa

SEQ ID NO: 276113 - DNA, 20 bp, Artificial Sequence
  Description of Artificial Sequence: Synthetic oligonucleotide
  Target: ATXN1; (+) strand; PAM type: YTN; PAM sequence: CTC
ctcatctggaataaaccttc

SEQ ID NO: 276114 - DNA, 20 bp, Artificial Sequence
  Description of Artificial Sequence: Synthetic oligonucleotide
  Target: ATXN1; (+) strand; PAM type: YTN; PAM sequence: CTC
atctggaataaaccttccta

SEQ ID NO: 276115 - DNA, 20 bp, Artificial Sequence
  Description of Artificial Sequence: Synthetic oligonucleotide
  Target: ATXN1; (+) strand; PAM type: YTN; PAM sequence: CTG
gaataaaccttcctaagtct

SEQ ID NO: 276116 - DNA, 20 bp, Artificial Sequence
  Description of Artificial Sequence: Synthetic oligonucleotide
  Target: ATXN1; (+) strand; PAM type: YTN; PAM sequence: CTT
cctaagtctgctcttgtata

SEQ ID NO: 276117 - DNA, 20 bp, Artificial Sequence
  Description of Artificial Sequence: Synthetic oligonucleotide
  Target: ATXN1; (+) strand; PAM type: YTN; PAM sequence: TTC
ctaagtctgctcttgtataa

SEQ ID NO: 276118 - DNA, 20 bp, Artificial Sequence
  Description of Artificial Sequence: Synthetic oligonucleotide
  Target: ATXN1; (+) strand; PAM type: YTN; PAM sequence: CTA
agtctgctcttgtataaaca

SEQ ID NO: 276119 - DNA, 20 bp, Artificial Sequence
  Description of Artificial Sequence: Synthetic oligonucleotide
  Target: ATXN1; (+) strand; PAM type: YTN; PAM sequence: CTG
ctcttgtataaacagctttc

SEQ ID NO: 276120 - DNA, 20 bp, Artificial Sequence
  Description of Artificial Sequence: Synthetic oligonucleotide
  Target: ATXN1; (+) strand; PAM type: YTN; PAM sequence: CTC
ttgtataaacagctttcttt

SEQ ID NO: 276121 - DNA, 20 bp, Artificial Sequence
  Description of Artificial Sequence: Synthetic oligonucleotide
  Target: ATXN1; (+) strand; PAM type: YTN; PAM sequence: CTT
gtataaacagctttctttga

SEQ ID NO: 276122 - DNA, 20 bp, Artificial Sequence
  Description of Artificial Sequence: Synthetic oligonucleotide
  Target: ATXN1; (+) strand; PAM type: YTN; PAM sequence: TTG
tataaacagctttctttgaa

SEQ ID NO: 276123 - DNA, 20 bp, Artificial Sequence
  Description of Artificial Sequence: Synthetic oligonucleotide
  Target: ATXN1; (+) strand; PAM type: YTN; PAM sequence: CTT
tctttgaatgctcttaggct

SEQ ID NO: 276124 - DNA, 20 bp, Artificial Sequence
  Description of Artificial Sequence: Synthetic oligonucleotide
  Target: ATXN1; (+) strand; PAM type: YTN; PAM sequence: TTT
ctttgaatgctcttaggcta

SEQ ID NO: 276125 - DNA, 20 bp, Artificial Sequence
  Description of Artificial Sequence: Synthetic oligonucleotide
  Target: ATXN1; (+) strand; PAM type: YTN; PAM sequence: TTC
tttgaatgctcttaggctag

SEQ ID NO: 276126 - DNA, 20 bp, Artificial Sequence
  Description of Artificial Sequence: Synthetic oligonucleotide
  Target: ATXN1; (+) strand; PAM type: YTN; PAM sequence: CTT
tgaatgctcttaggctaggt

SEQ ID NO: 276127 - DNA, 20 bp, Artificial Sequence
  Description of Artificial Sequence: Synthetic oligonucleotide
  Target: ATXN1; (+) strand; PAM type: YTN; PAM sequence: TTT
gaatgctcttaggctaggtc

SEQ ID NO: 276128 - DNA, 20 bp, Artificial Sequence
  Description of Artificial Sequence: Synthetic oligonucleotide
  Target: ATXN1; (+) strand; PAM type: YTN; PAM sequence: TTG
aatgctcttaggctaggtcg

SEQ ID NO: 276129 - DNA, 20 bp, Artificial Sequence
  Description of Artificial Sequence: Synthetic oligonucleotide
  Target: ATXN1; (+) strand; PAM type: YTN; PAM sequence: CTC
ttaggctaggtcgcaccagc

SEQ ID NO: 276130 - DNA, 20 bp, Artificial Sequence
  Description of Artificial Sequence: Synthetic oligonucleotide
  Target: ATXN1; (+) strand; PAM type: YTN; PAM sequence: CTT
aggctaggtcgcaccagccc

SEQ ID NO: 276131 - DNA, 20 bp, Artificial Sequence
  Description of Artificial Sequence: Synthetic oligonucleotide
  Target: ATXN1; (+) strand; PAM type: YTN; PAM sequence: TTA
ggctaggtcgcaccagccct

SEQ ID NO: 276132 - DNA, 20 bp, Artificial Sequence
  Description of Artificial Sequence: Synthetic oligonucleotide
  Target: ATXN1; (+) strand; PAM type: YTN; PAM sequence: CTA
ggtcgcaccagcccttctgt

SEQ ID NO: 276133 - DNA, 20 bp, Artificial Sequence
  Description of Artificial Sequence: Synthetic oligonucleotide
  Target: ATXN1; (+) strand; PAM type: YTN; PAM sequence: CTT
ctgtattctgattttctaca

SEQ ID NO: 276134 - DNA, 20 bp, Artificial Sequence
  Description of Artificial Sequence: Synthetic oligonucleotide
  Target: ATXN1; (+) strand; PAM type: YTN; PAM sequence: TTC
tgtattctgattttctacag

SEQ ID NO: 276135 - DNA, 20 bp, Artificial Sequence
  Description of Artificial Sequence: Synthetic oligonucleotide
  Target: ATXN1; (+) strand; PAM type: YTN; PAM sequence: CTG
tattctgattttctacagca

SEQ ID NO: 276136 - DNA, 20 bp, Artificial Sequence
  Description of Artificial Sequence: Synthetic oligonucleotide
  Target: ATXN1; (+) strand; PAM type: YTN; PAM sequence: TTC
tgattttctacagcacttct

SEQ ID NO: 276137 - DNA, 20 bp, Artificial Sequence
  Description of Artificial Sequence: Synthetic oligonucleotide
  Target: ATXN1; (+) strand; PAM type: YTN; PAM sequence: CTG
attttctacagcacttctct

SEQ ID NO: 276138 - DNA, 20 bp, Artificial Sequence
  Description of Artificial Sequence: Synthetic oligonucleotide
  Target: ATXN1; (+) strand; PAM type: YTN; PAM sequence: TTT
tctacagcacttctctgtta

SEQ ID NO: 276139 - DNA, 20 bp, Artificial Sequence
  Description of Artificial Sequence: Synthetic oligonucleotide
  Target: ATXN1; (+) strand; PAM type: YTN; PAM sequence: TTT
ctacagcacttctctgttac

SEQ ID NO: 276140 - DNA, 20 bp, Artificial Sequence
  Description of Artificial Sequence: Synthetic oligonucleotide
  Target: ATXN1; (+) strand; PAM type: YTN; PAM sequence: TTC
tacagcacttctctgttact

SEQ ID NO: 276141 - DNA, 20 bp, Artificial Sequence
  Description of Artificial Sequence: Synthetic oligonucleotide
  Target: ATXN1; (+) strand; PAM type: YTN; PAM sequence: CTA
cagcacttctctgttactgt

SEQ ID NO: 276142 - DNA, 20 bp, Artificial Sequence
  Description of Artificial Sequence: Synthetic oligonucleotide
  Target: ATXN1; (+) strand; PAM type: YTN; PAM sequence: CTT
ctctgttactgtcctgtcat

SEQ ID NO: 276143 - DNA, 20 bp, Artificial Sequence
  Description of Artificial Sequence: Synthetic oligonucleotide
  Target: ATXN1; (+) strand; PAM type: YTN; PAM sequence: TTC
tctgttactgtcctgtcatt

SEQ ID NO: 276144 - DNA, 20 bp, Artificial Sequence
  Description of Artificial Sequence: Synthetic oligonucleotide
  Target: ATXN1; (+) strand; PAM type: YTN; PAM sequence: CTC
tgttactgtcctgtcatttg

SEQ ID NO: 276145 - DNA, 20 bp, Artificial Sequence
  Description of Artificial Sequence: Synthetic oligonucleotide
  Target: ATXN1; (+) strand; PAM type: YTN; PAM sequence: CTG
ttactgtcctgtcatttgat

SEQ ID NO: 276146 - DNA, 20 bp, Artificial Sequence
  Description of Artificial Sequence: Synthetic oligonucleotide
  Target: ATXN1; (+) strand; PAM type: YTN; PAM sequence: TTA
ctgtcctgtcatttgattct

SEQ ID NO: 276147 - DNA, 20 bp, Artificial Sequence
  Description of Artificial Sequence: Synthetic oligonucleotide
  Target: ATXN1; (+) strand; PAM type: YTN; PAM sequence: CTG
tcctgtcatttgattctaga

SEQ ID NO: 276148 - DNA, 20 bp, Artificial Sequence
  Description of Artificial Sequence: Synthetic oligonucleotide
  Target: ATXN1; (+) strand; PAM type: YTN; PAM sequence: CTG
tcatttgattctagagggca

SEQ ID NO: 276149 - DNA, 20 bp, Artificial Sequence
  Description of Artificial Sequence: Synthetic oligonucleotide
  Target: ATXN1; (+) strand; PAM type: YTN; PAM sequence: TTT
gattctagagggcaggggtc

SEQ ID NO: 276150 - DNA, 20 bp, Artificial Sequence
  Description of Artificial Sequence: Synthetic oligonucleotide
  Target: ATXN1; (+) strand; PAM type: YTN; PAM sequence: TTG
attctagagggcaggggtct

SEQ ID NO: 276151 - DNA, 20 bp, Artificial Sequence
  Description of Artificial Sequence: Synthetic oligonucleotide
  Target: ATXN1; (+) strand; PAM type: YTN; PAM sequence: TTC
tagagggcaggggtctgtga

SEQ ID NO: 276152 - DNA, 20 bp, Artificial Sequence
  Description of Artificial Sequence: Synthetic oligonucleotide
  Target: ATXN1; (+) strand; PAM type: YTN; PAM sequence: CTA
gagggcaggggtctgtgagg

SEQ ID NO: 276153 - DNA, 20 bp, Artificial Sequence
  Description of Artificial Sequence: Synthetic oligonucleotide
  Target: ATXN1; (+) strand; PAM type: YTN; PAM sequence: CTG
tgagggcagggcatctgccc

SEQ ID NO: 276154 - DNA, 20 bp, Artificial Sequence
  Description of Artificial Sequence: Synthetic oligonucleotide
  Target: ATXN1; (+) strand; PAM type: YTN; PAM sequence: CTG
cccacaggaataagcacagc

SEQ ID NO: 276155 - DNA, 20 bp, Artificial Sequence
  Description of Artificial Sequence: Synthetic oligonucleotide
  Target: ATXN1; (+) strand; PAM type: YTN; PAM sequence: CTG
acttggattgagctgaataa

SEQ ID NO: 276156 - DNA, 20 bp, Artificial Sequence
  Description of Artificial Sequence: Synthetic oligonucleotide
  Target: ATXN1; (+) strand; PAM type: YTN; PAM sequence: CTT
ggattgagctgaataaatga

SEQ ID NO: 276157 - DNA, 20 bp, Artificial Sequence
  Description of Artificial Sequence: Synthetic oligonucleotide
  Target: ATXN1; (+) strand; PAM type: YTN; PAM sequence: TTG
gattgagctgaataaatgaa

SEQ ID NO: 276158 - DNA, 20 bp, Artificial Sequence
  Description of Artificial Sequence: Synthetic oligonucleotide
  Target: ATXN1; (+) strand; PAM type: YTN; PAM sequence: TTG
agctgaataaatgaaatctg

SEQ ID NO: 276159 - DNA, 20 bp, Artificial Sequence
  Description of Artificial Sequence: Synthetic oligonucleotide
  Target: ATXN1; (+) strand; PAM type: YTN; PAM sequence: CTG
aataaatgaaatctgttgag

SEQ ID NO: 276160 - DNA, 20 bp, Artificial Sequence
  Description of Artificial Sequence: Synthetic oligonucleotide
  Target: ATXN1; (+) strand; PAM type: YTN; PAM sequence: CTG
ttgagttgactggctgggct

SEQ ID NO: 276161 - DNA, 20 bp, Artificial Sequence
  Description of Artificial Sequence: Synthetic oligonucleotide
  Target: ATXN1; (+) strand; PAM type: YTN; PAM sequence: TTG
agttgactggctgggctgcc

SEQ ID NO: 276162 - DNA, 20 bp, Artificial Sequence
  Description of Artificial Sequence: Synthetic oligonucleotide
  Target: ATXN1; (+) strand; PAM type: YTN; PAM sequence: TTG
actggctgggctgccttctg

SEQ ID NO: 276163 - DNA, 20 bp, Artificial Sequence
  Description of Artificial Sequence: Synthetic oligonucleotide
  Target: ATXN1; (+) strand; PAM type: YTN; PAM sequence: CTG
gctgggctgccttctgtcta

SEQ ID NO: 276164 - DNA, 20 bp, Artificial Sequence
  Description of Artificial Sequence: Synthetic oligonucleotide
  Target: ATXN1; (+) strand; PAM type: YTN; PAM sequence: CTG
ggctgccttctgtctagtct

SEQ ID NO: 276165 - DNA, 20 bp, Artificial Sequence
  Description of Artificial Sequence: Synthetic oligonucleotide
  Target: ATXN1; (+) strand; PAM type: YTN; PAM sequence: CTG
ccttctgtctagtctgccac

SEQ ID NO: 276166 - DNA, 20 bp, Artificial Sequence
  Description of Artificial Sequence: Synthetic oligonucleotide
  Target: ATXN1; (+) strand; PAM type: YTN; PAM sequence: CTT
ctgtctagtctgccacagtg

SEQ ID NO: 276167 - DNA, 20 bp, Artificial Sequence
  Description of Artificial Sequence: Synthetic oligonucleotide
  Target: ATXN1; (+) strand; PAM type: YTN; PAM sequence: TTC
tgtctagtctgccacagtga

SEQ ID NO: 276168 - DNA, 20 bp, Artificial Sequence
  Description of Artificial Sequence: Synthetic oligonucleotide
  Target: ATXN1; (+) strand; PAM type: YTN; PAM sequence: CTG
tctagtctgccacagtgagc

SEQ ID NO: 276169 - DNA, 20 bp, Artificial Sequence
  Description of Artificial Sequence: Synthetic oligonucleotide
  Target: ATXN1; (+) strand; PAM type: YTN; PAM sequence: CTA
gtctgccacagtgagctagg

SEQ ID NO: 276170 - DNA, 20 bp, Artificial Sequence
  Description of Artificial Sequence: Synthetic oligonucleotide
  Target: ATXN1; (+) strand; PAM type: YTN; PAM sequence: CTG
ccacagtgagctaggctcct

SEQ ID NO: 276171 - DNA, 20 bp, Artificial Sequence
  Description of Artificial Sequence: Synthetic oligonucleotide
  Target: ATXN1; (+) strand; PAM type: YTN; PAM sequence: CTA
ggctcctcctgaagtgaact

SEQ ID NO: 276172 - DNA, 20 bp, Artificial Sequence
  Description of Artificial Sequence: Synthetic oligonucleotide
  Target: ATXN1; (+) strand; PAM type: YTN; PAM sequence: CTC
ctcctgaagtgaactaggat

SEQ ID NO: 276173 - DNA, 20 bp, Artificial Sequence
  Description of Artificial Sequence: Synthetic oligonucleotide
  Target: ATXN1; (+) strand; PAM type: YTN; PAM sequence: CTC
ctgaagtgaactaggatcag

SEQ ID NO: 276174 - DNA, 20 bp, Artificial Sequence
  Description of Artificial Sequence: Synthetic oligonucleotide
  Target: ATXN1; (+) strand; PAM type: YTN; PAM sequence: CTG
aagtgaactaggatcagtga

SEQ ID NO: 276175 - DNA, 20 bp, Artificial Sequence
  Description of Artificial Sequence: Synthetic oligonucleotide
  Target: ATXN1; (+) strand; PAM type: YTN; PAM sequence: CTA
ggatcagtgagggactaaag

SEQ ID NO: 276176 - DNA, 20 bp, Artificial Sequence
  Description of Artificial Sequence: Synthetic oligonucleotide
  Target: ATXN1; (+) strand; PAM type: YTN; PAM sequence: CTA
aagtcaatctgtagcatgaa

SEQ ID NO: 276177 - DNA, 20 bp, Artificial Sequence
  Description of Artificial Sequence: Synthetic oligonucleotide
  Target: ATXN1; (+) strand; PAM type: YTN; PAM sequence: CTG
tagcatgaagatttcacagg

SEQ ID NO: 276178 - DNA, 20 bp, Artificial Sequence
  Description of Artificial Sequence: Synthetic oligonucleotide
  Target: ATXN1; (+) strand; PAM type: YTN; PAM sequence: TTT
cacagggcactcactactgc

SEQ ID NO: 276179 - DNA, 20 bp, Artificial Sequence
  Description of Artificial Sequence: Synthetic oligonucleotide
  Target: ATXN1; (+) strand; PAM type: YTN; PAM sequence: TTC
acagggcactcactactgca

SEQ ID NO: 276180 - DNA, 20 bp, Artificial Sequence
  Description of Artificial Sequence: Synthetic oligonucleotide
  Target: ATXN1; (+) strand; PAM type: YTN; PAM sequence: CTC
actactgcacacaccaaact

SEQ ID NO: 276181 - DNA, 20 bp, Artificial Sequence
  Description of Artificial Sequence: Synthetic oligonucleotide
  Target: ATXN1; (+) strand; PAM type: YTN; PAM sequence: CTA
ctgcacacaccaaactccca

SEQ ID NO: 276182 - DNA, 20 bp, Artificial Sequence
  Description of Artificial Sequence: Synthetic oligonucleotide
  Target: ATXN1; (+) strand; PAM type: YTN; PAM sequence: CTG
cacacaccaaactcccacaa

SEQ ID NO: 276183 - DNA, 20 bp, Artificial Sequence
  Description of Artificial Sequence: Synthetic oligonucleotide
  Target: ATXN1; (+) strand; PAM type: YTN; PAM sequence: CTC
ccacaaaaggaagaggggga

SEQ ID NO: 276184 - DNA, 20 bp, Artificial Sequence
  Description of Artificial Sequence: Synthetic oligonucleotide
  Target: ATXN1; (+) strand; PAM type: YTN; PAM sequence: CTA
atatgtgttgggcataaaat

SEQ ID NO: 276185 - DNA, 20 bp, Artificial Sequence
  Description of Artificial Sequence: Synthetic oligonucleotide
  Target: ATXN1; (+) strand; PAM type: YTN; PAM sequence: TTG
ggcataaaatttctgcaagc

SEQ ID NO: 276186 - DNA, 20 bp, Artificial Sequence
  Description of Artificial Sequence: Synthetic oligonucleotide
  Target: ATXN1; (+) strand; PAM type: YTN; PAM sequence: TTT
ctgcaagccccagcacccag

SEQ ID NO: 276187 - DNA, 20 bp, Artificial Sequence
  Description of Artificial Sequence: Synthetic oligonucleotide
  Target: ATXN1; (+) strand; PAM type: YTN; PAM sequence: TTC
tgcaagccccagcacccaga

SEQ ID NO: 276188 - DNA, 20 bp, Artificial Sequence
  Description of Artificial Sequence: Synthetic oligonucleotide
  Target: ATXN1; (+) strand; PAM type: YTN; PAM sequence: CTG
caagccccagcacccagaac

SEQ ID NO: 276189 - DNA, 20 bp, Artificial Sequence
  Description of Artificial Sequence: Synthetic oligonucleotide
  Target: ATXN1; (+) strand; PAM type: YTN; PAM sequence: CTT
agttcctaacaccattctcc

SEQ ID NO: 276190 - DNA, 20 bp, Artificial Sequence
  Description of Artificial Sequence: Synthetic oligonucleotide
  Target: ATXN1; (+) strand; PAM type: YTN; PAM sequence: TTA
gttcctaacaccattctcca

SEQ ID NO: 276191 - DNA, 20 bp, Artificial Sequence
  Description of Artificial Sequence: Synthetic oligonucleotide
  Target: ATXN1; (+) strand; PAM type: YTN; PAM sequence: TTC
ctaacaccattctccaataa

SEQ ID NO: 276192 - DNA, 20 bp, Artificial Sequence
  Description of Artificial Sequence: Synthetic oligonucleotide
  Target: ATXN1; (+) strand; PAM type: YTN; PAM sequence: CTA
acaccattctccaataaaac

SEQ ID NO: 276193 - DNA, 20 bp, Artificial Sequence
  Description of Artificial Sequence: Synthetic oligonucleotide
  Target: ATXN1; (+) strand; PAM type: YTN; PAM sequence: TTC
tccaataaaacaaaccaggg

SEQ ID NO: 276194 - DNA, 20 bp, Artificial Sequence
  Description of Artificial Sequence: Synthetic oligonucleotide
  Target: ATXN1; (+) strand; PAM type: YTN; PAM sequence: CTC
caataaaacaaaccaggggt

SEQ ID NO: 276195 - DNA, 20 bp, Artificial Sequence
  Description of Artificial Sequence: Synthetic oligonucleotide
  Target: ATXN1; (+) strand; PAM type: YTN; PAM sequence: CTT
tggagaaatggctgattcta

SEQ ID NO: 276196 - DNA, 20 bp, Artificial Sequence
  Description of Artificial Sequence: Synthetic oligonucleotide
  Target: ATXN1; (+) strand; PAM type: YTN; PAM sequence: TTT
ggagaaatggctgattctag

SEQ ID NO: 276197 - DNA, 20 bp, Artificial Sequence
  Description of Artificial Sequence: Synthetic oligonucleotide
  Target: ATXN1; (+) strand; PAM type: YTN; PAM sequence: TTG
gagaaatggctgattctagt

SEQ ID NO: 276198 - DNA, 20 bp, Artificial Sequence
  Description of Artificial Sequence: Synthetic oligonucleotide
  Target: ATXN1; (+) strand; PAM type: YTN; PAM sequence: CTG
attctagtactgtgacaggg

SEQ ID NO: 276199 - DNA, 20 bp, Artificial Sequence
  Description of Artificial Sequence: Synthetic oligonucleotide
  Target: ATXN1; (+) strand; PAM type: YTN; PAM sequence: TTC
tagtactgtgacagggaata

SEQ ID NO: 276200 - DNA, 20 bp, Artificial Sequence
  Description of Artificial Sequence: Synthetic oligonucleotide
  Target: ATXN1; (+) strand; PAM type: YTN; PAM sequence: CTA
gtactgtgacagggaatatc

SEQ ID NO: 276201 - DNA, 20 bp, Artificial Sequence
  Description of Artificial Sequence: Synthetic oligonucleotide
  Target: ATXN1; (+) strand; PAM type: YTN; PAM sequence: CTG
tgacagggaatatccaagat

SEQ ID NO: 276202 - DNA, 20 bp, Artificial Sequence
  Description of Artificial Sequence: Synthetic oligonucleotide
  Target: ATXN1; (+) strand; PAM type: YTN; PAM sequence: CTT
gtagtatcagaaagtgggaa

SEQ ID NO: 276203 - DNA, 20 bp, Artificial Sequence
  Description of Artificial Sequence: Synthetic oligonucleotide
  Target: ATXN1; (+) strand; PAM type: YTN; PAM sequence: TTG
tagtatcagaaagtgggaaa

SEQ ID NO: 276204 - DNA, 20 bp, Artificial Sequence
  Description of Artificial Sequence: Synthetic oligonucleotide
  Target: ATXN1; (+) strand; PAM type: YTN; PAM sequence: CTA
aatagataaatcaatacccc

SEQ ID NO: 276205 - DNA, 20 bp, Artificial Sequence
  Description of Artificial Sequence: Synthetic oligonucleotide
  Target: ATXN1; (+) strand; PAM type: YTN; PAM sequence: TTC
ctaatatttctcaaagagct

SEQ ID NO: 276206 - DNA, 20 bp, Artificial Sequence
  Description of Artificial Sequence: Synthetic oligonucleotide
  Target: ATXN1; (+) strand; PAM type: YTN; PAM sequence: CTA
atatttctcaaagagctgcc

SEQ ID NO: 276207 - DNA, 20 bp, Artificial Sequence
  Description of Artificial Sequence: Synthetic oligonucleotide
  Target: ATXN1; (+) strand; PAM type: YTN; PAM sequence: TTT
ctcaaagagctgccaatggc

SEQ ID NO: 276208 - DNA, 20 bp, Artificial Sequence
  Description of Artificial Sequence: Synthetic oligonucleotide
  Target: ATXN1; (+) strand; PAM type: YTN; PAM sequence: TTC
tcaaagagctgccaatggcc

SEQ ID NO: 276209 - DNA, 20 bp, Artificial Sequence
  Description of Artificial Sequence: Synthetic oligonucleotide
  Target: ATXN1; (+) strand; PAM type: YTN; PAM sequence: CTC
aaagagctgccaatggccag

SEQ ID NO: 276210 - DNA, 20 bp, Artificial Sequence
  Description of Artificial Sequence: Synthetic oligonucleotide
  Target: ATXN1; (+) strand; PAM type: YTN; PAM sequence: CTG
ccaatggccagaactaaaac

SEQ ID NO: 276211 - DNA, 20 bp, Artificial Sequence
  Description of Artificial Sequence: Synthetic oligonucleotide
  Target: ATXN1; (+) strand; PAM type: YTN; PAM sequence: CTA
aaacaaccagagcaacaaaa

SEQ ID NO: 276212 - DNA, 20 bp, Artificial Sequence
  Description of Artificial Sequence: Synthetic oligonucleotide
  Target: ATXN1; (+) strand; PAM type: YTN; PAM sequence: CTG
gattagaacctaaagaataa

SEQ ID NO: 276213 - DNA, 20 bp, Artificial Sequence
  Description of Artificial Sequence: Synthetic oligonucleotide
  Target: ATXN1; (+) strand; PAM type: YTN; PAM sequence: TTA
gaacctaaagaataaaataa

SEQ ID NO: 276214 - DNA, 20 bp, Artificial Sequence
  Description of Artificial Sequence: Synthetic oligonucleotide
  Target: ATXN1; (+) strand; PAM type: YTN; PAM sequence: CTA
aagaataaaataaacaccca

SEQ ID NO: 276215 - DNA, 20 bp, Artificial Sequence
  Description of Artificial Sequence: Synthetic oligonucleotide
  Target: ATXN1; (+) strand; PAM type: YTN; PAM sequence: TTC
atattgatataaataaattt

SEQ ID NO: 276216 - DNA, 20 bp, Artificial Sequence
  Description of Artificial Sequence: Synthetic oligonucleotide
  Target: ATXN1; (+) strand; PAM type: YTN; PAM sequence: TTG
atataaataaattttaaaag

SEQ ID NO: 276217 - DNA, 20 bp, Artificial Sequence
  Description of Artificial Sequence: Synthetic oligonucleotide
  Target: ATXN1; (+) strand; PAM type: YTN; PAM sequence: TTT
taaaagaggaagaaaacacg

SEQ ID NO: 276218 - DNA, 20 bp, Artificial Sequence
  Description of Artificial Sequence: Synthetic oligonucleotide
  Target: ATXN1; (+) strand; PAM type: YTN; PAM sequence: TTT
aaaagaggaagaaaacacgc

SEQ ID NO: 276219 - DNA, 20 bp, Artificial Sequence
  Description of Artificial Sequence: Synthetic oligonucleotide
  Target: ATXN1; (+) strand; PAM type: YTN; PAM sequence: TTA
aaagaggaagaaaacacgca

SEQ ID NO: 276220 - DNA, 20 bp, Artificial Sequence
  Description of Artificial Sequence: Synthetic oligonucleotide
  Target: ATXN1; (+) strand; PAM type: YTN; PAM sequence: CTC
ttgagcaaaggagttctaaa

SEQ ID NO: 276221 - DNA, 20 bp, Artificial Sequence
  Description of Artificial Sequence: Synthetic oligonucleotide
  Target: ATXN1; (+) strand; PAM type: YTN; PAM sequence: CTT
gagcaaaggagttctaaata

SEQ ID NO: 276222 - DNA, 20 bp, Artificial Sequence
  Description of Artificial Sequence: Synthetic oligonucleotide
  Target: ATXN1; (+) strand; PAM type: YTN; PAM sequence: TTG
agcaaaggagttctaaataa

SEQ ID NO: 276223 - DNA, 20 bp, Artificial Sequence
  Description of Artificial Sequence: Synthetic oligonucleotide
  Target: ATXN1; (+) strand; PAM type: YTN; PAM sequence: TTC
taaataattcatgcagatgt

SEQ ID NO: 276224 - DNA, 20 bp, Artificial Sequence
  Description of Artificial Sequence: Synthetic oligonucleotide
  Target: ATXN1; (+) strand; PAM type: YTN; PAM sequence: CTA
aataattcatgcagatgttc

SEQ ID NO: 276225 - DNA, 20 bp, Artificial Sequence
  Description of Artificial Sequence: Synthetic oligonucleotide
  Target: ATXN1; (+) strand; PAM type: YTN; PAM sequence: TTC
atgcagatgttctgcccttg

SEQ ID NO: 276226 - DNA, 20 bp, Artificial Sequence
  Description of Artificial Sequence: Synthetic oligonucleotide
  Target: ATXN1; (+) strand; PAM type: YTN; PAM sequence: TTC
tgcccttgtaaaggtagagc

SEQ ID NO: 276227 - DNA, 20 bp, Artificial Sequence
  Description of Artificial Sequence: Synthetic oligonucleotide
  Target: ATXN1; (+) strand; PAM type: YTN; PAM sequence: CTG
cccttgtaaaggtagagcgt

SEQ ID NO: 276228 - DNA, 20 bp, Artificial Sequence
  Description of Artificial Sequence: Synthetic oligonucleotide
  Target: ATXN1; (+) strand; PAM type: YTN; PAM sequence: CTT
gtaaaggtagagcgtaactg

SEQ ID NO: 276229 - DNA, 20 bp, Artificial Sequence
  Description of Artificial Sequence: Synthetic oligonucleotide
  Target: ATXN1; (+) strand; PAM type: YTN; PAM sequence: TTG
taaaggtagagcgtaactgc

SEQ ID NO: 276230 - DNA, 20 bp, Artificial Sequence
  Description of Artificial Sequence: Synthetic oligonucleotide
  Target: ATXN1; (+) strand; PAM type: YTN; PAM sequence: CTG
cccaccccttaagtgtgggc

SEQ ID NO: 276231 - DNA, 20 bp, Artificial Sequence
  Description of Artificial Sequence: Synthetic oligonucleotide
  Target: ATXN1; (+) strand; PAM type: YTN; PAM sequence: CTT
aagtgtgggctgtgcacagt

SEQ ID NO: 276232 - DNA, 20 bp, Artificial Sequence
  Description of Artificial Sequence: Synthetic oligonucleotide
  Target: ATXN1; (+) strand; PAM type: YTN; PAM sequence: TTA
agtgtgggctgtgcacagtg

SEQ ID NO: 276233 - DNA, 20 bp, Artificial Sequence
  Description of Artificial Sequence: Synthetic oligonucleotide
  Target: ATXN1; (+) strand; PAM type: YTN; PAM sequence: CTG
tgcacagtgacttccttcca

SEQ ID NO: 276234 - DNA, 20 bp, Artificial Sequence
  Description of Artificial Sequence: Synthetic oligonucleotide
  Target: ATXN1; (+) strand; PAM type: YTN; PAM sequence: CTT
ccttccaacgagtagtacag

SEQ ID NO: 276235 - DNA, 20 bp, Artificial Sequence
  Description of Artificial Sequence: Synthetic oligonucleotide
  Target: ATXN1; (+) strand; PAM type: YTN; PAM sequence: TTC
cttccaacgagtagtacagt

SEQ ID NO: 276236 - DNA, 20 bp, Artificial Sequence
  Description of Artificial Sequence: Synthetic oligonucleotide
  Target: ATXN1; (+) strand; PAM type: YTN; PAM sequence: CTT
ccaacgagtagtacagtatg

SEQ ID NO: 276237 - DNA, 20 bp, Artificial Sequence
  Description of Artificial Sequence: Synthetic oligonucleotide
  Target: ATXN1; (+) strand; PAM type: YTN; PAM sequence: TTC
caacgagtagtacagtatgg

SEQ ID NO: 276238 - DNA, 20 bp, Artificial Sequence
  Description of Artificial Sequence: Synthetic oligonucleotide
  Target: ATXN1; (+) strand; PAM type: YTN; PAM sequence: CTG
tgtacaaagagtaactttaa

SEQ ID NO: 276239 - DNA, 20 bp, Artificial Sequence
  Description of Artificial Sequence: Synthetic oligonucleotide
  Target: ATXN1; (+) strand; PAM type: YTN; PAM sequence: CTT
taaagttgacaaaccctgac

SEQ ID NO: 276240 - DNA, 20 bp, Artificial Sequence
  Description of Artificial Sequence: Synthetic oligonucleotide
  Target: ATXN1; (+) strand; PAM type: YTN; PAM sequence: TTT
aaagttgacaaaccctgaca

SEQ ID NO: 276241 - DNA, 20 bp, Artificial Sequence
  Description of Artificial Sequence: Synthetic oligonucleotide
  Target: ATXN1; (+) strand; PAM type: YTN; PAM sequence: TTA
aagttgacaaaccctgacac

SEQ ID NO: 276242 - DNA, 20 bp, Artificial Sequence
  Description of Artificial Sequence: Synthetic oligonucleotide
  Target: ATXN1; (+) strand; PAM type: YTN; PAM sequence: TTG
acaaaccctgacacaacctc

SEQ ID NO: 276243 - DNA, 20 bp, Artificial Sequence
  Description of Artificial Sequence: Synthetic oligonucleotide
  Target: ATXN1; (+) strand; PAM type: YTN; PAM sequence: CTG
acacaacctcggctgaggtc

SEQ ID NO: 276244 - DNA, 20 bp, Artificial Sequence
  Description of Artificial Sequence: Synthetic oligonucleotide
  Target: ATXN1; (+) strand; PAM type: YTN; PAM sequence: CTC
ggctgaggtcatcaagatca

SEQ ID NO: 276245 - DNA, 20 bp, Artificial Sequence
  Description of Artificial Sequence: Synthetic oligonucleotide
  Target: ATXN1; (+) strand; PAM type: YTN; PAM sequence: CTG
aggtcatcaagatcaacagc

SEQ ID NO: 276246 - DNA, 20 bp, Artificial Sequence
  Description of Artificial Sequence: Synthetic oligonucleotide
  Target: ATXN1; (+) strand; PAM type: YTN; PAM sequence: CTG
ccaattttaaggagtacaga

SEQ ID NO: 276247 - DNA, 20 bp, Artificial Sequence
  Description of Artificial Sequence: Synthetic oligonucleotide
  Target: ATXN1; (+) strand; PAM type: YTN; PAM sequence: TTT
taaggagtacagactaatca

SEQ ID NO: 276248 - DNA, 20 bp, Artificial Sequence
  Description of Artificial Sequence: Synthetic oligonucleotide
  Target: ATXN1; (+) strand; PAM type: YTN; PAM sequence: TTT
aaggagtacagactaatcat

SEQ ID NO: 276249 - DNA, 20 bp, Artificial Sequence
  Description of Artificial Sequence: Synthetic oligonucleotide
  Target: ATXN1; (+) strand; PAM type: YTN; PAM sequence: TTA
aggagtacagactaatcatt

SEQ ID NO: 276250 - DNA, 20 bp, Artificial Sequence
  Description of Artificial Sequence: Synthetic oligonucleotide
  Target: ATXN1; (+) strand; PAM type: YTN; PAM sequence: CTA
atcattttgtggactgtccc

SEQ ID NO: 276251 - DNA, 20 bp, Artificial Sequence
  Description of Artificial Sequence: Synthetic oligonucleotide
  Target: ATXN1; (+) strand; PAM type: YTN; PAM sequence: TTT
tgtggactgtccctcaattt

SEQ ID NO: 276252 - DNA, 20 bp, Artificial Sequence
  Description of Artificial Sequence: Synthetic oligonucleotide
  Target: ATXN1; (+) strand; PAM type: YTN; PAM sequence: TTT
gtggactgtccctcaatttg

SEQ ID NO: 276253 - DNA, 20 bp, Artificial Sequence
  Description of Artificial Sequence: Synthetic oligonucleotide
  Target: ATXN1; (+) strand; PAM type: YTN; PAM sequence: TTG
tggactgtccctcaatttgg

SEQ ID NO: 276254 - DNA, 20 bp, Artificial Sequence
  Description of Artificial Sequence: Synthetic oligonucleotide
  Target: ATXN1; (+) strand; PAM type: YTN; PAM sequence: CTG
tccctcaatttgggtttttc

SEQ ID NO: 276255 - DNA, 20 bp, Artificial Sequence
  Description of Artificial Sequence: Synthetic oligonucleotide
  Target: ATXN1; (+) strand; PAM type: YTN; PAM sequence: CTC
aatttgggtttttctggcca

SEQ ID NO: 276256 - DNA, 20 bp, Artificial Sequence
  Description of Artificial Sequence: Synthetic oligonucleotide
  Target: ATXN1; (+) strand; PAM type: YTN; PAM sequence: TTT
gggtttttctggccaggcat

SEQ ID NO: 276257 - DNA, 20 bp, Artificial Sequence
  Description of Artificial Sequence: Synthetic oligonucleotide
  Target: ATXN1; (+) strand; PAM type: YTN; PAM sequence: TTG
ggtttttctggccaggcatg

SEQ ID NO: 276258 - DNA, 20 bp, Artificial Sequence
  Description of Artificial Sequence: Synthetic oligonucleotide
  Target: ATXN1; (+) strand; PAM type: YTN; PAM sequence: TTT
ttctggccaggcatggttgg

SEQ ID NO: 276259 - DNA, 20 bp, Artificial Sequence
  Description of Artificial Sequence: Synthetic oligonucleotide
  Target: ATXN1; (+) strand; PAM type: YTN; PAM sequence: TTT
tctggccaggcatggttggc

SEQ ID NO: 276260 - DNA, 20 bp, Artificial Sequence
  Description of Artificial Sequence: Synthetic oligonucleotide
  Target: ATXN1; (+) strand; PAM type: YTN; PAM sequence: TTT
ctggccaggcatggttggct

SEQ ID NO: 276261 - DNA, 20 bp, Artificial Sequence
  Description of Artificial Sequence: Synthetic oligonucleotide
  Target: ATXN1; (+) strand; PAM type: YTN; PAM sequence: TTC
tggccaggcatggttggctc

SEQ ID NO: 276262 - DNA, 20 bp, Artificial Sequence
  Description of Artificial Sequence: Synthetic oligonucleotide
  Target: ATXN1; (+) strand; PAM type: YTN; PAM sequence: CTG
gccaggcatggttggctcac

SEQ ID NO: 276263 - DNA, 20 bp, Artificial Sequence
  Description of Artificial Sequence: Synthetic oligonucleotide
  Target: ATXN1; (+) strand; PAM type: YTN; PAM sequence: TTG
gctcacgcctgtaatcccag

SEQ ID NO: 276264 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 276265 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgtggg

SEQ ID NO: 276266 - DNA, 20 bp, Artificial Sequence
  Description of Artificial Sequence: Synthetic oligonucleotide
  Target: ATXN1; (+) strand; PAM type: YTN; PAM sequence: CTT
tgtggggccaaagagggtgg

SEQ ID NO: 276267 - DNA, 20 bp, Artificial Sequence
  Description of Artificial Sequence: Synthetic oligonucleotide
  Target: ATXN1; (+) strand; PAM type: YTN; PAM sequence: TTT
gtggggccaaagagggtgga

SEQ ID NO: 276268 - DNA, 20 bp, Artificial Sequence
  Description of Artificial Sequence: Synthetic oligonucleotide
  Target: ATXN1; (+) strand; PAM type: YTN; PAM sequence: TTG
tggggccaaagagggtggat

SEQ ID NO: 276269 - DNA, 20 bp, Artificial Sequence
  Description of Artificial Sequence: Synthetic oligonucleotide
  Target: ATXN1; (+) strand; PAM type: YTN; PAM sequence: CTT
gagcccagaagtttgacacc

SEQ ID NO: 276270 - DNA, 20 bp, Artificial Sequence
  Description of Artificial Sequence: Synthetic oligonucleotide
  Target: ATXN1; (+) strand; PAM type: YTN; PAM sequence: TTG
agcccagaagtttgacacca

SEQ ID NO: 276271 - DNA, 20 bp, Artificial Sequence
  Description of Artificial Sequence: Synthetic oligonucleotide
  Target: ATXN1; (+) strand; PAM type: YTN; PAM sequence: TTT
gacaccagcctggcaaaacc

SEQ ID NO: 276272 - DNA, 20 bp, Artificial Sequence
  Description of Artificial Sequence: Synthetic oligonucleotide
  Target: ATXN1; (+) strand; PAM type: YTN; PAM sequence: TTG
acaccagcctggcaaaaccc

SEQ ID NO: 276273 - DNA, 20 bp, Artificial Sequence
  Description of Artificial Sequence: Synthetic oligonucleotide
  Target: ATXN1; (+) strand; PAM type: YTN; PAM sequence: CTG
gcaaaaccctgactctacca

SEQ ID NO: 276274 - DNA, 20 bp, Artificial Sequence
  Description of Artificial Sequence: Synthetic oligonucleotide
  Target: ATXN1; (+) strand; PAM type: YTN; PAM sequence: CTG
actctaccaaaaaaaaacca

SEQ ID NO: 276275 - DNA, 20 bp, Artificial Sequence
  Description of Artificial Sequence: Synthetic oligonucleotide
  Target: ATXN1; (+) strand; PAM type: YTN; PAM sequence: CTC
taccaaaaaaaaaccaaaaa

SEQ ID NO: 276276 - DNA, 20 bp, Artificial Sequence
  Description of Artificial Sequence: Synthetic oligonucleotide
  Target: ATXN1; (+) strand; PAM type: YTN; PAM sequence: CTA
ccaaaaaaaaaccaaaaacc

SEQ ID NO: 276277 - DNA, 20 bp, Artificial Sequence
  Description of Artificial Sequence: Synthetic oligonucleotide
  Target: ATXN1; (+) strand; PAM type: YTN; PAM sequence: TTA
gctggatgtggtagcctatg

SEQ ID NO: 276278 - DNA, 20 bp, Artificial Sequence
  Description of Artificial Sequence: Synthetic oligonucleotide
  Target: ATXN1; (+) strand; PAM type: YTN; PAM sequence: CTG
gatgtggtagcctatgcctg

SEQ ID NO: 276279 - DNA, 20 bp, Artificial Sequence
  Description of Artificial Sequence: Synthetic oligonucleotide
  Target: ATXN1; (+) strand; PAM type: YTN; PAM sequence: CTA
tgcctgtagtcccagctact

SEQ ID NO: 276280 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcagggg

SEQ ID NO: 276281 - DNA, 20 bp, Artificial Sequence
  Description of Artificial Sequence: Synthetic oligonucleotide
  Target: ATXN1; (+) strand; PAM type: YTN; PAM sequence: CTA
ctcagggggctaagatggga

SEQ ID NO: 276282 - DNA, 20 bp, Artificial Sequence
  Description of Artificial Sequence: Synthetic oligonucleotide
  Target: ATXN1; (+) strand; PAM type: YTN; PAM sequence: CTC
agggggctaagatgggagga

SEQ ID NO: 276283 - DNA, 20 bp, Artificial Sequence
  Description of Artificial Sequence: Synthetic oligonucleotide
  Target: ATXN1; (+) strand; PAM type: YTN; PAM sequence: CTA
agatgggaggattgcttaag

SEQ ID NO: 276284 - DNA, 20 bp, Artificial Sequence
  Description of Artificial Sequence: Synthetic oligonucleotide
  Target: ATXN1; (+) strand; PAM type: YTN; PAM sequence: TTG
cttaagccccgaaggtccag

SEQ ID NO: 276285 - DNA, 20 bp, Artificial Sequence
  Description of Artificial Sequence: Synthetic oligonucleotide
  Target: ATXN1; (+) strand; PAM type: YTN; PAM sequence: CTT
aagccccgaaggtccagtct

SEQ ID NO: 276286 - DNA, 20 bp, Artificial Sequence
  Description of Artificial Sequence: Synthetic oligonucleotide
  Target: ATXN1; (+) strand; PAM type: YTN; PAM sequence: TTA
agccccgaaggtccagtctg

SEQ ID NO: 276287 - DNA, 20 bp, Artificial Sequence
  Description of Artificial Sequence: Synthetic oligonucleotide
  Target: ATXN1; (+) strand; PAM type: YTN; PAM sequence: CTG
cagtgagctgagatcgtacc

SEQ ID NO: 276288 - DNA, 20 bp, Artificial Sequence
  Description of Artificial Sequence: Synthetic oligonucleotide
  Target: ATXN1; (+) strand; PAM type: YTN; PAM sequence: CTG
agatcgtaccactgcactcc

SEQ ID NO: 276289 - DNA, 20 bp, Artificial Sequence
  Description of Artificial Sequence: Synthetic oligonucleotide
  Target: ATXN1; (+) strand; PAM type: YTN; PAM sequence: CTG
cactccaacctgggcgacag

SEQ ID NO: 276290 - DNA, 20 bp, Artificial Sequence
  Description of Artificial Sequence: Synthetic oligonucleotide
  Target: ATXN1; (+) strand; PAM type: YTN; PAM sequence: CTC
caacctgggcgacagagtga

SEQ ID NO: 276291 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagtgagaccctg

SEQ ID NO: 276292 - DNA, 20 bp, Artificial Sequence
  Description of Artificial Sequence: Synthetic oligonucleotide
  Target: ATXN1; (+) strand; PAM type: YTN; PAM sequence: CTG
tctcaacaataataataata

SEQ ID NO: 276293 - DNA, 20 bp, Artificial Sequence
  Description of Artificial Sequence: Synthetic oligonucleotide
  Target: ATXN1; (+) strand; PAM type: YTN; PAM sequence: CTC
aacaataataataataatag

SEQ ID NO: 276294 - DNA, 20 bp, Artificial Sequence
  Description of Artificial Sequence: Synthetic oligonucleotide
  Target: ATXN1; (+) strand; PAM type: YTN; PAM sequence: TTT
acctaaaagcaagaactaaa

SEQ ID NO: 276295 - DNA, 20 bp, Artificial Sequence
  Description of Artificial Sequence: Synthetic oligonucleotide
  Target: ATXN1; (+) strand; PAM type: YTN; PAM sequence: TTA
cctaaaagcaagaactaaag

SEQ ID NO: 276296 - DNA, 20 bp, Artificial Sequence
  Description of Artificial Sequence: Synthetic oligonucleotide
  Target: ATXN1; (+) strand; PAM type: YTN; PAM sequence: CTA
aaagcaagaactaaagccaa

SEQ ID NO: 276297 - DNA, 20 bp, Artificial Sequence
  Description of Artificial Sequence: Synthetic oligonucleotide
  Target: ATXN1; (+) strand; PAM type: YTN; PAM sequence: CTA
aagccaatattttattttga

SEQ ID NO: 276298 - DNA, 20 bp, Artificial Sequence
  Description of Artificial Sequence: Synthetic oligonucleotide
  Target: ATXN1; (+) strand; PAM type: YTN; PAM sequence: TTT
tattttgattgagtaatgat

SEQ ID NO: 276299 - DNA, 20 bp, Artificial Sequence
  Description of Artificial Sequence: Synthetic oligonucleotide
  Target: ATXN1; (+) strand; PAM type: YTN; PAM sequence: TTT
attttgattgagtaatgata

SEQ ID NO: 276300 - DNA, 20 bp, Artificial Sequence
  Description of Artificial Sequence: Synthetic oligonucleotide
  Target: ATXN1; (+) strand; PAM type: YTN; PAM sequence: TTA
ttttgattgagtaatgatac

SEQ ID NO: 276301 - DNA, 20 bp, Artificial Sequence
  Description of Artificial Sequence: Synthetic oligonucleotide
  Target: ATXN1; (+) strand; PAM type: YTN; PAM sequence: TTT
tgattgagtaatgatacaca

SEQ ID NO: 276302 - DNA, 20 bp, Artificial Sequence
  Description of Artificial Sequence: Synthetic oligonucleotide
  Target: ATXN1; (+) strand; PAM type: YTN; PAM sequence: TTT
gattgagtaatgatacacaa

SEQ ID NO: 276303 - DNA, 20 bp, Artificial Sequence
  Description of Artificial Sequence: Synthetic oligonucleotide
  Target: ATXN1; (+) strand; PAM type: YTN; PAM sequence: TTG
attgagtaatgatacacaat

SEQ ID NO: 276304 - DNA, 20 bp, Artificial Sequence
  Description of Artificial Sequence: Synthetic oligonucleotide
  Target: ATXN1; (+) strand; PAM type: YTN; PAM sequence: TTG
agtaatgatacacaataact

SEQ ID NO: 276305 - DNA, 20 bp, Artificial Sequence
  Description of Artificial Sequence: Synthetic oligonucleotide
  Target: ATXN1; (+) strand; PAM type: YTN; PAM sequence: CTA
gtcttgaagggcatcaacta

SEQ ID NO: 276306 - DNA, 20 bp, Artificial Sequence
  Description of Artificial Sequence: Synthetic oligonucleotide
  Target: ATXN1; (+) strand; PAM type: YTN; PAM sequence: CTT
gaagggcatcaactaaaaca

SEQ ID NO: 276307 - DNA, 20 bp, Artificial Sequence
  Description of Artificial Sequence: Synthetic oligonucleotide
  Target: ATXN1; (+) strand; PAM type: YTN; PAM sequence: TTG
aagggcatcaactaaaacat

SEQ ID NO: 276308 - DNA, 20 bp, Artificial Sequence
  Description of Artificial Sequence: Synthetic oligonucleotide
  Target: ATXN1; (+) strand; PAM type: YTN; PAM sequence: CTA
aaacatgatggactgcagga

SEQ ID NO: 276309 - DNA, 20 bp, Artificial Sequence
  Description of Artificial Sequence: Synthetic oligonucleotide
  Target: ATXN1; (+) strand; PAM type: YTN; PAM sequence: CTG
caggatggacagatggcttg

SEQ ID NO: 276310 - DNA, 20 bp, Artificial Sequence
  Description of Artificial Sequence: Synthetic oligonucleotide
  Target: ATXN1; (+) strand; PAM type: YTN; PAM sequence: CTT
gatacctgacaaagcaaata

SEQ ID NO: 276311 - DNA, 20 bp, Artificial Sequence
  Description of Artificial Sequence: Synthetic oligonucleotide
  Target: ATXN1; (+) strand; PAM type: YTN; PAM sequence: TTG
atacctgacaaagcaaatat

SEQ ID NO: 276312 - DNA, 20 bp, Artificial Sequence
  Description of Artificial Sequence: Synthetic oligonucleotide
  Target: ATXN1; (+) strand; PAM type: YTN; PAM sequence: CTG
acaaagcaaatatagcaaaa

SEQ ID NO: 276313 - DNA, 20 bp, Artificial Sequence
  Description of Artificial Sequence: Synthetic oligonucleotide
  Target: ATXN1; (+) strand; PAM type: YTN; PAM sequence: TTA
tttgcaaaatctaggtggca

SEQ ID NO: 276314 - DNA, 20 bp, Artificial Sequence
  Description of Artificial Sequence: Synthetic oligonucleotide
  Target: ATXN1; (+) strand; PAM type: YTN; PAM sequence: TTT
gcaaaatctaggtggcaagt

SEQ ID NO: 276315 - DNA, 20 bp, Artificial Sequence
  Description of Artificial Sequence: Synthetic oligonucleotide
  Target: ATXN1; (+) strand; PAM type: YTN; PAM sequence: TTG
caaaatctaggtggcaagtt

SEQ ID NO: 276316 - DNA, 20 bp, Artificial Sequence
  Description of Artificial Sequence: Synthetic oligonucleotide
  Target: ATXN1; (+) strand; PAM type: YTN; PAM sequence: CTA
ggtggcaagtttatgggtgt

SEQ ID NO: 276317 - DNA, 20 bp, Artificial Sequence
  Description of Artificial Sequence: Synthetic oligonucleotide
  Target: ATXN1; (+) strand; PAM type: YTN; PAM sequence: TTT
atgggtgttcactgtacaat

SEQ ID NO: 276318 - DNA, 20 bp, Artificial Sequence
  Description of Artificial Sequence: Synthetic oligonucleotide
  Target: ATXN1; (+) strand; PAM type: YTN; PAM sequence: TTA
tgggtgttcactgtacaatt

SEQ ID NO: 276319 - DNA, 20 bp, Artificial Sequence
  Description of Artificial Sequence: Synthetic oligonucleotide
  Target: ATXN1; (+) strand; PAM type: YTN; PAM sequence: TTC
actgtacaattcttacaatt

SEQ ID NO: 276320 - DNA, 20 bp, Artificial Sequence
  Description of Artificial Sequence: Synthetic oligonucleotide
  Target: ATXN1; (+) strand; PAM type: YTN; PAM sequence: CTG
tacaattcttacaatttact

SEQ ID NO: 276321 - DNA, 20 bp, Artificial Sequence
  Description of Artificial Sequence: Synthetic oligonucleotide
  Target: ATXN1; (+) strand; PAM type: YTN; PAM sequence: TTC
ttacaatttacttgtatgtt

SEQ ID NO: 276322 - DNA, 20 bp, Artificial Sequence
  Description of Artificial Sequence: Synthetic oligonucleotide
  Target: ATXN1; (+) strand; PAM type: YTN; PAM sequence: CTT
acaatttacttgtatgtttg

SEQ ID NO: 276323 - DNA, 20 bp, Artificial Sequence
  Description of Artificial Sequence: Synthetic oligonucleotide
  Target: ATXN1; (+) strand; PAM type: YTN; PAM sequence: TTA
caatttacttgtatgtttgc

SEQ ID NO: 276324 - DNA, 20 bp, Artificial Sequence
  Description of Artificial Sequence: Synthetic oligonucleotide
  Target: ATXN1; (+) strand; PAM type: YTN; PAM sequence: TTT
acttgtatgtttgcaatttt

SEQ ID NO: 276325 - DNA, 20 bp, Artificial Sequence
  Description of Artificial Sequence: Synthetic oligonucleotide
  Target: ATXN1; (+) strand; PAM type: YTN; PAM sequence: TTA
cttgtatgtttgcaattttt

SEQ ID NO: 276326 - DNA, 20 bp, Artificial Sequence
  Description of Artificial Sequence: Synthetic oligonucleotide
  Target: ATXN1; (+) strand; PAM type: YTN; PAM sequence: CTT
gtatgtttgcaatttttcct

SEQ ID NO: 276327 - DNA, 20 bp, Artificial Sequence
  Description of Artificial Sequence: Synthetic oligonucleotide
  Target: ATXN1; (+) strand; PAM type: YTN; PAM sequence: TTG
tatgtttgcaatttttccta

SEQ ID NO: 276328 - DNA, 20 bp, Artificial Sequence
  Description of Artificial Sequence: Synthetic oligonucleotide
  Target: ATXN1; (+) strand; PAM type: YTN; PAM sequence: TTT
gcaatttttcctaataaaat

SEQ ID NO: 276329 - DNA, 20 bp, Artificial Sequence
  Description of Artificial Sequence: Synthetic oligonucleotide
  Target: ATXN1; (+) strand; PAM type: YTN; PAM sequence: TTG
caatttttcctaataaaatg

SEQ ID NO: 276330 - DNA, 20 bp, Artificial Sequence
  Description of Artificial Sequence: Synthetic oligonucleotide
  Target: ATXN1; (+) strand; PAM type: YTN; PAM sequence: TTT
ttcctaataaaatgttgggg

SEQ ID NO: 276331 - DNA, 20 bp, Artificial Sequence
  Description of Artificial Sequence: Synthetic oligonucleotide
  Target: ATXN1; (+) strand; PAM type: YTN; PAM sequence: TTT
tcctaataaaatgttggggg

SEQ ID NO: 276332 - DNA, 20 bp, Artificial Sequence
  Description of Artificial Sequence: Synthetic oligonucleotide
  Target: ATXN1; (+) strand; PAM type: YTN; PAM sequence: TTT
cctaataaaatgttgggggg

SEQ ID NO: 276333 - DNA, 20 bp, Artificial Sequence
  Description of Artificial Sequence: Synthetic oligonucleotide
  Target: ATXN1; (+) strand; PAM type: YTN; PAM sequence: TTC
ctaataaaatgttgggggga

SEQ ID NO: 276334 - DNA, 20 bp, Artificial Sequence
  Description of Artificial Sequence: Synthetic oligonucleotide
  Target: ATXN1; (+) strand; PAM type: YTN; PAM sequence: CTA
ataaaatgttggggggaaag

SEQ ID NO: 276335 - DNA, 20 bp, Artificial Sequence
  Description of Artificial Sequence: Synthetic oligonucleotide
  Target: ATXN1; (+) strand; PAM type: YTN; PAM sequence: TTG
gggggaaagtctctcgtgaa

SEQ ID NO: 276336 - DNA, 20 bp, Artificial Sequence
  Description of Artificial Sequence: Synthetic oligonucleotide
  Target: ATXN1; (+) strand; PAM type: YTN; PAM sequence: CTC
tcgtgaacaactctgcccag

SEQ ID NO: 276337 - DNA, 20 bp, Artificial Sequence
  Description of Artificial Sequence: Synthetic oligonucleotide
  Target: ATXN1; (+) strand; PAM type: YTN; PAM sequence: CTC
gtgaacaactctgcccagtc

SEQ ID NO: 276338 - DNA, 20 bp, Artificial Sequence
  Description of Artificial Sequence: Synthetic oligonucleotide
  Target: ATXN1; (+) strand; PAM type: YTN; PAM sequence: CTC
tgcccagtcatagaagagtt

SEQ ID NO: 276339 - DNA, 20 bp, Artificial Sequence
  Description of Artificial Sequence: Synthetic oligonucleotide
  Target: ATXN1; (+) strand; PAM type: YTN; PAM sequence: CTG
cccagtcatagaagagtttc

SEQ ID NO: 276340 - DNA, 20 bp, Artificial Sequence
  Description of Artificial Sequence: Synthetic oligonucleotide
  Target: ATXN1; (+) strand; PAM type: YTN; PAM sequence: TTT
cccaggaaagatttatttag

SEQ ID NO: 276341 - DNA, 20 bp, Artificial Sequence
  Description of Artificial Sequence: Synthetic oligonucleotide
  Target: ATXN1; (+) strand; PAM type: YTN; PAM sequence: TTC
ccaggaaagatttatttagc

SEQ ID NO: 276342 - DNA, 20 bp, Artificial Sequence
  Description of Artificial Sequence: Synthetic oligonucleotide
  Target: ATXN1; (+) strand; PAM type: YTN; PAM sequence: TTT
atttagcccaaatatgcatg

SEQ ID NO: 276343 - DNA, 20 bp, Artificial Sequence
  Description of Artificial Sequence: Synthetic oligonucleotide
  Target: ATXN1; (+) strand; PAM type: YTN; PAM sequence: TTA
tttagcccaaatatgcatgt

SEQ ID NO: 276344 - DNA, 20 bp, Artificial Sequence
  Description of Artificial Sequence: Synthetic oligonucleotide
  Target: ATXN1; (+) strand; PAM type: YTN; PAM sequence: TTT
agcccaaatatgcatgtatc

SEQ ID NO: 276345 - DNA, 20 bp, Artificial Sequence
  Description of Artificial Sequence: Synthetic oligonucleotide
  Target: ATXN1; (+) strand; PAM type: YTN; PAM sequence: TTA
gcccaaatatgcatgtatct

SEQ ID NO: 276346 - DNA, 20 bp, Artificial Sequence
  Description of Artificial Sequence: Synthetic oligonucleotide
  Target: ATXN1; (+) strand; PAM type: YTN; PAM sequence: CTG
acttttgggggacatctcat

SEQ ID NO: 276347 - DNA, 20 bp, Artificial Sequence
  Description of Artificial Sequence: Synthetic oligonucleotide
  Target: ATXN1; (+) strand; PAM type: YTN; PAM sequence: CTT
ttgggggacatctcatttaa

SEQ ID NO: 276348 - DNA, 20 bp, Artificial Sequence
  Description of Artificial Sequence: Synthetic oligonucleotide
  Target: ATXN1; (+) strand; PAM type: YTN; PAM sequence: TTT
tgggggacatctcatttaac

SEQ ID NO: 276349 - DNA, 20 bp, Artificial Sequence
  Description of Artificial Sequence: Synthetic oligonucleotide
  Target: ATXN1; (+) strand; PAM type: YTN; PAM sequence: TTT
gggggacatctcatttaaca

SEQ ID NO: 276350 - DNA, 20 bp, Artificial Sequence
  Description of Artificial Sequence: Synthetic oligonucleotide
  Target: ATXN1; (+) strand; PAM type: YTN; PAM sequence: TTG
ggggacatctcatttaacaa

SEQ ID NO: 276351 - DNA, 20 bp, Artificial Sequence
  Description of Artificial Sequence: Synthetic oligonucleotide
  Target: ATXN1; (+) strand; PAM type: YTN; PAM sequence: CTC
atttaacaaaaattaggctt

SEQ ID NO: 276352 - DNA, 20 bp, Artificial Sequence
  Description of Artificial Sequence: Synthetic oligonucleotide
  Target: ATXN1; (+) strand; PAM type: YTN; PAM sequence: TTT
aacaaaaattaggcttctga

SEQ ID NO: 276353 - DNA, 20 bp, Artificial Sequence
  Description of Artificial Sequence: Synthetic oligonucleotide
  Target: ATXN1; (+) strand; PAM type: YTN; PAM sequence: TTA
acaaaaattaggcttctgat

SEQ ID NO: 276354 - DNA, 20 bp, Artificial Sequence
  Description of Artificial Sequence: Synthetic oligonucleotide
  Target: ATXN1; (+) strand; PAM type: YTN; PAM sequence: TTA
ggcttctgatttctcctttt

SEQ ID NO: 276355 - DNA, 20 bp, Artificial Sequence
  Description of Artificial Sequence: Synthetic oligonucleotide
  Target: ATXN1; (+) strand; PAM type: YTN; PAM sequence: CTT
ctgatttctccttttaacct

SEQ ID NO: 276356 - DNA, 20 bp, Artificial Sequence
  Description of Artificial Sequence: Synthetic oligonucleotide
  Target: ATXN1; (+) strand; PAM type: YTN; PAM sequence: TTC
tgatttctccttttaacctc

SEQ ID NO: 276357 - DNA, 20 bp, Artificial Sequence
  Description of Artificial Sequence: Synthetic oligonucleotide
  Target: ATXN1; (+) strand; PAM type: YTN; PAM sequence: CTG
atttctccttttaacctctt

SEQ ID NO: 276358 - DNA, 20 bp, Artificial Sequence
  Description of Artificial Sequence: Synthetic oligonucleotide
  Target: ATXN1; (+) strand; PAM type: YTN; PAM sequence: TTT
ctccttttaacctcttttac

SEQ ID NO: 276359 - DNA, 20 bp, Artificial Sequence
  Description of Artificial Sequence: Synthetic oligonucleotide
  Target: ATXN1; (+) strand; PAM type: YTN; PAM sequence: TTC
tccttttaacctcttttaca

SEQ ID NO: 276360 - DNA, 20 bp, Artificial Sequence
  Description of Artificial Sequence: Synthetic oligonucleotide
  Target: ATXN1; (+) strand; PAM type: YTN; PAM sequence: CTC
cttttaacctcttttacaga

SEQ ID NO: 276361 - DNA, 20 bp, Artificial Sequence
  Description of Artificial Sequence: Synthetic oligonucleotide
  Target: ATXN1; (+) strand; PAM type: YTN; PAM sequence: CTT
ttaacctcttttacagaaaa

SEQ ID NO: 276362 - DNA, 20 bp, Artificial Sequence
  Description of Artificial Sequence: Synthetic oligonucleotide
  Target: ATXN1; (+) strand; PAM type: YTN; PAM sequence: TTT
taacctcttttacagaaaac

SEQ ID NO: 276363 - DNA, 20 bp, Artificial Sequence
  Description of Artificial Sequence: Synthetic oligonucleotide
  Target: ATXN1; (+) strand; PAM type: YTN; PAM sequence: TTT
aacctcttttacagaaaact

SEQ ID NO: 276364 - DNA, 20 bp, Artificial Sequence
  Description of Artificial Sequence: Synthetic oligonucleotide
  Target: ATXN1; (+) strand; PAM type: YTN; PAM sequence: TTA
acctcttttacagaaaactg

SEQ ID NO: 276365 - DNA, 20 bp, Artificial Sequence
  Description of Artificial Sequence: Synthetic oligonucleotide
  Target: ATXN1; (+) strand; PAM type: YTN; PAM sequence: CTC
ttttacagaaaactgccccc

SEQ ID NO: 276366 - DNA, 20 bp, Artificial Sequence
  Description of Artificial Sequence: Synthetic oligonucleotide
  Target: ATXN1; (+) strand; PAM type: YTN; PAM sequence: CTT
ttacagaaaactgcccccct

SEQ ID NO: 276367 - DNA, 20 bp, Artificial Sequence
  Description of Artificial Sequence: Synthetic oligonucleotide
  Target: ATXN1; (+) strand; PAM type: YTN; PAM sequence: TTT
tacagaaaactgcccccctt

SEQ ID NO: 276368 - DNA, 20 bp, Artificial Sequence
  Description of Artificial Sequence: Synthetic oligonucleotide
  Target: ATXN1; (+) strand; PAM type: YTN; PAM sequence: TTT
acagaaaactgcccccctta

SEQ ID NO: 276369 - DNA, 20 bp, Artificial Sequence
  Description of Artificial Sequence: Synthetic oligonucleotide
  Target: ATXN1; (+) strand; PAM type: YTN; PAM sequence: TTA
cagaaaactgccccccttag

SEQ ID NO: 276370 - DNA, 20 bp, Artificial Sequence
  Description of Artificial Sequence: Synthetic oligonucleotide
  Target: ATXN1; (+) strand; PAM type: YTN; PAM sequence: CTG
ccccccttagcagtgaaagg

SEQ ID NO: 276371 - DNA, 20 bp, Artificial Sequence
  Description of Artificial Sequence: Synthetic oligonucleotide
  Target: ATXN1; (+) strand; PAM type: YTN; PAM sequence: CTT
agcagtgaaaggcagcactt

SEQ ID NO: 276372 - DNA, 20 bp, Artificial Sequence
  Description of Artificial Sequence: Synthetic oligonucleotide
  Target: ATXN1; (+) strand; PAM type: YTN; PAM sequence: TTA
gcagtgaaaggcagcacttt

SEQ ID NO: 276373 - DNA, 20 bp, Artificial Sequence
  Description of Artificial Sequence: Synthetic oligonucleotide
  Target: ATXN1; (+) strand; PAM type: YTN; PAM sequence: CTT
ttgccaatgtgctattgcaa

SEQ ID NO: 276374 - DNA, 20 bp, Artificial Sequence
  Description of Artificial Sequence: Synthetic oligonucleotide
  Target: ATXN1; (+) strand; PAM type: YTN; PAM sequence: TTT
tgccaatgtgctattgcaat

SEQ ID NO: 276375 - DNA, 20 bp, Artificial Sequence
  Description of Artificial Sequence: Synthetic oligonucleotide
  Target: ATXN1; (+) strand; PAM type: YTN; PAM sequence: TTT
gccaatgtgctattgcaatg

SEQ ID NO: 276376 - DNA, 20 bp, Artificial Sequence
  Description of Artificial Sequence: Synthetic oligonucleotide
  Target: ATXN1; (+) strand; PAM type: YTN; PAM sequence: TTG
ccaatgtgctattgcaatgt

SEQ ID NO: 276377 - DNA, 20 bp, Artificial Sequence
  Description of Artificial Sequence: Synthetic oligonucleotide
  Target: ATXN1; (+) strand; PAM type: YTN; PAM sequence: CTA
ttgcaatgtgctactgcaat

SEQ ID NO: 276378 - DNA, 20 bp, Artificial Sequence
  Description of Artificial Sequence: Synthetic oligonucleotide
  Target: ATXN1; (+) strand; PAM type: YTN; PAM sequence: TTG
caatgtgctactgcaatgtg

SEQ ID NO: 276379 - DNA, 20 bp, Artificial Sequence
  Description of Artificial Sequence: Synthetic oligonucleotide
  Target: ATXN1; (+) strand; PAM type: YTN; PAM sequence: CTA
ctgcaatgtgcaatgcaatt

SEQ ID NO: 276380 - DNA, 20 bp, Artificial Sequence
  Description of Artificial Sequence: Synthetic oligonucleotide
  Target: ATXN1; (+) strand; PAM type: YTN; PAM sequence: CTG
caatgtgcaatgcaattagg

SEQ ID NO: 276381 - DNA, 20 bp, Artificial Sequence
  Description of Artificial Sequence: Synthetic oligonucleotide
  Target: ATXN1; (+) strand; PAM type: YTN; PAM sequence: TTA
ggctattaaataatagacaa

SEQ ID NO: 276382 - DNA, 20 bp, Artificial Sequence
  Description of Artificial Sequence: Synthetic oligonucleotide
  Target: ATXN1; (+) strand; PAM type: YTN; PAM sequence: CTA
ttaaataatagacaaaaggc

SEQ ID NO: 276383 - DNA, 20 bp, Artificial Sequence
  Description of Artificial Sequence: Synthetic oligonucleotide
  Target: ATXN1; (+) strand; PAM type: YTN; PAM sequence: TTA
aataatagacaaaaggccaa

SEQ ID NO: 276384 - DNA, 20 bp, Artificial Sequence
  Description of Artificial Sequence: Synthetic oligonucleotide
  Target: ATXN1; (+) strand; PAM type: YTN; PAM sequence: TTT
attaattagcaaaaagccat

SEQ ID NO: 276385 - DNA, 20 bp, Artificial Sequence
  Description of Artificial Sequence: Synthetic oligonucleotide
  Target: ATXN1; (+) strand; PAM type: YTN; PAM sequence: TTA
ttaattagcaaaaagccata

SEQ ID NO: 276386 - DNA, 20 bp, Artificial Sequence
  Description of Artificial Sequence: Synthetic oligonucleotide
  Target: ATXN1; (+) strand; PAM type: YTN; PAM sequence: TTA
attagcaaaaagccatatag

SEQ ID NO: 276387 - DNA, 20 bp, Artificial Sequence
  Description of Artificial Sequence: Synthetic oligonucleotide
  Target: ATXN1; (+) strand; PAM type: YTN; PAM sequence: TTA
gcaaaaagccatataggata

SEQ ID NO: 276388 - DNA, 20 bp, Artificial Sequence
  Description of Artificial Sequence: Synthetic oligonucleotide
  Target: ATXN1; (+) strand; PAM type: YTN; PAM sequence: CTC
tagactctgcagagctttat

SEQ ID NO: 276389 - DNA, 20 bp, Artificial Sequence
  Description of Artificial Sequence: Synthetic oligonucleotide
  Target: ATXN1; (+) strand; PAM type: YTN; PAM sequence: CTA
gactctgcagagctttatat

SEQ ID NO: 276390 - DNA, 20 bp, Artificial Sequence
  Description of Artificial Sequence: Synthetic oligonucleotide
  Target: ATXN1; (+) strand; PAM type: YTN; PAM sequence: CTC
tgcagagctttatattccac

SEQ ID NO: 276391 - DNA, 20 bp, Artificial Sequence
  Description of Artificial Sequence: Synthetic oligonucleotide
  Target: ATXN1; (+) strand; PAM type: YTN; PAM sequence: CTG
cagagctttatattccacat

SEQ ID NO: 276392 - DNA, 20 bp, Artificial Sequence
  Description of Artificial Sequence: Synthetic oligonucleotide
  Target: ATXN1; (+) strand; PAM type: YTN; PAM sequence: CTT
tatattccacatggaccctc

SEQ ID NO: 276393 - DNA, 20 bp, Artificial Sequence
  Description of Artificial Sequence: Synthetic oligonucleotide
  Target: ATXN1; (+) strand; PAM type: YTN; PAM sequence: TTT
atattccacatggaccctcc

SEQ ID NO: 276394 - DNA, 20 bp, Artificial Sequence
  Description of Artificial Sequence: Synthetic oligonucleotide
  Target: ATXN1; (+) strand; PAM type: YTN; PAM sequence: TTA
tattccacatggaccctcca

SEQ ID NO: 276395 - DNA, 20 bp, Artificial Sequence
  Description of Artificial Sequence: Synthetic oligonucleotide
  Target: ATXN1; (+) strand; PAM type: YTN; PAM sequence: TTC
cacatggaccctccaatcat

SEQ ID NO: 276396 - DNA, 20 bp, Artificial Sequence
  Description of Artificial Sequence: Synthetic oligonucleotide
  Target: ATXN1; (+) strand; PAM type: YTN; PAM sequence: CTC
caatcatttttgtggcttgg

SEQ ID NO: 276397 - DNA, 20 bp, Artificial Sequence
  Description of Artificial Sequence: Synthetic oligonucleotide
  Target: ATXN1; (+) strand; PAM type: YTN; PAM sequence: TTT
ttgtggcttggatggatttc

SEQ ID NO: 276398 - DNA, 20 bp, Artificial Sequence
  Description of Artificial Sequence: Synthetic oligonucleotide
  Target: ATXN1; (+) strand; PAM type: YTN; PAM sequence: TTT
tgtggcttggatggatttca

SEQ ID NO: 276399 - DNA, 20 bp, Artificial Sequence
  Description of Artificial Sequence: Synthetic oligonucleotide
  Target: ATXN1; (+) strand; PAM type: YTN; PAM sequence: TTT
gtggcttggatggatttcag

SEQ ID NO: 276400 - DNA, 20 bp, Artificial Sequence
  Description of Artificial Sequence: Synthetic oligonucleotide
  Target: ATXN1; (+) strand; PAM type: YTN; PAM sequence: TTG
tggcttggatggatttcagc

SEQ ID NO: 276401 - DNA, 20 bp, Artificial Sequence
  Description of Artificial Sequence: Synthetic oligonucleotide
  Target: ATXN1; (+) strand; PAM type: YTN; PAM sequence: CTT
ggatggatttcagcactggt

SEQ ID NO: 276402 - DNA, 20 bp, Artificial Sequence
  Description of Artificial Sequence: Synthetic oligonucleotide
  Target: ATXN1; (+) strand; PAM type: YTN; PAM sequence: TTG
gatggatttcagcactggta

SEQ ID NO: 276403 - DNA, 20 bp, Artificial Sequence
  Description of Artificial Sequence: Synthetic oligonucleotide
  Target: ATXN1; (+) strand; PAM type: YTN; PAM sequence: TTT
cagcactggtacttatcatg

SEQ ID NO: 276404 - DNA, 20 bp, Artificial Sequence
  Description of Artificial Sequence: Synthetic oligonucleotide
  Target: ATXN1; (+) strand; PAM type: YTN; PAM sequence: TTC
agcactggtacttatcatgg

SEQ ID NO: 276405 - DNA, 20 bp, Artificial Sequence
  Description of Artificial Sequence: Synthetic oligonucleotide
  Target: ATXN1; (+) strand; PAM type: YTN; PAM sequence: CTG
gtacttatcatggtcaaaga

SEQ ID NO: 276406 - DNA, 20 bp, Artificial Sequence
  Description of Artificial Sequence: Synthetic oligonucleotide
  Target: ATXN1; (+) strand; PAM type: YTN; PAM sequence: CTT
atcatggtcaaagatacatc

SEQ ID NO: 276407 - DNA, 20 bp, Artificial Sequence
  Description of Artificial Sequence: Synthetic oligonucleotide
  Target: ATXN1; (+) strand; PAM type: YTN; PAM sequence: TTA
tcatggtcaaagatacatca

SEQ ID NO: 276408 - DNA, 20 bp, Artificial Sequence
  Description of Artificial Sequence: Synthetic oligonucleotide
  Target: ATXN1; (+) strand; PAM type: YTN; PAM sequence: TTA
ttgctctagtcaatacacat

SEQ ID NO: 276409 - DNA, 20 bp, Artificial Sequence
  Description of Artificial Sequence: Synthetic oligonucleotide
  Target: ATXN1; (+) strand; PAM type: YTN; PAM sequence: TTG
ctctagtcaatacacatttt

SEQ ID NO: 276410 - DNA, 20 bp, Artificial Sequence
  Description of Artificial Sequence: Synthetic oligonucleotide
  Target: ATXN1; (+) strand; PAM type: YTN; PAM sequence: CTC
tagtcaatacacattttcat

SEQ ID NO: 276411 - DNA, 20 bp, Artificial Sequence
  Description of Artificial Sequence: Synthetic oligonucleotide
  Target: ATXN1; (+) strand; PAM type: YTN; PAM sequence: CTA
gtcaatacacattttcatta

SEQ ID NO: 276412 - DNA, 20 bp, Artificial Sequence
  Description of Artificial Sequence: Synthetic oligonucleotide
  Target: ATXN1; (+) strand; PAM type: YTN; PAM sequence: TTT
tcattaaatagcacatttat

SEQ ID NO: 276413 - DNA, 20 bp, Artificial Sequence
  Description of Artificial Sequence: Synthetic oligonucleotide
  Target: ATXN1; (+) strand; PAM type: YTN; PAM sequence: TTT
cattaaatagcacatttata

SEQ ID NO: 276414 - DNA, 20 bp, Artificial Sequence
  Description of Artificial Sequence: Synthetic oligonucleotide
  Target: ATXN1; (+) strand; PAM type: YTN; PAM sequence: TTC
attaaatagcacatttataa

SEQ ID NO: 276415 - DNA, 20 bp, Artificial Sequence
  Description of Artificial Sequence: Synthetic oligonucleotide
  Target: ATXN1; (+) strand; PAM type: YTN; PAM sequence: TTA
aatagcacatttataacaca

SEQ ID NO: 276416 - DNA, 20 bp, Artificial Sequence
  Description of Artificial Sequence: Synthetic oligonucleotide
  Target: ATXN1; (+) strand; PAM type: YTN; PAM sequence: TTT
ataacacatgtatttatttt

SEQ ID NO: 276417 - DNA, 20 bp, Artificial Sequence
  Description of Artificial Sequence: Synthetic oligonucleotide
  Target: ATXN1; (+) strand; PAM type: YTN; PAM sequence: TTA
taacacatgtatttatttta

SEQ ID NO: 276418 - DNA, 20 bp, Artificial Sequence
  Description of Artificial Sequence: Synthetic oligonucleotide
  Target: ATXN1; (+) strand; PAM type: YTN; PAM sequence: TTT
attttacaatttccataaac

SEQ ID NO: 276419 - DNA, 20 bp, Artificial Sequence
  Description of Artificial Sequence: Synthetic oligonucleotide
  Target: ATXN1; (+) strand; PAM type: YTN; PAM sequence: TTA
ttttacaatttccataaact

SEQ ID NO: 276420 - DNA, 20 bp, Artificial Sequence
  Description of Artificial Sequence: Synthetic oligonucleotide
  Target: ATXN1; (+) strand; PAM type: YTN; PAM sequence: TTT
tacaatttccataaacttgg

SEQ ID NO: 276421 - DNA, 20 bp, Artificial Sequence
  Description of Artificial Sequence: Synthetic oligonucleotide
  Target: ATXN1; (+) strand; PAM type: YTN; PAM sequence: TTT
acaatttccataaacttggt

SEQ ID NO: 276422 - DNA, 20 bp, Artificial Sequence
  Description of Artificial Sequence: Synthetic oligonucleotide
  Target: ATXN1; (+) strand; PAM type: YTN; PAM sequence: TTA
caatttccataaacttggtt

SEQ ID NO: 276423 - DNA, 20 bp, Artificial Sequence
  Description of Artificial Sequence: Synthetic oligonucleotide
  Target: ATXN1; (+) strand; PAM type: YTN; PAM sequence: TTT
ccataaacttggttatttac

SEQ ID NO: 276424 - DNA, 20 bp, Artificial Sequence
  Description of Artificial Sequence: Synthetic oligonucleotide
  Target: ATXN1; (+) strand; PAM type: YTN; PAM sequence: TTC
cataaacttggttatttact

SEQ ID NO: 276425 - DNA, 20 bp, Artificial Sequence
  Description of Artificial Sequence: Synthetic oligonucleotide
  Target: ATXN1; (+) strand; PAM type: YTN; PAM sequence: CTT
ggttatttactcattctacc

SEQ ID NO: 276426 - DNA, 20 bp, Artificial Sequence
  Description of Artificial Sequence: Synthetic oligonucleotide
  Target: ATXN1; (+) strand; PAM type: YTN; PAM sequence: TTG
gttatttactcattctacct

SEQ ID NO: 276427 - DNA, 20 bp, Artificial Sequence
  Description of Artificial Sequence: Synthetic oligonucleotide
  Target: ATXN1; (+) strand; PAM type: YTN; PAM sequence: TTA
tttactcattctaccttcaa

SEQ ID NO: 276428 - DNA, 20 bp, Artificial Sequence
  Description of Artificial Sequence: Synthetic oligonucleotide
  Target: ATXN1; (+) strand; PAM type: YTN; PAM sequence: TTT
actcattctaccttcaactc

SEQ ID NO: 276429 - DNA, 20 bp, Artificial Sequence
  Description of Artificial Sequence: Synthetic oligonucleotide
  Target: ATXN1; (+) strand; PAM type: YTN; PAM sequence: TTA
ctcattctaccttcaactct

SEQ ID NO: 276430 - DNA, 20 bp, Artificial Sequence
  Description of Artificial Sequence: Synthetic oligonucleotide
  Target: ATXN1; (+) strand; PAM type: YTN; PAM sequence: CTC
attctaccttcaactcttac

SEQ ID NO: 276431 - DNA, 20 bp, Artificial Sequence
  Description of Artificial Sequence: Synthetic oligonucleotide
  Target: ATXN1; (+) strand; PAM type: YTN; PAM sequence: TTC
taccttcaactcttacttgg

SEQ ID NO: 276432 - DNA, 20 bp, Artificial Sequence
  Description of Artificial Sequence: Synthetic oligonucleotide
  Target: ATXN1; (+) strand; PAM type: YTN; PAM sequence: CTA
ccttcaactcttacttggcc

SEQ ID NO: 276433 - DNA, 20 bp, Artificial Sequence
  Description of Artificial Sequence: Synthetic oligonucleotide
  Target: ATXN1; (+) strand; PAM type: YTN; PAM sequence: CTT
caactcttacttggccttag

SEQ ID NO: 276434 - DNA, 20 bp, Artificial Sequence
  Description of Artificial Sequence: Synthetic oligonucleotide
  Target: ATXN1; (+) strand; PAM type: YTN; PAM sequence: TTC
aactcttacttggccttagg

SEQ ID NO: 276435 - DNA, 20 bp, Artificial Sequence
  Description of Artificial Sequence: Synthetic oligonucleotide
  Target: ATXN1; (+) strand; PAM type: YTN; PAM sequence: CTC
ttacttggccttaggaaatg

SEQ ID NO: 276436 - DNA, 20 bp, Artificial Sequence
  Description of Artificial Sequence: Synthetic oligonucleotide
  Target: ATXN1; (+) strand; PAM type: YTN; PAM sequence: CTT
acttggccttaggaaatgta

SEQ ID NO: 276437 - DNA, 20 bp, Artificial Sequence
  Description of Artificial Sequence: Synthetic oligonucleotide
  Target: ATXN1; (+) strand; PAM type: YTN; PAM sequence: TTA
cttggccttaggaaatgtaa

SEQ ID NO: 276438 - DNA, 20 bp, Artificial Sequence
  Description of Artificial Sequence: Synthetic oligonucleotide
  Target: ATXN1; (+) strand; PAM type: YTN; PAM sequence: CTT
ggccttaggaaatgtaaaat

SEQ ID NO: 276439 - DNA, 20 bp, Artificial Sequence
  Description of Artificial Sequence: Synthetic oligonucleotide
  Target: ATXN1; (+) strand; PAM type: YTN; PAM sequence: TTG
gccttaggaaatgtaaaatc

SEQ ID NO: 276440 - DNA, 20 bp, Artificial Sequence
  Description of Artificial Sequence: Synthetic oligonucleotide
  Target: ATXN1; (+) strand; PAM type: YTN; PAM sequence: CTT
aggaaatgtaaaatcttttt

SEQ ID NO: 276441 - DNA, 20 bp, Artificial Sequence
  Description of Artificial Sequence: Synthetic oligonucleotide
  Target: ATXN1; (+) strand; PAM type: YTN; PAM sequence: TTA
ggaaatgtaaaatctttttt

SEQ ID NO: 276442 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttgataagag

SEQ ID NO: 276443 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgataagagg

SEQ ID NO: 276444 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgataagaggt

SEQ ID NO: 276445 - DNA, 20 bp, Artificial Sequence
  Description of Artificial Sequence: Synthetic oligonucleotide
  Target: ATXN1; (+) strand; PAM type: YTN; PAM sequence: TTT
tttttttttgataagaggtt

SEQ ID NO: 276446 - DNA, 20 bp, Artificial Sequence
  Description of Artificial Sequence: Synthetic oligonucleotide
  Target: ATXN1; (+) strand; PAM type: YTN; PAM sequence: TTT
ttttttttgataagaggttt

SEQ ID NO: 276447 - DNA, 20 bp, Artificial Sequence
  Description of Artificial Sequence: Synthetic oligonucleotide
  Target: ATXN1; (+) strand; PAM type: YTN; PAM sequence: TTT
tttttttgataagaggtttt

SEQ ID NO: 276448 - DNA, 20 bp, Artificial Sequence
  Description of Artificial Sequence: Synthetic oligonucleotide
  Target: ATXN1; (+) strand; PAM type: YTN; PAM sequence: TTT
ttttttgataagaggttttt

SEQ ID NO: 276449 - DNA, 20 bp, Artificial Sequence
  Description of Artificial Sequence: Synthetic oligonucleotide
  Target: ATXN1; (+) strand; PAM type: YTN; PAM sequence: TTT
tttttgataagaggtttttc

SEQ ID NO: 276450 - DNA, 20 bp, Artificial Sequence
  Description of Artificial Sequence: Synthetic oligonucleotide
  Target: ATXN1; (+) strand; PAM type: YTN; PAM sequence: TTT
ttttgataagaggtttttct

SEQ ID NO: 276451 - DNA, 20 bp, Artificial Sequence
  Description of Artificial Sequence: Synthetic oligonucleotide
  Target: ATXN1; (+) strand; PAM type: YTN; PAM sequence: TTT
tttgataagaggtttttctt

SEQ ID NO: 276452 - DNA, 20 bp, Artificial Sequence
  Description of Artificial Sequence: Synthetic oligonucleotide
  Target: ATXN1; (+) strand; PAM type: YTN; PAM sequence: TTT
ttgataagaggtttttcttg

SEQ ID NO: 276453 - DNA, 20 bp, Artificial Sequence
  Description of Artificial Sequence: Synthetic oligonucleotide
  Target: ATXN1; (+) strand; PAM type: YTN; PAM sequence: TTT
tgataagaggtttttcttga

SEQ ID NO: 276454 - DNA, 20 bp, Artificial Sequence
  Description of Artificial Sequence: Synthetic oligonucleotide
  Target: ATXN1; (+) strand; PAM type: YTN; PAM sequence: TTT
gataagaggtttttcttgaa

SEQ ID NO: 276455 - DNA, 20 bp, Artificial Sequence
  Description of Artificial Sequence: Synthetic oligonucleotide
  Target: ATXN1; (+) strand; PAM type: YTN; PAM sequence: TTG
ataagaggtttttcttgaaa

SEQ ID NO: 276456 - DNA, 20 bp, Artificial Sequence
  Description of Artificial Sequence: Synthetic oligonucleotide
  Target: ATXN1; (+) strand; PAM type: YTN; PAM sequence: TTT
ttcttgaaataggagttaat

SEQ ID NO: 276457 - DNA, 20 bp, Artificial Sequence
  Description of Artificial Sequence: Synthetic oligonucleotide
  Target: ATXN1; (+) strand; PAM type: YTN; PAM sequence: TTT
tcttgaaataggagttaatt

SEQ ID NO: 276458 - DNA, 20 bp, Artificial Sequence
  Description of Artificial Sequence: Synthetic oligonucleotide
  Target: ATXN1; (+) strand; PAM type: YTN; PAM sequence: TTT
cttgaaataggagttaatta

SEQ ID NO: 276459 - DNA, 20 bp, Artificial Sequence
  Description of Artificial Sequence: Synthetic oligonucleotide
  Target: ATXN1; (+) strand; PAM type: YTN; PAM sequence: TTC
ttgaaataggagttaattaa

SEQ ID NO: 276460 - DNA, 20 bp, Artificial Sequence
  Description of Artificial Sequence: Synthetic oligonucleotide
  Target: ATXN1; (+) strand; PAM type: YTN; PAM sequence: CTT
gaaataggagttaattaaaa

SEQ ID NO: 276461 - DNA, 20 bp, Artificial Sequence
  Description of Artificial Sequence: Synthetic oligonucleotide
  Target: ATXN1; (+) strand; PAM type: YTN; PAM sequence: TTG
aaataggagttaattaaaag

SEQ ID NO: 276462 - DNA, 20 bp, Artificial Sequence
  Description of Artificial Sequence: Synthetic oligonucleotide
  Target: ATXN1; (+) strand; PAM type: YTN; PAM sequence: TTA
attaaaagatttaaggaaaa

SEQ ID NO: 276463 - DNA, 20 bp, Artificial Sequence
  Description of Artificial Sequence: Synthetic oligonucleotide
  Target: ATXN1; (+) strand; PAM type: YTN; PAM sequence: TTA
aaagatttaaggaaaacgta

SEQ ID NO: 276464 - DNA, 20 bp, Artificial Sequence
  Description of Artificial Sequence: Synthetic oligonucleotide
  Target: ATXN1; (+) strand; PAM type: YTN; PAM sequence: TTT
aaggaaaacgtacctcttgt

SEQ ID NO: 276465 - DNA, 20 bp, Artificial Sequence
  Description of Artificial Sequence: Synthetic oligonucleotide
  Target: ATXN1; (+) strand; PAM type: YTN; PAM sequence: TTA
aggaaaacgtacctcttgtg

SEQ ID NO: 276466 - DNA, 20 bp, Artificial Sequence
  Description of Artificial Sequence: Synthetic oligonucleotide
  Target: ATXN1; (+) strand; PAM type: YTN; PAM sequence: CTC
ttgtgattcaaacatgagat

SEQ ID NO: 276467 - DNA, 20 bp, Artificial Sequence
  Description of Artificial Sequence: Synthetic oligonucleotide
  Target: ATXN1; (+) strand; PAM type: YTN; PAM sequence: CTT
gtgattcaaacatgagatta

SEQ ID NO: 276468 - DNA, 20 bp, Artificial Sequence
  Description of Artificial Sequence: Synthetic oligonucleotide
  Target: ATXN1; (+) strand; PAM type: YTN; PAM sequence: TTG
tgattcaaacatgagattat

SEQ ID NO: 276469 - DNA, 20 bp, Artificial Sequence
  Description of Artificial Sequence: Synthetic oligonucleotide
  Target: ATXN1; (+) strand; PAM type: YTN; PAM sequence: TTC
aaacatgagattattattat

SEQ ID NO: 276470 - DNA, 20 bp, Artificial Sequence
  Description of Artificial Sequence: Synthetic oligonucleotide
  Target: ATXN1; (+) strand; PAM type: YTN; PAM sequence: TTA
ttattatcttttataaaagg

SEQ ID NO: 276471 - DNA, 20 bp, Artificial Sequence
  Description of Artificial Sequence: Synthetic oligonucleotide
  Target: ATXN1; (+) strand; PAM type: YTN; PAM sequence: TTA
ttatcttttataaaaggtaa

SEQ ID NO: 276472 - DNA, 20 bp, Artificial Sequence
  Description of Artificial Sequence: Synthetic oligonucleotide
  Target: ATXN1; (+) strand; PAM type: YTN; PAM sequence: TTA
tcttttataaaaggtaaaat

SEQ ID NO: 276473 - DNA, 20 bp, Artificial Sequence
  Description of Artificial Sequence: Synthetic oligonucleotide
  Target: ATXN1; (+) strand; PAM type: YTN; PAM sequence: CTT
ttataaaaggtaaaatctat

SEQ ID NO: 276474 - DNA, 20 bp, Artificial Sequence
  Description of Artificial Sequence: Synthetic oligonucleotide
  Target: ATXN1; (+) strand; PAM type: YTN; PAM sequence: TTT
tataaaaggtaaaatctatt

SEQ ID NO: 276475 - DNA, 20 bp, Artificial Sequence
  Description of Artificial Sequence: Synthetic oligonucleotide
  Target: ATXN1; (+) strand; PAM type: YTN; PAM sequence: TTT
ataaaaggtaaaatctattt

SEQ ID NO: 276476 - DNA, 20 bp, Artificial Sequence
  Description of Artificial Sequence: Synthetic oligonucleotide
  Target: ATXN1; (+) strand; PAM type: YTN; PAM sequence: TTA
taaaaggtaaaatctatttc

SEQ ID NO: 276477 - DNA, 20 bp, Artificial Sequence
  Description of Artificial Sequence: Synthetic oligonucleotide
  Target: ATXN1; (+) strand; PAM type: YTN; PAM sequence: CTA
tttcagagcattttaagtgt

SEQ ID NO: 276478 - DNA, 20 bp, Artificial Sequence
  Description of Artificial Sequence: Synthetic oligonucleotide
  Target: ATXN1; (+) strand; PAM type: YTN; PAM sequence: TTT
cagagcattttaagtgtgca

SEQ ID NO: 276479 - DNA, 20 bp, Artificial Sequence
  Description of Artificial Sequence: Synthetic oligonucleotide
  Target: ATXN1; (+) strand; PAM type: YTN; PAM sequence: TTC
agagcattttaagtgtgcat

SEQ ID NO: 276480 - DNA, 20 bp, Artificial Sequence
  Description of Artificial Sequence: Synthetic oligonucleotide
  Target: ATXN1; (+) strand; PAM type: YTN; PAM sequence: TTT
taagtgtgcatcaaccgtcc

SEQ ID NO: 276481 - DNA, 20 bp, Artificial Sequence
  Description of Artificial Sequence: Synthetic oligonucleotide
  Target: ATXN1; (+) strand; PAM type: YTN; PAM sequence: TTT
aagtgtgcatcaaccgtccc

SEQ ID NO: 276482 - DNA, 20 bp, Artificial Sequence
  Description of Artificial Sequence: Synthetic oligonucleotide
  Target: ATXN1; (+) strand; PAM type: YTN; PAM sequence: TTA
agtgtgcatcaaccgtccct

SEQ ID NO: 276483 - DNA, 20 bp, Artificial Sequence
  Description of Artificial Sequence: Synthetic oligonucleotide
  Target: ATXN1; (+) strand; PAM type: YTN; PAM sequence: CTG
aattccgatgcttgacaaat

SEQ ID NO: 276484 - DNA, 20 bp, Artificial Sequence
  Description of Artificial Sequence: Synthetic oligonucleotide
  Target: ATXN1; (+) strand; PAM type: YTN; PAM sequence: TTC
cgatgcttgacaaattcatt

SEQ ID NO: 276485 - DNA, 20 bp, Artificial Sequence
  Description of Artificial Sequence: Synthetic oligonucleotide
  Target: ATXN1; (+) strand; PAM type: YTN; PAM sequence: CTT
gacaaattcattagcaataa

SEQ ID NO: 276486 - DNA, 20 bp, Artificial Sequence
  Description of Artificial Sequence: Synthetic oligonucleotide
  Target: ATXN1; (+) strand; PAM type: YTN; PAM sequence: TTG
acaaattcattagcaataac

SEQ ID NO: 276487 - DNA, 20 bp, Artificial Sequence
  Description of Artificial Sequence: Synthetic oligonucleotide
  Target: ATXN1; (+) strand; PAM type: YTN; PAM sequence: TTC
attagcaataacaaatgtta

SEQ ID NO: 276488 - DNA, 20 bp, Artificial Sequence
  Description of Artificial Sequence: Synthetic oligonucleotide
  Target: ATXN1; (+) strand; PAM type: YTN; PAM sequence: TTA
gcaataacaaatgttaaacc

SEQ ID NO: 276489 - DNA, 20 bp, Artificial Sequence
  Description of Artificial Sequence: Synthetic oligonucleotide
  Target: ATXN1; (+) strand; PAM type: YTN; PAM sequence: TTA
aacctgtctagagtatttcc

SEQ ID NO: 276490 - DNA, 20 bp, Artificial Sequence
  Description of Artificial Sequence: Synthetic oligonucleotide
  Target: ATXN1; (+) strand; PAM type: YTN; PAM sequence: CTG
tctagagtatttccttgcta

SEQ ID NO: 276491 - DNA, 20 bp, Artificial Sequence
  Description of Artificial Sequence: Synthetic oligonucleotide
  Target: ATXN1; (+) strand; PAM type: YTN; PAM sequence: CTA
gagtatttccttgctattct

SEQ ID NO: 276492 - DNA, 20 bp, Artificial Sequence
  Description of Artificial Sequence: Synthetic oligonucleotide
  Target: ATXN1; (+) strand; PAM type: YTN; PAM sequence: TTT
ccttgctattctacgcagca

SEQ ID NO: 276493 - DNA, 20 bp, Artificial Sequence
  Description of Artificial Sequence: Synthetic oligonucleotide
  Target: ATXN1; (+) strand; PAM type: YTN; PAM sequence: TTC
cttgctattctacgcagcaa

SEQ ID NO: 276494 - DNA, 20 bp, Artificial Sequence
  Description of Artificial Sequence: Synthetic oligonucleotide
  Target: ATXN1; (+) strand; PAM type: YTN; PAM sequence: CTT
gctattctacgcagcaaatc

SEQ ID NO: 276495 - DNA, 20 bp, Artificial Sequence
  Description of Artificial Sequence: Synthetic oligonucleotide
  Target: ATXN1; (+) strand; PAM type: YTN; PAM sequence: TTG
ctattctacgcagcaaatca

SEQ ID NO: 276496 - DNA, 20 bp, Artificial Sequence
  Description of Artificial Sequence: Synthetic oligonucleotide
  Target: ATXN1; (+) strand; PAM type: YTN; PAM sequence: CTA
ttctacgcagcaaatcaatg

SEQ ID NO: 276497 - DNA, 20 bp, Artificial Sequence
  Description of Artificial Sequence: Synthetic oligonucleotide
  Target: ATXN1; (+) strand; PAM type: YTN; PAM sequence: TTC
tacgcagcaaatcaatggcc

SEQ ID NO: 276498 - DNA, 20 bp, Artificial Sequence
  Description of Artificial Sequence: Synthetic oligonucleotide
  Target: ATXN1; (+) strand; PAM type: YTN; PAM sequence: CTA
cgcagcaaatcaatggcctc

SEQ ID NO: 276499 - DNA, 20 bp, Artificial Sequence
  Description of Artificial Sequence: Synthetic oligonucleotide
  Target: ATXN1; (+) strand; PAM type: YTN; PAM sequence: CTC
gccaaccgccacaggataaa

SEQ ID NO: 276500 - DNA, 20 bp, Artificial Sequence
  Description of Artificial Sequence: Synthetic oligonucleotide
  Target: ATXN1; (+) strand; PAM type: YTN; PAM sequence: TTC
tgccaacgtgatgccaccga

SEQ ID NO: 276501 - DNA, 20 bp, Artificial Sequence
  Description of Artificial Sequence: Synthetic oligonucleotide
  Target: ATXN1; (+) strand; PAM type: YTN; PAM sequence: CTG
ccaacgtgatgccaccgaca

SEQ ID NO: 276502 - DNA, 20 bp, Artificial Sequence
  Description of Artificial Sequence: Synthetic oligonucleotide
  Target: ATXN1; (+) strand; PAM type: YTN; PAM sequence: CTC
tgctcaccctccgagaagga

SEQ ID NO: 276503 - DNA, 20 bp, Artificial Sequence
  Description of Artificial Sequence: Synthetic oligonucleotide
  Target: ATXN1; (+) strand; PAM type: YTN; PAM sequence: CTG
ctcaccctccgagaaggact

SEQ ID NO: 276504 - DNA, 20 bp, Artificial Sequence
  Description of Artificial Sequence: Synthetic oligonucleotide
  Target: ATXN1; (+) strand; PAM type: YTN; PAM sequence: CTC
accctccgagaaggactcta

SEQ ID NO: 276505 - DNA, 20 bp, Artificial Sequence
  Description of Artificial Sequence: Synthetic oligonucleotide
  Target: ATXN1; (+) strand; PAM type: YTN; PAM sequence: CTC
cgagaaggactctagtgcat

SEQ ID NO: 276506 - DNA, 20 bp, Artificial Sequence
  Description of Artificial Sequence: Synthetic oligonucleotide
  Target: ATXN1; (+) strand; PAM type: YTN; PAM sequence: CTC
tagtgcataagtggctgcct

SEQ ID NO: 276507 - DNA, 20 bp, Artificial Sequence
  Description of Artificial Sequence: Synthetic oligonucleotide
  Target: ATXN1; (+) strand; PAM type: YTN; PAM sequence: CTA
gtgcataagtggctgcctat

SEQ ID NO: 276508 - DNA, 20 bp, Artificial Sequence
  Description of Artificial Sequence: Synthetic oligonucleotide
  Target: ATXN1; (+) strand; PAM type: YTN; PAM sequence: CTG
cctatgtattgggatgttct

SEQ ID NO: 276509 - DNA, 20 bp, Artificial Sequence
  Description of Artificial Sequence: Synthetic oligonucleotide
  Target: ATXN1; (+) strand; PAM type: YTN; PAM sequence: CTA
tgtattgggatgttctggcc

SEQ ID NO: 276510 - DNA, 20 bp, Artificial Sequence
  Description of Artificial Sequence: Synthetic oligonucleotide
  Target: ATXN1; (+) strand; PAM type: YTN; PAM sequence: TTG
ggatgttctggccgggcgcg

SEQ ID NO: 276511 - DNA, 20 bp, Artificial Sequence
  Description of Artificial Sequence: Synthetic oligonucleotide
  Target: ATXN1; (+) strand; PAM type: YTN; PAM sequence: TTC
tggccgggcgcggtggctca

SEQ ID NO: 276512 - DNA, 20 bp, Artificial Sequence
  Description of Artificial Sequence: Synthetic oligonucleotide
  Target: ATXN1; (+) strand; PAM type: YTN; PAM sequence: CTG
gccgggcgcggtggctcacg

SEQ ID NO: 276513 - DNA, 20 bp, Artificial Sequence
  Description of Artificial Sequence: Synthetic oligonucleotide
  Target: ATXN1; (+) strand; PAM type: YTN; PAM sequence: CTC
acgcatgtaatcccagcact

SEQ ID NO: 276514 - DNA, 20 bp, Artificial Sequence
  Description of Artificial Sequence: Synthetic oligonucleotide
  Target: ATXN1; (+) strand; PAM type: YTN; PAM sequence: CTT
tgggaggctggggcagatgg

SEQ ID NO: 276515 - DNA, 20 bp, Artificial Sequence
  Description of Artificial Sequence: Synthetic oligonucleotide
  Target: ATXN1; (+) strand; PAM type: YTN; PAM sequence: TTT
gggaggctggggcagatgga

SEQ ID NO: 276516 - DNA, 20 bp, Artificial Sequence
  Description of Artificial Sequence: Synthetic oligonucleotide
  Target: ATXN1; (+) strand; PAM type: YTN; PAM sequence: TTG
ggaggctggggcagatggat

SEQ ID NO: 276517 - DNA, 20 bp, Artificial Sequence
  Description of Artificial Sequence: Synthetic oligonucleotide
  Target: ATXN1; (+) strand; PAM type: YTN; PAM sequence: CTG
gggcagatggatcacctgag

SEQ ID NO: 276518 - DNA, 20 bp, Artificial Sequence
  Description of Artificial Sequence: Synthetic oligonucleotide
  Target: ATXN1; (+) strand; PAM type: YTN; PAM sequence: CTG
aggtcaagagttcaagatgg

SEQ ID NO: 276519 - DNA, 20 bp, Artificial Sequence
  Description of Artificial Sequence: Synthetic oligonucleotide
  Target: ATXN1; (+) strand; PAM type: YTN; PAM sequence: TTC
aagatgggcttggtcagcac

SEQ ID NO: 276520 - DNA, 20 bp, Artificial Sequence
  Description of Artificial Sequence: Synthetic oligonucleotide
  Target: ATXN1; (+) strand; PAM type: YTN; PAM sequence: CTT
ggtcagcacagtgaaacact

SEQ ID NO: 276521 - DNA, 20 bp, Artificial Sequence
  Description of Artificial Sequence: Synthetic oligonucleotide
  Target: ATXN1; (+) strand; PAM type: YTN; PAM sequence: TTG
gtcagcacagtgaaacactg

SEQ ID NO: 276522 - DNA, 20 bp, Artificial Sequence
  Description of Artificial Sequence: Synthetic oligonucleotide
  Target: ATXN1; (+) strand; PAM type: YTN; PAM sequence: CTG
tcactactaaaaagacgcaa

SEQ ID NO: 276523 - DNA, 20 bp, Artificial Sequence
  Description of Artificial Sequence: Synthetic oligonucleotide
  Target: ATXN1; (+) strand; PAM type: YTN; PAM sequence: CTA
ctaaaaagacgcaaaattag

SEQ ID NO: 276524 - DNA, 20 bp, Artificial Sequence
  Description of Artificial Sequence: Synthetic oligonucleotide
  Target: ATXN1; (+) strand; PAM type: YTN; PAM sequence: CTA
aaaagacgcaaaattagctg

SEQ ID NO: 276525 - DNA, 20 bp, Artificial Sequence
  Description of Artificial Sequence: Synthetic oligonucleotide
  Target: ATXN1; (+) strand; PAM type: YTN; PAM sequence: TTA
gctggacgtggtggcaggtg

SEQ ID NO: 276526 - DNA, 20 bp, Artificial Sequence
  Description of Artificial Sequence: Synthetic oligonucleotide
  Target: ATXN1; (+) strand; PAM type: YTN; PAM sequence: CTG
gacgtggtggcaggtgcctg

SEQ ID NO: 276527 - DNA, 20 bp, Artificial Sequence
  Description of Artificial Sequence: Synthetic oligonucleotide
  Target: ATXN1; (+) strand; PAM type: YTN; PAM sequence: CTG
taatccctgctagtcggcag

SEQ ID NO: 276528 - DNA, 20 bp, Artificial Sequence
  Description of Artificial Sequence: Synthetic oligonucleotide
  Target: ATXN1; (+) strand; PAM type: YTN; PAM sequence: CTG
ctagtcggcaggctggggca

SEQ ID NO: 276529 - DNA, 20 bp, Artificial Sequence
  Description of Artificial Sequence: Synthetic oligonucleotide
  Target: ATXN1; (+) strand; PAM type: YTN; PAM sequence: CTA
gtcggcaggctggggcagga

SEQ ID NO: 276530 - DNA, 20 bp, Artificial Sequence
  Description of Artificial Sequence: Synthetic oligonucleotide
  Target: ATXN1; (+) strand; PAM type: YTN; PAM sequence: CTG
gggcaggagaatcgcttgaa

SEQ ID NO: 276531 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggtagaggtt

SEQ ID NO: 276532 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggtagaggttg

SEQ ID NO: 276533 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagactgcacc

SEQ ID NO: 276534 - DNA, 20 bp, Artificial Sequence
  Description of Artificial Sequence: Synthetic oligonucleotide
  Target: ATXN1; (+) strand; PAM type: YTN; PAM sequence: CTG
caccactgcactccagtctg

SEQ ID NO: 276535 - DNA, 20 bp, Artificial Sequence
  Description of Artificial Sequence: Synthetic oligonucleotide
  Target: ATXN1; (+) strand; PAM type: YTN; PAM sequence: CTG
cactccagtctgggcaacaa

SEQ ID NO: 276536 - DNA, 20 bp, Artificial Sequence
  Description of Artificial Sequence: Synthetic oligonucleotide
  Target: ATXN1; (+) strand; PAM type: YTN; PAM sequence: CTC
cagtctgggcaacaagagtg

SEQ ID NO: 276537 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagtgaaactct

SEQ ID NO: 276538 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaagaaaaa

SEQ ID NO: 276539 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaagaaaaaaa

SEQ ID NO: 276540 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaagaaaaaaagaaa

SEQ ID NO: 276541 - DNA, 20 bp, Artificial Sequence
  Description of Artificial Sequence: Synthetic oligonucleotide
  Target: ATXN1; (+) strand; PAM type: YTN; PAM sequence: TTC
taactgaaatacaaccatga

SEQ ID NO: 276542 - DNA, 20 bp, Artificial Sequence
  Description of Artificial Sequence: Synthetic oligonucleotide
  Target: ATXN1; (+) strand; PAM type: YTN; PAM sequence: CTA
actgaaatacaaccatgata

SEQ ID NO: 276543 - DNA, 20 bp, Artificial Sequence
  Description of Artificial Sequence: Synthetic oligonucleotide
  Target: ATXN1; (+) strand; PAM type: YTN; PAM sequence: CTG
aaatacaaccatgatacagg

SEQ ID NO: 276544 - DNA, 20 bp, Artificial Sequence
  Description of Artificial Sequence: Synthetic oligonucleotide
  Target: ATXN1; (+) strand; PAM type: YTN; PAM sequence: CTT
cgatttggaagctaaaaaag

SEQ ID NO: 276545 - DNA, 20 bp, Artificial Sequence
  Description of Artificial Sequence: Synthetic oligonucleotide
  Target: ATXN1; (+) strand; PAM type: YTN; PAM sequence: TTC
gatttggaagctaaaaaagg

SEQ ID NO: 276546 - DNA, 20 bp, Artificial Sequence
  Description of Artificial Sequence: Synthetic oligonucleotide
  Target: ATXN1; (+) strand; PAM type: YTN; PAM sequence: TTT
ggaagctaaaaaaggtgtct

SEQ ID NO: 276547 - DNA, 20 bp, Artificial Sequence
  Description of Artificial Sequence: Synthetic oligonucleotide
  Target: ATXN1; (+) strand; PAM type: YTN; PAM sequence: TTG
gaagctaaaaaaggtgtctt

SEQ ID NO: 276548 - DNA, 20 bp, Artificial Sequence
  Description of Artificial Sequence: Synthetic oligonucleotide
  Target: ATXN1; (+) strand; PAM type: YTN; PAM sequence: CTA
aaaaaggtgtcttggccagg

SEQ ID NO: 276549 - DNA, 20 bp, Artificial Sequence
  Description of Artificial Sequence: Synthetic oligonucleotide
  Target: ATXN1; (+) strand; PAM type: YTN; PAM sequence: CTT
ggccaggtgcggtggctcac

SEQ ID NO: 276550 - DNA, 20 bp, Artificial Sequence
  Description of Artificial Sequence: Synthetic oligonucleotide
  Target: ATXN1; (+) strand; PAM type: YTN; PAM sequence: TTG
gccaggtgcggtggctcaca

SEQ ID NO: 276551 - DNA, 20 bp, Artificial Sequence
  Description of Artificial Sequence: Synthetic oligonucleotide
  Target: ATXN1; (+) strand; PAM type: YTN; PAM sequence: CTC
acacctgtaataccagcact

SEQ ID NO: 276552 - DNA, 20 bp, Artificial Sequence
  Description of Artificial Sequence: Synthetic oligonucleotide
  Target: ATXN1; (+) strand; PAM type: YTN; PAM sequence: CTG
taataccagcactttgggag

SEQ ID NO: 276553 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggcgg

SEQ ID NO: 276554 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggcgga

SEQ ID NO: 276555 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggcggat

SEQ ID NO: 276556 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagtttgagacca

SEQ ID NO: 276557 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggccatcat

SEQ ID NO: 276558 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggccatcatg

SEQ ID NO: 276559 - DNA, 20 bp, Artificial Sequence
  Description of Artificial Sequence: Synthetic oligonucleotide
  Target: ATXN1; (+) strand; PAM type: YTN; PAM sequence: CTG
gccatcatggtgatacccca

SEQ ID NO: 276560 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 276561 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 276562 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 276563 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggcagatg

SEQ ID NO: 276564 - DNA, 20 bp, Artificial Sequence
  Description of Artificial Sequence: Synthetic oligonucleotide
  Target: ATXN1; (+) strand; PAM type: YTN; PAM sequence: CTG
taatctcagctacttgggag

SEQ ID NO: 276565 - DNA, 20 bp, Artificial Sequence
  Description of Artificial Sequence: Synthetic oligonucleotide
  Target: ATXN1; (+) strand; PAM type: YTN; PAM sequence: CTC
agctacttgggaggtcaaag

SEQ ID NO: 276566 - DNA, 20 bp, Artificial Sequence
  Description of Artificial Sequence: Synthetic oligonucleotide
  Target: ATXN1; (+) strand; PAM type: YTN; PAM sequence: CTA
cttgggaggtcaaagcagga

SEQ ID NO: 276567 - DNA, 20 bp, Artificial Sequence
  Description of Artificial Sequence: Synthetic oligonucleotide
  Target: ATXN1; (+) strand; PAM type: YTN; PAM sequence: CTT
gggaggtcaaagcaggagaa

SEQ ID NO: 276568 - DNA, 20 bp, Artificial Sequence
  Description of Artificial Sequence: Synthetic oligonucleotide
  Target: ATXN1; (+) strand; PAM type: YTN; PAM sequence: TTG
ggaggtcaaagcaggagaat

SEQ ID NO: 276569 - DNA, 20 bp, Artificial Sequence
  Description of Artificial Sequence: Synthetic oligonucleotide
  Target: ATXN1; (+) strand; PAM type: YTN; PAM sequence: CTT
aaacccaggtcagcttgctg

SEQ ID NO: 276570 - DNA, 20 bp, Artificial Sequence
  Description of Artificial Sequence: Synthetic oligonucleotide
  Target: ATXN1; (+) strand; PAM type: YTN; PAM sequence: TTA
aacccaggtcagcttgctgg

SEQ ID NO: 276571 - DNA, 20 bp, Artificial Sequence
  Description of Artificial Sequence: Synthetic oligonucleotide
  Target: ATXN1; (+) strand; PAM type: YTN; PAM sequence: CTT
gctggcaacttcccagatta

SEQ ID NO: 276572 - DNA, 20 bp, Artificial Sequence
  Description of Artificial Sequence: Synthetic oligonucleotide
  Target: ATXN1; (+) strand; PAM type: YTN; PAM sequence: TTG
ctggcaacttcccagattag

SEQ ID NO: 276573 - DNA, 20 bp, Artificial Sequence
  Description of Artificial Sequence: Synthetic oligonucleotide
  Target: ATXN1; (+) strand; PAM type: YTN; PAM sequence: CTG
gcaacttcccagattagtgc

SEQ ID NO: 276574 - DNA, 20 bp, Artificial Sequence
  Description of Artificial Sequence: Synthetic oligonucleotide
  Target: ATXN1; (+) strand; PAM type: YTN; PAM sequence: CTT
cccagattagtgcacttgat

SEQ ID NO: 276575 - DNA, 20 bp, Artificial Sequence
  Description of Artificial Sequence: Synthetic oligonucleotide
  Target: ATXN1; (+) strand; PAM type: YTN; PAM sequence: TTC
ccagattagtgcacttgatg

SEQ ID NO: 276576 - DNA, 20 bp, Artificial Sequence
  Description of Artificial Sequence: Synthetic oligonucleotide
  Target: ATXN1; (+) strand; PAM type: YTN; PAM sequence: TTA
gtgcacttgatgaaacccct

SEQ ID NO: 276577 - DNA, 20 bp, Artificial Sequence
  Description of Artificial Sequence: Synthetic oligonucleotide
  Target: ATXN1; (+) strand; PAM type: YTN; PAM sequence: CTT
gatgaaaccccttgtaataa

SEQ ID NO: 276578 - DNA, 20 bp, Artificial Sequence
  Description of Artificial Sequence: Synthetic oligonucleotide
  Target: ATXN1; (+) strand; PAM type: YTN; PAM sequence: TTG
atgaaaccccttgtaataat

SEQ ID NO: 276579 - DNA, 20 bp, Artificial Sequence
  Description of Artificial Sequence: Synthetic oligonucleotide
  Target: ATXN1; (+) strand; PAM type: YTN; PAM sequence: CTT
gtaataattaaattccttcc

SEQ ID NO: 276580 - DNA, 20 bp, Artificial Sequence
  Description of Artificial Sequence: Synthetic oligonucleotide
  Target: ATXN1; (+) strand; PAM type: YTN; PAM sequence: TTG
taataattaaattccttcca

SEQ ID NO: 276581 - DNA, 20 bp, Artificial Sequence
  Description of Artificial Sequence: Synthetic oligonucleotide
  Target: ATXN1; (+) strand; PAM type: YTN; PAM sequence: TTA
aattccttccaccggcacaa

SEQ ID NO: 276582 - DNA, 20 bp, Artificial Sequence
  Description of Artificial Sequence: Synthetic oligonucleotide
  Target: ATXN1; (+) strand; PAM type: YTN; PAM sequence: TTC
cttccaccggcacaagaaat

SEQ ID NO: 276583 - DNA, 20 bp, Artificial Sequence
  Description of Artificial Sequence: Synthetic oligonucleotide
  Target: ATXN1; (+) strand; PAM type: YTN; PAM sequence: CTT
ccaccggcacaagaaatatg

SEQ ID NO: 276584 - DNA, 20 bp, Artificial Sequence
  Description of Artificial Sequence: Synthetic oligonucleotide
  Target: ATXN1; (+) strand; PAM type: YTN; PAM sequence: TTC
caccggcacaagaaatatgt

SEQ ID NO: 276585 - DNA, 20 bp, Artificial Sequence
  Description of Artificial Sequence: Synthetic oligonucleotide
  Target: ATXN1; (+) strand; PAM type: YTN; PAM sequence: CTG
aaaataggaatttcctttct

SEQ ID NO: 276586 - DNA, 20 bp, Artificial Sequence
  Description of Artificial Sequence: Synthetic oligonucleotide
  Target: ATXN1; (+) strand; PAM type: YTN; PAM sequence: TTT
cctttctctctttgccctca

SEQ ID NO: 276587 - DNA, 20 bp, Artificial Sequence
  Description of Artificial Sequence: Synthetic oligonucleotide
  Target: ATXN1; (+) strand; PAM type: YTN; PAM sequence: TTC
ctttctctctttgccctcaa

SEQ ID NO: 276588 - DNA, 20 bp, Artificial Sequence
  Description of Artificial Sequence: Synthetic oligonucleotide
  Target: ATXN1; (+) strand; PAM type: YTN; PAM sequence: CTT
tctctctttgccctcaagac

SEQ ID NO: 276589 - DNA, 20 bp, Artificial Sequence
  Description of Artificial Sequence: Synthetic oligonucleotide
  Target: ATXN1; (+) strand; PAM type: YTN; PAM sequence: TTT
ctctctttgccctcaagacc

SEQ ID NO: 276590 - DNA, 20 bp, Artificial Sequence
  Description of Artificial Sequence: Synthetic oligonucleotide
  Target: ATXN1; (+) strand; PAM type: YTN; PAM sequence: TTC
tctctttgccctcaagacct

SEQ ID NO: 276591 - DNA, 20 bp, Artificial Sequence
  Description of Artificial Sequence: Synthetic oligonucleotide
  Target: ATXN1; (+) strand; PAM type: YTN; PAM sequence: CTC
tctttgccctcaagaccttc

SEQ ID NO: 276592 - DNA, 20 bp, Artificial Sequence
  Description of Artificial Sequence: Synthetic oligonucleotide
  Target: ATXN1; (+) strand; PAM type: YTN; PAM sequence: CTC
tttgccctcaagaccttcac

SEQ ID NO: 276593 - DNA, 20 bp, Artificial Sequence
  Description of Artificial Sequence: Synthetic oligonucleotide
  Target: ATXN1; (+) strand; PAM type: YTN; PAM sequence: CTT
tgccctcaagaccttcacca

SEQ ID NO: 276594 - DNA, 20 bp, Artificial Sequence
  Description of Artificial Sequence: Synthetic oligonucleotide
  Target: ATXN1; (+) strand; PAM type: YTN; PAM sequence: TTT
gccctcaagaccttcaccac

SEQ ID NO: 276595 - DNA, 20 bp, Artificial Sequence
  Description of Artificial Sequence: Synthetic oligonucleotide
  Target: ATXN1; (+) strand; PAM type: YTN; PAM sequence: TTG
ccctcaagaccttcaccacc

SEQ ID NO: 276596 - DNA, 20 bp, Artificial Sequence
  Description of Artificial Sequence: Synthetic oligonucleotide
  Target: ATXN1; (+) strand; PAM type: YTN; PAM sequence: CTC
aagaccttcaccacccagga

SEQ ID NO: 276597 - DNA, 20 bp, Artificial Sequence
  Description of Artificial Sequence: Synthetic oligonucleotide
  Target: ATXN1; (+) strand; PAM type: YTN; PAM sequence: CTT
caccacccaggacagtgaga

SEQ ID NO: 276598 - DNA, 20 bp, Artificial Sequence
  Description of Artificial Sequence: Synthetic oligonucleotide
  Target: ATXN1; (+) strand; PAM type: YTN; PAM sequence: TTC
accacccaggacagtgagag

SEQ ID NO: 276599 - DNA, 20 bp, Artificial Sequence
  Description of Artificial Sequence: Synthetic oligonucleotide
  Target: ATXN1; (+) strand; PAM type: YTN; PAM sequence: CTA
taagtgttaagggcaccggg

SEQ ID NO: 276600 - DNA, 20 bp, Artificial Sequence
  Description of Artificial Sequence: Synthetic oligonucleotide
  Target: ATXN1; (+) strand; PAM type: YTN; PAM sequence: TTA
agggcaccggggcagagcca

SEQ ID NO: 276601 - DNA, 20 bp, Artificial Sequence
  Description of Artificial Sequence: Synthetic oligonucleotide
  Target: ATXN1; (+) strand; PAM type: YTN; PAM sequence: CTG
ggtttaaatgaccttgggca

SEQ ID NO: 276602 - DNA, 20 bp, Artificial Sequence
  Description of Artificial Sequence: Synthetic oligonucleotide
  Target: ATXN1; (+) strand; PAM type: YTN; PAM sequence: TTT
aaatgaccttgggcaaatca

SEQ ID NO: 276603 - DNA, 20 bp, Artificial Sequence
  Description of Artificial Sequence: Synthetic oligonucleotide
  Target: ATXN1; (+) strand; PAM type: YTN; PAM sequence: TTA
aatgaccttgggcaaatcac

SEQ ID NO: 276604 - DNA, 20 bp, Artificial Sequence
  Description of Artificial Sequence: Synthetic oligonucleotide
  Target: ATXN1; (+) strand; PAM type: YTN; PAM sequence: CTT
gggcaaatcacttaacctca

SEQ ID NO: 276605 - DNA, 20 bp, Artificial Sequence
  Description of Artificial Sequence: Synthetic oligonucleotide
  Target: ATXN1; (+) strand; PAM type: YTN; PAM sequence: TTG
ggcaaatcacttaacctcac

SEQ ID NO: 276606 - DNA, 20 bp, Artificial Sequence
  Description of Artificial Sequence: Synthetic oligonucleotide
  Target: ATXN1; (+) strand; PAM type: YTN; PAM sequence: CTT
aacctcactgttttcagata

SEQ ID NO: 276607 - DNA, 20 bp, Artificial Sequence
  Description of Artificial Sequence: Synthetic oligonucleotide
  Target: ATXN1; (+) strand; PAM type: YTN; PAM sequence: TTA
acctcactgttttcagatat

SEQ ID NO: 276608 - DNA, 20 bp, Artificial Sequence
  Description of Artificial Sequence: Synthetic oligonucleotide
  Target: ATXN1; (+) strand; PAM type: YTN; PAM sequence: CTC
actgttttcagatataaaat

SEQ ID NO: 276609 - DNA, 20 bp, Artificial Sequence
  Description of Artificial Sequence: Synthetic oligonucleotide
  Target: ATXN1; (+) strand; PAM type: YTN; PAM sequence: CTG
ttttcagatataaaatttac

SEQ ID NO: 276610 - DNA, 20 bp, Artificial Sequence
  Description of Artificial Sequence: Synthetic oligonucleotide
  Target: ATXN1; (+) strand; PAM type: YTN; PAM sequence: TTT
tcagatataaaatttacata

SEQ ID NO: 276611 - DNA, 20 bp, Artificial Sequence
  Description of Artificial Sequence: Synthetic oligonucleotide
  Target: ATXN1; (+) strand; PAM type: YTN; PAM sequence: TTT
cagatataaaatttacataa

SEQ ID NO: 276612 - DNA, 20 bp, Artificial Sequence
  Description of Artificial Sequence: Synthetic oligonucleotide
  Target: ATXN1; (+) strand; PAM type: YTN; PAM sequence: TTC
agatataaaatttacataac

SEQ ID NO: 276613 - DNA, 20 bp, Artificial Sequence
  Description of Artificial Sequence: Synthetic oligonucleotide
  Target: ATXN1; (+) strand; PAM type: YTN; PAM sequence: TTT
acataacaaaagttgtgagg

SEQ ID NO: 276614 - DNA, 20 bp, Artificial Sequence
  Description of Artificial Sequence: Synthetic oligonucleotide
  Target: ATXN1; (+) strand; PAM type: YTN; PAM sequence: TTA
cataacaaaagttgtgagga

SEQ ID NO: 276615 - DNA, 20 bp, Artificial Sequence
  Description of Artificial Sequence: Synthetic oligonucleotide
  Target: ATXN1; (+) strand; PAM type: YTN; PAM sequence: TTG
tgaggattaaagggttaata

SEQ ID NO: 276616 - DNA, 20 bp, Artificial Sequence
  Description of Artificial Sequence: Synthetic oligonucleotide
  Target: ATXN1; (+) strand; PAM type: YTN; PAM sequence: TTA
aagggttaatatagcacaaa

SEQ ID NO: 276617 - DNA, 20 bp, Artificial Sequence
  Description of Artificial Sequence: Synthetic oligonucleotide
  Target: ATXN1; (+) strand; PAM type: YTN; PAM sequence: TTA
atatagcacaaagcacttag

SEQ ID NO: 276618 - DNA, 20 bp, Artificial Sequence
  Description of Artificial Sequence: Synthetic oligonucleotide
  Target: ATXN1; (+) strand; PAM type: YTN; PAM sequence: CTT
agagcagtattataggtgtt

SEQ ID NO: 276619 - DNA, 20 bp, Artificial Sequence
  Description of Artificial Sequence: Synthetic oligonucleotide
  Target: ATXN1; (+) strand; PAM type: YTN; PAM sequence: TTA
gagcagtattataggtgttt

SEQ ID NO: 276620 - DNA, 20 bp, Artificial Sequence
  Description of Artificial Sequence: Synthetic oligonucleotide
  Target: ATXN1; (+) strand; PAM type: YTN; PAM sequence: TTA
taggtgtttgcttttattga

SEQ ID NO: 276621 - DNA, 20 bp, Artificial Sequence
  Description of Artificial Sequence: Synthetic oligonucleotide
  Target: ATXN1; (+) strand; PAM type: YTN; PAM sequence: TTT
gcttttattgaccaacatac

SEQ ID NO: 276622 - DNA, 20 bp, Artificial Sequence
  Description of Artificial Sequence: Synthetic oligonucleotide
  Target: ATXN1; (+) strand; PAM type: YTN; PAM sequence: TTG
cttttattgaccaacataca

SEQ ID NO: 276623 - DNA, 20 bp, Artificial Sequence
  Description of Artificial Sequence: Synthetic oligonucleotide
  Target: ATXN1; (+) strand; PAM type: YTN; PAM sequence: CTT
ttattgaccaacatacaaag

SEQ ID NO: 276624 - DNA, 20 bp, Artificial Sequence
  Description of Artificial Sequence: Synthetic oligonucleotide
  Target: ATXN1; (+) strand; PAM type: YTN; PAM sequence: TTT
tattgaccaacatacaaaga

SEQ ID NO: 276625 - DNA, 20 bp, Artificial Sequence
  Description of Artificial Sequence: Synthetic oligonucleotide
  Target: ATXN1; (+) strand; PAM type: YTN; PAM sequence: TTT
attgaccaacatacaaagag

SEQ ID NO: 276626 - DNA, 20 bp, Artificial Sequence
  Description of Artificial Sequence: Synthetic oligonucleotide
  Target: ATXN1; (+) strand; PAM type: YTN; PAM sequence: TTA
ttgaccaacatacaaagagc

SEQ ID NO: 276627 - DNA, 20 bp, Artificial Sequence
  Description of Artificial Sequence: Synthetic oligonucleotide
  Target: ATXN1; (+) strand; PAM type: YTN; PAM sequence: TTG
accaacatacaaagagctga

SEQ ID NO: 276628 - DNA, 20 bp, Artificial Sequence
  Description of Artificial Sequence: Synthetic oligonucleotide
  Target: ATXN1; (+) strand; PAM type: YTN; PAM sequence: CTG
actgttattcaatgattcca

SEQ ID NO: 276629 - DNA, 20 bp, Artificial Sequence
  Description of Artificial Sequence: Synthetic oligonucleotide
  Target: ATXN1; (+) strand; PAM type: YTN; PAM sequence: CTG
ttattcaatgattccaaaat

SEQ ID NO: 276630 - DNA, 20 bp, Artificial Sequence
  Description of Artificial Sequence: Synthetic oligonucleotide
  Target: ATXN1; (+) strand; PAM type: YTN; PAM sequence: TTA
ttcaatgattccaaaataat

SEQ ID NO: 276631 - DNA, 20 bp, Artificial Sequence
  Description of Artificial Sequence: Synthetic oligonucleotide
  Target: ATXN1; (+) strand; PAM type: YTN; PAM sequence: TTC
aatgattccaaaataattgt

SEQ ID NO: 276632 - DNA, 20 bp, Artificial Sequence
  Description of Artificial Sequence: Synthetic oligonucleotide
  Target: ATXN1; (+) strand; PAM type: YTN; PAM sequence: TTC
caaaataattgttcttttta

SEQ ID NO: 276633 - DNA, 20 bp, Artificial Sequence
  Description of Artificial Sequence: Synthetic oligonucleotide
  Target: ATXN1; (+) strand; PAM type: YTN; PAM sequence: TTG
ttctttttatttttttaatc

SEQ ID NO: 276634 - DNA, 20 bp, Artificial Sequence
  Description of Artificial Sequence: Synthetic oligonucleotide
  Target: ATXN1; (+) strand; PAM type: YTN; PAM sequence: TTC
tttttatttttttaatcttt

SEQ ID NO: 276635 - DNA, 20 bp, Artificial Sequence
  Description of Artificial Sequence: Synthetic oligonucleotide
  Target: ATXN1; (+) strand; PAM type: YTN; PAM sequence: CTT
tttatttttttaatcttttt

SEQ ID NO: 276636 - DNA, 20 bp, Artificial Sequence
  Description of Artificial Sequence: Synthetic oligonucleotide
  Target: ATXN1; (+) strand; PAM type: YTN; PAM sequence: TTT
ttatttttttaatctttttt

SEQ ID NO: 276637 - DNA, 20 bp, Artificial Sequence
  Description of Artificial Sequence: Synthetic oligonucleotide
  Target: ATXN1; (+) strand; PAM type: YTN; PAM sequence: TTT
tatttttttaatcttttttt

SEQ ID NO: 276638 - DNA, 20 bp, Artificial Sequence
  Description of Artificial Sequence: Synthetic oligonucleotide
  Target: ATXN1; (+) strand; PAM type: YTN; PAM sequence: TTT
atttttttaatctttttttt

SEQ ID NO: 276639 - DNA, 20 bp, Artificial Sequence
  Description of Artificial Sequence: Synthetic oligonucleotide
  Target: ATXN1; (+) strand; PAM type: YTN; PAM sequence: TTA
tttttttaatcttttttttg

SEQ ID NO: 276640 - DNA, 20 bp, Artificial Sequence
  Description of Artificial Sequence: Synthetic oligonucleotide
  Target: ATXN1; (+) strand; PAM type: YTN; PAM sequence: TTT
ttttaatcttttttttgttt

SEQ ID NO: 276641 - DNA, 20 bp, Artificial Sequence
  Description of Artificial Sequence: Synthetic oligonucleotide
  Target: ATXN1; (+) strand; PAM type: YTN; PAM sequence: TTT
tttaatcttttttttgtttt

SEQ ID NO: 276642 - DNA, 20 bp, Artificial Sequence
  Description of Artificial Sequence: Synthetic oligonucleotide
  Target: ATXN1; (+) strand; PAM type: YTN; PAM sequence: TTT
ttaatcttttttttgttttt

SEQ ID NO: 276643 - DNA, 20 bp, Artificial Sequence
  Description of Artificial Sequence: Synthetic oligonucleotide
  Target: ATXN1; (+) strand; PAM type: YTN; PAM sequence: TTT
taatcttttttttgttttta

SEQ ID NO: 276644 - DNA, 20 bp, Artificial Sequence
  Description of Artificial Sequence: Synthetic oligonucleotide
  Target: ATXN1; (+) strand; PAM type: YTN; PAM sequence: TTT
aatcttttttttgtttttaa

SEQ ID NO: 276645 - DNA, 20 bp, Artificial Sequence
  Description of Artificial Sequence: Synthetic oligonucleotide
  Target: ATXN1; (+) strand; PAM type: YTN; PAM sequence: TTA
atcttttttttgtttttaat

SEQ ID NO: 276646 - DNA, 20 bp, Artificial Sequence
  Description of Artificial Sequence: Synthetic oligonucleotide
  Target: ATXN1; (+) strand; PAM type: YTN; PAM sequence: CTT
ttttttgtttttaattatac

SEQ ID NO: 276647 - DNA, 20 bp, Artificial Sequence
  Description of Artificial Sequence: Synthetic oligonucleotide
  Target: ATXN1; (+) strand; PAM type: YTN; PAM sequence: TTT
tttttgtttttaattatact

SEQ ID NO: 276648 - DNA, 20 bp, Artificial Sequence
  Description of Artificial Sequence: Synthetic oligonucleotide
  Target: ATXN1; (+) strand; PAM type: YTN; PAM sequence: TTT
ttttgtttttaattatactt

SEQ ID NO: 276649 - DNA, 20 bp, Artificial Sequence
  Description of Artificial Sequence: Synthetic oligonucleotide
  Target: ATXN1; (+) strand; PAM type: YTN; PAM sequence: TTT
tttgtttttaattatacttt

SEQ ID NO: 276650 - DNA, 20 bp, Artificial Sequence
  Description of Artificial Sequence: Synthetic oligonucleotide
  Target: ATXN1; (+) strand; PAM type: YTN; PAM sequence: TTT
ttgtttttaattatacttta

SEQ ID NO: 276651 - DNA, 20 bp, Artificial Sequence
  Description of Artificial Sequence: Synthetic oligonucleotide
  Target: ATXN1; (+) strand; PAM type: YTN; PAM sequence: TTT
tgtttttaattatactttaa

SEQ ID NO: 276652 - DNA, 20 bp, Artificial Sequence
  Description of Artificial Sequence: Synthetic oligonucleotide
  Target: ATXN1; (+) strand; PAM type: YTN; PAM sequence: TTT
gtttttaattatactttaag

SEQ ID NO: 276653 - DNA, 20 bp, Artificial Sequence
  Description of Artificial Sequence: Synthetic oligonucleotide
  Target: ATXN1; (+) strand; PAM type: YTN; PAM sequence: TTG
tttttaattatactttaagt

SEQ ID NO: 276654 - DNA, 20 bp, Artificial Sequence
  Description of Artificial Sequence: Synthetic oligonucleotide
  Target: ATXN1; (+) strand; PAM type: YTN; PAM sequence: TTT
ttaattatactttaagtttt

SEQ ID NO: 276655 - DNA, 20 bp, Artificial Sequence
  Description of Artificial Sequence: Synthetic oligonucleotide
  Target: ATXN1; (+) strand; PAM type: YTN; PAM sequence: TTT
taattatactttaagtttta

SEQ ID NO: 276656 - DNA, 20 bp, Artificial Sequence
  Description of Artificial Sequence: Synthetic oligonucleotide
  Target: ATXN1; (+) strand; PAM type: YTN; PAM sequence: TTT
aattatactttaagttttag

SEQ ID NO: 276657 - DNA, 20 bp, Artificial Sequence
  Description of Artificial Sequence: Synthetic oligonucleotide
  Target: ATXN1; (+) strand; PAM type: YTN; PAM sequence: TTA
attatactttaagttttagg

SEQ ID NO: 276658 - DNA, 20 bp, Artificial Sequence
  Description of Artificial Sequence: Synthetic oligonucleotide
  Target: ATXN1; (+) strand; PAM type: YTN; PAM sequence: TTA
tactttaagttttagggtac

SEQ ID NO: 276659 - DNA, 20 bp, Artificial Sequence
  Description of Artificial Sequence: Synthetic oligonucleotide
  Target: ATXN1; (+) strand; PAM type: YTN; PAM sequence: CTT
taagttttagggtacatgtg

SEQ ID NO: 276660 - DNA, 20 bp, Artificial Sequence
  Description of Artificial Sequence: Synthetic oligonucleotide
  Target: ATXN1; (+) strand; PAM type: YTN; PAM sequence: TTT
aagttttagggtacatgtgc

SEQ ID NO: 276661 - DNA, 20 bp, Artificial Sequence
  Description of Artificial Sequence: Synthetic oligonucleotide
  Target: ATXN1; (+) strand; PAM type: YTN; PAM sequence: TTA
agttttagggtacatgtgca

SEQ ID NO: 276662 - DNA, 20 bp, Artificial Sequence
  Description of Artificial Sequence: Synthetic oligonucleotide
  Target: ATXN1; (+) strand; PAM type: YTN; PAM sequence: TTT
tagggtacatgtgcacaaca

SEQ ID NO: 276663 - DNA, 20 bp, Artificial Sequence
  Description of Artificial Sequence: Synthetic oligonucleotide
  Target: ATXN1; (+) strand; PAM type: YTN; PAM sequence: TTT
agggtacatgtgcacaacat

SEQ ID NO: 276664 - DNA, 20 bp, Artificial Sequence
  Description of Artificial Sequence: Synthetic oligonucleotide
  Target: ATXN1; (+) strand; PAM type: YTN; PAM sequence: TTA
gggtacatgtgcacaacatg

SEQ ID NO: 276665 - DNA, 20 bp, Artificial Sequence
  Description of Artificial Sequence: Synthetic oligonucleotide
  Target: ATXN1; (+) strand; PAM type: YTN; PAM sequence: TTT
gttacatatgtatagatgtg

SEQ ID NO: 276666 - DNA, 20 bp, Artificial Sequence
  Description of Artificial Sequence: Synthetic oligonucleotide
  Target: ATXN1; (+) strand; PAM type: YTN; PAM sequence: TTG
ttacatatgtatagatgtgc

SEQ ID NO: 276667 - DNA, 20 bp, Artificial Sequence
  Description of Artificial Sequence: Synthetic oligonucleotide
  Target: ATXN1; (+) strand; PAM type: YTN; PAM sequence: TTA
catatgtatagatgtgccag

SEQ ID NO: 276668 - DNA, 20 bp, Artificial Sequence
  Description of Artificial Sequence: Synthetic oligonucleotide
  Target: ATXN1; (+) strand; PAM type: YTN; PAM sequence: TTG
gcgtgctgcacccattaact

SEQ ID NO: 276669 - DNA, 20 bp, Artificial Sequence
  Description of Artificial Sequence: Synthetic oligonucleotide
  Target: ATXN1; (+) strand; PAM type: YTN; PAM sequence: CTG
cacccattaacttgtcattt

SEQ ID NO: 276670 - DNA, 20 bp, Artificial Sequence
  Description of Artificial Sequence: Synthetic oligonucleotide
  Target: ATXN1; (+) strand; PAM type: YTN; PAM sequence: TTA
acttgtcatttaacattagg

SEQ ID NO: 276671 - DNA, 20 bp, Artificial Sequence
  Description of Artificial Sequence: Synthetic oligonucleotide
  Target: ATXN1; (+) strand; PAM type: YTN; PAM sequence: CTT
gtcatttaacattaggtata

SEQ ID NO: 276672 - DNA, 20 bp, Artificial Sequence
  Description of Artificial Sequence: Synthetic oligonucleotide
  Target: ATXN1; (+) strand; PAM type: YTN; PAM sequence: TTG
tcatttaacattaggtatat

SEQ ID NO: 276673 - DNA, 20 bp, Artificial Sequence
  Description of Artificial Sequence: Synthetic oligonucleotide
  Target: ATXN1; (+) strand; PAM type: YTN; PAM sequence: TTT
aacattaggtatatctccta

SEQ ID NO: 276674 - DNA, 20 bp, Artificial Sequence
  Description of Artificial Sequence: Synthetic oligonucleotide
  Target: ATXN1; (+) strand; PAM type: YTN; PAM sequence: TTA
acattaggtatatctcctaa

SEQ ID NO: 276675 - DNA, 20 bp, Artificial Sequence
  Description of Artificial Sequence: Synthetic oligonucleotide
  Target: ATXN1; (+) strand; PAM type: YTN; PAM sequence: TTA
ggtatatctcctaatgctat

SEQ ID NO: 276676 - DNA, 20 bp, Artificial Sequence
  Description of Artificial Sequence: Synthetic oligonucleotide
  Target: ATXN1; (+) strand; PAM type: YTN; PAM sequence: CTC
ctaatgctatccttcccccc

SEQ ID NO: 276677 - DNA, 20 bp, Artificial Sequence
  Description of Artificial Sequence: Synthetic oligonucleotide
  Target: ATXN1; (+) strand; PAM type: YTN; PAM sequence: CTA
atgctatccttcccccctcc

SEQ ID NO: 276678 - DNA, 20 bp, Artificial Sequence
  Description of Artificial Sequence: Synthetic oligonucleotide
  Target: ATXN1; (+) strand; PAM type: YTN; PAM sequence: CTA
tccttcccccctccccccac

SEQ ID NO: 276679 - DNA, 20 bp, Artificial Sequence
  Description of Artificial Sequence: Synthetic oligonucleotide
  Target: ATXN1; (+) strand; PAM type: YTN; PAM sequence: CTT
cccccctccccccaccccac

SEQ ID NO: 276680 - DNA, 20 bp, Artificial Sequence
  Description of Artificial Sequence: Synthetic oligonucleotide
  Target: ATXN1; (+) strand; PAM type: YTN; PAM sequence: TTC
ccccctccccccaccccaca

SEQ ID NO: 276681 - DNA, 20 bp, Artificial Sequence
  Description of Artificial Sequence: Synthetic oligonucleotide
  Target: ATXN1; (+) strand; PAM type: YTN; PAM sequence: CTC
cccccaccccacaacaggcc

SEQ ID NO: 276682 - DNA, 20 bp, Artificial Sequence
  Description of Artificial Sequence: Synthetic oligonucleotide
  Target: ATXN1; (+) strand; PAM type: YTN; PAM sequence: TTC
cccttcctgtgtccatgtgt

SEQ ID NO: 276683 - DNA, 20 bp, Artificial Sequence
  Description of Artificial Sequence: Synthetic oligonucleotide
  Target: ATXN1; (+) strand; PAM type: YTN; PAM sequence: CTT
cctgtgtccatgtgttctca

SEQ ID NO: 276684 - DNA, 20 bp, Artificial Sequence
  Description of Artificial Sequence: Synthetic oligonucleotide
  Target: ATXN1; (+) strand; PAM type: YTN; PAM sequence: TTC
ctgtgtccatgtgttctcat

SEQ ID NO: 276685 - DNA, 20 bp, Artificial Sequence
  Description of Artificial Sequence: Synthetic oligonucleotide
  Target: ATXN1; (+) strand; PAM type: YTN; PAM sequence: CTG
tgtccatgtgttctcattgt

SEQ ID NO: 276686 - DNA, 20 bp, Artificial Sequence
  Description of Artificial Sequence: Synthetic oligonucleotide
  Target: ATXN1; (+) strand; PAM type: YTN; PAM sequence: TTC
tcattgttcaattcccacct

SEQ ID NO: 276687 - DNA, 20 bp, Artificial Sequence
  Description of Artificial Sequence: Synthetic oligonucleotide
  Target: ATXN1; (+) strand; PAM type: YTN; PAM sequence: CTC
attgttcaattcccacctat

SEQ ID NO: 276688 - DNA, 20 bp, Artificial Sequence
  Description of Artificial Sequence: Synthetic oligonucleotide
  Target: ATXN1; (+) strand; PAM type: YTN; PAM sequence: TTG
ttcaattcccacctatgagt

SEQ ID NO: 276689 - DNA, 20 bp, Artificial Sequence
  Description of Artificial Sequence: Synthetic oligonucleotide
  Target: ATXN1; (+) strand; PAM type: YTN; PAM sequence: TTC
aattcccacctatgagtgag

SEQ ID NO: 276690 - DNA, 20 bp, Artificial Sequence
  Description of Artificial Sequence: Synthetic oligonucleotide
  Target: ATXN1; (+) strand; PAM type: YTN; PAM sequence: TTC
ccacctatgagtgagaacat

SEQ ID NO: 276691 - DNA, 20 bp, Artificial Sequence
  Description of Artificial Sequence: Synthetic oligonucleotide
  Target: ATXN1; (+) strand; PAM type: YTN; PAM sequence: CTA
tgagtgagaacatggggtgt

SEQ ID NO: 276692 - DNA, 20 bp, Artificial Sequence
  Description of Artificial Sequence: Synthetic oligonucleotide
  Target: ATXN1; (+) strand; PAM type: YTN; PAM sequence: TTT
ggttttttgtccttgcgatt

SEQ ID NO: 276693 - DNA, 20 bp, Artificial Sequence
  Description of Artificial Sequence: Synthetic oligonucleotide
  Target: ATXN1; (+) strand; PAM type: YTN; PAM sequence: TTG
gttttttgtccttgcgattg

SEQ ID NO: 276694 - DNA, 20 bp, Artificial Sequence
  Description of Artificial Sequence: Synthetic oligonucleotide
  Target: ATXN1; (+) strand; PAM type: YTN; PAM sequence: TTT
tttgtccttgcgattgagat

SEQ ID NO: 276695 - DNA, 20 bp, Artificial Sequence
  Description of Artificial Sequence: Synthetic oligonucleotide
  Target: ATXN1; (+) strand; PAM type: YTN; PAM sequence: TTT
ttgtccttgcgattgagata

SEQ ID NO: 276696 - DNA, 20 bp, Artificial Sequence
  Description of Artificial Sequence: Synthetic oligonucleotide
  Target: ATXN1; (+) strand; PAM type: YTN; PAM sequence: TTT
tgtccttgcgattgagatag

SEQ ID NO: 276697 - DNA, 20 bp, Artificial Sequence
  Description of Artificial Sequence: Synthetic oligonucleotide
  Target: ATXN1; (+) strand; PAM type: YTN; PAM sequence: TTT
gtccttgcgattgagatagt

SEQ ID NO: 276698 - DNA, 20 bp, Artificial Sequence
  Description of Artificial Sequence: Synthetic oligonucleotide
  Target: ATXN1; (+) strand; PAM type: YTN; PAM sequence: TTG
tccttgcgattgagatagtc

SEQ ID NO: 276699 - DNA, 20 bp, Artificial Sequence
  Description of Artificial Sequence: Synthetic oligonucleotide
  Target: ATXN1; (+) strand; PAM type: YTN; PAM sequence: CTT
gcgattgagatagtctcgct

SEQ ID NO: 276700 - DNA, 20 bp, Artificial Sequence
  Description of Artificial Sequence: Synthetic oligonucleotide
  Target: ATXN1; (+) strand; PAM type: YTN; PAM sequence: TTG
cgattgagatagtctcgctc

SEQ ID NO: 276701 - DNA, 20 bp, Artificial Sequence
  Description of Artificial Sequence: Synthetic oligonucleotide
  Target: ATXN1; (+) strand; PAM type: YTN; PAM sequence: TTG
agatagtctcgctctgtcac

SEQ ID NO: 276702 - DNA, 20 bp, Artificial Sequence
  Description of Artificial Sequence: Synthetic oligonucleotide
  Target: ATXN1; (+) strand; PAM type: YTN; PAM sequence: CTC
gctctgtcacccaggatgga

SEQ ID NO: 276703 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggatggagtgc

SEQ ID NO: 276704 - DNA, 20 bp, Artificial Sequence
  Description of Artificial Sequence: Synthetic oligonucleotide
  Target: ATXN1; (+) strand; PAM type: YTN; PAM sequence: CTG
tcacccaggatggagtgcaa

SEQ ID NO: 276705 - DNA, 20 bp, Artificial Sequence
  Description of Artificial Sequence: Synthetic oligonucleotide
  Target: ATXN1; (+) strand; PAM type: YTN; PAM sequence: CTA
tctcggctcactgcaaccta

SEQ ID NO: 276706 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctacgcc

SEQ ID NO: 276707 - DNA, 20 bp, Artificial Sequence
  Description of Artificial Sequence: Synthetic oligonucleotide
  Target: ATXN1; (+) strand; PAM type: YTN; PAM sequence: CTC
actgcaacctacgcctccca

SEQ ID NO: 276708 - DNA, 20 bp, Artificial Sequence
  Description of Artificial Sequence: Synthetic oligonucleotide
  Target: ATXN1; (+) strand; PAM type: YTN; PAM sequence: CTG
caacctacgcctcccaggtt

SEQ ID NO: 276709 - DNA, 20 bp, Artificial Sequence
  Description of Artificial Sequence: Synthetic oligonucleotide
  Target: ATXN1; (+) strand; PAM type: YTN; PAM sequence: CTA
cgcctcccaggttcaagcaa

SEQ ID NO: 276710 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcaatcctct

SEQ ID NO: 276711 - DNA, 20 bp, Artificial Sequence
  Description of Artificial Sequence: Synthetic oligonucleotide
  Target: ATXN1; (+) strand; PAM type: YTN; PAM sequence: TTC
aagcaatcctctcgcctcag

SEQ ID NO: 276712 - DNA, 20 bp, Artificial Sequence
  Description of Artificial Sequence: Synthetic oligonucleotide
  Target: ATXN1; (+) strand; PAM type: YTN; PAM sequence: CTC
tcgcctcagcctcccaagta

SEQ ID NO: 276713 - DNA, 20 bp, Artificial Sequence
  Description of Artificial Sequence: Synthetic oligonucleotide
  Target: ATXN1; (+) strand; PAM type: YTN; PAM sequence: CTC
gcctcagcctcccaagtagc

SEQ ID NO: 276714 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 276715 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggactacag

SEQ ID NO: 276716 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcatgagccac

SEQ ID NO: 276717 - DNA, 20 bp, Artificial Sequence
  Description of Artificial Sequence: Synthetic oligonucleotide
  Target: ATXN1; (+) strand; PAM type: YTN; PAM sequence: CTA
caggcatgagccaccacacc

SEQ ID NO: 276718 - DNA, 20 bp, Artificial Sequence
  Description of Artificial Sequence: Synthetic oligonucleotide
  Target: ATXN1; (+) strand; PAM type: YTN; PAM sequence: CTG
gctaattcttgttttttcag

SEQ ID NO: 276719 - DNA, 20 bp, Artificial Sequence
  Description of Artificial Sequence: Synthetic oligonucleotide
  Target: ATXN1; (+) strand; PAM type: YTN; PAM sequence: CTA
attcttgttttttcagtaga

SEQ ID NO: 276720 - DNA, 20 bp, Artificial Sequence
  Description of Artificial Sequence: Synthetic oligonucleotide
  Target: ATXN1; (+) strand; PAM type: YTN; PAM sequence: TTC
ttgttttttcagtagagaca

SEQ ID NO: 276721 - DNA, 20 bp, Artificial Sequence
  Description of Artificial Sequence: Synthetic oligonucleotide
  Target: ATXN1; (+) strand; PAM type: YTN; PAM sequence: CTT
gttttttcagtagagacagg

SEQ ID NO: 276722 - DNA, 20 bp, Artificial Sequence
  Description of Artificial Sequence: Synthetic oligonucleotide
  Target: ATXN1; (+) strand; PAM type: YTN; PAM sequence: TTG
ttttttcagtagagacaggg

SEQ ID NO: 276723 - DNA, 20 bp, Artificial Sequence
  Description of Artificial Sequence: Synthetic oligonucleotide
  Target: ATXN1; (+) strand; PAM type: YTN; PAM sequence: TTT
tttcagtagagacagggttt

SEQ ID NO: 276724 - DNA, 20 bp, Artificial Sequence
  Description of Artificial Sequence: Synthetic oligonucleotide
  Target: ATXN1; (+) strand; PAM type: YTN; PAM sequence: TTT
ttcagtagagacagggtttc

SEQ ID NO: 276725 - DNA, 20 bp, Artificial Sequence
  Description of Artificial Sequence: Synthetic oligonucleotide
  Target: ATXN1; (+) strand; PAM type: YTN; PAM sequence: TTT
tcagtagagacagggtttca

SEQ ID NO: 276726 - DNA, 20 bp, Artificial Sequence
  Description of Artificial Sequence: Synthetic oligonucleotide
  Target: ATXN1; (+) strand; PAM type: YTN; PAM sequence: TTT
cagtagagacagggtttcac

SEQ ID NO: 276727 - DNA, 20 bp, Artificial Sequence
  Description of Artificial Sequence: Synthetic oligonucleotide
  Target: ATXN1; (+) strand; PAM type: YTN; PAM sequence: TTC
agtagagacagggtttcacc

SEQ ID NO: 276728 - DNA, 20 bp, Artificial Sequence
  Description of Artificial Sequence: Synthetic oligonucleotide
  Target: ATXN1; (+) strand; PAM type: YTN; PAM sequence: TTT
caccatgttgtccaggatgg

SEQ ID NO: 276729 - DNA, 20 bp, Artificial Sequence
  Description of Artificial Sequence: Synthetic oligonucleotide
  Target: ATXN1; (+) strand; PAM type: YTN; PAM sequence: TTC
accatgttgtccaggatggt

SEQ ID NO: 276730 - DNA, 20 bp, Artificial Sequence
  Description of Artificial Sequence: Synthetic oligonucleotide
  Target: ATXN1; (+) strand; PAM type: YTN; PAM sequence: TTG
tccaggatggtctcgaactc

SEQ ID NO: 276731 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 276732 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 276733 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacctgc

SEQ ID NO: 276734 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacctgcctcgg

SEQ ID NO: 276735 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtgct

SEQ ID NO: 276736 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 276737 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 276738 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgagtcac

SEQ ID NO: 276739 - DNA, 20 bp, Artificial Sequence
  Description of Artificial Sequence: Synthetic oligonucleotide
  Target: ATXN1; (+) strand; PAM type: YTN; PAM sequence: TTA
caggcatgagtcactgcgcc

SEQ ID NO: 276740 - DNA, 20 bp, Artificial Sequence
  Description of Artificial Sequence: Synthetic oligonucleotide
  Target: ATXN1; (+) strand; PAM type: YTN; PAM sequence: CTG
cgcccagcccaaaataacta

SEQ ID NO: 276741 - DNA, 20 bp, Artificial Sequence
  Description of Artificial Sequence: Synthetic oligonucleotide
  Target: ATXN1; (+) strand; PAM type: YTN; PAM sequence: CTA
ttctaacctatcctctcctc

SEQ ID NO: 276742 - DNA, 20 bp, Artificial Sequence
  Description of Artificial Sequence: Synthetic oligonucleotide
  Target: ATXN1; (+) strand; PAM type: YTN; PAM sequence: TTC
taacctatcctctcctcact

SEQ ID NO: 276743 - DNA, 20 bp, Artificial Sequence
  Description of Artificial Sequence: Synthetic oligonucleotide
  Target: ATXN1; (+) strand; PAM type: YTN; PAM sequence: CTA
acctatcctctcctcactac

SEQ ID NO: 276744 - DNA, 20 bp, Artificial Sequence
  Description of Artificial Sequence: Synthetic oligonucleotide
  Target: ATXN1; (+) strand; PAM type: YTN; PAM sequence: CTA
tcctctcctcactacttacc

SEQ ID NO: 276745 - DNA, 20 bp, Artificial Sequence
  Description of Artificial Sequence: Synthetic oligonucleotide
  Target: ATXN1; (+) strand; PAM type: YTN; PAM sequence: CTC
tcctcactacttacccccac

SEQ ID NO: 276746 - DNA, 20 bp, Artificial Sequence
  Description of Artificial Sequence: Synthetic oligonucleotide
  Target: ATXN1; (+) strand; PAM type: YTN; PAM sequence: CTC
ctcactacttacccccacta

SEQ ID NO: 276747 - DNA, 20 bp, Artificial Sequence
  Description of Artificial Sequence: Synthetic oligonucleotide
  Target: ATXN1; (+) strand; PAM type: YTN; PAM sequence: CTC
actacttacccccactatcc

SEQ ID NO: 276748 - DNA, 20 bp, Artificial Sequence
  Description of Artificial Sequence: Synthetic oligonucleotide
  Target: ATXN1; (+) strand; PAM type: YTN; PAM sequence: CTA
cttacccccactatccttca

SEQ ID NO: 276749 - DNA, 20 bp, Artificial Sequence
  Description of Artificial Sequence: Synthetic oligonucleotide
  Target: ATXN1; (+) strand; PAM type: YTN; PAM sequence: CTT
acccccactatccttcacct

SEQ ID NO: 276750 - DNA, 20 bp, Artificial Sequence
  Description of Artificial Sequence: Synthetic oligonucleotide
  Target: ATXN1; (+) strand; PAM type: YTN; PAM sequence: TTA
cccccactatccttcacctg

SEQ ID NO: 276751 - DNA, 20 bp, Artificial Sequence
  Description of Artificial Sequence: Synthetic oligonucleotide
  Target: ATXN1; (+) strand; PAM type: YTN; PAM sequence: CTA
tccttcacctgccaacccac

SEQ ID NO: 276752 - DNA, 20 bp, Artificial Sequence
  Description of Artificial Sequence: Synthetic oligonucleotide
  Target: ATXN1; (+) strand; PAM type: YTN; PAM sequence: CTT
cacctgccaacccactctaa

SEQ ID NO: 276753 - DNA, 20 bp, Artificial Sequence
  Description of Artificial Sequence: Synthetic oligonucleotide
  Target: ATXN1; (+) strand; PAM type: YTN; PAM sequence: TTC
acctgccaacccactctaag

SEQ ID NO: 276754 - DNA, 20 bp, Artificial Sequence
  Description of Artificial Sequence: Synthetic oligonucleotide
  Target: ATXN1; (+) strand; PAM type: YTN; PAM sequence: CTG
ccaacccactctaagtctgt

SEQ ID NO: 276755 - DNA, 20 bp, Artificial Sequence
  Description of Artificial Sequence: Synthetic oligonucleotide
  Target: ATXN1; (+) strand; PAM type: YTN; PAM sequence: CTC
taagtctgttcatttagact

SEQ ID NO: 276756 - DNA, 20 bp, Artificial Sequence
  Description of Artificial Sequence: Synthetic oligonucleotide
  Target: ATXN1; (+) strand; PAM type: YTN; PAM sequence: CTA
agtctgttcatttagacttc

SEQ ID NO: 276757 - DNA, 20 bp, Artificial Sequence
  Description of Artificial Sequence: Synthetic oligonucleotide
  Target: ATXN1; (+) strand; PAM type: YTN; PAM sequence: CTG
ttcatttagacttctaccca

SEQ ID NO: 276758 - DNA, 20 bp, Artificial Sequence
  Description of Artificial Sequence: Synthetic oligonucleotide
  Target: ATXN1; (+) strand; PAM type: YTN; PAM sequence: TTC
atttagacttctacccattc

SEQ ID NO: 276759 - DNA, 20 bp, Artificial Sequence
  Description of Artificial Sequence: Synthetic oligonucleotide
  Target: ATXN1; (+) strand; PAM type: YTN; PAM sequence: TTT
agacttctacccattcccat

SEQ ID NO: 276760 - DNA, 20 bp, Artificial Sequence
  Description of Artificial Sequence: Synthetic oligonucleotide
  Target: ATXN1; (+) strand; PAM type: YTN; PAM sequence: TTA
gacttctacccattcccatg

SEQ ID NO: 276761 - DNA, 20 bp, Artificial Sequence
  Description of Artificial Sequence: Synthetic oligonucleotide
  Target: ATXN1; (+) strand; PAM type: YTN; PAM sequence: CTT
ctacccattcccatgcagaa

SEQ ID NO: 276762 - DNA, 20 bp, Artificial Sequence
  Description of Artificial Sequence: Synthetic oligonucleotide
  Target: ATXN1; (+) strand; PAM type: YTN; PAM sequence: TTC
tacccattcccatgcagaaa

SEQ ID NO: 276763 - DNA, 20 bp, Artificial Sequence
  Description of Artificial Sequence: Synthetic oligonucleotide
  Target: ATXN1; (+) strand; PAM type: YTN; PAM sequence: CTA
cccattcccatgcagaaagg

SEQ ID NO: 276764 - DNA, 20 bp, Artificial Sequence
  Description of Artificial Sequence: Synthetic oligonucleotide
  Target: ATXN1; (+) strand; PAM type: YTN; PAM sequence: TTC
ccatgcagaaaggaccagtt

SEQ ID NO: 276765 - DNA, 20 bp, Artificial Sequence
  Description of Artificial Sequence: Synthetic oligonucleotide
  Target: ATXN1; (+) strand; PAM type: YTN; PAM sequence: TTC
agcaacagcagggatgctgg

SEQ ID NO: 276766 - DNA, 20 bp, Artificial Sequence
  Description of Artificial Sequence: Synthetic oligonucleotide
  Target: ATXN1; (+) strand; PAM type: YTN; PAM sequence: CTG
gcaggtaggttttagaaact

SEQ ID NO: 276767 - DNA, 20 bp, Artificial Sequence
  Description of Artificial Sequence: Synthetic oligonucleotide
  Target: ATXN1; (+) strand; PAM type: YTN; PAM sequence: TTT
tagaaactcttaatcacagg

SEQ ID NO: 276768 - DNA, 20 bp, Artificial Sequence
  Description of Artificial Sequence: Synthetic oligonucleotide
  Target: ATXN1; (+) strand; PAM type: YTN; PAM sequence: TTT
agaaactcttaatcacaggg

SEQ ID NO: 276769 - DNA, 20 bp, Artificial Sequence
  Description of Artificial Sequence: Synthetic oligonucleotide
  Target: ATXN1; (+) strand; PAM type: YTN; PAM sequence: TTA
gaaactcttaatcacagggc

SEQ ID NO: 276770 - DNA, 20 bp, Artificial Sequence
  Description of Artificial Sequence: Synthetic oligonucleotide
  Target: ATXN1; (+) strand; PAM type: YTN; PAM sequence: CTC
ttaatcacagggctaatgtg

SEQ ID NO: 276771 - DNA, 20 bp, Artificial Sequence
  Description of Artificial Sequence: Synthetic oligonucleotide
  Target: ATXN1; (+) strand; PAM type: YTN; PAM sequence: CTT
aatcacagggctaatgtgtt

SEQ ID NO: 276772 - DNA, 20 bp, Artificial Sequence
  Description of Artificial Sequence: Synthetic oligonucleotide
  Target: ATXN1; (+) strand; PAM type: YTN; PAM sequence: TTA
atcacagggctaatgtgttg

SEQ ID NO: 276773 - DNA, 20 bp, Artificial Sequence
  Description of Artificial Sequence: Synthetic oligonucleotide
  Target: ATXN1; (+) strand; PAM type: YTN; PAM sequence: CTA
atgtgttgatccagcttaaa

SEQ ID NO: 276774 - DNA, 20 bp, Artificial Sequence
  Description of Artificial Sequence: Synthetic oligonucleotide
  Target: ATXN1; (+) strand; PAM type: YTN; PAM sequence: TTG
atccagcttaaatgtatagc

SEQ ID NO: 276775 - DNA, 20 bp, Artificial Sequence
  Description of Artificial Sequence: Synthetic oligonucleotide
  Target: ATXN1; (+) strand; PAM type: YTN; PAM sequence: CTT
aaatgtatagctaatgattc

SEQ ID NO: 276776 - DNA, 20 bp, Artificial Sequence
  Description of Artificial Sequence: Synthetic oligonucleotide
  Target: ATXN1; (+) strand; PAM type: YTN; PAM sequence: TTA
aatgtatagctaatgattca

SEQ ID NO: 276777 - DNA, 20 bp, Artificial Sequence
  Description of Artificial Sequence: Synthetic oligonucleotide
  Target: ATXN1; (+) strand; PAM type: YTN; PAM sequence: CTA
atgattcattccacttttca

SEQ ID NO: 276778 - DNA, 20 bp, Artificial Sequence
  Description of Artificial Sequence: Synthetic oligonucleotide
  Target: ATXN1; (+) strand; PAM type: YTN; PAM sequence: TTC
attccacttttcattttata

SEQ ID NO: 276779 - DNA, 20 bp, Artificial Sequence
  Description of Artificial Sequence: Synthetic oligonucleotide
  Target: ATXN1; (+) strand; PAM type: YTN; PAM sequence: TTC
cacttttcattttataacaa

SEQ ID NO: 276780 - DNA, 20 bp, Artificial Sequence
  Description of Artificial Sequence: Synthetic oligonucleotide
  Target: ATXN1; (+) strand; PAM type: YTN; PAM sequence: CTT
ttcattttataacaagggtt

SEQ ID NO: 276781 - DNA, 20 bp, Artificial Sequence
  Description of Artificial Sequence: Synthetic oligonucleotide
  Target: ATXN1; (+) strand; PAM type: YTN; PAM sequence: TTT
tcattttataacaagggttt

SEQ ID NO: 276782 - DNA, 20 bp, Artificial Sequence
  Description of Artificial Sequence: Synthetic oligonucleotide
  Target: ATXN1; (+) strand; PAM type: YTN; PAM sequence: TTT
cattttataacaagggtttt

SEQ ID NO: 276783 - DNA, 20 bp, Artificial Sequence
  Description of Artificial Sequence: Synthetic oligonucleotide
  Target: ATXN1; (+) strand; PAM type: YTN; PAM sequence: TTC
attttataacaagggttttt

SEQ ID NO: 276784 - DNA, 20 bp, Artificial Sequence
  Description of Artificial Sequence: Synthetic oligonucleotide
  Target: ATXN1; (+) strand; PAM type: YTN; PAM sequence: TTT
tataacaagggtttttttgc

SEQ ID NO: 276785 - DNA, 20 bp, Artificial Sequence
  Description of Artificial Sequence: Synthetic oligonucleotide
  Target: ATXN1; (+) strand; PAM type: YTN; PAM sequence: TTT
ataacaagggtttttttgca

SEQ ID NO: 276786 - DNA, 20 bp, Artificial Sequence
  Description of Artificial Sequence: Synthetic oligonucleotide
  Target: ATXN1; (+) strand; PAM type: YTN; PAM sequence: TTA
taacaagggtttttttgcat

SEQ ID NO: 276787 - DNA, 20 bp, Artificial Sequence
  Description of Artificial Sequence: Synthetic oligonucleotide
  Target: ATXN1; (+) strand; PAM type: YTN; PAM sequence: TTT
ttttgcatgcagattttatc

SEQ ID NO: 276788 - DNA, 20 bp, Artificial Sequence
  Description of Artificial Sequence: Synthetic oligonucleotide
  Target: ATXN1; (+) strand; PAM type: YTN; PAM sequence: TTT
tttgcatgcagattttatca

SEQ ID NO: 276789 - DNA, 20 bp, Artificial Sequence
  Description of Artificial Sequence: Synthetic oligonucleotide
  Target: ATXN1; (+) strand; PAM type: YTN; PAM sequence: TTT
ttgcatgcagattttatcat

SEQ ID NO: 276790 - DNA, 20 bp, Artificial Sequence
  Description of Artificial Sequence: Synthetic oligonucleotide
  Target: ATXN1; (+) strand; PAM type: YTN; PAM sequence: TTT
tgcatgcagattttatcatg

SEQ ID NO: 276791 - DNA, 20 bp, Artificial Sequence
  Description of Artificial Sequence: Synthetic oligonucleotide
  Target: ATXN1; (+) strand; PAM type: YTN; PAM sequence: TTT
gcatgcagattttatcatga

SEQ ID NO: 276792 - DNA, 20 bp, Artificial Sequence
  Description of Artificial Sequence: Synthetic oligonucleotide
  Target: ATXN1; (+) strand; PAM type: YTN; PAM sequence: TTG
catgcagattttatcatgac

SEQ ID NO: 276793 - DNA, 20 bp, Artificial Sequence
  Description of Artificial Sequence: Synthetic oligonucleotide
  Target: ATXN1; (+) strand; PAM type: YTN; PAM sequence: TTT
tatcatgacgcttgctttct

SEQ ID NO: 276794 - DNA, 20 bp, Artificial Sequence
  Description of Artificial Sequence: Synthetic oligonucleotide
  Target: ATXN1; (+) strand; PAM type: YTN; PAM sequence: TTT
atcatgacgcttgctttctc

SEQ ID NO: 276795 - DNA, 20 bp, Artificial Sequence
  Description of Artificial Sequence: Synthetic oligonucleotide
  Target: ATXN1; (+) strand; PAM type: YTN; PAM sequence: TTA
tcatgacgcttgctttctct

SEQ ID NO: 276796 - DNA, 20 bp, Artificial Sequence
  Description of Artificial Sequence: Synthetic oligonucleotide
  Target: ATXN1; (+) strand; PAM type: YTN; PAM sequence: CTT
gctttctctcttctcttgta

SEQ ID NO: 276797 - DNA, 20 bp, Artificial Sequence
  Description of Artificial Sequence: Synthetic oligonucleotide
  Target: ATXN1; (+) strand; PAM type: YTN; PAM sequence: TTG
ctttctctcttctcttgtat

SEQ ID NO: 276798 - DNA, 20 bp, Artificial Sequence
  Description of Artificial Sequence: Synthetic oligonucleotide
  Target: ATXN1; (+) strand; PAM type: YTN; PAM sequence: CTT
tctctcttctcttgtatcaa

SEQ ID NO: 276799 - DNA, 20 bp, Artificial Sequence
  Description of Artificial Sequence: Synthetic oligonucleotide
  Target: ATXN1; (+) strand; PAM type: YTN; PAM sequence: TTT
ctctcttctcttgtatcaag

SEQ ID NO: 276800 - DNA, 20 bp, Artificial Sequence
  Description of Artificial Sequence: Synthetic oligonucleotide
  Target: ATXN1; (+) strand; PAM type: YTN; PAM sequence: TTC
tctcttctcttgtatcaagc

SEQ ID NO: 276801 - DNA, 20 bp, Artificial Sequence
  Description of Artificial Sequence: Synthetic oligonucleotide
  Target: ATXN1; (+) strand; PAM type: YTN; PAM sequence: CTC
tcttctcttgtatcaagcat

SEQ ID NO: 276802 - DNA, 20 bp, Artificial Sequence
  Description of Artificial Sequence: Synthetic oligonucleotide
  Target: ATXN1; (+) strand; PAM type: YTN; PAM sequence: CTC
ttctcttgtatcaagcatct

SEQ ID NO: 276803 - DNA, 20 bp, Artificial Sequence
  Description of Artificial Sequence: Synthetic oligonucleotide
  Target: ATXN1; (+) strand; PAM type: YTN; PAM sequence: CTT
ctcttgtatcaagcatcttt

SEQ ID NO: 276804 - DNA, 20 bp, Artificial Sequence
  Description of Artificial Sequence: Synthetic oligonucleotide
  Target: ATXN1; (+) strand; PAM type: YTN; PAM sequence: TTC
tcttgtatcaagcatctttt

SEQ ID NO: 276805 - DNA, 20 bp, Artificial Sequence
  Description of Artificial Sequence: Synthetic oligonucleotide
  Target: ATXN1; (+) strand; PAM type: YTN; PAM sequence: CTC
ttgtatcaagcatcttttca

SEQ ID NO: 276806 - DNA, 20 bp, Artificial Sequence
  Description of Artificial Sequence: Synthetic oligonucleotide
  Target: ATXN1; (+) strand; PAM type: YTN; PAM sequence: CTT
gtatcaagcatcttttcatc

SEQ ID NO: 276807 - DNA, 20 bp, Artificial Sequence
  Description of Artificial Sequence: Synthetic oligonucleotide
  Target: ATXN1; (+) strand; PAM type: YTN; PAM sequence: TTG
tatcaagcatcttttcatct

SEQ ID NO: 276808 - DNA, 20 bp, Artificial Sequence
  Description of Artificial Sequence: Synthetic oligonucleotide
  Target: ATXN1; (+) strand; PAM type: YTN; PAM sequence: CTT
ttcatcttcagctctgtccc

SEQ ID NO: 276809 - DNA, 20 bp, Artificial Sequence
  Description of Artificial Sequence: Synthetic oligonucleotide
  Target: ATXN1; (+) strand; PAM type: YTN; PAM sequence: TTT
tcatcttcagctctgtccca

SEQ ID NO: 276810 - DNA, 20 bp, Artificial Sequence
  Description of Artificial Sequence: Synthetic oligonucleotide
  Target: ATXN1; (+) strand; PAM type: YTN; PAM sequence: TTT
catcttcagctctgtcccac

SEQ ID NO: 276811 - DNA, 20 bp, Artificial Sequence
  Description of Artificial Sequence: Synthetic oligonucleotide
  Target: ATXN1; (+) strand; PAM type: YTN; PAM sequence: TTC
atcttcagctctgtcccacc

SEQ ID NO: 276812 - DNA, 20 bp, Artificial Sequence
  Description of Artificial Sequence: Synthetic oligonucleotide
  Target: ATXN1; (+) strand; PAM type: YTN; PAM sequence: CTT
cagctctgtcccaccccact

SEQ ID NO: 276813 - DNA, 20 bp, Artificial Sequence
  Description of Artificial Sequence: Synthetic oligonucleotide
  Target: ATXN1; (+) strand; PAM type: YTN; PAM sequence: TTC
agctctgtcccaccccactg

SEQ ID NO: 276814 - DNA, 20 bp, Artificial Sequence
  Description of Artificial Sequence: Synthetic oligonucleotide
  Target: ATXN1; (+) strand; PAM type: YTN; PAM sequence: CTC
tgtcccaccccactgctgaa

SEQ ID NO: 276815 - DNA, 20 bp, Artificial Sequence
  Description of Artificial Sequence: Synthetic oligonucleotide
  Target: ATXN1; (+) strand; PAM type: YTN; PAM sequence: CTG
tcccaccccactgctgaatt

SEQ ID NO: 276816 - DNA, 20 bp, Artificial Sequence
  Description of Artificial Sequence: Synthetic oligonucleotide
  Target: ATXN1; (+) strand; PAM type: YTN; PAM sequence: CTG
ctgaattttttaaaaaagaa

SEQ ID NO: 276817 - DNA, 20 bp, Artificial Sequence
  Description of Artificial Sequence: Synthetic oligonucleotide
  Target: ATXN1; (+) strand; PAM type: YTN; PAM sequence: CTG
aattttttaaaaaagaaaaa

SEQ ID NO: 276818 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaagaaaaaagaaa

SEQ ID NO: 276819 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaagaaaaaagaaac

SEQ ID NO: 276820 - DNA, 20 bp, Artificial Sequence
  Description of Artificial Sequence: Synthetic oligonucleotide
  Target: ATXN1; (+) strand; PAM type: YTN; PAM sequence: TTT
taaaaaagaaaaaagaaacc

SEQ ID NO: 276821 - DNA, 20 bp, Artificial Sequence
  Description of Artificial Sequence: Synthetic oligonucleotide
  Target: ATXN1; (+) strand; PAM type: YTN; PAM sequence: TTT
aaaaaagaaaaaagaaaccc

SEQ ID NO: 276822 - DNA, 20 bp, Artificial Sequence
  Description of Artificial Sequence: Synthetic oligonucleotide
  Target: ATXN1; (+) strand; PAM type: YTN; PAM sequence: TTA
aaaaagaaaaaagaaaccca

SEQ ID NO: 276823 - DNA, 20 bp, Artificial Sequence
  Description of Artificial Sequence: Synthetic oligonucleotide
  Target: ATXN1; (+) strand; PAM type: YTN; PAM sequence: CTA
gctcagaggcctatgtattt

SEQ ID NO: 276824 - DNA, 20 bp, Artificial Sequence
  Description of Artificial Sequence: Synthetic oligonucleotide
  Target: ATXN1; (+) strand; PAM type: YTN; PAM sequence: CTC
agaggcctatgtattttgct

SEQ ID NO: 276825 - DNA, 20 bp, Artificial Sequence
  Description of Artificial Sequence: Synthetic oligonucleotide
  Target: ATXN1; (+) strand; PAM type: YTN; PAM sequence: CTA
tgtattttgctctgaacttc

SEQ ID NO: 276826 - DNA, 20 bp, Artificial Sequence
  Description of Artificial Sequence: Synthetic oligonucleotide
  Target: ATXN1; (+) strand; PAM type: YTN; PAM sequence: TTT
tgctctgaacttcacactga

SEQ ID NO: 276827 - DNA, 20 bp, Artificial Sequence
  Description of Artificial Sequence: Synthetic oligonucleotide
  Target: ATXN1; (+) strand; PAM type: YTN; PAM sequence: TTT
gctctgaacttcacactgac

SEQ ID NO: 276828 - DNA, 20 bp, Artificial Sequence
  Description of Artificial Sequence: Synthetic oligonucleotide
  Target: ATXN1; (+) strand; PAM type: YTN; PAM sequence: TTG
ctctgaacttcacactgacg

SEQ ID NO: 276829 - DNA, 20 bp, Artificial Sequence
  Description of Artificial Sequence: Synthetic oligonucleotide
  Target: ATXN1; (+) strand; PAM type: YTN; PAM sequence: CTC
tgaacttcacactgacgata

SEQ ID NO: 276830 - DNA, 20 bp, Artificial Sequence
  Description of Artificial Sequence: Synthetic oligonucleotide
  Target: ATXN1; (+) strand; PAM type: YTN; PAM sequence: CTG
aacttcacactgacgatatt

SEQ ID NO: 276831 - DNA, 20 bp, Artificial Sequence
  Description of Artificial Sequence: Synthetic oligonucleotide
  Target: ATXN1; (+) strand; PAM type: YTN; PAM sequence: CTT
cacactgacgatattataca

SEQ ID NO: 276832 - DNA, 20 bp, Artificial Sequence
  Description of Artificial Sequence: Synthetic oligonucleotide
  Target: ATXN1; (+) strand; PAM type: YTN; PAM sequence: TTC
acactgacgatattatacac

SEQ ID NO: 276833 - DNA, 20 bp, Artificial Sequence
  Description of Artificial Sequence: Synthetic oligonucleotide
  Target: ATXN1; (+) strand; PAM type: YTN; PAM sequence: CTG
acgatattatacacagtcat

SEQ ID NO: 276834 - DNA, 20 bp, Artificial Sequence
  Description of Artificial Sequence: Synthetic oligonucleotide
  Target: ATXN1; (+) strand; PAM type: YTN; PAM sequence: TTA
tacacagtcatggcagtgac

SEQ ID NO: 276835 - DNA, 20 bp, Artificial Sequence
  Description of Artificial Sequence: Synthetic oligonucleotide
  Target: ATXN1; (+) strand; PAM type: YTN; PAM sequence: CTG
tattatacacggtcatggaa

SEQ ID NO: 276836 - DNA, 20 bp, Artificial Sequence
  Description of Artificial Sequence: Synthetic oligonucleotide
  Target: ATXN1; (+) strand; PAM type: YTN; PAM sequence: TTA
tacacggtcatggaagttat

SEQ ID NO: 276837 - DNA, 20 bp, Artificial Sequence
  Description of Artificial Sequence: Synthetic oligonucleotide
  Target: ATXN1; (+) strand; PAM type: YTN; PAM sequence: TTA
tggagaattggaatctaatg

SEQ ID NO: 276838 - DNA, 20 bp, Artificial Sequence
  Description of Artificial Sequence: Synthetic oligonucleotide
  Target: ATXN1; (+) strand; PAM type: YTN; PAM sequence: TTG
gaatctaatgaaaagagata

SEQ ID NO: 276839 - DNA, 20 bp, Artificial Sequence
  Description of Artificial Sequence: Synthetic oligonucleotide
  Target: ATXN1; (+) strand; PAM type: YTN; PAM sequence: CTA
atgaaaagagataagagagg

SEQ ID NO: 276840 - DNA, 20 bp, Artificial Sequence
  Description of Artificial Sequence: Synthetic oligonucleotide
  Target: ATXN1; (+) strand; PAM type: YTN; PAM sequence: CTT
gaaaatcagccccaatatct

SEQ ID NO: 276841 - DNA, 20 bp, Artificial Sequence
  Description of Artificial Sequence: Synthetic oligonucleotide
  Target: ATXN1; (+) strand; PAM type: YTN; PAM sequence: TTG
aaaatcagccccaatatctc

SEQ ID NO: 276842 - DNA, 20 bp, Artificial Sequence
  Description of Artificial Sequence: Synthetic oligonucleotide
  Target: ATXN1; (+) strand; PAM type: YTN; PAM sequence: CTC
acccagatatgggtggcctc

SEQ ID NO: 276843 - DNA, 20 bp, Artificial Sequence
  Description of Artificial Sequence: Synthetic oligonucleotide
  Target: ATXN1; (+) strand; PAM type: YTN; PAM sequence: CTC
agagcttattgatatagact

SEQ ID NO: 276844 - DNA, 20 bp, Artificial Sequence
  Description of Artificial Sequence: Synthetic oligonucleotide
  Target: ATXN1; (+) strand; PAM type: YTN; PAM sequence: CTT
attgatatagactgtgtctc

SEQ ID NO: 276845 - DNA, 20 bp, Artificial Sequence
  Description of Artificial Sequence: Synthetic oligonucleotide
  Target: ATXN1; (+) strand; PAM type: YTN; PAM sequence: TTA
ttgatatagactgtgtctct

SEQ ID NO: 276846 - DNA, 20 bp, Artificial Sequence
  Description of Artificial Sequence: Synthetic oligonucleotide
  Target: ATXN1; (+) strand; PAM type: YTN; PAM sequence: TTG
atatagactgtgtctctcac

SEQ ID NO: 276847 - DNA, 20 bp, Artificial Sequence
  Description of Artificial Sequence: Synthetic oligonucleotide
  Target: ATXN1; (+) strand; PAM type: YTN; PAM sequence: CTG
tgtctctcaccaaagggcat

SEQ ID NO: 276848 - DNA, 20 bp, Artificial Sequence
  Description of Artificial Sequence: Synthetic oligonucleotide
  Target: ATXN1; (+) strand; PAM type: YTN; PAM sequence: CTC
tcaccaaagggcatgccatt

SEQ ID NO: 276849 - DNA, 20 bp, Artificial Sequence
  Description of Artificial Sequence: Synthetic oligonucleotide
  Target: ATXN1; (+) strand; PAM type: YTN; PAM sequence: CTC
accaaagggcatgccatttg

SEQ ID NO: 276850 - DNA, 20 bp, Artificial Sequence
  Description of Artificial Sequence: Synthetic oligonucleotide
  Target: ATXN1; (+) strand; PAM type: YTN; PAM sequence: TTT
gcttgccatcatttctttaa

SEQ ID NO: 276851 - DNA, 20 bp, Artificial Sequence
  Description of Artificial Sequence: Synthetic oligonucleotide
  Target: ATXN1; (+) strand; PAM type: YTN; PAM sequence: TTG
cttgccatcatttctttaaa

SEQ ID NO: 276852 - DNA, 20 bp, Artificial Sequence
  Description of Artificial Sequence: Synthetic oligonucleotide
  Target: ATXN1; (+) strand; PAM type: YTN; PAM sequence: CTT
gccatcatttctttaaaact

SEQ ID NO: 276853 - DNA, 20 bp, Artificial Sequence
  Description of Artificial Sequence: Synthetic oligonucleotide
  Target: ATXN1; (+) strand; PAM type: YTN; PAM sequence: TTG
ccatcatttctttaaaacta

SEQ ID NO: 276854 - DNA, 20 bp, Artificial Sequence
  Description of Artificial Sequence: Synthetic oligonucleotide
  Target: ATXN1; (+) strand; PAM type: YTN; PAM sequence: TTT
ctttaaaactattagtcact

SEQ ID NO: 276855 - DNA, 20 bp, Artificial Sequence
  Description of Artificial Sequence: Synthetic oligonucleotide
  Target: ATXN1; (+) strand; PAM type: YTN; PAM sequence: TTC
tttaaaactattagtcactc

SEQ ID NO: 276856 - DNA, 20 bp, Artificial Sequence
  Description of Artificial Sequence: Synthetic oligonucleotide
  Target: ATXN1; (+) strand; PAM type: YTN; PAM sequence: CTT
taaaactattagtcactctc

SEQ ID NO: 276857 - DNA, 20 bp, Artificial Sequence
  Description of Artificial Sequence: Synthetic oligonucleotide
  Target: ATXN1; (+) strand; PAM type: YTN; PAM sequence: TTT
aaaactattagtcactctca

SEQ ID NO: 276858 - DNA, 20 bp, Artificial Sequence
  Description of Artificial Sequence: Synthetic oligonucleotide
  Target: ATXN1; (+) strand; PAM type: YTN; PAM sequence: TTA
aaactattagtcactctcac

SEQ ID NO: 276859 - DNA, 20 bp, Artificial Sequence
  Description of Artificial Sequence: Synthetic oligonucleotide
  Target: ATXN1; (+) strand; PAM type: YTN; PAM sequence: CTA
ttagtcactctcacaccgat

SEQ ID NO: 276860 - DNA, 20 bp, Artificial Sequence
  Description of Artificial Sequence: Synthetic oligonucleotide
  Target: ATXN1; (+) strand; PAM type: YTN; PAM sequence: TTA
gtcactctcacaccgattta

SEQ ID NO: 276861 - DNA, 20 bp, Artificial Sequence
  Description of Artificial Sequence: Synthetic oligonucleotide
  Target: ATXN1; (+) strand; PAM type: YTN; PAM sequence: CTC
tcacaccgatttacctttaa

SEQ ID NO: 276862 - DNA, 20 bp, Artificial Sequence
  Description of Artificial Sequence: Synthetic oligonucleotide
  Target: ATXN1; (+) strand; PAM type: YTN; PAM sequence: CTC
acaccgatttacctttaaac

SEQ ID NO: 276863 - DNA, 20 bp, Artificial Sequence
  Description of Artificial Sequence: Synthetic oligonucleotide
  Target: ATXN1; (+) strand; PAM type: YTN; PAM sequence: TTT
acctttaaacaaggacattc

SEQ ID NO: 276864 - DNA, 20 bp, Artificial Sequence
  Description of Artificial Sequence: Synthetic oligonucleotide
  Target: ATXN1; (+) strand; PAM type: YTN; PAM sequence: TTA
cctttaaacaaggacattct

SEQ ID NO: 276865 - DNA, 20 bp, Artificial Sequence
  Description of Artificial Sequence: Synthetic oligonucleotide
  Target: ATXN1; (+) strand; PAM type: YTN; PAM sequence: CTT
taaacaaggacattctataa

SEQ ID NO: 276866 - DNA, 20 bp, Artificial Sequence
  Description of Artificial Sequence: Synthetic oligonucleotide
  Target: ATXN1; (+) strand; PAM type: YTN; PAM sequence: TTT
aaacaaggacattctataac

SEQ ID NO: 276867 - DNA, 20 bp, Artificial Sequence
  Description of Artificial Sequence: Synthetic oligonucleotide
  Target: ATXN1; (+) strand; PAM type: YTN; PAM sequence: TTA
aacaaggacattctataacc

SEQ ID NO: 276868 - DNA, 20 bp, Artificial Sequence
  Description of Artificial Sequence: Synthetic oligonucleotide
  Target: ATXN1; (+) strand; PAM type: YTN; PAM sequence: TTC
tataaccagggatccacctc

SEQ ID NO: 276869 - DNA, 20 bp, Artificial Sequence
  Description of Artificial Sequence: Synthetic oligonucleotide
  Target: ATXN1; (+) strand; PAM type: YTN; PAM sequence: CTA
taaccagggatccacctctg

SEQ ID NO: 276870 - DNA, 20 bp, Artificial Sequence
  Description of Artificial Sequence: Synthetic oligonucleotide
  Target: ATXN1; (+) strand; PAM type: YTN; PAM sequence: CTC
tgtggcttagtcatcggatc

SEQ ID NO: 276871 - DNA, 20 bp, Artificial Sequence
  Description of Artificial Sequence: Synthetic oligonucleotide
  Target: ATXN1; (+) strand; PAM type: YTN; PAM sequence: CTG
tggcttagtcatcggatcag

SEQ ID NO: 276872 - DNA, 20 bp, Artificial Sequence
  Description of Artificial Sequence: Synthetic oligonucleotide
  Target: ATXN1; (+) strand; PAM type: YTN; PAM sequence: CTT
agtcatcggatcagcctcaa

SEQ ID NO: 276873 - DNA, 20 bp, Artificial Sequence
  Description of Artificial Sequence: Synthetic oligonucleotide
  Target: ATXN1; (+) strand; PAM type: YTN; PAM sequence: TTA
gtcatcggatcagcctcaag

SEQ ID NO: 276874 - DNA, 20 bp, Artificial Sequence
  Description of Artificial Sequence: Synthetic oligonucleotide
  Target: ATXN1; (+) strand; PAM type: YTN; PAM sequence: CTC
aaggtcaccgactagagtaa

SEQ ID NO: 276875 - DNA, 20 bp, Artificial Sequence
  Description of Artificial Sequence: Synthetic oligonucleotide
  Target: ATXN1; (+) strand; PAM type: YTN; PAM sequence: CTA
gagtaacctgatgacaatta

SEQ ID NO: 276876 - DNA, 20 bp, Artificial Sequence
  Description of Artificial Sequence: Synthetic oligonucleotide
  Target: ATXN1; (+) strand; PAM type: YTN; PAM sequence: CTG
atgacaattacctcattcac

SEQ ID NO: 276877 - DNA, 20 bp, Artificial Sequence
  Description of Artificial Sequence: Synthetic oligonucleotide
  Target: ATXN1; (+) strand; PAM type: YTN; PAM sequence: TTA
cctcattcacccactataga

SEQ ID NO: 276878 - DNA, 20 bp, Artificial Sequence
  Description of Artificial Sequence: Synthetic oligonucleotide
  Target: ATXN1; (+) strand; PAM type: YTN; PAM sequence: CTC
attcacccactatagaacag

SEQ ID NO: 276879 - DNA, 20 bp, Artificial Sequence
  Description of Artificial Sequence: Synthetic oligonucleotide
  Target: ATXN1; (+) strand; PAM type: YTN; PAM sequence: TTC
acccactatagaacagttct

SEQ ID NO: 276880 - DNA, 20 bp, Artificial Sequence
  Description of Artificial Sequence: Synthetic oligonucleotide
  Target: ATXN1; (+) strand; PAM type: YTN; PAM sequence: CTA
tagaacagttctatcaccga

SEQ ID NO: 276881 - DNA, 20 bp, Artificial Sequence
  Description of Artificial Sequence: Synthetic oligonucleotide
  Target: ATXN1; (+) strand; PAM type: YTN; PAM sequence: TTC
tatcaccgatcaatacagga

SEQ ID NO: 276882 - DNA, 20 bp, Artificial Sequence
  Description of Artificial Sequence: Synthetic oligonucleotide
  Target: ATXN1; (+) strand; PAM type: YTN; PAM sequence: CTA
tcaccgatcaatacaggaca

SEQ ID NO: 276883 - DNA, 20 bp, Artificial Sequence
  Description of Artificial Sequence: Synthetic oligonucleotide
  Target: ATXN1; (+) strand; PAM type: YTN; PAM sequence: CTC
tgcacaacatcaacaaagcc

SEQ ID NO: 276884 - DNA, 20 bp, Artificial Sequence
  Description of Artificial Sequence: Synthetic oligonucleotide
  Target: ATXN1; (+) strand; PAM type: YTN; PAM sequence: CTG
cacaacatcaacaaagcctt

SEQ ID NO: 276885 - DNA, 20 bp, Artificial Sequence
  Description of Artificial Sequence: Synthetic oligonucleotide
  Target: ATXN1; (+) strand; PAM type: YTN; PAM sequence: CTT
ctcaagggggcaccctgcat

SEQ ID NO: 276886 - DNA, 20 bp, Artificial Sequence
  Description of Artificial Sequence: Synthetic oligonucleotide
  Target: ATXN1; (+) strand; PAM type: YTN; PAM sequence: TTC
tcaagggggcaccctgcatg

SEQ ID NO: 276887 - DNA, 20 bp, Artificial Sequence
  Description of Artificial Sequence: Synthetic oligonucleotide
  Target: ATXN1; (+) strand; PAM type: YTN; PAM sequence: CTC
aagggggcaccctgcatgca

SEQ ID NO: 276888 - DNA, 20 bp, Artificial Sequence
  Description of Artificial Sequence: Synthetic oligonucleotide
  Target: ATXN1; (+) strand; PAM type: YTN; PAM sequence: CTG
catgcatcagaaacaaatta

SEQ ID NO: 276889 - DNA, 20 bp, Artificial Sequence
  Description of Artificial Sequence: Synthetic oligonucleotide
  Target: ATXN1; (+) strand; PAM type: YTN; PAM sequence: TTA
cacccttagaggcagatgac

SEQ ID NO: 276890 - DNA, 20 bp, Artificial Sequence
  Description of Artificial Sequence: Synthetic oligonucleotide
  Target: ATXN1; (+) strand; PAM type: YTN; PAM sequence: CTT
agaggcagatgacacaccga

SEQ ID NO: 276891 - DNA, 20 bp, Artificial Sequence
  Description of Artificial Sequence: Synthetic oligonucleotide
  Target: ATXN1; (+) strand; PAM type: YTN; PAM sequence: TTA
gaggcagatgacacaccgaa

SEQ ID NO: 276892 - DNA, 20 bp, Artificial Sequence
  Description of Artificial Sequence: Synthetic oligonucleotide
  Target: ATXN1; (+) strand; PAM type: YTN; PAM sequence: CTC
tctgcaaagcaaagcctttg

SEQ ID NO: 276893 - DNA, 20 bp, Artificial Sequence
  Description of Artificial Sequence: Synthetic oligonucleotide
  Target: ATXN1; (+) strand; PAM type: YTN; PAM sequence: CTC
tgcaaagcaaagcctttgtt

SEQ ID NO: 276894 - DNA, 20 bp, Artificial Sequence
  Description of Artificial Sequence: Synthetic oligonucleotide
  Target: ATXN1; (+) strand; PAM type: YTN; PAM sequence: CTG
caaagcaaagcctttgttta

SEQ ID NO: 276895 - DNA, 20 bp, Artificial Sequence
  Description of Artificial Sequence: Synthetic oligonucleotide
  Target: ATXN1; (+) strand; PAM type: YTN; PAM sequence: CTT
tgtttaagtctgagaggagt

SEQ ID NO: 276896 - DNA, 20 bp, Artificial Sequence
  Description of Artificial Sequence: Synthetic oligonucleotide
  Target: ATXN1; (+) strand; PAM type: YTN; PAM sequence: TTT
gtttaagtctgagaggagtg

SEQ ID NO: 276897 - DNA, 20 bp, Artificial Sequence
  Description of Artificial Sequence: Synthetic oligonucleotide
  Target: ATXN1; (+) strand; PAM type: YTN; PAM sequence: TTG
tttaagtctgagaggagtgc

SEQ ID NO: 276898 - DNA, 20 bp, Artificial Sequence
  Description of Artificial Sequence: Synthetic oligonucleotide
  Target: ATXN1; (+) strand; PAM type: YTN; PAM sequence: TTT
aagtctgagaggagtgccaa

SEQ ID NO: 276899 - DNA, 20 bp, Artificial Sequence
  Description of Artificial Sequence: Synthetic oligonucleotide
  Target: ATXN1; (+) strand; PAM type: YTN; PAM sequence: TTA
agtctgagaggagtgccaat

SEQ ID NO: 276900 - DNA, 20 bp, Artificial Sequence
  Description of Artificial Sequence: Synthetic oligonucleotide
  Target: ATXN1; (+) strand; PAM type: YTN; PAM sequence: CTG
agaggagtgccaatccaacc

SEQ ID NO: 276901 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaggagaaaaggaga

SEQ ID NO: 276902 - DNA, 20 bp, Artificial Sequence
  Description of Artificial Sequence: Synthetic oligonucleotide
  Target: ATXN1; (+) strand; PAM type: YTN; PAM sequence: CTG
ttcggaactcttttcttgac

SEQ ID NO: 276903 - DNA, 20 bp, Artificial Sequence
  Description of Artificial Sequence: Synthetic oligonucleotide
  Target: ATXN1; (+) strand; PAM type: YTN; PAM sequence: TTC
ggaactcttttcttgacatg

SEQ ID NO: 276904 - DNA, 20 bp, Artificial Sequence
  Description of Artificial Sequence: Synthetic oligonucleotide
  Target: ATXN1; (+) strand; PAM type: YTN; PAM sequence: CTC
ttttcttgacatgatgtttc

SEQ ID NO: 276905 - DNA, 20 bp, Artificial Sequence
  Description of Artificial Sequence: Synthetic oligonucleotide
  Target: ATXN1; (+) strand; PAM type: YTN; PAM sequence: CTT
ttcttgacatgatgtttccc

SEQ ID NO: 276906 - DNA, 20 bp, Artificial Sequence
  Description of Artificial Sequence: Synthetic oligonucleotide
  Target: ATXN1; (+) strand; PAM type: YTN; PAM sequence: TTT
tcttgacatgatgtttccct

SEQ ID NO: 276907 - DNA, 20 bp, Artificial Sequence
  Description of Artificial Sequence: Synthetic oligonucleotide
  Target: ATXN1; (+) strand; PAM type: YTN; PAM sequence: TTT
cttgacatgatgtttccctt

SEQ ID NO: 276908 - DNA, 20 bp, Artificial Sequence
  Description of Artificial Sequence: Synthetic oligonucleotide
  Target: ATXN1; (+) strand; PAM type: YTN; PAM sequence: TTC
ttgacatgatgtttcccttg

SEQ ID NO: 276909 - DNA, 20 bp, Artificial Sequence
  Description of Artificial Sequence: Synthetic oligonucleotide
  Target: ATXN1; (+) strand; PAM type: YTN; PAM sequence: CTT
gacatgatgtttcccttgcc

SEQ ID NO: 276910 - DNA, 20 bp, Artificial Sequence
  Description of Artificial Sequence: Synthetic oligonucleotide
  Target: ATXN1; (+) strand; PAM type: YTN; PAM sequence: TTG
acatgatgtttcccttgcct

SEQ ID NO: 276911 - DNA, 20 bp, Artificial Sequence
  Description of Artificial Sequence: Synthetic oligonucleotide
  Target: ATXN1; (+) strand; PAM type: YTN; PAM sequence: TTT
cccttgcctttccgctcgaa

SEQ ID NO: 276912 - DNA, 20 bp, Artificial Sequence
  Description of Artificial Sequence: Synthetic oligonucleotide
  Target: ATXN1; (+) strand; PAM type: YTN; PAM sequence: TTC
ccttgcctttccgctcgaac

SEQ ID NO: 276913 - DNA, 20 bp, Artificial Sequence
  Description of Artificial Sequence: Synthetic oligonucleotide
  Target: ATXN1; (+) strand; PAM type: YTN; PAM sequence: CTT
gcctttccgctcgaacacgg

SEQ ID NO: 276914 - DNA, 20 bp, Artificial Sequence
  Description of Artificial Sequence: Synthetic oligonucleotide
  Target: ATXN1; (+) strand; PAM type: YTN; PAM sequence: TTG
cctttccgctcgaacacggg

SEQ ID NO: 276915 - DNA, 20 bp, Artificial Sequence
  Description of Artificial Sequence: Synthetic oligonucleotide
  Target: ATXN1; (+) strand; PAM type: YTN; PAM sequence: CTT
tccgctcgaacacgggatgc

SEQ ID NO: 276916 - DNA, 20 bp, Artificial Sequence
  Description of Artificial Sequence: Synthetic oligonucleotide
  Target: ATXN1; (+) strand; PAM type: YTN; PAM sequence: TTT
ccgctcgaacacgggatgca

SEQ ID NO: 276917 - DNA, 20 bp, Artificial Sequence
  Description of Artificial Sequence: Synthetic oligonucleotide
  Target: ATXN1; (+) strand; PAM type: YTN; PAM sequence: TTC
cgctcgaacacgggatgcat

SEQ ID NO: 276918 - DNA, 20 bp, Artificial Sequence
  Description of Artificial Sequence: Synthetic oligonucleotide
  Target: ATXN1; (+) strand; PAM type: YTN; PAM sequence: CTC
gaacacgggatgcatcttct

SEQ ID NO: 276919 - DNA, 20 bp, Artificial Sequence
  Description of Artificial Sequence: Synthetic oligonucleotide
  Target: ATXN1; (+) strand; PAM type: YTN; PAM sequence: CTT
ctggggaagagaaaactgga

SEQ ID NO: 276920 - DNA, 20 bp, Artificial Sequence
  Description of Artificial Sequence: Synthetic oligonucleotide
  Target: ATXN1; (+) strand; PAM type: YTN; PAM sequence: TTC
tggggaagagaaaactggaa

SEQ ID NO: 276921 - DNA, 20 bp, Artificial Sequence
  Description of Artificial Sequence: Synthetic oligonucleotide
  Target: ATXN1; (+) strand; PAM type: YTN; PAM sequence: CTG
gggaagagaaaactggaagt

SEQ ID NO: 276922 - DNA, 20 bp, Artificial Sequence
  Description of Artificial Sequence: Synthetic oligonucleotide
  Target: ATXN1; (+) strand; PAM type: YTN; PAM sequence: CTG
gaagtgcaatgacaggggac

SEQ ID NO: 276923 - DNA, 20 bp, Artificial Sequence
  Description of Artificial Sequence: Synthetic oligonucleotide
  Target: ATXN1; (+) strand; PAM type: YTN; PAM sequence: CTG
caatgctgagaatcaagaaa

SEQ ID NO: 276924 - DNA, 20 bp, Artificial Sequence
  Description of Artificial Sequence: Synthetic oligonucleotide
  Target: ATXN1; (+) strand; PAM type: YTN; PAM sequence: CTG
agaatcaagaaacagaattt

SEQ ID NO: 276925 - DNA, 20 bp, Artificial Sequence
  Description of Artificial Sequence: Synthetic oligonucleotide
  Target: ATXN1; (+) strand; PAM type: YTN; PAM sequence: TTT
cacagtgcattggtgaaatc

SEQ ID NO: 276926 - DNA, 20 bp, Artificial Sequence
  Description of Artificial Sequence: Synthetic oligonucleotide
  Target: ATXN1; (+) strand; PAM type: YTN; PAM sequence: TTC
acagtgcattggtgaaatca

SEQ ID NO: 276927 - DNA, 20 bp, Artificial Sequence
  Description of Artificial Sequence: Synthetic oligonucleotide
  Target: ATXN1; (+) strand; PAM type: YTN; PAM sequence: TTG
gtgaaatcaccaataataaa

SEQ ID NO: 276928 - DNA, 20 bp, Artificial Sequence
  Description of Artificial Sequence: Synthetic oligonucleotide
  Target: ATXN1; (+) strand; PAM type: YTN; PAM sequence: TTA
tagagtgcttactctgtgtc

SEQ ID NO: 276929 - DNA, 20 bp, Artificial Sequence
  Description of Artificial Sequence: Synthetic oligonucleotide
  Target: ATXN1; (+) strand; PAM type: YTN; PAM sequence: CTT
actctgtgtcagtctcttaa

SEQ ID NO: 276930 - DNA, 20 bp, Artificial Sequence
  Description of Artificial Sequence: Synthetic oligonucleotide
  Target: ATXN1; (+) strand; PAM type: YTN; PAM sequence: TTA
ctctgtgtcagtctcttaat

SEQ ID NO: 276931 - DNA, 20 bp, Artificial Sequence
  Description of Artificial Sequence: Synthetic oligonucleotide
  Target: ATXN1; (+) strand; PAM type: YTN; PAM sequence: CTC
tgtgtcagtctcttaattat

SEQ ID NO: 276932 - DNA, 20 bp, Artificial Sequence
  Description of Artificial Sequence: Synthetic oligonucleotide
  Target: ATXN1; (+) strand; PAM type: YTN; PAM sequence: CTG
tgtcagtctcttaattatta

SEQ ID NO: 276933 - DNA, 20 bp, Artificial Sequence
  Description of Artificial Sequence: Synthetic oligonucleotide
  Target: ATXN1; (+) strand; PAM type: YTN; PAM sequence: CTC
ttaattattattataattat

SEQ ID NO: 276934 - DNA, 20 bp, Artificial Sequence
  Description of Artificial Sequence: Synthetic oligonucleotide
  Target: ATXN1; (+) strand; PAM type: YTN; PAM sequence: CTT
aattattattataattattt

SEQ ID NO: 276935 - DNA, 20 bp, Artificial Sequence
  Description of Artificial Sequence: Synthetic oligonucleotide
  Target: ATXN1; (+) strand; PAM type: YTN; PAM sequence: TTA
attattattataattatttt

SEQ ID NO: 276936 - DNA, 20 bp, Artificial Sequence
  Description of Artificial Sequence: Synthetic oligonucleotide
  Target: ATXN1; (+) strand; PAM type: YTN; PAM sequence: TTA
ttattataattatttttgga

SEQ ID NO: 276937 - DNA, 20 bp, Artificial Sequence
  Description of Artificial Sequence: Synthetic oligonucleotide
  Target: ATXN1; (+) strand; PAM type: YTN; PAM sequence: TTA
ttataattatttttggagac

SEQ ID NO: 276938 - DNA, 20 bp, Artificial Sequence
  Description of Artificial Sequence: Synthetic oligonucleotide
  Target: ATXN1; (+) strand; PAM type: YTN; PAM sequence: TTA
taattatttttggagacgga

SEQ ID NO: 276939 - DNA, 20 bp, Artificial Sequence
  Description of Artificial Sequence: Synthetic oligonucleotide
  Target: ATXN1; (+) strand; PAM type: YTN; PAM sequence: TTA
tttttggagacggaatcttg

SEQ ID NO: 276940 - DNA, 20 bp, Artificial Sequence
  Description of Artificial Sequence: Synthetic oligonucleotide
  Target: ATXN1; (+) strand; PAM type: YTN; PAM sequence: TTT
ttggagacggaatcttgttc

SEQ ID NO: 276941 - DNA, 20 bp, Artificial Sequence
  Description of Artificial Sequence: Synthetic oligonucleotide
  Target: ATXN1; (+) strand; PAM type: YTN; PAM sequence: TTT
tggagacggaatcttgttct

SEQ ID NO: 276942 - DNA, 20 bp, Artificial Sequence
  Description of Artificial Sequence: Synthetic oligonucleotide
  Target: ATXN1; (+) strand; PAM type: YTN; PAM sequence: TTT
ggagacggaatcttgttctg

SEQ ID NO: 276943 - DNA, 20 bp, Artificial Sequence
  Description of Artificial Sequence: Synthetic oligonucleotide
  Target: ATXN1; (+) strand; PAM type: YTN; PAM sequence: TTG
gagacggaatcttgttctgt

SEQ ID NO: 276944 - DNA, 20 bp, Artificial Sequence
  Description of Artificial Sequence: Synthetic oligonucleotide
  Target: ATXN1; (+) strand; PAM type: YTN; PAM sequence: CTT
gttctgtcaccaggctggag

SEQ ID NO: 276945 - DNA, 20 bp, Artificial Sequence
  Description of Artificial Sequence: Synthetic oligonucleotide
  Target: ATXN1; (+) strand; PAM type: YTN; PAM sequence: TTG
ttctgtcaccaggctggagt

SEQ ID NO: 276946 - DNA, 20 bp, Artificial Sequence
  Description of Artificial Sequence: Synthetic oligonucleotide
  Target: ATXN1; (+) strand; PAM type: YTN; PAM sequence: TTC
tgtcaccaggctggagtgca

SEQ ID NO: 276947 - DNA, 20 bp, Artificial Sequence
  Description of Artificial Sequence: Synthetic oligonucleotide
  Target: ATXN1; (+) strand; PAM type: YTN; PAM sequence: CTG
tcaccaggctggagtgcagt

SEQ ID NO: 276948 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtagcatgatctc

SEQ ID NO: 276949 - DNA, 20 bp, Artificial Sequence
  Description of Artificial Sequence: Synthetic oligonucleotide
  Target: ATXN1; (+) strand; PAM type: YTN; PAM sequence: CTC
ggctcaatgcaacctccgcc

SEQ ID NO: 276950 - DNA, 20 bp, Artificial Sequence
  Description of Artificial Sequence: Synthetic oligonucleotide
  Target: ATXN1; (+) strand; PAM type: YTN; PAM sequence: CTC
aatgcaacctccgcctcctg

SEQ ID NO: 276951 - DNA, 20 bp, Artificial Sequence
  Description of Artificial Sequence: Synthetic oligonucleotide
  Target: ATXN1; (+) strand; PAM type: YTN; PAM sequence: CTC
cgcctcctgggttcaagtga

SEQ ID NO: 276952 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagtgattcccc

SEQ ID NO: 276953 - DNA, 20 bp, Artificial Sequence
  Description of Artificial Sequence: Synthetic oligonucleotide
  Target: ATXN1; (+) strand; PAM type: YTN; PAM sequence: CTG
ggttcaagtgattcccctgc

SEQ ID NO: 276954 - DNA, 20 bp, Artificial Sequence
  Description of Artificial Sequence: Synthetic oligonucleotide
  Target: ATXN1; (+) strand; PAM type: YTN; PAM sequence: TTC
aagtgattcccctgcctcag

SEQ ID NO: 276955 - DNA, 20 bp, Artificial Sequence
  Description of Artificial Sequence: Synthetic oligonucleotide
  Target: ATXN1; (+) strand; PAM type: YTN; PAM sequence: TTC
ccctgcctcagcctcccaag

SEQ ID NO: 276956 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 276957 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 276958 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggactacag

SEQ ID NO: 276959 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcgtgccac

SEQ ID NO: 276960 - DNA, 20 bp, Artificial Sequence
  Description of Artificial Sequence: Synthetic oligonucleotide
  Target: ATXN1; (+) strand; PAM type: YTN; PAM sequence: CTA
caggcgcgtgccaccacgcc

SEQ ID NO: 276961 - DNA, 20 bp, Artificial Sequence
  Description of Artificial Sequence: Synthetic oligonucleotide
  Target: ATXN1; (+) strand; PAM type: YTN; PAM sequence: CTG
gctaattttttatattttta

SEQ ID NO: 276962 - DNA, 20 bp, Artificial Sequence
  Description of Artificial Sequence: Synthetic oligonucleotide
  Target: ATXN1; (+) strand; PAM type: YTN; PAM sequence: CTA
attttttatatttttagtag

SEQ ID NO: 276963 - DNA, 20 bp, Artificial Sequence
  Description of Artificial Sequence: Synthetic oligonucleotide
  Target: ATXN1; (+) strand; PAM type: YTN; PAM sequence: TTT
tttatatttttagtagagac

SEQ ID NO: 276964 - DNA, 20 bp, Artificial Sequence
  Description of Artificial Sequence: Synthetic oligonucleotide
  Target: ATXN1; (+) strand; PAM type: YTN; PAM sequence: TTT
ttatatttttagtagagacg

SEQ ID NO: 276965 - DNA, 20 bp, Artificial Sequence
  Description of Artificial Sequence: Synthetic oligonucleotide
  Target: ATXN1; (+) strand; PAM type: YTN; PAM sequence: TTT
tatatttttagtagagacgg

SEQ ID NO: 276966 - DNA, 20 bp, Artificial Sequence
  Description of Artificial Sequence: Synthetic oligonucleotide
  Target: ATXN1; (+) strand; PAM type: YTN; PAM sequence: TTT
atatttttagtagagacggg

SEQ ID NO: 276967 - DNA, 20 bp, Artificial Sequence
  Description of Artificial Sequence: Synthetic oligonucleotide
  Target: ATXN1; (+) strand; PAM type: YTN; PAM sequence: TTA
tatttttagtagagacgggt

SEQ ID NO: 276968 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacgggtttcac

SEQ ID NO: 276969 - DNA, 20 bp, Artificial Sequence
  Description of Artificial Sequence: Synthetic oligonucleotide
  Target: ATXN1; (+) strand; PAM type: YTN; PAM sequence: TTT
tagtagagacgggtttcacc

SEQ ID NO: 276970 - DNA, 20 bp, Artificial Sequence
  Description of Artificial Sequence: Synthetic oligonucleotide
  Target: ATXN1; (+) strand; PAM type: YTN; PAM sequence: TTT
agtagagacgggtttcacca

SEQ ID NO: 276971 - DNA, 20 bp, Artificial Sequence
  Description of Artificial Sequence: Synthetic oligonucleotide
  Target: ATXN1; (+) strand; PAM type: YTN; PAM sequence: TTA
gtagagacgggtttcaccat

SEQ ID NO: 276972 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggatgg

SEQ ID NO: 276973 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggatggt

SEQ ID NO: 276974 - DNA, 20 bp, Artificial Sequence
  Description of Artificial Sequence: Synthetic oligonucleotide
  Target: ATXN1; (+) strand; PAM type: YTN; PAM sequence: TTG
gccaggatggtctcgaactc

SEQ ID NO: 276975 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 276976 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 276977 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccac

SEQ ID NO: 276978 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccacctcag

SEQ ID NO: 276979 - DNA, 20 bp, Artificial Sequence
  Description of Artificial Sequence: Synthetic oligonucleotide
  Target: ATXN1; (+) strand; PAM type: YTN; PAM sequence: CTC
agcctcccagagtgctggga

SEQ ID NO: 276980 - DNA, 20 bp, Artificial Sequence
  Description of Artificial Sequence: Synthetic oligonucleotide
  Target: ATXN1; (+) strand; PAM type: YTN; PAM sequence: CTC
ccagagtgctgggattacag

SEQ ID NO: 276981 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgagccac

SEQ ID NO: 276982 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccactgcgcc

SEQ ID NO: 276983 - DNA, 20 bp, Artificial Sequence
  Description of Artificial Sequence: Synthetic oligonucleotide
  Target: ATXN1; (+) strand; PAM type: YTN; PAM sequence: CTG
cgcccggaactgattcagct

SEQ ID NO: 276984 - DNA, 20 bp, Artificial Sequence
  Description of Artificial Sequence: Synthetic oligonucleotide
  Target: ATXN1; (+) strand; PAM type: YTN; PAM sequence: CTG
attcagctctcccaacagcc

SEQ ID NO: 276985 - DNA, 20 bp, Artificial Sequence
  Description of Artificial Sequence: Synthetic oligonucleotide
  Target: ATXN1; (+) strand; PAM type: YTN; PAM sequence: TTC
agctctcccaacagcccagt

SEQ ID NO: 276986 - DNA, 20 bp, Artificial Sequence
  Description of Artificial Sequence: Synthetic oligonucleotide
  Target: ATXN1; (+) strand; PAM type: YTN; PAM sequence: CTC
tcccaacagcccagtgagat

SEQ ID NO: 276987 - DNA, 20 bp, Artificial Sequence
  Description of Artificial Sequence: Synthetic oligonucleotide
  Target: ATXN1; (+) strand; PAM type: YTN; PAM sequence: CTC
ccaacagcccagtgagatga

SEQ ID NO: 276988 - DNA, 20 bp, Artificial Sequence
  Description of Artificial Sequence: Synthetic oligonucleotide
  Target: ATXN1; (+) strand; PAM type: YTN; PAM sequence: TTC
tattattattcccattgtac

SEQ ID NO: 276989 - DNA, 20 bp, Artificial Sequence
  Description of Artificial Sequence: Synthetic oligonucleotide
  Target: ATXN1; (+) strand; PAM type: YTN; PAM sequence: CTA
ttattattcccattgtacag

SEQ ID NO: 276990 - DNA, 20 bp, Artificial Sequence
  Description of Artificial Sequence: Synthetic oligonucleotide
  Target: ATXN1; (+) strand; PAM type: YTN; PAM sequence: TTA
ttattcccattgtacagatt

SEQ ID NO: 276991 - DNA, 20 bp, Artificial Sequence
  Description of Artificial Sequence: Synthetic oligonucleotide
  Target: ATXN1; (+) strand; PAM type: YTN; PAM sequence: TTA
ttcccattgtacagattgga

SEQ ID NO: 276992 - DNA, 20 bp, Artificial Sequence
  Description of Artificial Sequence: Synthetic oligonucleotide
  Target: ATXN1; (+) strand; PAM type: YTN; PAM sequence: TTC
ccattgtacagattggagta

SEQ ID NO: 276993 - DNA, 20 bp, Artificial Sequence
  Description of Artificial Sequence: Synthetic oligonucleotide
  Target: ATXN1; (+) strand; PAM type: YTN; PAM sequence: TTG
tacagattggagtactgagg

SEQ ID NO: 276994 - DNA, 20 bp, Artificial Sequence
  Description of Artificial Sequence: Synthetic oligonucleotide
  Target: ATXN1; (+) strand; PAM type: YTN; PAM sequence: TTG
gagtactgaggcacaagagg

SEQ ID NO: 276995 - DNA, 20 bp, Artificial Sequence
  Description of Artificial Sequence: Synthetic oligonucleotide
  Target: ATXN1; (+) strand; PAM type: YTN; PAM sequence: CTG
aggcacaagagggtaggtaa

SEQ ID NO: 276996 - DNA, 20 bp, Artificial Sequence
  Description of Artificial Sequence: Synthetic oligonucleotide
  Target: ATXN1; (+) strand; PAM type: YTN; PAM sequence: CTG
aagtcacactgataaatggc

SEQ ID NO: 276997 - DNA, 20 bp, Artificial Sequence
  Description of Artificial Sequence: Synthetic oligonucleotide
  Target: ATXN1; (+) strand; PAM type: YTN; PAM sequence: CTG
ataaatggctgcagttggga

SEQ ID NO: 276998 - DNA, 20 bp, Artificial Sequence
  Description of Artificial Sequence: Synthetic oligonucleotide
  Target: ATXN1; (+) strand; PAM type: YTN; PAM sequence: CTG
cagttgggattcaaagccaa

SEQ ID NO: 276999 - DNA, 20 bp, Artificial Sequence
  Description of Artificial Sequence: Synthetic oligonucleotide
  Target: ATXN1; (+) strand; PAM type: YTN; PAM sequence: TTG
ggattcaaagccaaggagtt

SEQ ID NO: 277000 - DNA, 20 bp, Artificial Sequence
  Description of Artificial Sequence: Synthetic oligonucleotide
  Target: ATXN1; (+) strand; PAM type: YTN; PAM sequence: TTC
aaagccaaggagttaggctc

SEQ ID NO: 277001 - DNA, 20 bp, Artificial Sequence
  Description of Artificial Sequence: Synthetic oligonucleotide
  Target: ATXN1; (+) strand; PAM type: YTN; PAM sequence: TTA
ggctctagagtcactatatt

SEQ ID NO: 277002 - DNA, 20 bp, Artificial Sequence
  Description of Artificial Sequence: Synthetic oligonucleotide
  Target: ATXN1; (+) strand; PAM type: YTN; PAM sequence: CTC
tagagtcactatattaaact

SEQ ID NO: 277003 - DNA, 20 bp, Artificial Sequence
  Description of Artificial Sequence: Synthetic oligonucleotide
  Target: ATXN1; (+) strand; PAM type: YTN; PAM sequence: CTA
gagtcactatattaaactgc

SEQ ID NO: 277004 - DNA, 20 bp, Artificial Sequence
  Description of Artificial Sequence: Synthetic oligonucleotide
  Target: ATXN1; (+) strand; PAM type: YTN; PAM sequence: CTA
tattaaactgcctggttaag

SEQ ID NO: 277005 - DNA, 20 bp, Artificial Sequence
  Description of Artificial Sequence: Synthetic oligonucleotide
  Target: ATXN1; (+) strand; PAM type: YTN; PAM sequence: TTA
aactgcctggttaagaacag

SEQ ID NO: 277006 - DNA, 20 bp, Artificial Sequence
  Description of Artificial Sequence: Synthetic oligonucleotide
  Target: ATXN1; (+) strand; PAM type: YTN; PAM sequence: CTG
cctggttaagaacagcaata

SEQ ID NO: 277007 - DNA, 20 bp, Artificial Sequence
  Description of Artificial Sequence: Synthetic oligonucleotide
  Target: ATXN1; (+) strand; PAM type: YTN; PAM sequence: CTG
gttaagaacagcaatattac

SEQ ID NO: 277008 - DNA, 20 bp, Artificial Sequence
  Description of Artificial Sequence: Synthetic oligonucleotide
  Target: ATXN1; (+) strand; PAM type: YTN; PAM sequence: TTA
agaacagcaatattacataa

SEQ ID NO: 277009 - DNA, 20 bp, Artificial Sequence
  Description of Artificial Sequence: Synthetic oligonucleotide
  Target: ATXN1; (+) strand; PAM type: YTN; PAM sequence: TTA
cataatgttaggtttgtgtt

SEQ ID NO: 277010 - DNA, 20 bp, Artificial Sequence
  Description of Artificial Sequence: Synthetic oligonucleotide
  Target: ATXN1; (+) strand; PAM type: YTN; PAM sequence: TTA
ggtttgtgttgtgttttaca

SEQ ID NO: 277011 - DNA, 20 bp, Artificial Sequence
  Description of Artificial Sequence: Synthetic oligonucleotide
  Target: ATXN1; (+) strand; PAM type: YTN; PAM sequence: TTT
gtgttgtgttttacagttta

SEQ ID NO: 277012 - DNA, 20 bp, Artificial Sequence
  Description of Artificial Sequence: Synthetic oligonucleotide
  Target: ATXN1; (+) strand; PAM type: YTN; PAM sequence: TTG
tgttgtgttttacagtttac

SEQ ID NO: 277013 - DNA, 20 bp, Artificial Sequence
  Description of Artificial Sequence: Synthetic oligonucleotide
  Target: ATXN1; (+) strand; PAM type: YTN; PAM sequence: TTG
tgttttacagtttacaaaat

SEQ ID NO: 277014 - DNA, 20 bp, Artificial Sequence
  Description of Artificial Sequence: Synthetic oligonucleotide
  Target: ATXN1; (+) strand; PAM type: YTN; PAM sequence: TTT
tacagtttacaaaatatttg

SEQ ID NO: 277015 - DNA, 20 bp, Artificial Sequence
  Description of Artificial Sequence: Synthetic oligonucleotide
  Target: ATXN1; (+) strand; PAM type: YTN; PAM sequence: TTT
acagtttacaaaatatttgc

SEQ ID NO: 277016 - DNA, 20 bp, Artificial Sequence
  Description of Artificial Sequence: Synthetic oligonucleotide
  Target: ATXN1; (+) strand; PAM type: YTN; PAM sequence: TTA
cagtttacaaaatatttgca

SEQ ID NO: 277017 - DNA, 20 bp, Artificial Sequence
  Description of Artificial Sequence: Synthetic oligonucleotide
  Target: ATXN1; (+) strand; PAM type: YTN; PAM sequence: TTT
acaaaatatttgcacatgct

SEQ ID NO: 277018 - DNA, 20 bp, Artificial Sequence
  Description of Artificial Sequence: Synthetic oligonucleotide
  Target: ATXN1; (+) strand; PAM type: YTN; PAM sequence: TTA
caaaatatttgcacatgctt

SEQ ID NO: 277019 - DNA, 20 bp, Artificial Sequence
  Description of Artificial Sequence: Synthetic oligonucleotide
  Target: ATXN1; (+) strand; PAM type: YTN; PAM sequence: TTT
gcacatgctttttccctctg

SEQ ID NO: 277020 - DNA, 20 bp, Artificial Sequence
  Description of Artificial Sequence: Synthetic oligonucleotide
  Target: ATXN1; (+) strand; PAM type: YTN; PAM sequence: TTG
cacatgctttttccctctgc

SEQ ID NO: 277021 - DNA, 20 bp, Artificial Sequence
  Description of Artificial Sequence: Synthetic oligonucleotide
  Target: ATXN1; (+) strand; PAM type: YTN; PAM sequence: CTT
tttccctctgcttggaatgg

SEQ ID NO: 277022 - DNA, 20 bp, Artificial Sequence
  Description of Artificial Sequence: Synthetic oligonucleotide
  Target: ATXN1; (+) strand; PAM type: YTN; PAM sequence: TTT
ttccctctgcttggaatggc

SEQ ID NO: 277023 - DNA, 20 bp, Artificial Sequence
  Description of Artificial Sequence: Synthetic oligonucleotide
  Target: ATXN1; (+) strand; PAM type: YTN; PAM sequence: TTT
tccctctgcttggaatggct

SEQ ID NO: 277024 - DNA, 20 bp, Artificial Sequence
  Description of Artificial Sequence: Synthetic oligonucleotide
  Target: ATXN1; (+) strand; PAM type: YTN; PAM sequence: TTT
ccctctgcttggaatggctg

SEQ ID NO: 277025 - DNA, 20 bp, Artificial Sequence
  Description of Artificial Sequence: Synthetic oligonucleotide
  Target: ATXN1; (+) strand; PAM type: YTN; PAM sequence: TTC
cctctgcttggaatggctgt

SEQ ID NO: 277026 - DNA, 20 bp, Artificial Sequence
  Description of Artificial Sequence: Synthetic oligonucleotide
  Target: ATXN1; (+) strand; PAM type: YTN; PAM sequence: CTC
tgcttggaatggctgtctca

SEQ ID NO: 277027 - DNA, 20 bp, Artificial Sequence
  Description of Artificial Sequence: Synthetic oligonucleotide
  Target: ATXN1; (+) strand; PAM type: YTN; PAM sequence: CTG
cttggaatggctgtctcatg

SEQ ID NO: 277028 - DNA, 20 bp, Artificial Sequence
  Description of Artificial Sequence: Synthetic oligonucleotide
  Target: ATXN1; (+) strand; PAM type: YTN; PAM sequence: CTT
ggaatggctgtctcatgtat

SEQ ID NO: 277029 - DNA, 20 bp, Artificial Sequence
  Description of Artificial Sequence: Synthetic oligonucleotide
  Target: ATXN1; (+) strand; PAM type: YTN; PAM sequence: TTG
gaatggctgtctcatgtatt

SEQ ID NO: 277030 - DNA, 20 bp, Artificial Sequence
  Description of Artificial Sequence: Synthetic oligonucleotide
  Target: ATXN1; (+) strand; PAM type: YTN; PAM sequence: CTG
tctcatgtatttacttatga

SEQ ID NO: 277031 - DNA, 20 bp, Artificial Sequence
  Description of Artificial Sequence: Synthetic oligonucleotide
  Target: ATXN1; (+) strand; PAM type: YTN; PAM sequence: CTC
atgtatttacttatgagttc

SEQ ID NO: 277032 - DNA, 20 bp, Artificial Sequence
  Description of Artificial Sequence: Synthetic oligonucleotide
  Target: ATXN1; (+) strand; PAM type: YTN; PAM sequence: TTT
acttatgagttcctctccca

SEQ ID NO: 277033 - DNA, 20 bp, Artificial Sequence
  Description of Artificial Sequence: Synthetic oligonucleotide
  Target: ATXN1; (+) strand; PAM type: YTN; PAM sequence: TTA
cttatgagttcctctcccaa

SEQ ID NO: 277034 - DNA, 20 bp, Artificial Sequence
  Description of Artificial Sequence: Synthetic oligonucleotide
  Target: ATXN1; (+) strand; PAM type: YTN; PAM sequence: CTT
atgagttcctctcccaacag

SEQ ID NO: 277035 - DNA, 20 bp, Artificial Sequence
  Description of Artificial Sequence: Synthetic oligonucleotide
  Target: ATXN1; (+) strand; PAM type: YTN; PAM sequence: TTA
tgagttcctctcccaacaga

SEQ ID NO: 277036 - DNA, 20 bp, Artificial Sequence
  Description of Artificial Sequence: Synthetic oligonucleotide
  Target: ATXN1; (+) strand; PAM type: YTN; PAM sequence: TTC
ctctcccaacagagccttct

SEQ ID NO: 277037 - DNA, 20 bp, Artificial Sequence
  Description of Artificial Sequence: Synthetic oligonucleotide
  Target: ATXN1; (+) strand; PAM type: YTN; PAM sequence: CTC
tcccaacagagccttctact

SEQ ID NO: 277038 - DNA, 20 bp, Artificial Sequence
  Description of Artificial Sequence: Synthetic oligonucleotide
  Target: ATXN1; (+) strand; PAM type: YTN; PAM sequence: CTC
ccaacagagccttctactga

SEQ ID NO: 277039 - DNA, 20 bp, Artificial Sequence
  Description of Artificial Sequence: Synthetic oligonucleotide
  Target: ATXN1; (+) strand; PAM type: YTN; PAM sequence: CTT
ctactgaaaggtgttcaata

SEQ ID NO: 277040 - DNA, 20 bp, Artificial Sequence
  Description of Artificial Sequence: Synthetic oligonucleotide
  Target: ATXN1; (+) strand; PAM type: YTN; PAM sequence: TTC
tactgaaaggtgttcaatac

SEQ ID NO: 277041 - DNA, 20 bp, Artificial Sequence
  Description of Artificial Sequence: Synthetic oligonucleotide
  Target: ATXN1; (+) strand; PAM type: YTN; PAM sequence: CTA
ctgaaaggtgttcaataccg

SEQ ID NO: 277042 - DNA, 20 bp, Artificial Sequence
  Description of Artificial Sequence: Synthetic oligonucleotide
  Target: ATXN1; (+) strand; PAM type: YTN; PAM sequence: CTG
aaaggtgttcaataccgtgt

SEQ ID NO: 277043 - DNA, 20 bp, Artificial Sequence
  Description of Artificial Sequence: Synthetic oligonucleotide
  Target: ATXN1; (+) strand; PAM type: YTN; PAM sequence: TTC
aataccgtgttcatagagtg

SEQ ID NO: 277044 - DNA, 20 bp, Artificial Sequence
  Description of Artificial Sequence: Synthetic oligonucleotide
  Target: ATXN1; (+) strand; PAM type: YTN; PAM sequence: TTC
atagagtgaaggtatgaata

SEQ ID NO: 277045 - DNA, 20 bp, Artificial Sequence
  Description of Artificial Sequence: Synthetic oligonucleotide
  Target: ATXN1; (+) strand; PAM type: YTN; PAM sequence: CTG
actctaattaatccttaaat

SEQ ID NO: 277046 - DNA, 20 bp, Artificial Sequence
  Description of Artificial Sequence: Synthetic oligonucleotide
  Target: ATXN1; (+) strand; PAM type: YTN; PAM sequence: CTC
taattaatccttaaattgct

SEQ ID NO: 277047 - DNA, 20 bp, Artificial Sequence
  Description of Artificial Sequence: Synthetic oligonucleotide
  Target: ATXN1; (+) strand; PAM type: YTN; PAM sequence: CTA
attaatccttaaattgctgt

SEQ ID NO: 277048 - DNA, 20 bp, Artificial Sequence
  Description of Artificial Sequence: Synthetic oligonucleotide
  Target: ATXN1; (+) strand; PAM type: YTN; PAM sequence: TTA
atccttaaattgctgtggga

SEQ ID NO: 277049 - DNA, 20 bp, Artificial Sequence
  Description of Artificial Sequence: Synthetic oligonucleotide
  Target: ATXN1; (+) strand; PAM type: YTN; PAM sequence: CTT
aaattgctgtgggagacagg

SEQ ID NO: 277050 - DNA, 20 bp, Artificial Sequence
  Description of Artificial Sequence: Synthetic oligonucleotide
  Target: ATXN1; (+) strand; PAM type: YTN; PAM sequence: TTA
aattgctgtgggagacaggc

SEQ ID NO: 277051 - DNA, 20 bp, Artificial Sequence
  Description of Artificial Sequence: Synthetic oligonucleotide
  Target: ATXN1; (+) strand; PAM type: YTN; PAM sequence: TTG
ctgtgggagacaggctgaga

SEQ ID NO: 277052 - DNA, 20 bp, Artificial Sequence
  Description of Artificial Sequence: Synthetic oligonucleotide
  Target: ATXN1; (+) strand; PAM type: YTN; PAM sequence: CTG
tgggagacaggctgagaata

SEQ ID NO: 277053 - DNA, 20 bp, Artificial Sequence
  Description of Artificial Sequence: Synthetic oligonucleotide
  Target: ATXN1; (+) strand; PAM type: YTN; PAM sequence: CTG
agaatatatgactaaacttg

SEQ ID NO: 277054 - DNA, 20 bp, Artificial Sequence
  Description of Artificial Sequence: Synthetic oligonucleotide
  Target: ATXN1; (+) strand; PAM type: YTN; PAM sequence: CTA
aacttgttttgaaataagga

SEQ ID NO: 277055 - DNA, 20 bp, Artificial Sequence
  Description of Artificial Sequence: Synthetic oligonucleotide
  Target: ATXN1; (+) strand; PAM type: YTN; PAM sequence: CTT
gttttgaaataaggaaaatg

SEQ ID NO: 277056 - DNA, 20 bp, Artificial Sequence
  Description of Artificial Sequence: Synthetic oligonucleotide
  Target: ATXN1; (+) strand; PAM type: YTN; PAM sequence: TTG
ttttgaaataaggaaaatga

SEQ ID NO: 277057 - DNA, 20 bp, Artificial Sequence
  Description of Artificial Sequence: Synthetic oligonucleotide
  Target: ATXN1; (+) strand; PAM type: YTN; PAM sequence: TTT
tgaaataaggaaaatgaggt

SEQ ID NO: 277058 - DNA, 20 bp, Artificial Sequence
  Description of Artificial Sequence: Synthetic oligonucleotide
  Target: ATXN1; (+) strand; PAM type: YTN; PAM sequence: TTT
gaaataaggaaaatgaggtt

SEQ ID NO: 277059 - DNA, 20 bp, Artificial Sequence
  Description of Artificial Sequence: Synthetic oligonucleotide
  Target: ATXN1; (+) strand; PAM type: YTN; PAM sequence: TTG
aaataaggaaaatgaggttt

SEQ ID NO: 277060 - DNA, 20 bp, Artificial Sequence
  Description of Artificial Sequence: Synthetic oligonucleotide
  Target: ATXN1; (+) strand; PAM type: YTN; PAM sequence: TTT
gggaaaatcaaatgacttgt

SEQ ID NO: 277061 - DNA, 20 bp, Artificial Sequence
  Description of Artificial Sequence: Synthetic oligonucleotide
  Target: ATXN1; (+) strand; PAM type: YTN; PAM sequence: TTG
ggaaaatcaaatgacttgtc

SEQ ID NO: 277062 - DNA, 20 bp, Artificial Sequence
  Description of Artificial Sequence: Synthetic oligonucleotide
  Target: ATXN1; (+) strand; PAM type: YTN; PAM sequence: CTT
gtctaaggtcatattgcttt

SEQ ID NO: 277063 - DNA, 20 bp, Artificial Sequence
  Description of Artificial Sequence: Synthetic oligonucleotide
  Target: ATXN1; (+) strand; PAM type: YTN; PAM sequence: TTG
tctaaggtcatattgctttg

SEQ ID NO: 277064 - DNA, 20 bp, Artificial Sequence
  Description of Artificial Sequence: Synthetic oligonucleotide
  Target: ATXN1; (+) strand; PAM type: YTN; PAM sequence: CTA
aggtcatattgctttgaata

SEQ ID NO: 277065 - DNA, 20 bp, Artificial Sequence
  Description of Artificial Sequence: Synthetic oligonucleotide
  Target: ATXN1; (+) strand; PAM type: YTN; PAM sequence: TTG
ctttgaatatgagctcatcg

SEQ ID NO: 277066 - DNA, 20 bp, Artificial Sequence
  Description of Artificial Sequence: Synthetic oligonucleotide
  Target: ATXN1; (+) strand; PAM type: YTN; PAM sequence: CTT
tgaatatgagctcatcgtaa

SEQ ID NO: 277067 - DNA, 20 bp, Artificial Sequence
  Description of Artificial Sequence: Synthetic oligonucleotide
  Target: ATXN1; (+) strand; PAM type: YTN; PAM sequence: TTT
gaatatgagctcatcgtaac

SEQ ID NO: 277068 - DNA, 20 bp, Artificial Sequence
  Description of Artificial Sequence: Synthetic oligonucleotide
  Target: ATXN1; (+) strand; PAM type: YTN; PAM sequence: TTG
aatatgagctcatcgtaact

SEQ ID NO: 277069 - DNA, 20 bp, Artificial Sequence
  Description of Artificial Sequence: Synthetic oligonucleotide
  Target: ATXN1; (+) strand; PAM type: YTN; PAM sequence: CTC
atcgtaactaaaccagtggt

SEQ ID NO: 277070 - DNA, 20 bp, Artificial Sequence
  Description of Artificial Sequence: Synthetic oligonucleotide
  Target: ATXN1; (+) strand; PAM type: YTN; PAM sequence: CTA
aaccagtggtttaaaaaaaa

SEQ ID NO: 277071 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaattttttttaacc

SEQ ID NO: 277072 - DNA, 20 bp, Artificial Sequence
  Description of Artificial Sequence: Synthetic oligonucleotide
  Target: ATXN1; (+) strand; PAM type: YTN; PAM sequence: TTA
aaaaaaattttttttaacca

SEQ ID NO: 277073 - DNA, 20 bp, Artificial Sequence
  Description of Artificial Sequence: Synthetic oligonucleotide
  Target: ATXN1; (+) strand; PAM type: YTN; PAM sequence: TTT
tttttaaccacaggaccttt

SEQ ID NO: 277074 - DNA, 20 bp, Artificial Sequence
  Description of Artificial Sequence: Synthetic oligonucleotide
  Target: ATXN1; (+) strand; PAM type: YTN; PAM sequence: TTT
ttttaaccacaggacctttc

SEQ ID NO: 277075 - DNA, 20 bp, Artificial Sequence
  Description of Artificial Sequence: Synthetic oligonucleotide
  Target: ATXN1; (+) strand; PAM type: YTN; PAM sequence: TTT
tttaaccacaggacctttct

SEQ ID NO: 277076 - DNA, 20 bp, Artificial Sequence
  Description of Artificial Sequence: Synthetic oligonucleotide
  Target: ATXN1; (+) strand; PAM type: YTN; PAM sequence: TTT
ttaaccacaggacctttcta

SEQ ID NO: 277077 - DNA, 20 bp, Artificial Sequence
  Description of Artificial Sequence: Synthetic oligonucleotide
  Target: ATXN1; (+) strand; PAM type: YTN; PAM sequence: TTT
taaccacaggacctttctaa

SEQ ID NO: 277078 - DNA, 20 bp, Artificial Sequence
  Description of Artificial Sequence: Synthetic oligonucleotide
  Target: ATXN1; (+) strand; PAM type: YTN; PAM sequence: TTT
aaccacaggacctttctaag

SEQ ID NO: 277079 - DNA, 20 bp, Artificial Sequence
  Description of Artificial Sequence: Synthetic oligonucleotide
  Target: ATXN1; (+) strand; PAM type: YTN; PAM sequence: TTA
accacaggacctttctaaga

SEQ ID NO: 277080 - DNA, 20 bp, Artificial Sequence
  Description of Artificial Sequence: Synthetic oligonucleotide
  Target: ATXN1; (+) strand; PAM type: YTN; PAM sequence: CTT
tctaagaaaactattttaca

SEQ ID NO: 277081 - DNA, 20 bp, Artificial Sequence
  Description of Artificial Sequence: Synthetic oligonucleotide
  Target: ATXN1; (+) strand; PAM type: YTN; PAM sequence: TTT
ctaagaaaactattttacat

SEQ ID NO: 277082 - DNA, 20 bp, Artificial Sequence
  Description of Artificial Sequence: Synthetic oligonucleotide
  Target: ATXN1; (+) strand; PAM type: YTN; PAM sequence: TTC
taagaaaactattttacata

SEQ ID NO: 277083 - DNA, 20 bp, Artificial Sequence
  Description of Artificial Sequence: Synthetic oligonucleotide
  Target: ATXN1; (+) strand; PAM type: YTN; PAM sequence: CTA
agaaaactattttacatagc

SEQ ID NO: 277084 - DNA, 20 bp, Artificial Sequence
  Description of Artificial Sequence: Synthetic oligonucleotide
  Target: ATXN1; (+) strand; PAM type: YTN; PAM sequence: CTA
ttttacatagcctcagaata

SEQ ID NO: 277085 - DNA, 20 bp, Artificial Sequence
  Description of Artificial Sequence: Synthetic oligonucleotide
  Target: ATXN1; (+) strand; PAM type: YTN; PAM sequence: TTT
tacatagcctcagaatatca

SEQ ID NO: 277086 - DNA, 20 bp, Artificial Sequence
  Description of Artificial Sequence: Synthetic oligonucleotide
  Target: ATXN1; (+) strand; PAM type: YTN; PAM sequence: TTT
acatagcctcagaatatcac

SEQ ID NO: 277087 - DNA, 20 bp, Artificial Sequence
  Description of Artificial Sequence: Synthetic oligonucleotide
  Target: ATXN1; (+) strand; PAM type: YTN; PAM sequence: TTA
catagcctcagaatatcaca

SEQ ID NO: 277088 - DNA, 20 bp, Artificial Sequence
  Description of Artificial Sequence: Synthetic oligonucleotide
  Target: ATXN1; (+) strand; PAM type: YTN; PAM sequence: CTC
agaatatcacagagctgaag

SEQ ID NO: 277089 - DNA, 20 bp, Artificial Sequence
  Description of Artificial Sequence: Synthetic oligonucleotide
  Target: ATXN1; (+) strand; PAM type: YTN; PAM sequence: CTG
aaggagaagctgccccgctg

SEQ ID NO: 277090 - DNA, 20 bp, Artificial Sequence
  Description of Artificial Sequence: Synthetic oligonucleotide
  Target: ATXN1; (+) strand; PAM type: YTN; PAM sequence: CTG
ccccgctgccccggtcaata

SEQ ID NO: 277091 - DNA, 20 bp, Artificial Sequence
  Description of Artificial Sequence: Synthetic oligonucleotide
  Target: ATXN1; (+) strand; PAM type: YTN; PAM sequence: CTG
ccccggtcaatagaggctga

SEQ ID NO: 277092 - DNA, 20 bp, Artificial Sequence
  Description of Artificial Sequence: Synthetic oligonucleotide
  Target: ATXN1; (+) strand; PAM type: YTN; PAM sequence: CTG
agggcagcccacagcctcaa

SEQ ID NO: 277093 - DNA, 20 bp, Artificial Sequence
  Description of Artificial Sequence: Synthetic oligonucleotide
  Target: ATXN1; (+) strand; PAM type: YTN; PAM sequence: CTC
aaagtttatggggagcctct

SEQ ID NO: 277094 - DNA, 20 bp, Artificial Sequence
  Description of Artificial Sequence: Synthetic oligonucleotide
  Target: ATXN1; (+) strand; PAM type: YTN; PAM sequence: TTT
atggggagcctctggggctt

SEQ ID NO: 277095 - DNA, 20 bp, Artificial Sequence
  Description of Artificial Sequence: Synthetic oligonucleotide
  Target: ATXN1; (+) strand; PAM type: YTN; PAM sequence: TTA
tggggagcctctggggcttt

SEQ ID NO: 277096 - DNA, 20 bp, Artificial Sequence
  Description of Artificial Sequence: Synthetic oligonucleotide
  Target: ATXN1; (+) strand; PAM type: YTN; PAM sequence: CTC
tggggctttgcagaatgcag

SEQ ID NO: 277097 - DNA, 20 bp, Artificial Sequence
  Description of Artificial Sequence: Synthetic oligonucleotide
  Target: ATXN1; (+) strand; PAM type: YTN; PAM sequence: CTG
gggctttgcagaatgcaggc

SEQ ID NO: 277098 - DNA, 20 bp, Artificial Sequence
  Description of Artificial Sequence: Synthetic oligonucleotide
  Target: ATXN1; (+) strand; PAM type: YTN; PAM sequence: CTT
tgcagaatgcaggctgggga

SEQ ID NO: 277099 - DNA, 20 bp, Artificial Sequence
  Description of Artificial Sequence: Synthetic oligonucleotide
  Target: ATXN1; (+) strand; PAM type: YTN; PAM sequence: TTT
gcagaatgcaggctggggac

SEQ ID NO: 277100 - DNA, 20 bp, Artificial Sequence
  Description of Artificial Sequence: Synthetic oligonucleotide
  Target: ATXN1; (+) strand; PAM type: YTN; PAM sequence: TTG
cagaatgcaggctggggact

SEQ ID NO: 277101 - DNA, 20 bp, Artificial Sequence
  Description of Artificial Sequence: Synthetic oligonucleotide
  Target: ATXN1; (+) strand; PAM type: YTN; PAM sequence: CTG
gggactcactactgcaccac

SEQ ID NO: 277102 - DNA, 20 bp, Artificial Sequence
  Description of Artificial Sequence: Synthetic oligonucleotide
  Target: ATXN1; (+) strand; PAM type: YTN; PAM sequence: CTC
actactgcaccacgcaacac

SEQ ID NO: 277103 - DNA, 20 bp, Artificial Sequence
  Description of Artificial Sequence: Synthetic oligonucleotide
  Target: ATXN1; (+) strand; PAM type: YTN; PAM sequence: CTA
ctgcaccacgcaacactact

SEQ ID NO: 277104 - DNA, 20 bp, Artificial Sequence
  Description of Artificial Sequence: Synthetic oligonucleotide
  Target: ATXN1; (+) strand; PAM type: YTN; PAM sequence: CTG
caccacgcaacactactagg

SEQ ID NO: 277105 - DNA, 20 bp, Artificial Sequence
  Description of Artificial Sequence: Synthetic oligonucleotide
  Target: ATXN1; (+) strand; PAM type: YTN; PAM sequence: CTA
ctaggacacctgacccagcc

SEQ ID NO: 277106 - DNA, 20 bp, Artificial Sequence
  Description of Artificial Sequence: Synthetic oligonucleotide
  Target: ATXN1; (+) strand; PAM type: YTN; PAM sequence: CTA
ggacacctgacccagccctg

SEQ ID NO: 277107 - DNA, 20 bp, Artificial Sequence
  Description of Artificial Sequence: Synthetic oligonucleotide
  Target: ATXN1; (+) strand; PAM type: YTN; PAM sequence: CTG
acccagccctgaaactttga

SEQ ID NO: 277108 - DNA, 20 bp, Artificial Sequence
  Description of Artificial Sequence: Synthetic oligonucleotide
  Target: ATXN1; (+) strand; PAM type: YTN; PAM sequence: CTG
aaactttgagagagggtgac

SEQ ID NO: 277109 - DNA, 20 bp, Artificial Sequence
  Description of Artificial Sequence: Synthetic oligonucleotide
  Target: ATXN1; (+) strand; PAM type: YTN; PAM sequence: CTT
tgagagagggtgaccaacca

SEQ ID NO: 277110 - DNA, 20 bp, Artificial Sequence
  Description of Artificial Sequence: Synthetic oligonucleotide
  Target: ATXN1; (+) strand; PAM type: YTN; PAM sequence: TTT
gagagagggtgaccaaccac

SEQ ID NO: 277111 - DNA, 20 bp, Artificial Sequence
  Description of Artificial Sequence: Synthetic oligonucleotide
  Target: ATXN1; (+) strand; PAM type: YTN; PAM sequence: TTG
agagagggtgaccaaccaca

SEQ ID NO: 277112 - DNA, 20 bp, Artificial Sequence
  Description of Artificial Sequence: Synthetic oligonucleotide
  Target: ATXN1; (+) strand; PAM type: YTN; PAM sequence: CTT
caagtctcacccatttacga

SEQ ID NO: 277113 - DNA, 20 bp, Artificial Sequence
  Description of Artificial Sequence: Synthetic oligonucleotide
  Target: ATXN1; (+) strand; PAM type: YTN; PAM sequence: TTC
aagtctcacccatttacgac

SEQ ID NO: 277114 - DNA, 20 bp, Artificial Sequence
  Description of Artificial Sequence: Synthetic oligonucleotide
  Target: ATXN1; (+) strand; PAM type: YTN; PAM sequence: CTC
acccatttacgactctgacc

SEQ ID NO: 277115 - DNA, 20 bp, Artificial Sequence
  Description of Artificial Sequence: Synthetic oligonucleotide
  Target: ATXN1; (+) strand; PAM type: YTN; PAM sequence: TTT
acgactctgacccatggggg

SEQ ID NO: 277116 - DNA, 20 bp, Artificial Sequence
  Description of Artificial Sequence: Synthetic oligonucleotide
  Target: ATXN1; (+) strand; PAM type: YTN; PAM sequence: TTA
cgactctgacccatggggga

SEQ ID NO: 277117 - DNA, 20 bp, Artificial Sequence
  Description of Artificial Sequence: Synthetic oligonucleotide
  Target: ATXN1; (+) strand; PAM type: YTN; PAM sequence: CTC
tgacccatgggggaaggcag

SEQ ID NO: 277118 - DNA, 20 bp, Artificial Sequence
  Description of Artificial Sequence: Synthetic oligonucleotide
  Target: ATXN1; (+) strand; PAM type: YTN; PAM sequence: CTG
acccatgggggaaggcagag

SEQ ID NO: 277119 - DNA, 20 bp, Artificial Sequence
  Description of Artificial Sequence: Synthetic oligonucleotide
  Target: ATXN1; (+) strand; PAM type: YTN; PAM sequence: TTA
agattctttctccttccacc

SEQ ID NO: 277120 - DNA, 20 bp, Artificial Sequence
  Description of Artificial Sequence: Synthetic oligonucleotide
  Target: ATXN1; (+) strand; PAM type: YTN; PAM sequence: TTC
tttctccttccaccccagca

SEQ ID NO: 277121 - DNA, 20 bp, Artificial Sequence
  Description of Artificial Sequence: Synthetic oligonucleotide
  Target: ATXN1; (+) strand; PAM type: YTN; PAM sequence: CTT
tctccttccaccccagcaga

SEQ ID NO: 277122 - DNA, 20 bp, Artificial Sequence
  Description of Artificial Sequence: Synthetic oligonucleotide
  Target: ATXN1; (+) strand; PAM type: YTN; PAM sequence: TTT
ctccttccaccccagcagag

SEQ ID NO: 277123 - DNA, 20 bp, Artificial Sequence
  Description of Artificial Sequence: Synthetic oligonucleotide
  Target: ATXN1; (+) strand; PAM type: YTN; PAM sequence: TTC
tccttccaccccagcagagg

SEQ ID NO: 277124 - DNA, 20 bp, Artificial Sequence
  Description of Artificial Sequence: Synthetic oligonucleotide
  Target: ATXN1; (+) strand; PAM type: YTN; PAM sequence: CTC
cttccaccccagcagaggga

SEQ ID NO: 277125 - DNA, 20 bp, Artificial Sequence
  Description of Artificial Sequence: Synthetic oligonucleotide
  Target: ATXN1; (+) strand; PAM type: YTN; PAM sequence: CTT
ccaccccagcagagggacct

SEQ ID NO: 277126 - DNA, 20 bp, Artificial Sequence
  Description of Artificial Sequence: Synthetic oligonucleotide
  Target: ATXN1; (+) strand; PAM type: YTN; PAM sequence: TTC
caccccagcagagggacctg

SEQ ID NO: 277127 - DNA, 20 bp, Artificial Sequence
  Description of Artificial Sequence: Synthetic oligonucleotide
  Target: ATXN1; (+) strand; PAM type: YTN; PAM sequence: CTG
ttcttagcttcccagcttga

SEQ ID NO: 277128 - DNA, 20 bp, Artificial Sequence
  Description of Artificial Sequence: Synthetic oligonucleotide
  Target: ATXN1; (+) strand; PAM type: YTN; PAM sequence: TTC
ttagcttcccagcttgagcg

SEQ ID NO: 277129 - DNA, 20 bp, Artificial Sequence
  Description of Artificial Sequence: Synthetic oligonucleotide
  Target: ATXN1; (+) strand; PAM type: YTN; PAM sequence: CTT
agcttcccagcttgagcgtc

SEQ ID NO: 277130 - DNA, 20 bp, Artificial Sequence
  Description of Artificial Sequence: Synthetic oligonucleotide
  Target: ATXN1; (+) strand; PAM type: YTN; PAM sequence: TTA
gcttcccagcttgagcgtct

SEQ ID NO: 277131 - DNA, 20 bp, Artificial Sequence
  Description of Artificial Sequence: Synthetic oligonucleotide
  Target: ATXN1; (+) strand; PAM type: YTN; PAM sequence: CTT
cccagcttgagcgtctcttt

SEQ ID NO: 277132 - DNA, 20 bp, Artificial Sequence
  Description of Artificial Sequence: Synthetic oligonucleotide
  Target: ATXN1; (+) strand; PAM type: YTN; PAM sequence: TTC
ccagcttgagcgtctctttc

SEQ ID NO: 277133 - DNA, 20 bp, Artificial Sequence
  Description of Artificial Sequence: Synthetic oligonucleotide
  Target: ATXN1; (+) strand; PAM type: YTN; PAM sequence: CTT
gagcgtctctttctgtttct

SEQ ID NO: 277134 - DNA, 20 bp, Artificial Sequence
  Description of Artificial Sequence: Synthetic oligonucleotide
  Target: ATXN1; (+) strand; PAM type: YTN; PAM sequence: TTG
agcgtctctttctgtttctt

SEQ ID NO: 277135 - DNA, 20 bp, Artificial Sequence
  Description of Artificial Sequence: Synthetic oligonucleotide
  Target: ATXN1; (+) strand; PAM type: YTN; PAM sequence: CTC
tttctgtttctttctttgga

SEQ ID NO: 277136 - DNA, 20 bp, Artificial Sequence
  Description of Artificial Sequence: Synthetic oligonucleotide
  Target: ATXN1; (+) strand; PAM type: YTN; PAM sequence: CTT
tctgtttctttctttggagc

SEQ ID NO: 277137 - DNA, 20 bp, Artificial Sequence
  Description of Artificial Sequence: Synthetic oligonucleotide
  Target: ATXN1; (+) strand; PAM type: YTN; PAM sequence: TTT
ctgtttctttctttggagct

SEQ ID NO: 277138 - DNA, 20 bp, Artificial Sequence
  Description of Artificial Sequence: Synthetic oligonucleotide
  Target: ATXN1; (+) strand; PAM type: YTN; PAM sequence: TTC
tgtttctttctttggagctc

SEQ ID NO: 277139 - DNA, 20 bp, Artificial Sequence
  Description of Artificial Sequence: Synthetic oligonucleotide
  Target: ATXN1; (+) strand; PAM type: YTN; PAM sequence: CTG
tttctttctttggagctctt

SEQ ID NO: 277140 - DNA, 20 bp, Artificial Sequence
  Description of Artificial Sequence: Synthetic oligonucleotide
  Target: ATXN1; (+) strand; PAM type: YTN; PAM sequence: TTT
ctttctttggagctcttctg

SEQ ID NO: 277141 - DNA, 20 bp, Artificial Sequence
  Description of Artificial Sequence: Synthetic oligonucleotide
  Target: ATXN1; (+) strand; PAM type: YTN; PAM sequence: TTC
tttctttggagctcttctgt

SEQ ID NO: 277142 - DNA, 20 bp, Artificial Sequence
  Description of Artificial Sequence: Synthetic oligonucleotide
  Target: ATXN1; (+) strand; PAM type: YTN; PAM sequence: CTT
tctttggagctcttctgtat

SEQ ID NO: 277143 - DNA, 20 bp, Artificial Sequence
  Description of Artificial Sequence: Synthetic oligonucleotide
  Target: ATXN1; (+) strand; PAM type: YTN; PAM sequence: TTT
ctttggagctcttctgtatt

SEQ ID NO: 277144 - DNA, 20 bp, Artificial Sequence
  Description of Artificial Sequence: Synthetic oligonucleotide
  Target: ATXN1; (+) strand; PAM type: YTN; PAM sequence: TTC
tttggagctcttctgtattt

SEQ ID NO: 277145 - DNA, 20 bp, Artificial Sequence
  Description of Artificial Sequence: Synthetic oligonucleotide
  Target: ATXN1; (+) strand; PAM type: YTN; PAM sequence: CTT
tggagctcttctgtatttgt

SEQ ID NO: 277146 - DNA, 20 bp, Artificial Sequence
  Description of Artificial Sequence: Synthetic oligonucleotide
  Target: ATXN1; (+) strand; PAM type: YTN; PAM sequence: TTT
ggagctcttctgtatttgtt

SEQ ID NO: 277147 - DNA, 20 bp, Artificial Sequence
  Description of Artificial Sequence: Synthetic oligonucleotide
  Target: ATXN1; (+) strand; PAM type: YTN; PAM sequence: TTG
gagctcttctgtatttgttc

SEQ ID NO: 277148 - DNA, 20 bp, Artificial Sequence
  Description of Artificial Sequence: Synthetic oligonucleotide
  Target: ATXN1; (+) strand; PAM type: YTN; PAM sequence: CTC
ttctgtatttgttccttttt

SEQ ID NO: 277149 - DNA, 20 bp, Artificial Sequence
  Description of Artificial Sequence: Synthetic oligonucleotide
  Target: ATXN1; (+) strand; PAM type: YTN; PAM sequence: CTT
ctgtatttgttcctttttca

SEQ ID NO: 277150 - DNA, 20 bp, Artificial Sequence
  Description of Artificial Sequence: Synthetic oligonucleotide
  Target: ATXN1; (+) strand; PAM type: YTN; PAM sequence: TTC
tgtatttgttcctttttcag

SEQ ID NO: 277151 - DNA, 20 bp, Artificial Sequence
  Description of Artificial Sequence: Synthetic oligonucleotide
  Target: ATXN1; (+) strand; PAM type: YTN; PAM sequence: CTG
tatttgttcctttttcagtc

SEQ ID NO: 277152 - DNA, 20 bp, Artificial Sequence
  Description of Artificial Sequence: Synthetic oligonucleotide
  Target: ATXN1; (+) strand; PAM type: YTN; PAM sequence: TTT
gttcctttttcagtcccgag

SEQ ID NO: 277153 - DNA, 20 bp, Artificial Sequence
  Description of Artificial Sequence: Synthetic oligonucleotide
  Target: ATXN1; (+) strand; PAM type: YTN; PAM sequence: TTG
ttcctttttcagtcccgagg

SEQ ID NO: 277154 - DNA, 20 bp, Artificial Sequence
  Description of Artificial Sequence: Synthetic oligonucleotide
  Target: ATXN1; (+) strand; PAM type: YTN; PAM sequence: TTC
ctttttcagtcccgagggct

SEQ ID NO: 277155 - DNA, 20 bp, Artificial Sequence
  Description of Artificial Sequence: Synthetic oligonucleotide
  Target: ATXN1; (+) strand; PAM type: YTN; PAM sequence: CTT
tttcagtcccgagggctgat

SEQ ID NO: 277156 - DNA, 20 bp, Artificial Sequence
  Description of Artificial Sequence: Synthetic oligonucleotide
  Target: ATXN1; (+) strand; PAM type: YTN; PAM sequence: TTT
ttcagtcccgagggctgatc

SEQ ID NO: 277157 - DNA, 20 bp, Artificial Sequence
  Description of Artificial Sequence: Synthetic oligonucleotide
  Target: ATXN1; (+) strand; PAM type: YTN; PAM sequence: TTT
tcagtcccgagggctgatca

SEQ ID NO: 277158 - DNA, 20 bp, Artificial Sequence
  Description of Artificial Sequence: Synthetic oligonucleotide
  Target: ATXN1; (+) strand; PAM type: YTN; PAM sequence: TTT
cagtcccgagggctgatcac

SEQ ID NO: 277159 - DNA, 20 bp, Artificial Sequence
  Description of Artificial Sequence: Synthetic oligonucleotide
  Target: ATXN1; (+) strand; PAM type: YTN; PAM sequence: TTC
agtcccgagggctgatcact

SEQ ID NO: 277160 - DNA, 20 bp, Artificial Sequence
  Description of Artificial Sequence: Synthetic oligonucleotide
  Target: ATXN1; (+) strand; PAM type: YTN; PAM sequence: CTG
atcactggaaacagggcaac

SEQ ID NO: 277161 - DNA, 20 bp, Artificial Sequence
  Description of Artificial Sequence: Synthetic oligonucleotide
  Target: ATXN1; (+) strand; PAM type: YTN; PAM sequence: CTG
gaaacagggcaacctctggt

SEQ ID NO: 277162 - DNA, 20 bp, Artificial Sequence
  Description of Artificial Sequence: Synthetic oligonucleotide
  Target: ATXN1; (+) strand; PAM type: YTN; PAM sequence: CTC
tggtgacctggtttttcatc

SEQ ID NO: 277163 - DNA, 20 bp, Artificial Sequence
  Description of Artificial Sequence: Synthetic oligonucleotide
  Target: ATXN1; (+) strand; PAM type: YTN; PAM sequence: CTG
gtgacctggtttttcatcac

SEQ ID NO: 277164 - DNA, 20 bp, Artificial Sequence
  Description of Artificial Sequence: Synthetic oligonucleotide
  Target: ATXN1; (+) strand; PAM type: YTN; PAM sequence: CTG
gtttttcatcaccagccagg

SEQ ID NO: 277165 - DNA, 20 bp, Artificial Sequence
  Description of Artificial Sequence: Synthetic oligonucleotide
  Target: ATXN1; (+) strand; PAM type: YTN; PAM sequence: TTT
ttcatcaccagccagggcag

SEQ ID NO: 277166 - DNA, 20 bp, Artificial Sequence
  Description of Artificial Sequence: Synthetic oligonucleotide
  Target: ATXN1; (+) strand; PAM type: YTN; PAM sequence: TTT
tcatcaccagccagggcaga

SEQ ID NO: 277167 - DNA, 20 bp, Artificial Sequence
  Description of Artificial Sequence: Synthetic oligonucleotide
  Target: ATXN1; (+) strand; PAM type: YTN; PAM sequence: TTT
catcaccagccagggcagaa

SEQ ID NO: 277168 - DNA, 20 bp, Artificial Sequence
  Description of Artificial Sequence: Synthetic oligonucleotide
  Target: ATXN1; (+) strand; PAM type: YTN; PAM sequence: TTC
atcaccagccagggcagaag

SEQ ID NO: 277169 - DNA, 20 bp, Artificial Sequence
  Description of Artificial Sequence: Synthetic oligonucleotide
  Target: ATXN1; (+) strand; PAM type: YTN; PAM sequence: CTC
aagggctttgcacgctgctc

SEQ ID NO: 277170 - DNA, 20 bp, Artificial Sequence
  Description of Artificial Sequence: Synthetic oligonucleotide
  Target: ATXN1; (+) strand; PAM type: YTN; PAM sequence: CTT
tgcacgctgctccctagaac

SEQ ID NO: 277171 - DNA, 20 bp, Artificial Sequence
  Description of Artificial Sequence: Synthetic oligonucleotide
  Target: ATXN1; (+) strand; PAM type: YTN; PAM sequence: TTT
gcacgctgctccctagaact

SEQ ID NO: 277172 - DNA, 20 bp, Artificial Sequence
  Description of Artificial Sequence: Synthetic oligonucleotide
  Target: ATXN1; (+) strand; PAM type: YTN; PAM sequence: TTG
cacgctgctccctagaactg

SEQ ID NO: 277173 - DNA, 20 bp, Artificial Sequence
  Description of Artificial Sequence: Synthetic oligonucleotide
  Target: ATXN1; (+) strand; PAM type: YTN; PAM sequence: CTG
ctccctagaactggacgcct

SEQ ID NO: 277174 - DNA, 20 bp, Artificial Sequence
  Description of Artificial Sequence: Synthetic oligonucleotide
  Target: ATXN1; (+) strand; PAM type: YTN; PAM sequence: CTC
cctagaactggacgcctttg

SEQ ID NO: 277175 - DNA, 20 bp, Artificial Sequence
  Description of Artificial Sequence: Synthetic oligonucleotide
  Target: ATXN1; (+) strand; PAM type: YTN; PAM sequence: CTA
gaactggacgcctttgagaa

SEQ ID NO: 277176 - DNA, 20 bp, Artificial Sequence
  Description of Artificial Sequence: Synthetic oligonucleotide
  Target: ATXN1; (+) strand; PAM type: YTN; PAM sequence: CTG
gacgcctttgagaaatctgg

SEQ ID NO: 277177 - DNA, 20 bp, Artificial Sequence
  Description of Artificial Sequence: Synthetic oligonucleotide
  Target: ATXN1; (+) strand; PAM type: YTN; PAM sequence: CTT
tgagaaatctgggattcttc

SEQ ID NO: 277178 - DNA, 20 bp, Artificial Sequence
  Description of Artificial Sequence: Synthetic oligonucleotide
  Target: ATXN1; (+) strand; PAM type: YTN; PAM sequence: TTT
gagaaatctgggattcttcc

SEQ ID NO: 277179 - DNA, 20 bp, Artificial Sequence
  Description of Artificial Sequence: Synthetic oligonucleotide
  Target: ATXN1; (+) strand; PAM type: YTN; PAM sequence: TTG
agaaatctgggattcttcca

SEQ ID NO: 277180 - DNA, 20 bp, Artificial Sequence
  Description of Artificial Sequence: Synthetic oligonucleotide
  Target: ATXN1; (+) strand; PAM type: YTN; PAM sequence: CTG
ggattcttccaggcggcaga

SEQ ID NO: 277181 - DNA, 20 bp, Artificial Sequence
  Description of Artificial Sequence: Synthetic oligonucleotide
  Target: ATXN1; (+) strand; PAM type: YTN; PAM sequence: TTC
ttccaggcggcagacttcat

SEQ ID NO: 277182 - DNA, 20 bp, Artificial Sequence
  Description of Artificial Sequence: Synthetic oligonucleotide
  Target: ATXN1; (+) strand; PAM type: YTN; PAM sequence: CTT
ccaggcggcagacttcattc

SEQ ID NO: 277183 - DNA, 20 bp, Artificial Sequence
  Description of Artificial Sequence: Synthetic oligonucleotide
  Target: ATXN1; (+) strand; PAM type: YTN; PAM sequence: TTC
caggcggcagacttcattcc

SEQ ID NO: 277184 - DNA, 20 bp, Artificial Sequence
  Description of Artificial Sequence: Synthetic oligonucleotide
  Target: ATXN1; (+) strand; PAM type: YTN; PAM sequence: CTT
cattccacagtggtggaaaa

SEQ ID NO: 277185 - DNA, 20 bp, Artificial Sequence
  Description of Artificial Sequence: Synthetic oligonucleotide
  Target: ATXN1; (+) strand; PAM type: YTN; PAM sequence: TTC
attccacagtggtggaaaag

SEQ ID NO: 277186 - DNA, 20 bp, Artificial Sequence
  Description of Artificial Sequence: Synthetic oligonucleotide
  Target: ATXN1; (+) strand; PAM type: YTN; PAM sequence: TTC
cacagtggtggaaaagctgg

SEQ ID NO: 277187 - DNA, 20 bp, Artificial Sequence
  Description of Artificial Sequence: Synthetic oligonucleotide
  Target: ATXN1; (+) strand; PAM type: YTN; PAM sequence: CTG
gccagggagagagagcaatt

SEQ ID NO: 277188 - DNA, 20 bp, Artificial Sequence
  Description of Artificial Sequence: Synthetic oligonucleotide
  Target: ATXN1; (+) strand; PAM type: YTN; PAM sequence: TTT
tgcaaggcacagtgccgcac

SEQ ID NO: 277189 - DNA, 20 bp, Artificial Sequence
  Description of Artificial Sequence: Synthetic oligonucleotide
  Target: ATXN1; (+) strand; PAM type: YTN; PAM sequence: TTT
gcaaggcacagtgccgcact

SEQ ID NO: 277190 - DNA, 20 bp, Artificial Sequence
  Description of Artificial Sequence: Synthetic oligonucleotide
  Target: ATXN1; (+) strand; PAM type: YTN; PAM sequence: TTG
caaggcacagtgccgcactt

SEQ ID NO: 277191 - DNA, 20 bp, Artificial Sequence
  Description of Artificial Sequence: Synthetic oligonucleotide
  Target: ATXN1; (+) strand; PAM type: YTN; PAM sequence: CTT
ggacctgtatcctgacaccg

SEQ ID NO: 277192 - DNA, 20 bp, Artificial Sequence
  Description of Artificial Sequence: Synthetic oligonucleotide
  Target: ATXN1; (+) strand; PAM type: YTN; PAM sequence: TTG
gacctgtatcctgacaccgc

SEQ ID NO: 277193 - DNA, 20 bp, Artificial Sequence
  Description of Artificial Sequence: Synthetic oligonucleotide
  Target: ATXN1; (+) strand; PAM type: YTN; PAM sequence: CTG
tatcctgacaccgccaaatc

SEQ ID NO: 277194 - DNA, 20 bp, Artificial Sequence
  Description of Artificial Sequence: Synthetic oligonucleotide
  Target: ATXN1; (+) strand; PAM type: YTN; PAM sequence: CTG
acaccgccaaatcagaggag

SEQ ID NO: 277195 - DNA, 20 bp, Artificial Sequence
  Description of Artificial Sequence: Synthetic oligonucleotide
  Target: ATXN1; (+) strand; PAM type: YTN; PAM sequence: CTG
agtgttacagaacgtctgag

SEQ ID NO: 277196 - DNA, 20 bp, Artificial Sequence
  Description of Artificial Sequence: Synthetic oligonucleotide
  Target: ATXN1; (+) strand; PAM type: YTN; PAM sequence: TTA
cagaacgtctgagctagagg

SEQ ID NO: 277197 - DNA, 20 bp, Artificial Sequence
  Description of Artificial Sequence: Synthetic oligonucleotide
  Target: ATXN1; (+) strand; PAM type: YTN; PAM sequence: CTG
agctagaggaggcctctaag

SEQ ID NO: 277198 - DNA, 20 bp, Artificial Sequence
  Description of Artificial Sequence: Synthetic oligonucleotide
  Target: ATXN1; (+) strand; PAM type: YTN; PAM sequence: CTA
gaggaggcctctaagagctt

SEQ ID NO: 277199 - DNA, 20 bp, Artificial Sequence
  Description of Artificial Sequence: Synthetic oligonucleotide
  Target: ATXN1; (+) strand; PAM type: YTN; PAM sequence: CTC
taagagctttcagtccagtc

SEQ ID NO: 277200 - DNA, 20 bp, Artificial Sequence
  Description of Artificial Sequence: Synthetic oligonucleotide
  Target: ATXN1; (+) strand; PAM type: YTN; PAM sequence: CTA
agagctttcagtccagtctc

SEQ ID NO: 277201 - DNA, 20 bp, Artificial Sequence
  Description of Artificial Sequence: Synthetic oligonucleotide
  Target: ATXN1; (+) strand; PAM type: YTN; PAM sequence: CTT
tcagtccagtctcctcattt

SEQ ID NO: 277202 - DNA, 20 bp, Artificial Sequence
  Description of Artificial Sequence: Synthetic oligonucleotide
  Target: ATXN1; (+) strand; PAM type: YTN; PAM sequence: TTT
cagtccagtctcctcattta

SEQ ID NO: 277203 - DNA, 20 bp, Artificial Sequence
  Description of Artificial Sequence: Synthetic oligonucleotide
  Target: ATXN1; (+) strand; PAM type: YTN; PAM sequence: TTC
agtccagtctcctcatttaa

SEQ ID NO: 277204 - DNA, 20 bp, Artificial Sequence
  Description of Artificial Sequence: Synthetic oligonucleotide
  Target: ATXN1; (+) strand; PAM type: YTN; PAM sequence: CTC
ctcatttaatgaacacggaa

SEQ ID NO: 277205 - DNA, 20 bp, Artificial Sequence
  Description of Artificial Sequence: Synthetic oligonucleotide
  Target: ATXN1; (+) strand; PAM type: YTN; PAM sequence: CTC
atttaatgaacacggaaatt

SEQ ID NO: 277206 - DNA, 20 bp, Artificial Sequence
  Description of Artificial Sequence: Synthetic oligonucleotide
  Target: ATXN1; (+) strand; PAM type: YTN; PAM sequence: TTT
aatgaacacggaaattgtat

SEQ ID NO: 277207 - DNA, 20 bp, Artificial Sequence
  Description of Artificial Sequence: Synthetic oligonucleotide
  Target: ATXN1; (+) strand; PAM type: YTN; PAM sequence: TTA
atgaacacggaaattgtatc

SEQ ID NO: 277208 - DNA, 20 bp, Artificial Sequence
  Description of Artificial Sequence: Synthetic oligonucleotide
  Target: ATXN1; (+) strand; PAM type: YTN; PAM sequence: TTG
tatcctgctaacgtaaagtg

SEQ ID NO: 277209 - DNA, 20 bp, Artificial Sequence
  Description of Artificial Sequence: Synthetic oligonucleotide
  Target: ATXN1; (+) strand; PAM type: YTN; PAM sequence: CTG
ctaacgtaaagtgacttggt

SEQ ID NO: 277210 - DNA, 20 bp, Artificial Sequence
  Description of Artificial Sequence: Synthetic oligonucleotide
  Target: ATXN1; (+) strand; PAM type: YTN; PAM sequence: CTA
acgtaaagtgacttggtcaa

SEQ ID NO: 277211 - DNA, 20 bp, Artificial Sequence
  Description of Artificial Sequence: Synthetic oligonucleotide
  Target: ATXN1; (+) strand; PAM type: YTN; PAM sequence: CTT
ggtcaaagctacgcagtggc

SEQ ID NO: 277212 - DNA, 20 bp, Artificial Sequence
  Description of Artificial Sequence: Synthetic oligonucleotide
  Target: ATXN1; (+) strand; PAM type: YTN; PAM sequence: TTG
gtcaaagctacgcagtggca

SEQ ID NO: 277213 - DNA, 20 bp, Artificial Sequence
  Description of Artificial Sequence: Synthetic oligonucleotide
  Target: ATXN1; (+) strand; PAM type: YTN; PAM sequence: CTA
cgcagtggcacaactaaaac

SEQ ID NO: 277214 - DNA, 20 bp, Artificial Sequence
  Description of Artificial Sequence: Synthetic oligonucleotide
  Target: ATXN1; (+) strand; PAM type: YTN; PAM sequence: CTA
aaactcaggatttctgacat

SEQ ID NO: 277215 - DNA, 20 bp, Artificial Sequence
  Description of Artificial Sequence: Synthetic oligonucleotide
  Target: ATXN1; (+) strand; PAM type: YTN; PAM sequence: CTC
aggatttctgacatcttgcc

SEQ ID NO: 277216 - DNA, 20 bp, Artificial Sequence
  Description of Artificial Sequence: Synthetic oligonucleotide
  Target: ATXN1; (+) strand; PAM type: YTN; PAM sequence: TTT
ctgacatcttgcccctgagc

SEQ ID NO: 277217 - DNA, 20 bp, Artificial Sequence
  Description of Artificial Sequence: Synthetic oligonucleotide
  Target: ATXN1; (+) strand; PAM type: YTN; PAM sequence: TTC
tgacatcttgcccctgagca

SEQ ID NO: 277218 - DNA, 20 bp, Artificial Sequence
  Description of Artificial Sequence: Synthetic oligonucleotide
  Target: ATXN1; (+) strand; PAM type: YTN; PAM sequence: CTG
acatcttgcccctgagcacc

SEQ ID NO: 277219 - DNA, 20 bp, Artificial Sequence
  Description of Artificial Sequence: Synthetic oligonucleotide
  Target: ATXN1; (+) strand; PAM type: YTN; PAM sequence: CTT
gcccctgagcacccaaaact

SEQ ID NO: 277220 - DNA, 20 bp, Artificial Sequence
  Description of Artificial Sequence: Synthetic oligonucleotide
  Target: ATXN1; (+) strand; PAM type: YTN; PAM sequence: TTG
cccctgagcacccaaaactc

SEQ ID NO: 277221 - DNA, 20 bp, Artificial Sequence
  Description of Artificial Sequence: Synthetic oligonucleotide
  Target: ATXN1; (+) strand; PAM type: YTN; PAM sequence: CTG
agcacccaaaactcaaagga

SEQ ID NO: 277222 - DNA, 20 bp, Artificial Sequence
  Description of Artificial Sequence: Synthetic oligonucleotide
  Target: ATXN1; (+) strand; PAM type: YTN; PAM sequence: CTC
aaaggacagaaagtacaatg

SEQ ID NO: 277223 - DNA, 20 bp, Artificial Sequence
  Description of Artificial Sequence: Synthetic oligonucleotide
  Target: ATXN1; (+) strand; PAM type: YTN; PAM sequence: CTA
cagaagtaaccaaaggactt

SEQ ID NO: 277224 - DNA, 20 bp, Artificial Sequence
  Description of Artificial Sequence: Synthetic oligonucleotide
  Target: ATXN1; (+) strand; PAM type: YTN; PAM sequence: CTT
tctggtgatgtcaaatgatg

SEQ ID NO: 277225 - DNA, 20 bp, Artificial Sequence
  Description of Artificial Sequence: Synthetic oligonucleotide
  Target: ATXN1; (+) strand; PAM type: YTN; PAM sequence: TTT
ctggtgatgtcaaatgatgc

SEQ ID NO: 277226 - DNA, 20 bp, Artificial Sequence
  Description of Artificial Sequence: Synthetic oligonucleotide
  Target: ATXN1; (+) strand; PAM type: YTN; PAM sequence: TTC
tggtgatgtcaaatgatgca

SEQ ID NO: 277227 - DNA, 20 bp, Artificial Sequence
  Description of Artificial Sequence: Synthetic oligonucleotide
  Target: ATXN1; (+) strand; PAM type: YTN; PAM sequence: CTG
gtgatgtcaaatgatgcaag

SEQ ID NO: 277228 - DNA, 20 bp, Artificial Sequence
  Description of Artificial Sequence: Synthetic oligonucleotide
  Target: ATXN1; (+) strand; PAM type: YTN; PAM sequence: CTC
aagttgggaataaattgata

SEQ ID NO: 277229 - DNA, 20 bp, Artificial Sequence
  Description of Artificial Sequence: Synthetic oligonucleotide
  Target: ATXN1; (+) strand; PAM type: YTN; PAM sequence: TTG
ggaataaattgataggtgta

SEQ ID NO: 277230 - DNA, 20 bp, Artificial Sequence
  Description of Artificial Sequence: Synthetic oligonucleotide
  Target: ATXN1; (+) strand; PAM type: YTN; PAM sequence: TTG
ataggtgtatctattaaaac

SEQ ID NO: 277231 - DNA, 20 bp, Artificial Sequence
  Description of Artificial Sequence: Synthetic oligonucleotide
  Target: ATXN1; (+) strand; PAM type: YTN; PAM sequence: CTA
ttaaaaccatctcttaaggc

SEQ ID NO: 277232 - DNA, 20 bp, Artificial Sequence
  Description of Artificial Sequence: Synthetic oligonucleotide
  Target: ATXN1; (+) strand; PAM type: YTN; PAM sequence: TTA
aaaccatctcttaaggcctt

SEQ ID NO: 277233 - DNA, 20 bp, Artificial Sequence
  Description of Artificial Sequence: Synthetic oligonucleotide
  Target: ATXN1; (+) strand; PAM type: YTN; PAM sequence: CTC
ttaaggccttctgggggaaa

SEQ ID NO: 277234 - DNA, 20 bp, Artificial Sequence
  Description of Artificial Sequence: Synthetic oligonucleotide
  Target: ATXN1; (+) strand; PAM type: YTN; PAM sequence: CTT
aaggccttctgggggaaaac

SEQ ID NO: 277235 - DNA, 20 bp, Artificial Sequence
  Description of Artificial Sequence: Synthetic oligonucleotide
  Target: ATXN1; (+) strand; PAM type: YTN; PAM sequence: TTA
aggccttctgggggaaaacg

SEQ ID NO: 277236 - DNA, 20 bp, Artificial Sequence
  Description of Artificial Sequence: Synthetic oligonucleotide
  Target: ATXN1; (+) strand; PAM type: YTN; PAM sequence: CTT
ctgggggaaaacgccaccac

SEQ ID NO: 277237 - DNA, 20 bp, Artificial Sequence
  Description of Artificial Sequence: Synthetic oligonucleotide
  Target: ATXN1; (+) strand; PAM type: YTN; PAM sequence: TTC
tgggggaaaacgccaccacc

SEQ ID NO: 277238 - DNA, 20 bp, Artificial Sequence
  Description of Artificial Sequence: Synthetic oligonucleotide
  Target: ATXN1; (+) strand; PAM type: YTN; PAM sequence: CTG
ggggaaaacgccaccaccaa

SEQ ID NO: 277239 - DNA, 20 bp, Artificial Sequence
  Description of Artificial Sequence: Synthetic oligonucleotide
  Target: ATXN1; (+) strand; PAM type: YTN; PAM sequence: TTA
cttgaaggcttgtcaagtgc

SEQ ID NO: 277240 - DNA, 20 bp, Artificial Sequence
  Description of Artificial Sequence: Synthetic oligonucleotide
  Target: ATXN1; (+) strand; PAM type: YTN; PAM sequence: CTT
gaaggcttgtcaagtgcttt

SEQ ID NO: 277241 - DNA, 20 bp, Artificial Sequence
  Description of Artificial Sequence: Synthetic oligonucleotide
  Target: ATXN1; (+) strand; PAM type: YTN; PAM sequence: TTG
aaggcttgtcaagtgcttta

SEQ ID NO: 277242 - DNA, 20 bp, Artificial Sequence
  Description of Artificial Sequence: Synthetic oligonucleotide
  Target: ATXN1; (+) strand; PAM type: YTN; PAM sequence: CTT
gtcaagtgctttaaggcgct

SEQ ID NO: 277243 - DNA, 20 bp, Artificial Sequence
  Description of Artificial Sequence: Synthetic oligonucleotide
  Target: ATXN1; (+) strand; PAM type: YTN; PAM sequence: TTG
tcaagtgctttaaggcgcta

SEQ ID NO: 277244 - DNA, 20 bp, Artificial Sequence
  Description of Artificial Sequence: Synthetic oligonucleotide
  Target: ATXN1; (+) strand; PAM type: YTN; PAM sequence: CTT
taaggcgctataaggcaaga

SEQ ID NO: 277245 - DNA, 20 bp, Artificial Sequence
  Description of Artificial Sequence: Synthetic oligonucleotide
  Target: ATXN1; (+) strand; PAM type: YTN; PAM sequence: TTT
aaggcgctataaggcaagat

SEQ ID NO: 277246 - DNA, 20 bp, Artificial Sequence
  Description of Artificial Sequence: Synthetic oligonucleotide
  Target: ATXN1; (+) strand; PAM type: YTN; PAM sequence: TTA
aggcgctataaggcaagatg

SEQ ID NO: 277247 - DNA, 20 bp, Artificial Sequence
  Description of Artificial Sequence: Synthetic oligonucleotide
  Target: ATXN1; (+) strand; PAM type: YTN; PAM sequence: CTA
taaggcaagatgcaacactg

SEQ ID NO: 277248 - DNA, 20 bp, Artificial Sequence
  Description of Artificial Sequence: Synthetic oligonucleotide
  Target: ATXN1; (+) strand; PAM type: YTN; PAM sequence: CTG
agagacattaaaaaaagata

SEQ ID NO: 277249 - DNA, 20 bp, Artificial Sequence
  Description of Artificial Sequence: Synthetic oligonucleotide
  Target: ATXN1; (+) strand; PAM type: YTN; PAM sequence: TTA
aaaaaagataaccttttccc

SEQ ID NO: 277250 - DNA, 20 bp, Artificial Sequence
  Description of Artificial Sequence: Synthetic oligonucleotide
  Target: ATXN1; (+) strand; PAM type: YTN; PAM sequence: CTT
ttccccactgcctgagttgc

SEQ ID NO: 277251 - DNA, 20 bp, Artificial Sequence
  Description of Artificial Sequence: Synthetic oligonucleotide
  Target: ATXN1; (+) strand; PAM type: YTN; PAM sequence: TTT
tccccactgcctgagttgct

SEQ ID NO: 277252 - DNA, 20 bp, Artificial Sequence
  Description of Artificial Sequence: Synthetic oligonucleotide
  Target: ATXN1; (+) strand; PAM type: YTN; PAM sequence: TTT
ccccactgcctgagttgctc

SEQ ID NO: 277253 - DNA, 20 bp, Artificial Sequence
  Description of Artificial Sequence: Synthetic oligonucleotide
  Target: ATXN1; (+) strand; PAM type: YTN; PAM sequence: TTC
cccactgcctgagttgctct

SEQ ID NO: 277254 - DNA, 20 bp, Artificial Sequence
  Description of Artificial Sequence: Synthetic oligonucleotide
  Target: ATXN1; (+) strand; PAM type: YTN; PAM sequence: CTG
cctgagttgctcttgagtgc

SEQ ID NO: 277255 - DNA, 20 bp, Artificial Sequence
  Description of Artificial Sequence: Synthetic oligonucleotide
  Target: ATXN1; (+) strand; PAM type: YTN; PAM sequence: CTG
agttgctcttgagtgcctag

SEQ ID NO: 277256 - DNA, 20 bp, Artificial Sequence
  Description of Artificial Sequence: Synthetic oligonucleotide
  Target: ATXN1; (+) strand; PAM type: YTN; PAM sequence: TTG
ctcttgagtgcctagtgggt

SEQ ID NO: 277257 - DNA, 20 bp, Artificial Sequence
  Description of Artificial Sequence: Synthetic oligonucleotide
  Target: ATXN1; (+) strand; PAM type: YTN; PAM sequence: CTC
ttgagtgcctagtgggtgaa

SEQ ID NO: 277258 - DNA, 20 bp, Artificial Sequence
  Description of Artificial Sequence: Synthetic oligonucleotide
  Target: ATXN1; (+) strand; PAM type: YTN; PAM sequence: CTT
gagtgcctagtgggtgaaca

SEQ ID NO: 277259 - DNA, 20 bp, Artificial Sequence
  Description of Artificial Sequence: Synthetic oligonucleotide
  Target: ATXN1; (+) strand; PAM type: YTN; PAM sequence: TTG
agtgcctagtgggtgaacag

SEQ ID NO: 277260 - DNA, 20 bp, Artificial Sequence
  Description of Artificial Sequence: Synthetic oligonucleotide
  Target: ATXN1; (+) strand; PAM type: YTN; PAM sequence: CTA
gtgggtgaacagaggaggga

SEQ ID NO: 277261 - DNA, 20 bp, Artificial Sequence
  Description of Artificial Sequence: Synthetic oligonucleotide
  Target: ATXN1; (+) strand; PAM type: YTN; PAM sequence: CTT
ccaatgggttctctgcacag

SEQ ID NO: 277262 - DNA, 20 bp, Artificial Sequence
  Description of Artificial Sequence: Synthetic oligonucleotide
  Target: ATXN1; (+) strand; PAM type: YTN; PAM sequence: TTC
caatgggttctctgcacagc

SEQ ID NO: 277263 - DNA, 20 bp, Artificial Sequence
  Description of Artificial Sequence: Synthetic oligonucleotide
  Target: ATXN1; (+) strand; PAM type: YTN; PAM sequence: TTC
tctgcacagccacacggtca

SEQ ID NO: 277264 - DNA, 20 bp, Artificial Sequence
  Description of Artificial Sequence: Synthetic oligonucleotide
  Target: ATXN1; (+) strand; PAM type: YTN; PAM sequence: CTC
tgcacagccacacggtcatt

SEQ ID NO: 277265 - DNA, 20 bp, Artificial Sequence
  Description of Artificial Sequence: Synthetic oligonucleotide
  Target: ATXN1; (+) strand; PAM type: YTN; PAM sequence: CTG
cacagccacacggtcattag

SEQ ID NO: 277266 - DNA, 20 bp, Artificial Sequence
  Description of Artificial Sequence: Synthetic oligonucleotide
  Target: ATXN1; (+) strand; PAM type: YTN; PAM sequence: TTA
gcatccacaatctgcattca

SEQ ID NO: 277267 - DNA, 20 bp, Artificial Sequence
  Description of Artificial Sequence: Synthetic oligonucleotide
  Target: ATXN1; (+) strand; PAM type: YTN; PAM sequence: CTG
cattcactccagatgagatt

SEQ ID NO: 277268 - DNA, 20 bp, Artificial Sequence
  Description of Artificial Sequence: Synthetic oligonucleotide
  Target: ATXN1; (+) strand; PAM type: YTN; PAM sequence: TTC
actccagatgagatttcatc

SEQ ID NO: 277269 - DNA, 20 bp, Artificial Sequence
  Description of Artificial Sequence: Synthetic oligonucleotide
  Target: ATXN1; (+) strand; PAM type: YTN; PAM sequence: CTC
cagatgagatttcatcaccg

SEQ ID NO: 277270 - DNA, 20 bp, Artificial Sequence
  Description of Artificial Sequence: Synthetic oligonucleotide
  Target: ATXN1; (+) strand; PAM type: YTN; PAM sequence: TTT
catcaccgcatcctatttat

SEQ ID NO: 277271 - DNA, 20 bp, Artificial Sequence
  Description of Artificial Sequence: Synthetic oligonucleotide
  Target: ATXN1; (+) strand; PAM type: YTN; PAM sequence: TTC
atcaccgcatcctatttatt

SEQ ID NO: 277272 - DNA, 20 bp, Artificial Sequence
  Description of Artificial Sequence: Synthetic oligonucleotide
  Target: ATXN1; (+) strand; PAM type: YTN; PAM sequence: CTA
tttattcattccttaatata

SEQ ID NO: 277273 - DNA, 20 bp, Artificial Sequence
  Description of Artificial Sequence: Synthetic oligonucleotide
  Target: ATXN1; (+) strand; PAM type: YTN; PAM sequence: TTT
attcattccttaatataaat

SEQ ID NO: 277274 - DNA, 20 bp, Artificial Sequence
  Description of Artificial Sequence: Synthetic oligonucleotide
  Target: ATXN1; (+) strand; PAM type: YTN; PAM sequence: TTA
ttcattccttaatataaatc

SEQ ID NO: 277275 - DNA, 20 bp, Artificial Sequence
  Description of Artificial Sequence: Synthetic oligonucleotide
  Target: ATXN1; (+) strand; PAM type: YTN; PAM sequence: TTC
attccttaatataaatctaa

SEQ ID NO: 277276 - DNA, 20 bp, Artificial Sequence
  Description of Artificial Sequence: Synthetic oligonucleotide
  Target: ATXN1; (+) strand; PAM type: YTN; PAM sequence: TTC
cttaatataaatctaaattg

SEQ ID NO: 277277 - DNA, 20 bp, Artificial Sequence
  Description of Artificial Sequence: Synthetic oligonucleotide
  Target: ATXN1; (+) strand; PAM type: YTN; PAM sequence: CTT
aatataaatctaaattgcgc

SEQ ID NO: 277278 - DNA, 20 bp, Artificial Sequence
  Description of Artificial Sequence: Synthetic oligonucleotide
  Target: ATXN1; (+) strand; PAM type: YTN; PAM sequence: TTA
atataaatctaaattgcgct

SEQ ID NO: 277279 - DNA, 20 bp, Artificial Sequence
  Description of Artificial Sequence: Synthetic oligonucleotide
  Target: ATXN1; (+) strand; PAM type: YTN; PAM sequence: CTA
aattgcgctcttcaaatagc

SEQ ID NO: 277280 - DNA, 20 bp, Artificial Sequence
  Description of Artificial Sequence: Synthetic oligonucleotide
  Target: ATXN1; (+) strand; PAM type: YTN; PAM sequence: TTG
cgctcttcaaatagcagaga

SEQ ID NO: 277281 - DNA, 20 bp, Artificial Sequence
  Description of Artificial Sequence: Synthetic oligonucleotide
  Target: ATXN1; (+) strand; PAM type: YTN; PAM sequence: CTC
ttcaaatagcagagagcact

SEQ ID NO: 277282 - DNA, 20 bp, Artificial Sequence
  Description of Artificial Sequence: Synthetic oligonucleotide
  Target: ATXN1; (+) strand; PAM type: YTN; PAM sequence: CTT
caaatagcagagagcactat

SEQ ID NO: 277283 - DNA, 20 bp, Artificial Sequence
  Description of Artificial Sequence: Synthetic oligonucleotide
  Target: ATXN1; (+) strand; PAM type: YTN; PAM sequence: TTC
aaatagcagagagcactatg

SEQ ID NO: 277284 - DNA, 20 bp, Artificial Sequence
  Description of Artificial Sequence: Synthetic oligonucleotide
  Target: ATXN1; (+) strand; PAM type: YTN; PAM sequence: CTA
tgcttcagtaaggggaaaga

SEQ ID NO: 277285 - DNA, 20 bp, Artificial Sequence
  Description of Artificial Sequence: Synthetic oligonucleotide
  Target: ATXN1; (+) strand; PAM type: YTN; PAM sequence: CTT
cagtaaggggaaagagaaac

SEQ ID NO: 277286 - DNA, 20 bp, Artificial Sequence
  Description of Artificial Sequence: Synthetic oligonucleotide
  Target: ATXN1; (+) strand; PAM type: YTN; PAM sequence: TTC
agtaaggggaaagagaaacg

SEQ ID NO: 277287 - DNA, 20 bp, Artificial Sequence
  Description of Artificial Sequence: Synthetic oligonucleotide
  Target: ATXN1; (+) strand; PAM type: YTN; PAM sequence: TTA
agagacgtgctgctgcattt

SEQ ID NO: 277288 - DNA, 20 bp, Artificial Sequence
  Description of Artificial Sequence: Synthetic oligonucleotide
  Target: ATXN1; (+) strand; PAM type: YTN; PAM sequence: CTG
ctgcattttcatcttctccc

SEQ ID NO: 277289 - DNA, 20 bp, Artificial Sequence
  Description of Artificial Sequence: Synthetic oligonucleotide
  Target: ATXN1; (+) strand; PAM type: YTN; PAM sequence: CTG
cattttcatcttctccctcc

SEQ ID NO: 277290 - DNA, 20 bp, Artificial Sequence
  Description of Artificial Sequence: Synthetic oligonucleotide
  Target: ATXN1; (+) strand; PAM type: YTN; PAM sequence: TTT
tcatcttctccctcctatgt

SEQ ID NO: 277291 - DNA, 20 bp, Artificial Sequence
  Description of Artificial Sequence: Synthetic oligonucleotide
  Target: ATXN1; (+) strand; PAM type: YTN; PAM sequence: TTT
catcttctccctcctatgtt

SEQ ID NO: 277292 - DNA, 20 bp, Artificial Sequence
  Description of Artificial Sequence: Synthetic oligonucleotide
  Target: ATXN1; (+) strand; PAM type: YTN; PAM sequence: TTC
atcttctccctcctatgtta

SEQ ID NO: 277293 - DNA, 20 bp, Artificial Sequence
  Description of Artificial Sequence: Synthetic oligonucleotide
  Target: ATXN1; (+) strand; PAM type: YTN; PAM sequence: CTT
ctccctcctatgttactttg

SEQ ID NO: 277294 - DNA, 20 bp, Artificial Sequence
  Description of Artificial Sequence: Synthetic oligonucleotide
  Target: ATXN1; (+) strand; PAM type: YTN; PAM sequence: TTC
tccctcctatgttactttgg

SEQ ID NO: 277295 - DNA, 20 bp, Artificial Sequence
  Description of Artificial Sequence: Synthetic oligonucleotide
  Target: ATXN1; (+) strand; PAM type: YTN; PAM sequence: CTC
cctcctatgttactttggtc

SEQ ID NO: 277296 - DNA, 20 bp, Artificial Sequence
  Description of Artificial Sequence: Synthetic oligonucleotide
  Target: ATXN1; (+) strand; PAM type: YTN; PAM sequence: CTC
ctatgttactttggtcttga

SEQ ID NO: 277297 - DNA, 20 bp, Artificial Sequence
  Description of Artificial Sequence: Synthetic oligonucleotide
  Target: ATXN1; (+) strand; PAM type: YTN; PAM sequence: CTA
tgttactttggtcttgacag

SEQ ID NO: 277298 - DNA, 20 bp, Artificial Sequence
  Description of Artificial Sequence: Synthetic oligonucleotide
  Target: ATXN1; (+) strand; PAM type: YTN; PAM sequence: TTA
ctttggtcttgacagcctta

SEQ ID NO: 277299 - DNA, 20 bp, Artificial Sequence
  Description of Artificial Sequence: Synthetic oligonucleotide
  Target: ATXN1; (+) strand; PAM type: YTN; PAM sequence: CTT
tggtcttgacagccttaatt

SEQ ID NO: 277300 - DNA, 20 bp, Artificial Sequence
  Description of Artificial Sequence: Synthetic oligonucleotide
  Target: ATXN1; (+) strand; PAM type: YTN; PAM sequence: TTT
ggtcttgacagccttaattc

SEQ ID NO: 277301 - DNA, 20 bp, Artificial Sequence
  Description of Artificial Sequence: Synthetic oligonucleotide
  Target: ATXN1; (+) strand; PAM type: YTN; PAM sequence: TTG
gtcttgacagccttaattca

SEQ ID NO: 277302 - DNA, 20 bp, Artificial Sequence
  Description of Artificial Sequence: Synthetic oligonucleotide
  Target: ATXN1; (+) strand; PAM type: YTN; PAM sequence: CTT
gacagccttaattcacacag

SEQ ID NO: 277303 - DNA, 20 bp, Artificial Sequence
  Description of Artificial Sequence: Synthetic oligonucleotide
  Target: ATXN1; (+) strand; PAM type: YTN; PAM sequence: TTG
acagccttaattcacacagt

SEQ ID NO: 277304 - DNA, 20 bp, Artificial Sequence
  Description of Artificial Sequence: Synthetic oligonucleotide
  Target: ATXN1; (+) strand; PAM type: YTN; PAM sequence: CTT
aattcacacagtgctcccgg

SEQ ID NO: 277305 - DNA, 20 bp, Artificial Sequence
  Description of Artificial Sequence: Synthetic oligonucleotide
  Target: ATXN1; (+) strand; PAM type: YTN; PAM sequence: TTA
attcacacagtgctcccgga

SEQ ID NO: 277306 - DNA, 20 bp, Artificial Sequence
  Description of Artificial Sequence: Synthetic oligonucleotide
  Target: ATXN1; (+) strand; PAM type: YTN; PAM sequence: TTC
acacagtgctcccggagccc

SEQ ID NO: 277307 - DNA, 20 bp, Artificial Sequence
  Description of Artificial Sequence: Synthetic oligonucleotide
  Target: ATXN1; (+) strand; PAM type: YTN; PAM sequence: CTC
ccggagcccttccctggctc

SEQ ID NO: 277308 - DNA, 20 bp, Artificial Sequence
  Description of Artificial Sequence: Synthetic oligonucleotide
  Target: ATXN1; (+) strand; PAM type: YTN; PAM sequence: CTT
ccctggctcgtcccaaggat

SEQ ID NO: 277309 - DNA, 20 bp, Artificial Sequence
  Description of Artificial Sequence: Synthetic oligonucleotide
  Target: ATXN1; (+) strand; PAM type: YTN; PAM sequence: TTC
cctggctcgtcccaaggatc

SEQ ID NO: 277310 - DNA, 20 bp, Artificial Sequence
  Description of Artificial Sequence: Synthetic oligonucleotide
  Target: ATXN1; (+) strand; PAM type: YTN; PAM sequence: CTG
gctcgtcccaaggatcagca

SEQ ID NO: 277311 - DNA, 20 bp, Artificial Sequence
  Description of Artificial Sequence: Synthetic oligonucleotide
  Target: ATXN1; (+) strand; PAM type: YTN; PAM sequence: CTC
gtcccaaggatcagcaaaca

SEQ ID NO: 277312 - DNA, 20 bp, Artificial Sequence
  Description of Artificial Sequence: Synthetic oligonucleotide
  Target: ATXN1; (+) strand; PAM type: YTN; PAM sequence: CTA
tcttagtttttcacactggg

SEQ ID NO: 277313 - DNA, 20 bp, Artificial Sequence
  Description of Artificial Sequence: Synthetic oligonucleotide
  Target: ATXN1; (+) strand; PAM type: YTN; PAM sequence: CTT
agtttttcacactggggctc

SEQ ID NO: 277314 - DNA, 20 bp, Artificial Sequence
  Description of Artificial Sequence: Synthetic oligonucleotide
  Target: ATXN1; (+) strand; PAM type: YTN; PAM sequence: TTA
gtttttcacactggggctct

SEQ ID NO: 277315 - DNA, 20 bp, Artificial Sequence
  Description of Artificial Sequence: Synthetic oligonucleotide
  Target: ATXN1; (+) strand; PAM type: YTN; PAM sequence: TTT
ttcacactggggctctctct

SEQ ID NO: 277316 - DNA, 20 bp, Artificial Sequence
  Description of Artificial Sequence: Synthetic oligonucleotide
  Target: ATXN1; (+) strand; PAM type: YTN; PAM sequence: TTT
tcacactggggctctctcta

SEQ ID NO: 277317 - DNA, 20 bp, Artificial Sequence
  Description of Artificial Sequence: Synthetic oligonucleotide
  Target: ATXN1; (+) strand; PAM type: YTN; PAM sequence: TTT
cacactggggctctctctag

SEQ ID NO: 277318 - DNA, 20 bp, Artificial Sequence
  Description of Artificial Sequence: Synthetic oligonucleotide
  Target: ATXN1; (+) strand; PAM type: YTN; PAM sequence: TTC
acactggggctctctctaga

SEQ ID NO: 277319 - DNA, 20 bp, Artificial Sequence
  Description of Artificial Sequence: Synthetic oligonucleotide
  Target: ATXN1; (+) strand; PAM type: YTN; PAM sequence: CTG
gggctctctctagagggaaa

SEQ ID NO: 277320 - DNA, 20 bp, Artificial Sequence
  Description of Artificial Sequence: Synthetic oligonucleotide
  Target: ATXN1; (+) strand; PAM type: YTN; PAM sequence: CTC
tctctagagggaaagtatgt

SEQ ID NO: 277321 - DNA, 20 bp, Artificial Sequence
  Description of Artificial Sequence: Synthetic oligonucleotide
  Target: ATXN1; (+) strand; PAM type: YTN; PAM sequence: CTC
tctagagggaaagtatgtag

SEQ ID NO: 277322 - DNA, 20 bp, Artificial Sequence
  Description of Artificial Sequence: Synthetic oligonucleotide
  Target: ATXN1; (+) strand; PAM type: YTN; PAM sequence: CTC
tagagggaaagtatgtagct

SEQ ID NO: 277323 - DNA, 20 bp, Artificial Sequence
  Description of Artificial Sequence: Synthetic oligonucleotide
  Target: ATXN1; (+) strand; PAM type: YTN; PAM sequence: CTA
gagggaaagtatgtagcttt

SEQ ID NO: 277324 - DNA, 20 bp, Artificial Sequence
  Description of Artificial Sequence: Synthetic oligonucleotide
  Target: ATXN1; (+) strand; PAM type: YTN; PAM sequence: CTT
tccacattcccaactacttg

SEQ ID NO: 277325 - DNA, 20 bp, Artificial Sequence
  Description of Artificial Sequence: Synthetic oligonucleotide
  Target: ATXN1; (+) strand; PAM type: YTN; PAM sequence: TTT
ccacattcccaactacttgg

SEQ ID NO: 277326 - DNA, 20 bp, Artificial Sequence
  Description of Artificial Sequence: Synthetic oligonucleotide
  Target: ATXN1; (+) strand; PAM type: YTN; PAM sequence: TTC
cacattcccaactacttggg

SEQ ID NO: 277327 - DNA, 20 bp, Artificial Sequence
  Description of Artificial Sequence: Synthetic oligonucleotide
  Target: ATXN1; (+) strand; PAM type: YTN; PAM sequence: TTC
ccaactacttgggagcccaa

SEQ ID NO: 277328 - DNA, 20 bp, Artificial Sequence
  Description of Artificial Sequence: Synthetic oligonucleotide
  Target: ATXN1; (+) strand; PAM type: YTN; PAM sequence: CTA
cttgggagcccaaggtgttt

SEQ ID NO: 277329 - DNA, 20 bp, Artificial Sequence
  Description of Artificial Sequence: Synthetic oligonucleotide
  Target: ATXN1; (+) strand; PAM type: YTN; PAM sequence: CTT
gggagcccaaggtgtttgca

SEQ ID NO: 277330 - DNA, 20 bp, Artificial Sequence
  Description of Artificial Sequence: Synthetic oligonucleotide
  Target: ATXN1; (+) strand; PAM type: YTN; PAM sequence: TTG
ggagcccaaggtgtttgcag

SEQ ID NO: 277331 - DNA, 20 bp, Artificial Sequence
  Description of Artificial Sequence: Synthetic oligonucleotide
  Target: ATXN1; (+) strand; PAM type: YTN; PAM sequence: TTT
gcagcagccaaatacaacta

SEQ ID NO: 277332 - DNA, 20 bp, Artificial Sequence
  Description of Artificial Sequence: Synthetic oligonucleotide
  Target: ATXN1; (+) strand; PAM type: YTN; PAM sequence: TTG
cagcagccaaatacaactaa

SEQ ID NO: 277333 - DNA, 20 bp, Artificial Sequence
  Description of Artificial Sequence: Synthetic oligonucleotide
  Target: ATXN1; (+) strand; PAM type: YTN; PAM sequence: CTA
acgagtaggaaaaagacact

SEQ ID NO: 277334 - DNA, 20 bp, Artificial Sequence
  Description of Artificial Sequence: Synthetic oligonucleotide
  Target: ATXN1; (+) strand; PAM type: YTN; PAM sequence: CTA
agaaatgccacaattgtgtc

SEQ ID NO: 277335 - DNA, 20 bp, Artificial Sequence
  Description of Artificial Sequence: Synthetic oligonucleotide
  Target: ATXN1; (+) strand; PAM type: YTN; PAM sequence: TTG
tgtctgacacattcaaaaga

SEQ ID NO: 277336 - DNA, 20 bp, Artificial Sequence
  Description of Artificial Sequence: Synthetic oligonucleotide
  Target: ATXN1; (+) strand; PAM type: YTN; PAM sequence: CTG
acacattcaaaagacagttg

SEQ ID NO: 277337 - DNA, 20 bp, Artificial Sequence
  Description of Artificial Sequence: Synthetic oligonucleotide
  Target: ATXN1; (+) strand; PAM type: YTN; PAM sequence: TTC
aaaagacagttgtcctccca

SEQ ID NO: 277338 - DNA, 20 bp, Artificial Sequence
  Description of Artificial Sequence: Synthetic oligonucleotide
  Target: ATXN1; (+) strand; PAM type: YTN; PAM sequence: TTG
tcctcccatccatggaggat

SEQ ID NO: 277339 - DNA, 20 bp, Artificial Sequence
  Description of Artificial Sequence: Synthetic oligonucleotide
  Target: ATXN1; (+) strand; PAM type: YTN; PAM sequence: CTC
ccatccatggaggatctgtt

SEQ ID NO: 277340 - DNA, 20 bp, Artificial Sequence
  Description of Artificial Sequence: Synthetic oligonucleotide
  Target: ATXN1; (+) strand; PAM type: YTN; PAM sequence: CTG
ttccaagaccccagtggacg

SEQ ID NO: 277341 - DNA, 20 bp, Artificial Sequence
  Description of Artificial Sequence: Synthetic oligonucleotide
  Target: ATXN1; (+) strand; PAM type: YTN; PAM sequence: TTC
caagaccccagtggacgcct

SEQ ID NO: 277342 - DNA, 20 bp, Artificial Sequence
  Description of Artificial Sequence: Synthetic oligonucleotide
  Target: ATXN1; (+) strand; PAM type: YTN; PAM sequence: CTA
aaaccatgaatagtaccttt

SEQ ID NO: 277343 - DNA, 20 bp, Artificial Sequence
  Description of Artificial Sequence: Synthetic oligonucleotide
  Target: ATXN1; (+) strand; PAM type: YTN; PAM sequence: CTT
tatgtatatctactatgttt

SEQ ID NO: 277344 - DNA, 20 bp, Artificial Sequence
  Description of Artificial Sequence: Synthetic oligonucleotide
  Target: ATXN1; (+) strand; PAM type: YTN; PAM sequence: TTT
atgtatatctactatgtttt

SEQ ID NO: 277345 - DNA, 20 bp, Artificial Sequence
  Description of Artificial Sequence: Synthetic oligonucleotide
  Target: ATXN1; (+) strand; PAM type: YTN; PAM sequence: TTA
tgtatatctactatgttttt

SEQ ID NO: 277346 - DNA, 20 bp, Artificial Sequence
  Description of Artificial Sequence: Synthetic oligonucleotide
  Target: ATXN1; (+) strand; PAM type: YTN; PAM sequence: CTA
ctatgttttttcctatacat

SEQ ID NO: 277347 - DNA, 20 bp, Artificial Sequence
  Description of Artificial Sequence: Synthetic oligonucleotide
  Target: ATXN1; (+) strand; PAM type: YTN; PAM sequence: CTA
tgttttttcctatacatata

SEQ ID NO: 277348 - DNA, 20 bp, Artificial Sequence
  Description of Artificial Sequence: Synthetic oligonucleotide
  Target: ATXN1; (+) strand; PAM type: YTN; PAM sequence: TTT
tttcctatacatatacaccc

SEQ ID NO: 277349 - DNA, 20 bp, Artificial Sequence
  Description of Artificial Sequence: Synthetic oligonucleotide
  Target: ATXN1; (+) strand; PAM type: YTN; PAM sequence: TTT
ttcctatacatatacaccca

SEQ ID NO: 277350 - DNA, 20 bp, Artificial Sequence
  Description of Artificial Sequence: Synthetic oligonucleotide
  Target: ATXN1; (+) strand; PAM type: YTN; PAM sequence: TTT
tcctatacatatacacccat

SEQ ID NO: 277351 - DNA, 20 bp, Artificial Sequence
  Description of Artificial Sequence: Synthetic oligonucleotide
  Target: ATXN1; (+) strand; PAM type: YTN; PAM sequence: TTT
cctatacatatacacccatg

SEQ ID NO: 277352 - DNA, 20 bp, Artificial Sequence
  Description of Artificial Sequence: Synthetic oligonucleotide
  Target: ATXN1; (+) strand; PAM type: YTN; PAM sequence: TTC
ctatacatatacacccatga

SEQ ID NO: 277353 - DNA, 20 bp, Artificial Sequence
  Description of Artificial Sequence: Synthetic oligonucleotide
  Target: ATXN1; (+) strand; PAM type: YTN; PAM sequence: CTA
tacatatacacccatgatag

SEQ ID NO: 277354 - DNA, 20 bp, Artificial Sequence
  Description of Artificial Sequence: Synthetic oligonucleotide
  Target: ATXN1; (+) strand; PAM type: YTN; PAM sequence: TTT
aatttataaataagtcacag

SEQ ID NO: 277355 - DNA, 20 bp, Artificial Sequence
  Description of Artificial Sequence: Synthetic oligonucleotide
  Target: ATXN1; (+) strand; PAM type: YTN; PAM sequence: TTA
atttataaataagtcacagt

SEQ ID NO: 277356 - DNA, 20 bp, Artificial Sequence
  Description of Artificial Sequence: Synthetic oligonucleotide
  Target: ATXN1; (+) strand; PAM type: YTN; PAM sequence: TTT
ataaataagtcacagtaaga

SEQ ID NO: 277357 - DNA, 20 bp, Artificial Sequence
  Description of Artificial Sequence: Synthetic oligonucleotide
  Target: ATXN1; (+) strand; PAM type: YTN; PAM sequence: TTA
taaataagtcacagtaagag

SEQ ID NO: 277358 - DNA, 20 bp, Artificial Sequence
  Description of Artificial Sequence: Synthetic oligonucleotide
  Target: ATXN1; (+) strand; PAM type: YTN; PAM sequence: TTA
acaacaaaaactaataataa

SEQ ID NO: 277359 - DNA, 20 bp, Artificial Sequence
  Description of Artificial Sequence: Synthetic oligonucleotide
  Target: ATXN1; (+) strand; PAM type: YTN; PAM sequence: CTA
ataataaaatagaacaatca

SEQ ID NO: 277360 - DNA, 20 bp, Artificial Sequence
  Description of Artificial Sequence: Synthetic oligonucleotide
  Target: ATXN1; (+) strand; PAM type: YTN; PAM sequence: TTA
tactgtactaaaagttatgt

SEQ ID NO: 277361 - DNA, 20 bp, Artificial Sequence
  Description of Artificial Sequence: Synthetic oligonucleotide
  Target: ATXN1; (+) strand; PAM type: YTN; PAM sequence: CTG
tactaaaagttatgtgaatg

SEQ ID NO: 277362 - DNA, 20 bp, Artificial Sequence
  Description of Artificial Sequence: Synthetic oligonucleotide
  Target: ATXN1; (+) strand; PAM type: YTN; PAM sequence: CTA
aaagttatgtgaatgtggtg

SEQ ID NO: 277363 - DNA, 20 bp, Artificial Sequence
  Description of Artificial Sequence: Synthetic oligonucleotide
  Target: ATXN1; (+) strand; PAM type: YTN; PAM sequence: TTA
tgtgaatgtggtgtctctct

SEQ ID NO: 277364 - DNA, 20 bp, Artificial Sequence
  Description of Artificial Sequence: Synthetic oligonucleotide
  Target: ATXN1; (+) strand; PAM type: YTN; PAM sequence: CTC
tctctctctctcaaaatatc

SEQ ID NO: 277365 - DNA, 20 bp, Artificial Sequence
  Description of Artificial Sequence: Synthetic oligonucleotide
  Target: ATXN1; (+) strand; PAM type: YTN; PAM sequence: CTC
tctctctctcaaaatatctt

SEQ ID NO: 277366 - DNA, 20 bp, Artificial Sequence
  Description of Artificial Sequence: Synthetic oligonucleotide
  Target: ATXN1; (+) strand; PAM type: YTN; PAM sequence: CTC
tctctctcaaaatatcttat

SEQ ID NO: 277367 - DNA, 20 bp, Artificial Sequence
  Description of Artificial Sequence: Synthetic oligonucleotide
  Target: ATXN1; (+) strand; PAM type: YTN; PAM sequence: CTC
tctctcaaaatatcttattg

SEQ ID NO: 277368 - DNA, 20 bp, Artificial Sequence
  Description of Artificial Sequence: Synthetic oligonucleotide
  Target: ATXN1; (+) strand; PAM type: YTN; PAM sequence: CTC
tctcaaaatatcttattgca

SEQ ID NO: 277369 - DNA, 20 bp, Artificial Sequence
  Description of Artificial Sequence: Synthetic oligonucleotide
  Target: ATXN1; (+) strand; PAM type: YTN; PAM sequence: CTC
tcaaaatatcttattgcatg

SEQ ID NO: 277370 - DNA, 20 bp, Artificial Sequence
  Description of Artificial Sequence: Synthetic oligonucleotide
  Target: ATXN1; (+) strand; PAM type: YTN; PAM sequence: CTC
aaaatatcttattgcatggc

SEQ ID NO: 277371 - DNA, 20 bp, Artificial Sequence
  Description of Artificial Sequence: Synthetic oligonucleotide
  Target: ATXN1; (+) strand; PAM type: YTN; PAM sequence: CTT
attgcatggcactcacctgt

SEQ ID NO: 277372 - DNA, 20 bp, Artificial Sequence
  Description of Artificial Sequence: Synthetic oligonucleotide
  Target: ATXN1; (+) strand; PAM type: YTN; PAM sequence: TTA
ttgcatggcactcacctgtt

SEQ ID NO: 277373 - DNA, 20 bp, Artificial Sequence
  Description of Artificial Sequence: Synthetic oligonucleotide
  Target: ATXN1; (+) strand; PAM type: YTN; PAM sequence: TTG
catggcactcacctgttttt

SEQ ID NO: 277374 - DNA, 20 bp, Artificial Sequence
  Description of Artificial Sequence: Synthetic oligonucleotide
  Target: ATXN1; (+) strand; PAM type: YTN; PAM sequence: CTC
acctgtttttgtaccacgct

SEQ ID NO: 277375 - DNA, 20 bp, Artificial Sequence
  Description of Artificial Sequence: Synthetic oligonucleotide
  Target: ATXN1; (+) strand; PAM type: YTN; PAM sequence: CTG
tttttgtaccacgcttgact

SEQ ID NO: 277376 - DNA, 20 bp, Artificial Sequence
  Description of Artificial Sequence: Synthetic oligonucleotide
  Target: ATXN1; (+) strand; PAM type: YTN; PAM sequence: TTT
ttgtaccacgcttgactgtg

SEQ ID NO: 277377 - DNA, 20 bp, Artificial Sequence
  Description of Artificial Sequence: Synthetic oligonucleotide
  Target: ATXN1; (+) strand; PAM type: YTN; PAM sequence: TTT
tgtaccacgcttgactgtgg

SEQ ID NO: 277378 - DNA, 20 bp, Artificial Sequence
  Description of Artificial Sequence: Synthetic oligonucleotide
  Target: ATXN1; (+) strand; PAM type: YTN; PAM sequence: TTT
gtaccacgcttgactgtggg

SEQ ID NO: 277379 - DNA, 20 bp, Artificial Sequence
  Description of Artificial Sequence: Synthetic oligonucleotide
  Target: ATXN1; (+) strand; PAM type: YTN; PAM sequence: TTG
taccacgcttgactgtgggt

SEQ ID NO: 277380 - DNA, 20 bp, Artificial Sequence
  Description of Artificial Sequence: Synthetic oligonucleotide
  Target: ATXN1; (+) strand; PAM type: YTN; PAM sequence: CTT
gactgtgggtaattgaaaca

SEQ ID NO: 277381 - DNA, 20 bp, Artificial Sequence
  Description of Artificial Sequence: Synthetic oligonucleotide
  Target: ATXN1; (+) strand; PAM type: YTN; PAM sequence: TTG
actgtgggtaattgaaacag

SEQ ID NO: 277382 - DNA, 20 bp, Artificial Sequence
  Description of Artificial Sequence: Synthetic oligonucleotide
  Target: ATXN1; (+) strand; PAM type: YTN; PAM sequence: CTG
tgggtaattgaaacagcaga

SEQ ID NO: 277383 - DNA, 20 bp, Artificial Sequence
  Description of Artificial Sequence: Synthetic oligonucleotide
  Target: ATXN1; (+) strand; PAM type: YTN; PAM sequence: TTG
aaacagcagaaaatgacacc

SEQ ID NO: 277384 - DNA, 20 bp, Artificial Sequence
  Description of Artificial Sequence: Synthetic oligonucleotide
  Target: ATXN1; (+) strand; PAM type: YTN; PAM sequence: CTA
ctgtatcaacctggataagt

SEQ ID NO: 277385 - DNA, 20 bp, Artificial Sequence
  Description of Artificial Sequence: Synthetic oligonucleotide
  Target: ATXN1; (+) strand; PAM type: YTN; PAM sequence: CTG
tatcaacctggataagttca

SEQ ID NO: 277386 - DNA, 20 bp, Artificial Sequence
  Description of Artificial Sequence: Synthetic oligonucleotide
  Target: ATXN1; (+) strand; PAM type: YTN; PAM sequence: CTG
gataagttcacagggaacgg

SEQ ID NO: 277387 - DNA, 20 bp, Artificial Sequence
  Description of Artificial Sequence: Synthetic oligonucleotide
  Target: ATXN1; (+) strand; PAM type: YTN; PAM sequence: TTC
acagggaacggaacacattc

SEQ ID NO: 277388 - DNA, 20 bp, Artificial Sequence
  Description of Artificial Sequence: Synthetic oligonucleotide
  Target: ATXN1; (+) strand; PAM type: YTN; PAM sequence: TTC
tttccagaaggtgatgcata

SEQ ID NO: 277389 - DNA, 20 bp, Artificial Sequence
  Description of Artificial Sequence: Synthetic oligonucleotide
  Target: ATXN1; (+) strand; PAM type: YTN; PAM sequence: CTT
tccagaaggtgatgcataaa

SEQ ID NO: 277390 - DNA, 20 bp, Artificial Sequence
  Description of Artificial Sequence: Synthetic oligonucleotide
  Target: ATXN1; (+) strand; PAM type: YTN; PAM sequence: TTT
ccagaaggtgatgcataaaa

SEQ ID NO: 277391 - DNA, 20 bp, Artificial Sequence
  Description of Artificial Sequence: Synthetic oligonucleotide
  Target: ATXN1; (+) strand; PAM type: YTN; PAM sequence: TTC
cagaaggtgatgcataaaat

SEQ ID NO: 277392 - DNA, 20 bp, Artificial Sequence
  Description of Artificial Sequence: Synthetic oligonucleotide
  Target: ATXN1; (+) strand; PAM type: YTN; PAM sequence: CTT
tgggaatgatgggacatttg

SEQ ID NO: 277393 - DNA, 20 bp, Artificial Sequence
  Description of Artificial Sequence: Synthetic oligonucleotide
  Target: ATXN1; (+) strand; PAM type: YTN; PAM sequence: TTT
gggaatgatgggacatttga

SEQ ID NO: 277394 - DNA, 20 bp, Artificial Sequence
  Description of Artificial Sequence: Synthetic oligonucleotide
  Target: ATXN1; (+) strand; PAM type: YTN; PAM sequence: TTG
ggaatgatgggacatttgag

SEQ ID NO: 277395 - DNA, 20 bp, Artificial Sequence
  Description of Artificial Sequence: Synthetic oligonucleotide
  Target: ATXN1; (+) strand; PAM type: YTN; PAM sequence: TTT
gagtttacaaaatgcgagac

SEQ ID NO: 277396 - DNA, 20 bp, Artificial Sequence
  Description of Artificial Sequence: Synthetic oligonucleotide
  Target: ATXN1; (+) strand; PAM type: YTN; PAM sequence: TTG
agtttacaaaatgcgagaca

SEQ ID NO: 277397 - DNA, 20 bp, Artificial Sequence
  Description of Artificial Sequence: Synthetic oligonucleotide
  Target: ATXN1; (+) strand; PAM type: YTN; PAM sequence: TTT
acaaaatgcgagacaagcaa

SEQ ID NO: 277398 - DNA, 20 bp, Artificial Sequence
  Description of Artificial Sequence: Synthetic oligonucleotide
  Target: ATXN1; (+) strand; PAM type: YTN; PAM sequence: TTA
caaaatgcgagacaagcaaa

SEQ ID NO: 277399 - DNA, 20 bp, Artificial Sequence
  Description of Artificial Sequence: Synthetic oligonucleotide
  Target: ATXN1; (+) strand; PAM type: YTN; PAM sequence: CTG
agctctggcctgggtcccgc

SEQ ID NO: 277400 - DNA, 20 bp, Artificial Sequence
  Description of Artificial Sequence: Synthetic oligonucleotide
  Target: ATXN1; (+) strand; PAM type: YTN; PAM sequence: CTC
tggcctgggtcccgctcatt

SEQ ID NO: 277401 - DNA, 20 bp, Artificial Sequence
  Description of Artificial Sequence: Synthetic oligonucleotide
  Target: ATXN1; (+) strand; PAM type: YTN; PAM sequence: CTG
gcctgggtcccgctcattcc

SEQ ID NO: 277402 - DNA, 20 bp, Artificial Sequence
  Description of Artificial Sequence: Synthetic oligonucleotide
  Target: ATXN1; (+) strand; PAM type: YTN; PAM sequence: CTG
ggtcccgctcattccttccc

SEQ ID NO: 277403 - DNA, 20 bp, Artificial Sequence
  Description of Artificial Sequence: Synthetic oligonucleotide
  Target: ATXN1; (+) strand; PAM type: YTN; PAM sequence: CTC
attccttcccaccgtcccgc

SEQ ID NO: 277404 - DNA, 20 bp, Artificial Sequence
  Description of Artificial Sequence: Synthetic oligonucleotide
  Target: ATXN1; (+) strand; PAM type: YTN; PAM sequence: TTC
cttcccaccgtcccgcagcc

SEQ ID NO: 277405 - DNA, 20 bp, Artificial Sequence
  Description of Artificial Sequence: Synthetic oligonucleotide
  Target: ATXN1; (+) strand; PAM type: YTN; PAM sequence: CTT
cccaccgtcccgcagccacc

SEQ ID NO: 277406 - DNA, 20 bp, Artificial Sequence
  Description of Artificial Sequence: Synthetic oligonucleotide
  Target: ATXN1; (+) strand; PAM type: YTN; PAM sequence: TTC
ccaccgtcccgcagccacca

SEQ ID NO: 277407 - DNA, 20 bp, Artificial Sequence
  Description of Artificial Sequence: Synthetic oligonucleotide
  Target: ATXN1; (+) strand; PAM type: YTN; PAM sequence: CTC
tcattctgtgcgggagggga

SEQ ID NO: 277408 - DNA, 20 bp, Artificial Sequence
  Description of Artificial Sequence: Synthetic oligonucleotide
  Target: ATXN1; (+) strand; PAM type: YTN; PAM sequence: CTC
attctgtgcgggaggggaca

SEQ ID NO: 277409 - DNA, 20 bp, Artificial Sequence
  Description of Artificial Sequence: Synthetic oligonucleotide
  Target: ATXN1; (+) strand; PAM type: YTN; PAM sequence: TTC
tgtgcgggaggggacatgtg

SEQ ID NO: 277410 - DNA, 20 bp, Artificial Sequence
  Description of Artificial Sequence: Synthetic oligonucleotide
  Target: ATXN1; (+) strand; PAM type: YTN; PAM sequence: CTG
tgcgggaggggacatgtggc

SEQ ID NO: 277411 - DNA, 20 bp, Artificial Sequence
  Description of Artificial Sequence: Synthetic oligonucleotide
  Target: ATXN1; (+) strand; PAM type: YTN; PAM sequence: CTA
gcaccaccactttccttata

SEQ ID NO: 277412 - DNA, 20 bp, Artificial Sequence
  Description of Artificial Sequence: Synthetic oligonucleotide
  Target: ATXN1; (+) strand; PAM type: YTN; PAM sequence: CTT
tccttataaaaagtaattta

SEQ ID NO: 277413 - DNA, 20 bp, Artificial Sequence
  Description of Artificial Sequence: Synthetic oligonucleotide
  Target: ATXN1; (+) strand; PAM type: YTN; PAM sequence: TTT
ccttataaaaagtaatttat

SEQ ID NO: 277414 - DNA, 20 bp, Artificial Sequence
  Description of Artificial Sequence: Synthetic oligonucleotide
  Target: ATXN1; (+) strand; PAM type: YTN; PAM sequence: TTC
cttataaaaagtaatttatg

SEQ ID NO: 277415 - DNA, 20 bp, Artificial Sequence
  Description of Artificial Sequence: Synthetic oligonucleotide
  Target: ATXN1; (+) strand; PAM type: YTN; PAM sequence: CTT
ataaaaagtaatttatggtt

SEQ ID NO: 277416 - DNA, 20 bp, Artificial Sequence
  Description of Artificial Sequence: Synthetic oligonucleotide
  Target: ATXN1; (+) strand; PAM type: YTN; PAM sequence: TTA
taaaaagtaatttatggttc

SEQ ID NO: 277417 - DNA, 20 bp, Artificial Sequence
  Description of Artificial Sequence: Synthetic oligonucleotide
  Target: ATXN1; (+) strand; PAM type: YTN; PAM sequence: TTT
atggttccctttcccatgac

SEQ ID NO: 277418 - DNA, 20 bp, Artificial Sequence
  Description of Artificial Sequence: Synthetic oligonucleotide
  Target: ATXN1; (+) strand; PAM type: YTN; PAM sequence: TTA
tggttccctttcccatgaca

SEQ ID NO: 277419 - DNA, 20 bp, Artificial Sequence
  Description of Artificial Sequence: Synthetic oligonucleotide
  Target: ATXN1; (+) strand; PAM type: YTN; PAM sequence: TTC
cctttcccatgacaggaaaa

SEQ ID NO: 277420 - DNA, 20 bp, Artificial Sequence
  Description of Artificial Sequence: Synthetic oligonucleotide
  Target: ATXN1; (+) strand; PAM type: YTN; PAM sequence: CTT
tcccatgacaggaaaactga

SEQ ID NO: 277421 - DNA, 20 bp, Artificial Sequence
  Description of Artificial Sequence: Synthetic oligonucleotide
  Target: ATXN1; (+) strand; PAM type: YTN; PAM sequence: TTT
cccatgacaggaaaactgat

SEQ ID NO: 277422 - DNA, 20 bp, Artificial Sequence
  Description of Artificial Sequence: Synthetic oligonucleotide
  Target: ATXN1; (+) strand; PAM type: YTN; PAM sequence: TTC
ccatgacaggaaaactgata

SEQ ID NO: 277423 - DNA, 20 bp, Artificial Sequence
  Description of Artificial Sequence: Synthetic oligonucleotide
  Target: ATXN1; (+) strand; PAM type: YTN; PAM sequence: CTG
atagaagtttacaggcaaaa

SEQ ID NO: 277424 - DNA, 20 bp, Artificial Sequence
  Description of Artificial Sequence: Synthetic oligonucleotide
  Target: ATXN1; (+) strand; PAM type: YTN; PAM sequence: TTT
acaggcaaaagtattatttc

SEQ ID NO: 277425 - DNA, 20 bp, Artificial Sequence
  Description of Artificial Sequence: Synthetic oligonucleotide
  Target: ATXN1; (+) strand; PAM type: YTN; PAM sequence: TTA
caggcaaaagtattatttct

SEQ ID NO: 277426 - DNA, 20 bp, Artificial Sequence
  Description of Artificial Sequence: Synthetic oligonucleotide
  Target: ATXN1; (+) strand; PAM type: YTN; PAM sequence: TTA
tttctaattcttttcatttg

SEQ ID NO: 277427 - DNA, 20 bp, Artificial Sequence
  Description of Artificial Sequence: Synthetic oligonucleotide
  Target: ATXN1; (+) strand; PAM type: YTN; PAM sequence: TTT
ctaattcttttcatttgggg

SEQ ID NO: 277428 - DNA, 20 bp, Artificial Sequence
  Description of Artificial Sequence: Synthetic oligonucleotide
  Target: ATXN1; (+) strand; PAM type: YTN; PAM sequence: TTC
taattcttttcatttgggga

SEQ ID NO: 277429 - DNA, 20 bp, Artificial Sequence
  Description of Artificial Sequence: Synthetic oligonucleotide
  Target: ATXN1; (+) strand; PAM type: YTN; PAM sequence: CTA
attcttttcatttggggata

SEQ ID NO: 277430 - DNA, 20 bp, Artificial Sequence
  Description of Artificial Sequence: Synthetic oligonucleotide
  Target: ATXN1; (+) strand; PAM type: YTN; PAM sequence: TTC
ttttcatttggggataagac

SEQ ID NO: 277431 - DNA, 20 bp, Artificial Sequence
  Description of Artificial Sequence: Synthetic oligonucleotide
  Target: ATXN1; (+) strand; PAM type: YTN; PAM sequence: CTT
ttcatttggggataagacaa

SEQ ID NO: 277432 - DNA, 20 bp, Artificial Sequence
  Description of Artificial Sequence: Synthetic oligonucleotide
  Target: ATXN1; (+) strand; PAM type: YTN; PAM sequence: TTT
tcatttggggataagacaag

SEQ ID NO: 277433 - DNA, 20 bp, Artificial Sequence
  Description of Artificial Sequence: Synthetic oligonucleotide
  Target: ATXN1; (+) strand; PAM type: YTN; PAM sequence: TTT
catttggggataagacaagt

SEQ ID NO: 277434 - DNA, 20 bp, Artificial Sequence
  Description of Artificial Sequence: Synthetic oligonucleotide
  Target: ATXN1; (+) strand; PAM type: YTN; PAM sequence: TTC
atttggggataagacaagtc

SEQ ID NO: 277435 - DNA, 20 bp, Artificial Sequence
  Description of Artificial Sequence: Synthetic oligonucleotide
  Target: ATXN1; (+) strand; PAM type: YTN; PAM sequence: TTT
ggggataagacaagtctttt

SEQ ID NO: 277436 - DNA, 20 bp, Artificial Sequence
  Description of Artificial Sequence: Synthetic oligonucleotide
  Target: ATXN1; (+) strand; PAM type: YTN; PAM sequence: TTG
gggataagacaagtcttttc

SEQ ID NO: 277437 - DNA, 20 bp, Artificial Sequence
  Description of Artificial Sequence: Synthetic oligonucleotide
  Target: ATXN1; (+) strand; PAM type: YTN; PAM sequence: CTT
ttccccctctgtgtgtattt

SEQ ID NO: 277438 - DNA, 20 bp, Artificial Sequence
  Description of Artificial Sequence: Synthetic oligonucleotide
  Target: ATXN1; (+) strand; PAM type: YTN; PAM sequence: TTT
tccccctctgtgtgtatttt

SEQ ID NO: 277439 - DNA, 20 bp, Artificial Sequence
  Description of Artificial Sequence: Synthetic oligonucleotide
  Target: ATXN1; (+) strand; PAM type: YTN; PAM sequence: TTT
ccccctctgtgtgtattttt

SEQ ID NO: 277440 - DNA, 20 bp, Artificial Sequence
  Description of Artificial Sequence: Synthetic oligonucleotide
  Target: ATXN1; (+) strand; PAM type: YTN; PAM sequence: TTC
cccctctgtgtgtattttta

SEQ ID NO: 277441 - DNA, 20 bp, Artificial Sequence
  Description of Artificial Sequence: Synthetic oligonucleotide
  Target: ATXN1; (+) strand; PAM type: YTN; PAM sequence: CTC
tgtgtgtatttttaaaatag

SEQ ID NO: 277442 - DNA, 20 bp, Artificial Sequence
  Description of Artificial Sequence: Synthetic oligonucleotide
  Target: ATXN1; (+) strand; PAM type: YTN; PAM sequence: CTG
tgtgtatttttaaaatagta

SEQ ID NO: 277443 - DNA, 20 bp, Artificial Sequence
  Description of Artificial Sequence: Synthetic oligonucleotide
  Target: ATXN1; (+) strand; PAM type: YTN; PAM sequence: TTT
ttaaaatagtaaaaatttta

SEQ ID NO: 277444 - DNA, 20 bp, Artificial Sequence
  Description of Artificial Sequence: Synthetic oligonucleotide
  Target: ATXN1; (+) strand; PAM type: YTN; PAM sequence: TTT
taaaatagtaaaaattttaa

SEQ ID NO: 277445 - DNA, 20 bp, Artificial Sequence
  Description of Artificial Sequence: Synthetic oligonucleotide
  Target: ATXN1; (+) strand; PAM type: YTN; PAM sequence: TTT
aaaatagtaaaaattttaaa

SEQ ID NO: 277446 - DNA, 20 bp, Artificial Sequence
  Description of Artificial Sequence: Synthetic oligonucleotide
  Target: ATXN1; (+) strand; PAM type: YTN; PAM sequence: TTA
aaatagtaaaaattttaaat

SEQ ID NO: 277447 - DNA, 20 bp, Artificial Sequence
  Description of Artificial Sequence: Synthetic oligonucleotide
  Target: ATXN1; (+) strand; PAM type: YTN; PAM sequence: TTT
taaatgaacatcctttatcg

SEQ ID NO: 277448 - DNA, 20 bp, Artificial Sequence
  Description of Artificial Sequence: Synthetic oligonucleotide
  Target: ATXN1; (+) strand; PAM type: YTN; PAM sequence: TTT
aaatgaacatcctttatcgg

SEQ ID NO: 277449 - DNA, 20 bp, Artificial Sequence
  Description of Artificial Sequence: Synthetic oligonucleotide
  Target: ATXN1; (+) strand; PAM type: YTN; PAM sequence: TTA
aatgaacatcctttatcggc

SEQ ID NO: 277450 - DNA, 20 bp, Artificial Sequence
  Description of Artificial Sequence: Synthetic oligonucleotide
  Target: ATXN1; (+) strand; PAM type: YTN; PAM sequence: CTT
tatcggcttgcacatatgct

SEQ ID NO: 277451 - DNA, 20 bp, Artificial Sequence
  Description of Artificial Sequence: Synthetic oligonucleotide
  Target: ATXN1; (+) strand; PAM type: YTN; PAM sequence: TTT
atcggcttgcacatatgcta

SEQ ID NO: 277452 - DNA, 20 bp, Artificial Sequence
  Description of Artificial Sequence: Synthetic oligonucleotide
  Target: ATXN1; (+) strand; PAM type: YTN; PAM sequence: TTA
tcggcttgcacatatgctaa

SEQ ID NO: 277453 - DNA, 20 bp, Artificial Sequence
  Description of Artificial Sequence: Synthetic oligonucleotide
  Target: ATXN1; (+) strand; PAM type: YTN; PAM sequence: CTT
gcacatatgctaaaggcagg

SEQ ID NO: 277454 - DNA, 20 bp, Artificial Sequence
  Description of Artificial Sequence: Synthetic oligonucleotide
  Target: ATXN1; (+) strand; PAM type: YTN; PAM sequence: TTG
cacatatgctaaaggcaggg

SEQ ID NO: 277455 - DNA, 20 bp, Artificial Sequence
  Description of Artificial Sequence: Synthetic oligonucleotide
  Target: ATXN1; (+) strand; PAM type: YTN; PAM sequence: CTA
aaggcagggcacataagact

SEQ ID NO: 277456 - DNA, 20 bp, Artificial Sequence
  Description of Artificial Sequence: Synthetic oligonucleotide
  Target: ATXN1; (+) strand; PAM type: YTN; PAM sequence: CTC
ttacaggaaagtatgccaag

SEQ ID NO: 277457 - DNA, 20 bp, Artificial Sequence
  Description of Artificial Sequence: Synthetic oligonucleotide
  Target: ATXN1; (+) strand; PAM type: YTN; PAM sequence: CTT
acaggaaagtatgccaagag

SEQ ID NO: 277458 - DNA, 20 bp, Artificial Sequence
  Description of Artificial Sequence: Synthetic oligonucleotide
  Target: ATXN1; (+) strand; PAM type: YTN; PAM sequence: TTA
caggaaagtatgccaagaga

SEQ ID NO: 277459 - DNA, 20 bp, Artificial Sequence
  Description of Artificial Sequence: Synthetic oligonucleotide
  Target: ATXN1; (+) strand; PAM type: YTN; PAM sequence: TTA
catgtgaattgaactcctaa

SEQ ID NO: 277460 - DNA, 20 bp, Artificial Sequence
  Description of Artificial Sequence: Synthetic oligonucleotide
  Target: ATXN1; (+) strand; PAM type: YTN; PAM sequence: TTG
aactcctaaatatgccttaa

SEQ ID NO: 277461 - DNA, 20 bp, Artificial Sequence
  Description of Artificial Sequence: Synthetic oligonucleotide
  Target: ATXN1; (+) strand; PAM type: YTN; PAM sequence: CTC
ctaaatatgccttaaaccag

SEQ ID NO: 277462 - DNA, 20 bp, Artificial Sequence
  Description of Artificial Sequence: Synthetic oligonucleotide
  Target: ATXN1; (+) strand; PAM type: YTN; PAM sequence: CTA
aatatgccttaaaccagggg

SEQ ID NO: 277463 - DNA, 20 bp, Artificial Sequence
  Description of Artificial Sequence: Synthetic oligonucleotide
  Target: ATXN1; (+) strand; PAM type: YTN; PAM sequence: CTT
aaaccaggggatacgtgacc

SEQ ID NO: 277464 - DNA, 20 bp, Artificial Sequence
  Description of Artificial Sequence: Synthetic oligonucleotide
  Target: ATXN1; (+) strand; PAM type: YTN; PAM sequence: TTA
aaccaggggatacgtgacca

SEQ ID NO: 277465 - DNA, 20 bp, Artificial Sequence
  Description of Artificial Sequence: Synthetic oligonucleotide
  Target: ATXN1; (+) strand; PAM type: YTN; PAM sequence: TTT
tattcagtaattctgtttgc

SEQ ID NO: 277466 - DNA, 20 bp, Artificial Sequence
  Description of Artificial Sequence: Synthetic oligonucleotide
  Target: ATXN1; (+) strand; PAM type: YTN; PAM sequence: TTT
attcagtaattctgtttgca

SEQ ID NO: 277467 - DNA, 20 bp, Artificial Sequence
  Description of Artificial Sequence: Synthetic oligonucleotide
  Target: ATXN1; (+) strand; PAM type: YTN; PAM sequence: TTA
ttcagtaattctgtttgcat

SEQ ID NO: 277468 - DNA, 20 bp, Artificial Sequence
  Description of Artificial Sequence: Synthetic oligonucleotide
  Target: ATXN1; (+) strand; PAM type: YTN; PAM sequence: TTC
agtaattctgtttgcatgtg

SEQ ID NO: 277469 - DNA, 20 bp, Artificial Sequence
  Description of Artificial Sequence: Synthetic oligonucleotide
  Target: ATXN1; (+) strand; PAM type: YTN; PAM sequence: TTC
tgtttgcatgtgttctaacc

SEQ ID NO: 277470 - DNA, 20 bp, Artificial Sequence
  Description of Artificial Sequence: Synthetic oligonucleotide
  Target: ATXN1; (+) strand; PAM type: YTN; PAM sequence: CTG
tttgcatgtgttctaaccac

SEQ ID NO: 277471 - DNA, 20 bp, Artificial Sequence
  Description of Artificial Sequence: Synthetic oligonucleotide
  Target: ATXN1; (+) strand; PAM type: YTN; PAM sequence: TTT
gcatgtgttctaaccactac

SEQ ID NO: 277472 - DNA, 20 bp, Artificial Sequence
  Description of Artificial Sequence: Synthetic oligonucleotide
  Target: ATXN1; (+) strand; PAM type: YTN; PAM sequence: TTG
catgtgttctaaccactacc

SEQ ID NO: 277473 - DNA, 20 bp, Artificial Sequence
  Description of Artificial Sequence: Synthetic oligonucleotide
  Target: ATXN1; (+) strand; PAM type: YTN; PAM sequence: TTC
taaccactaccatttcagct

SEQ ID NO: 277474 - DNA, 20 bp, Artificial Sequence
  Description of Artificial Sequence: Synthetic oligonucleotide
  Target: ATXN1; (+) strand; PAM type: YTN; PAM sequence: CTA
accactaccatttcagctat

SEQ ID NO: 277475 - DNA, 20 bp, Artificial Sequence
  Description of Artificial Sequence: Synthetic oligonucleotide
  Target: ATXN1; (+) strand; PAM type: YTN; PAM sequence: CTA
ccatttcagctattttccta

SEQ ID NO: 277476 - DNA, 20 bp, Artificial Sequence
  Description of Artificial Sequence: Synthetic oligonucleotide
  Target: ATXN1; (+) strand; PAM type: YTN; PAM sequence: TTT
cagctattttcctaaaaaaa

SEQ ID NO: 277477 - DNA, 20 bp, Artificial Sequence
  Description of Artificial Sequence: Synthetic oligonucleotide
  Target: ATXN1; (+) strand; PAM type: YTN; PAM sequence: TTC
agctattttcctaaaaaaaa

SEQ ID NO: 277478 - DNA, 20 bp, Artificial Sequence
  Description of Artificial Sequence: Synthetic oligonucleotide
  Target: ATXN1; (+) strand; PAM type: YTN; PAM sequence: CTA
ttttcctaaaaaaaaaaaaa

SEQ ID NO: 277479 - DNA, 20 bp, Artificial Sequence
  Description of Artificial Sequence: Synthetic oligonucleotide
  Target: ATXN1; (+) strand; PAM type: YTN; PAM sequence: TTT
tcctaaaaaaaaaaaaaaaa

SEQ ID NO: 277480 - DNA, 20 bp, Artificial Sequence
  Description of Artificial Sequence: Synthetic oligonucleotide
  Target: ATXN1; (+) strand; PAM type: YTN; PAM sequence: TTT
cctaaaaaaaaaaaaaaaaa

SEQ ID NO: 277481 - DNA, 20 bp, Artificial Sequence
  Description of Artificial Sequence: Synthetic oligonucleotide
  Target: ATXN1; (+) strand; PAM type: YTN; PAM sequence: TTC
ctaaaaaaaaaaaaaaaaaa

SEQ ID NO: 277482 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaaaaaaaaaaaa

SEQ ID NO: 277483 - DNA, 20 bp, Artificial Sequence
  Description of Artificial Sequence: Synthetic oligonucleotide
  Target: ATXN1; (+) strand; PAM type: YTN; PAM sequence: TTT
aagcatgcctagggctcaga

SEQ ID NO: 277484 - DNA, 20 bp, Artificial Sequence
  Description of Artificial Sequence: Synthetic oligonucleotide
  Target: ATXN1; (+) strand; PAM type: YTN; PAM sequence: TTA
agcatgcctagggctcagag

SEQ ID NO: 277485 - DNA, 20 bp, Artificial Sequence
  Description of Artificial Sequence: Synthetic oligonucleotide
  Target: ATXN1; (+) strand; PAM type: YTN; PAM sequence: CTA
gggctcagaggaatttagat

SEQ ID NO: 277486 - DNA, 20 bp, Artificial Sequence
  Description of Artificial Sequence: Synthetic oligonucleotide
  Target: ATXN1; (+) strand; PAM type: YTN; PAM sequence: CTC
agaggaatttagatgttttc

SEQ ID NO: 277487 - DNA, 20 bp, Artificial Sequence
  Description of Artificial Sequence: Synthetic oligonucleotide
  Target: ATXN1; (+) strand; PAM type: YTN; PAM sequence: TTT
agatgttttcaagcattact

SEQ ID NO: 277488 - DNA, 20 bp, Artificial Sequence
  Description of Artificial Sequence: Synthetic oligonucleotide
  Target: ATXN1; (+) strand; PAM type: YTN; PAM sequence: TTA
gatgttttcaagcattacta

SEQ ID NO: 277489 - DNA, 20 bp, Artificial Sequence
  Description of Artificial Sequence: Synthetic oligonucleotide
  Target: ATXN1; (+) strand; PAM type: YTN; PAM sequence: TTT
tcaagcattactacttgatg

SEQ ID NO: 277490 - DNA, 20 bp, Artificial Sequence
  Description of Artificial Sequence: Synthetic oligonucleotide
  Target: ATXN1; (+) strand; PAM type: YTN; PAM sequence: TTT
caagcattactacttgatgc

SEQ ID NO: 277491 - DNA, 20 bp, Artificial Sequence
  Description of Artificial Sequence: Synthetic oligonucleotide
  Target: ATXN1; (+) strand; PAM type: YTN; PAM sequence: TTC
aagcattactacttgatgct

SEQ ID NO: 277492 - DNA, 20 bp, Artificial Sequence
  Description of Artificial Sequence: Synthetic oligonucleotide
  Target: ATXN1; (+) strand; PAM type: YTN; PAM sequence: TTA
ctacttgatgcttttagagc

SEQ ID NO: 277493 - DNA, 20 bp, Artificial Sequence
  Description of Artificial Sequence: Synthetic oligonucleotide
  Target: ATXN1; (+) strand; PAM type: YTN; PAM sequence: CTA
cttgatgcttttagagcttc

SEQ ID NO: 277494 - DNA, 20 bp, Artificial Sequence
  Description of Artificial Sequence: Synthetic oligonucleotide
  Target: ATXN1; (+) strand; PAM type: YTN; PAM sequence: CTT
gatgcttttagagcttcatg

SEQ ID NO: 277495 - DNA, 20 bp, Artificial Sequence
  Description of Artificial Sequence: Synthetic oligonucleotide
  Target: ATXN1; (+) strand; PAM type: YTN; PAM sequence: TTG
atgcttttagagcttcatgc

SEQ ID NO: 277496 - DNA, 20 bp, Artificial Sequence
  Description of Artificial Sequence: Synthetic oligonucleotide
  Target: ATXN1; (+) strand; PAM type: YTN; PAM sequence: CTT
ttagagcttcatgcttgagt

SEQ ID NO: 277497 - DNA, 20 bp, Artificial Sequence
  Description of Artificial Sequence: Synthetic oligonucleotide
  Target: ATXN1; (+) strand; PAM type: YTN; PAM sequence: TTT
tagagcttcatgcttgagtt

SEQ ID NO: 277498 - DNA, 20 bp, Artificial Sequence
  Description of Artificial Sequence: Synthetic oligonucleotide
  Target: ATXN1; (+) strand; PAM type: YTN; PAM sequence: TTT
agagcttcatgcttgagtta

SEQ ID NO: 277499 - DNA, 20 bp, Artificial Sequence
  Description of Artificial Sequence: Synthetic oligonucleotide
  Target: ATXN1; (+) strand; PAM type: YTN; PAM sequence: TTA
gagcttcatgcttgagttaa

SEQ ID NO: 277500 - DNA, 20 bp, Artificial Sequence
  Description of Artificial Sequence: Synthetic oligonucleotide
  Target: ATXN1; (+) strand; PAM type: YTN; PAM sequence: CTT
catgcttgagttaaaggcga

SEQ ID NO: 277501 - DNA, 20 bp, Artificial Sequence
  Description of Artificial Sequence: Synthetic oligonucleotide
  Target: ATXN1; (+) strand; PAM type: YTN; PAM sequence: TTC
atgcttgagttaaaggcgag

SEQ ID NO: 277502 - DNA, 20 bp, Artificial Sequence
  Description of Artificial Sequence: Synthetic oligonucleotide
  Target: ATXN1; (+) strand; PAM type: YTN; PAM sequence: CTT
gagttaaaggcgagcactta

SEQ ID NO: 277503 - DNA, 20 bp, Artificial Sequence
  Description of Artificial Sequence: Synthetic oligonucleotide
  Target: ATXN1; (+) strand; PAM type: YTN; PAM sequence: TTG
agttaaaggcgagcacttaa

SEQ ID NO: 277504 - DNA, 20 bp, Artificial Sequence
  Description of Artificial Sequence: Synthetic oligonucleotide
  Target: ATXN1; (+) strand; PAM type: YTN; PAM sequence: TTA
aaggcgagcacttaaaaatt

SEQ ID NO: 277505 - DNA, 20 bp, Artificial Sequence
  Description of Artificial Sequence: Synthetic oligonucleotide
  Target: ATXN1; (+) strand; PAM type: YTN; PAM sequence: CTT
aaaaattaactctaacctct

SEQ ID NO: 277506 - DNA, 20 bp, Artificial Sequence
  Description of Artificial Sequence: Synthetic oligonucleotide
  Target: ATXN1; (+) strand; PAM type: YTN; PAM sequence: TTA
aaaattaactctaacctctg

SEQ ID NO: 277507 - DNA, 20 bp, Artificial Sequence
  Description of Artificial Sequence: Synthetic oligonucleotide
  Target: ATXN1; (+) strand; PAM type: YTN; PAM sequence: TTA
actctaacctctgggtttag

SEQ ID NO: 277508 - DNA, 20 bp, Artificial Sequence
  Description of Artificial Sequence: Synthetic oligonucleotide
  Target: ATXN1; (+) strand; PAM type: YTN; PAM sequence: CTC
taacctctgggtttagggct

SEQ ID NO: 277509 - DNA, 20 bp, Artificial Sequence
  Description of Artificial Sequence: Synthetic oligonucleotide
  Target: ATXN1; (+) strand; PAM type: YTN; PAM sequence: CTA
acctctgggtttagggctag

SEQ ID NO: 277510 - DNA, 20 bp, Artificial Sequence
  Description of Artificial Sequence: Synthetic oligonucleotide
  Target: ATXN1; (+) strand; PAM type: YTN; PAM sequence: CTC
tgggtttagggctagaagcc

SEQ ID NO: 277511 - DNA, 20 bp, Artificial Sequence
  Description of Artificial Sequence: Synthetic oligonucleotide
  Target: ATXN1; (+) strand; PAM type: YTN; PAM sequence: CTG
ggtttagggctagaagccaa

SEQ ID NO: 277512 - DNA, 20 bp, Artificial Sequence
  Description of Artificial Sequence: Synthetic oligonucleotide
  Target: ATXN1; (+) strand; PAM type: YTN; PAM sequence: TTT
agggctagaagccaatgact

SEQ ID NO: 277513 - DNA, 20 bp, Artificial Sequence
  Description of Artificial Sequence: Synthetic oligonucleotide
  Target: ATXN1; (+) strand; PAM type: YTN; PAM sequence: TTA
gggctagaagccaatgactt

SEQ ID NO: 277514 - DNA, 20 bp, Artificial Sequence
  Description of Artificial Sequence: Synthetic oligonucleotide
  Target: ATXN1; (+) strand; PAM type: YTN; PAM sequence: CTA
gaagccaatgacttcccata

SEQ ID NO: 277515 - DNA, 20 bp, Artificial Sequence
  Description of Artificial Sequence: Synthetic oligonucleotide
  Target: ATXN1; (+) strand; PAM type: YTN; PAM sequence: CTT
cccatagggtcactaaagat

SEQ ID NO: 277516 - DNA, 20 bp, Artificial Sequence
  Description of Artificial Sequence: Synthetic oligonucleotide
  Target: ATXN1; (+) strand; PAM type: YTN; PAM sequence: TTC
ccatagggtcactaaagatg

SEQ ID NO: 277517 - DNA, 20 bp, Artificial Sequence
  Description of Artificial Sequence: Synthetic oligonucleotide
  Target: ATXN1; (+) strand; PAM type: YTN; PAM sequence: CTA
aagatgctatttgttggcta

SEQ ID NO: 277518 - DNA, 20 bp, Artificial Sequence
  Description of Artificial Sequence: Synthetic oligonucleotide
  Target: ATXN1; (+) strand; PAM type: YTN; PAM sequence: CTA
tttgttggctagatttgtcc

SEQ ID NO: 277519 - DNA, 20 bp, Artificial Sequence
  Description of Artificial Sequence: Synthetic oligonucleotide
  Target: ATXN1; (+) strand; PAM type: YTN; PAM sequence: TTT
gttggctagatttgtcctgg

SEQ ID NO: 277520 - DNA, 20 bp, Artificial Sequence
  Description of Artificial Sequence: Synthetic oligonucleotide
  Target: ATXN1; (+) strand; PAM type: YTN; PAM sequence: TTG
ttggctagatttgtcctggg

SEQ ID NO: 277521 - DNA, 20 bp, Artificial Sequence
  Description of Artificial Sequence: Synthetic oligonucleotide
  Target: ATXN1; (+) strand; PAM type: YTN; PAM sequence: TTG
gctagatttgtcctgggagt

SEQ ID NO: 277522 - DNA, 20 bp, Artificial Sequence
  Description of Artificial Sequence: Synthetic oligonucleotide
  Target: ATXN1; (+) strand; PAM type: YTN; PAM sequence: CTA
gatttgtcctgggagtactc

SEQ ID NO: 277523 - DNA, 20 bp, Artificial Sequence
  Description of Artificial Sequence: Synthetic oligonucleotide
  Target: ATXN1; (+) strand; PAM type: YTN; PAM sequence: TTT
gtcctgggagtactcaaggg

SEQ ID NO: 277524 - DNA, 20 bp, Artificial Sequence
  Description of Artificial Sequence: Synthetic oligonucleotide
  Target: ATXN1; (+) strand; PAM type: YTN; PAM sequence: TTG
tcctgggagtactcaagggt

SEQ ID NO: 277525 - DNA, 20 bp, Artificial Sequence
  Description of Artificial Sequence: Synthetic oligonucleotide
  Target: ATXN1; (+) strand; PAM type: YTN; PAM sequence: CTG
ggagtactcaagggtctcgc

SEQ ID NO: 277526 - DNA, 20 bp, Artificial Sequence
  Description of Artificial Sequence: Synthetic oligonucleotide
  Target: ATXN1; (+) strand; PAM type: YTN; PAM sequence: CTC
aagggtctcgcaacaaaagt

SEQ ID NO: 277527 - DNA, 20 bp, Artificial Sequence
  Description of Artificial Sequence: Synthetic oligonucleotide
  Target: ATXN1; (+) strand; PAM type: YTN; PAM sequence: CTC
gcaacaaaagtaacagggtt

SEQ ID NO: 277528 - DNA, 20 bp, Artificial Sequence
  Description of Artificial Sequence: Synthetic oligonucleotide
  Target: ATXN1; (+) strand; PAM type: YTN; PAM sequence: TTG
tcacttcgaacctaaagact

SEQ ID NO: 277529 - DNA, 20 bp, Artificial Sequence
  Description of Artificial Sequence: Synthetic oligonucleotide
  Target: ATXN1; (+) strand; PAM type: YTN; PAM sequence: CTT
cgaacctaaagactcgattg

SEQ ID NO: 277530 - DNA, 20 bp, Artificial Sequence
  Description of Artificial Sequence: Synthetic oligonucleotide
  Target: ATXN1; (+) strand; PAM type: YTN; PAM sequence: TTC
gaacctaaagactcgattgc

SEQ ID NO: 277531 - DNA, 20 bp, Artificial Sequence
  Description of Artificial Sequence: Synthetic oligonucleotide
  Target: ATXN1; (+) strand; PAM type: YTN; PAM sequence: CTA
aagactcgattgcagcatgg

SEQ ID NO: 277532 - DNA, 20 bp, Artificial Sequence
  Description of Artificial Sequence: Synthetic oligonucleotide
  Target: ATXN1; (+) strand; PAM type: YTN; PAM sequence: CTC
gattgcagcatgggaaaaca

SEQ ID NO: 277533 - DNA, 20 bp, Artificial Sequence
  Description of Artificial Sequence: Synthetic oligonucleotide
  Target: ATXN1; (+) strand; PAM type: YTN; PAM sequence: TTG
cagcatgggaaaacataaca

SEQ ID NO: 277534 - DNA, 20 bp, Artificial Sequence
  Description of Artificial Sequence: Synthetic oligonucleotide
  Target: ATXN1; (+) strand; PAM type: YTN; PAM sequence: TTA
tcaagaatccttttttacta

SEQ ID NO: 277535 - DNA, 20 bp, Artificial Sequence
  Description of Artificial Sequence: Synthetic oligonucleotide
  Target: ATXN1; (+) strand; PAM type: YTN; PAM sequence: CTT
ttttactatcaagtctgaag

SEQ ID NO: 277536 - DNA, 20 bp, Artificial Sequence
  Description of Artificial Sequence: Synthetic oligonucleotide
  Target: ATXN1; (+) strand; PAM type: YTN; PAM sequence: TTT
tttactatcaagtctgaagt

SEQ ID NO: 277537 - DNA, 20 bp, Artificial Sequence
  Description of Artificial Sequence: Synthetic oligonucleotide
  Target: ATXN1; (+) strand; PAM type: YTN; PAM sequence: TTT
ttactatcaagtctgaagta

SEQ ID NO: 277538 - DNA, 20 bp, Artificial Sequence
  Description of Artificial Sequence: Synthetic oligonucleotide
  Target: ATXN1; (+) strand; PAM type: YTN; PAM sequence: TTT
tactatcaagtctgaagtac

SEQ ID NO: 277539 - DNA, 20 bp, Artificial Sequence
  Description of Artificial Sequence: Synthetic oligonucleotide
  Target: ATXN1; (+) strand; PAM type: YTN; PAM sequence: TTT
actatcaagtctgaagtact

SEQ ID NO: 277540 - DNA, 20 bp, Artificial Sequence
  Description of Artificial Sequence: Synthetic oligonucleotide
  Target: ATXN1; (+) strand; PAM type: YTN; PAM sequence: TTA
ctatcaagtctgaagtactg

SEQ ID NO: 277541 - DNA, 20 bp, Artificial Sequence
  Description of Artificial Sequence: Synthetic oligonucleotide
  Target: ATXN1; (+) strand; PAM type: YTN; PAM sequence: CTA
tcaagtctgaagtactggag

SEQ ID NO: 277542 - DNA, 20 bp, Artificial Sequence
  Description of Artificial Sequence: Synthetic oligonucleotide
  Target: ATXN1; (+) strand; PAM type: YTN; PAM sequence: CTG
aagtactggagatgatgaga

SEQ ID NO: 277543 - DNA, 20 bp, Artificial Sequence
  Description of Artificial Sequence: Synthetic oligonucleotide
  Target: ATXN1; (+) strand; PAM type: YTN; PAM sequence: CTG
gagatgatgagaggaacatc

SEQ ID NO: 277544 - DNA, 20 bp, Artificial Sequence
  Description of Artificial Sequence: Synthetic oligonucleotide
  Target: ATXN1; (+) strand; PAM type: YTN; PAM sequence: TTG
gaccatgaagagaaaattcc

SEQ ID NO: 277545 - DNA, 20 bp, Artificial Sequence
  Description of Artificial Sequence: Synthetic oligonucleotide
  Target: ATXN1; (+) strand; PAM type: YTN; PAM sequence: TTC
cagtcctgggtgtgccatcc

SEQ ID NO: 277546 - DNA, 20 bp, Artificial Sequence
  Description of Artificial Sequence: Synthetic oligonucleotide
  Target: ATXN1; (+) strand; PAM type: YTN; PAM sequence: CTG
ggtgtgccatcctgagcaag

SEQ ID NO: 277547 - DNA, 20 bp, Artificial Sequence
  Description of Artificial Sequence: Synthetic oligonucleotide
  Target: ATXN1; (+) strand; PAM type: YTN; PAM sequence: CTG
agcaagtcatagctctcctc

SEQ ID NO: 277548 - DNA, 20 bp, Artificial Sequence
  Description of Artificial Sequence: Synthetic oligonucleotide
  Target: ATXN1; (+) strand; PAM type: YTN; PAM sequence: CTC
tcctctgcacctcagtttcc

SEQ ID NO: 277549 - DNA, 20 bp, Artificial Sequence
  Description of Artificial Sequence: Synthetic oligonucleotide
  Target: ATXN1; (+) strand; PAM type: YTN; PAM sequence: CTC
ctctgcacctcagtttccta

SEQ ID NO: 277550 - DNA, 20 bp, Artificial Sequence
  Description of Artificial Sequence: Synthetic oligonucleotide
  Target: ATXN1; (+) strand; PAM type: YTN; PAM sequence: CTC
tgcacctcagtttcctaatc

SEQ ID NO: 277551 - DNA, 20 bp, Artificial Sequence
  Description of Artificial Sequence: Synthetic oligonucleotide
  Target: ATXN1; (+) strand; PAM type: YTN; PAM sequence: CTG
cacctcagtttcctaatcag

SEQ ID NO: 277552 - DNA, 20 bp, Artificial Sequence
  Description of Artificial Sequence: Synthetic oligonucleotide
  Target: ATXN1; (+) strand; PAM type: YTN; PAM sequence: CTC
agtttcctaatcagtaaaac

SEQ ID NO: 277553 - DNA, 20 bp, Artificial Sequence
  Description of Artificial Sequence: Synthetic oligonucleotide
  Target: ATXN1; (+) strand; PAM type: YTN; PAM sequence: TTT
cctaatcagtaaaacaaggg

SEQ ID NO: 277554 - DNA, 20 bp, Artificial Sequence
  Description of Artificial Sequence: Synthetic oligonucleotide
  Target: ATXN1; (+) strand; PAM type: YTN; PAM sequence: TTC
ctaatcagtaaaacaaggga

SEQ ID NO: 277555 - DNA, 20 bp, Artificial Sequence
  Description of Artificial Sequence: Synthetic oligonucleotide
  Target: ATXN1; (+) strand; PAM type: YTN; PAM sequence: CTA
atcagtaaaacaagggagtt

SEQ ID NO: 277556 - DNA, 20 bp, Artificial Sequence
  Description of Artificial Sequence: Synthetic oligonucleotide
  Target: ATXN1; (+) strand; PAM type: YTN; PAM sequence: TTG
gtgaatttctcaagtccctc

SEQ ID NO: 277557 - DNA, 20 bp, Artificial Sequence
  Description of Artificial Sequence: Synthetic oligonucleotide
  Target: ATXN1; (+) strand; PAM type: YTN; PAM sequence: TTT
ctcaagtccctcgcatgctc

SEQ ID NO: 277558 - DNA, 20 bp, Artificial Sequence
  Description of Artificial Sequence: Synthetic oligonucleotide
  Target: ATXN1; (+) strand; PAM type: YTN; PAM sequence: TTC
tcaagtccctcgcatgctcc

SEQ ID NO: 277559 - DNA, 20 bp, Artificial Sequence
  Description of Artificial Sequence: Synthetic oligonucleotide
  Target: ATXN1; (+) strand; PAM type: YTN; PAM sequence: CTC
aagtccctcgcatgctccag

SEQ ID NO: 277560 - DNA, 20 bp, Artificial Sequence
  Description of Artificial Sequence: Synthetic oligonucleotide
  Target: ATXN1; (+) strand; PAM type: YTN; PAM sequence: CTC
gcatgctccaggtctccgat

SEQ ID NO: 277561 - DNA, 20 bp, Artificial Sequence
  Description of Artificial Sequence: Synthetic oligonucleotide
  Target: ATXN1; (+) strand; PAM type: YTN; PAM sequence: CTC
caggtctccgattccacgct

SEQ ID NO: 277562 - DNA, 20 bp, Artificial Sequence
  Description of Artificial Sequence: Synthetic oligonucleotide
  Target: ATXN1; (+) strand; PAM type: YTN; PAM sequence: CTC
cgattccacgctcctcgtct

SEQ ID NO: 277563 - DNA, 20 bp, Artificial Sequence
  Description of Artificial Sequence: Synthetic oligonucleotide
  Target: ATXN1; (+) strand; PAM type: YTN; PAM sequence: TTC
cacgctcctcgtctttctct

SEQ ID NO: 277564 - DNA, 20 bp, Artificial Sequence
  Description of Artificial Sequence: Synthetic oligonucleotide
  Target: ATXN1; (+) strand; PAM type: YTN; PAM sequence: CTC
ctcgtctttctctttgccag

SEQ ID NO: 277565 - DNA, 20 bp, Artificial Sequence
  Description of Artificial Sequence: Synthetic oligonucleotide
  Target: ATXN1; (+) strand; PAM type: YTN; PAM sequence: CTC
gtctttctctttgccagcag

SEQ ID NO: 277566 - DNA, 20 bp, Artificial Sequence
  Description of Artificial Sequence: Synthetic oligonucleotide
  Target: ATXN1; (+) strand; PAM type: YTN; PAM sequence: CTT
tctctttgccagcagggact

SEQ ID NO: 277567 - DNA, 20 bp, Artificial Sequence
  Description of Artificial Sequence: Synthetic oligonucleotide
  Target: ATXN1; (+) strand; PAM type: YTN; PAM sequence: TTT
ctctttgccagcagggactg

SEQ ID NO: 277568 - DNA, 20 bp, Artificial Sequence
  Description of Artificial Sequence: Synthetic oligonucleotide
  Target: ATXN1; (+) strand; PAM type: YTN; PAM sequence: TTC
tctttgccagcagggactga

SEQ ID NO: 277569 - DNA, 20 bp, Artificial Sequence
  Description of Artificial Sequence: Synthetic oligonucleotide
  Target: ATXN1; (+) strand; PAM type: YTN; PAM sequence: CTC
tttgccagcagggactgagt

SEQ ID NO: 277570 - DNA, 20 bp, Artificial Sequence
  Description of Artificial Sequence: Synthetic oligonucleotide
  Target: ATXN1; (+) strand; PAM type: YTN; PAM sequence: CTT
tgccagcagggactgagtgt

SEQ ID NO: 277571 - DNA, 20 bp, Artificial Sequence
  Description of Artificial Sequence: Synthetic oligonucleotide
  Target: ATXN1; (+) strand; PAM type: YTN; PAM sequence: TTT
gccagcagggactgagtgtg

SEQ ID NO: 277572 - DNA, 20 bp, Artificial Sequence
  Description of Artificial Sequence: Synthetic oligonucleotide
  Target: ATXN1; (+) strand; PAM type: YTN; PAM sequence: TTG
ccagcagggactgagtgtgt

SEQ ID NO: 277573 - DNA, 20 bp, Artificial Sequence
  Description of Artificial Sequence: Synthetic oligonucleotide
  Target: ATXN1; (+) strand; PAM type: YTN; PAM sequence: CTG
agtgtgtgacgaaggttgtg

SEQ ID NO: 277574 - DNA, 20 bp, Artificial Sequence
  Description of Artificial Sequence: Synthetic oligonucleotide
  Target: ATXN1; (+) strand; PAM type: YTN; PAM sequence: TTG
tgcctttgacctcagaggaa

SEQ ID NO: 277575 - DNA, 20 bp, Artificial Sequence
  Description of Artificial Sequence: Synthetic oligonucleotide
  Target: ATXN1; (+) strand; PAM type: YTN; PAM sequence: CTT
tgacctcagaggaatgtgac

SEQ ID NO: 277576 - DNA, 20 bp, Artificial Sequence
  Description of Artificial Sequence: Synthetic oligonucleotide
  Target: ATXN1; (+) strand; PAM type: YTN; PAM sequence: TTT
gacctcagaggaatgtgaca

SEQ ID NO: 277577 - DNA, 20 bp, Artificial Sequence
  Description of Artificial Sequence: Synthetic oligonucleotide
  Target: ATXN1; (+) strand; PAM type: YTN; PAM sequence: TTG
acctcagaggaatgtgacaa

SEQ ID NO: 277578 - DNA, 20 bp, Artificial Sequence
  Description of Artificial Sequence: Synthetic oligonucleotide
  Target: ATXN1; (+) strand; PAM type: YTN; PAM sequence: CTC
agaggaatgtgacaacggcc

SEQ ID NO: 277579 - DNA, 20 bp, Artificial Sequence
  Description of Artificial Sequence: Synthetic oligonucleotide
  Target: ATXN1; (+) strand; PAM type: YTN; PAM sequence: CTT
ccttgcattgttcccacagt

SEQ ID NO: 277580 - DNA, 20 bp, Artificial Sequence
  Description of Artificial Sequence: Synthetic oligonucleotide
  Target: ATXN1; (+) strand; PAM type: YTN; PAM sequence: TTC
cttgcattgttcccacagta

SEQ ID NO: 277581 - DNA, 20 bp, Artificial Sequence
  Description of Artificial Sequence: Synthetic oligonucleotide
  Target: ATXN1; (+) strand; PAM type: YTN; PAM sequence: CTT
gcattgttcccacagtaacc

SEQ ID NO: 277582 - DNA, 20 bp, Artificial Sequence
  Description of Artificial Sequence: Synthetic oligonucleotide
  Target: ATXN1; (+) strand; PAM type: YTN; PAM sequence: TTG
cattgttcccacagtaacca

SEQ ID NO: 277583 - DNA, 20 bp, Artificial Sequence
  Description of Artificial Sequence: Synthetic oligonucleotide
  Target: ATXN1; (+) strand; PAM type: YTN; PAM sequence: TTG
ttcccacagtaaccagagcc

SEQ ID NO: 277584 - DNA, 20 bp, Artificial Sequence
  Description of Artificial Sequence: Synthetic oligonucleotide
  Target: ATXN1; (+) strand; PAM type: YTN; PAM sequence: TTC
ccacagtaaccagagccagc

SEQ ID NO: 277585 - DNA, 20 bp, Artificial Sequence
  Description of Artificial Sequence: Synthetic oligonucleotide
  Target: ATXN1; (+) strand; PAM type: YTN; PAM sequence: CTG
tccaggccggctggccaagt

SEQ ID NO: 277586 - DNA, 20 bp, Artificial Sequence
  Description of Artificial Sequence: Synthetic oligonucleotide
  Target: ATXN1; (+) strand; PAM type: YTN; PAM sequence: CTG
gccaagttgtggcgcaggat

SEQ ID NO: 277587 - DNA, 20 bp, Artificial Sequence
  Description of Artificial Sequence: Synthetic oligonucleotide
  Target: ATXN1; (+) strand; PAM type: YTN; PAM sequence: TTG
tggcgcaggatcacacacaa

SEQ ID NO: 277588 - DNA, 20 bp, Artificial Sequence
  Description of Artificial Sequence: Synthetic oligonucleotide
  Target: ATXN1; (+) strand; PAM type: YTN; PAM sequence: TTG
gggctctgcttgggggactc

SEQ ID NO: 277589 - DNA, 20 bp, Artificial Sequence
  Description of Artificial Sequence: Synthetic oligonucleotide
  Target: ATXN1; (+) strand; PAM type: YTN; PAM sequence: CTC
tgcttgggggactccgcctc

SEQ ID NO: 277590 - DNA, 20 bp, Artificial Sequence
  Description of Artificial Sequence: Synthetic oligonucleotide
  Target: ATXN1; (+) strand; PAM type: YTN; PAM sequence: CTG
cttgggggactccgcctcaa

SEQ ID NO: 277591 - DNA, 20 bp, Artificial Sequence
  Description of Artificial Sequence: Synthetic oligonucleotide
  Target: ATXN1; (+) strand; PAM type: YTN; PAM sequence: CTT
gggggactccgcctcaaggc

SEQ ID NO: 277592 - DNA, 20 bp, Artificial Sequence
  Description of Artificial Sequence: Synthetic oligonucleotide
  Target: ATXN1; (+) strand; PAM type: YTN; PAM sequence: TTG
ggggactccgcctcaaggcc

SEQ ID NO: 277593 - DNA, 20 bp, Artificial Sequence
  Description of Artificial Sequence: Synthetic oligonucleotide
  Target: ATXN1; (+) strand; PAM type: YTN; PAM sequence: CTC
cgcctcaaggcctccccctt

SEQ ID NO: 277594 - DNA, 20 bp, Artificial Sequence
  Description of Artificial Sequence: Synthetic oligonucleotide
  Target: ATXN1; (+) strand; PAM type: YTN; PAM sequence: CTC
aaggcctcccccttcctcta

SEQ ID NO: 277595 - DNA, 20 bp, Artificial Sequence
  Description of Artificial Sequence: Synthetic oligonucleotide
  Target: ATXN1; (+) strand; PAM type: YTN; PAM sequence: CTC
ccccttcctctaggtcttta

SEQ ID NO: 277596 - DNA, 20 bp, Artificial Sequence
  Description of Artificial Sequence: Synthetic oligonucleotide
  Target: ATXN1; (+) strand; PAM type: YTN; PAM sequence: CTT
cctctaggtctttatccgca

SEQ ID NO: 277597 - DNA, 20 bp, Artificial Sequence
  Description of Artificial Sequence: Synthetic oligonucleotide
  Target: ATXN1; (+) strand; PAM type: YTN; PAM sequence: TTC
ctctaggtctttatccgcag

SEQ ID NO: 277598 - DNA, 20 bp, Artificial Sequence
  Description of Artificial Sequence: Synthetic oligonucleotide
  Target: ATXN1; (+) strand; PAM type: YTN; PAM sequence: CTC
taggtctttatccgcaggtc

SEQ ID NO: 277599 - DNA, 20 bp, Artificial Sequence
  Description of Artificial Sequence: Synthetic oligonucleotide
  Target: ATXN1; (+) strand; PAM type: YTN; PAM sequence: CTA
ggtctttatccgcaggtcgg

SEQ ID NO: 277600 - DNA, 20 bp, Artificial Sequence
  Description of Artificial Sequence: Synthetic oligonucleotide
  Target: ATXN1; (+) strand; PAM type: YTN; PAM sequence: CTT
tatccgcaggtcgggaccct

SEQ ID NO: 277601 - DNA, 20 bp, Artificial Sequence
  Description of Artificial Sequence: Synthetic oligonucleotide
  Target: ATXN1; (+) strand; PAM type: YTN; PAM sequence: TTT
atccgcaggtcgggaccctc

SEQ ID NO: 277602 - DNA, 20 bp, Artificial Sequence
  Description of Artificial Sequence: Synthetic oligonucleotide
  Target: ATXN1; (+) strand; PAM type: YTN; PAM sequence: TTA
tccgcaggtcgggaccctcc

SEQ ID NO: 277603 - DNA, 20 bp, Artificial Sequence
  Description of Artificial Sequence: Synthetic oligonucleotide
  Target: ATXN1; (+) strand; PAM type: YTN; PAM sequence: CTC
ctaagaacacaagaatgagc

SEQ ID NO: 277604 - DNA, 20 bp, Artificial Sequence
  Description of Artificial Sequence: Synthetic oligonucleotide
  Target: ATXN1; (+) strand; PAM type: YTN; PAM sequence: CTA
agaacacaagaatgagcctg

SEQ ID NO: 277605 - DNA, 20 bp, Artificial Sequence
  Description of Artificial Sequence: Synthetic oligonucleotide
  Target: ATXN1; (+) strand; PAM type: YTN; PAM sequence: CTG
caatccttcctaaataactt

SEQ ID NO: 277606 - DNA, 20 bp, Artificial Sequence
  Description of Artificial Sequence: Synthetic oligonucleotide
  Target: ATXN1; (+) strand; PAM type: YTN; PAM sequence: CTT
cctaaataacttttgggggc

SEQ ID NO: 277607 - DNA, 20 bp, Artificial Sequence
  Description of Artificial Sequence: Synthetic oligonucleotide
  Target: ATXN1; (+) strand; PAM type: YTN; PAM sequence: TTC
ctaaataacttttgggggct

SEQ ID NO: 277608 - DNA, 20 bp, Artificial Sequence
  Description of Artificial Sequence: Synthetic oligonucleotide
  Target: ATXN1; (+) strand; PAM type: YTN; PAM sequence: CTA
aataacttttgggggcttaa

SEQ ID NO: 277609 - DNA, 20 bp, Artificial Sequence
  Description of Artificial Sequence: Synthetic oligonucleotide
  Target: ATXN1; (+) strand; PAM type: YTN; PAM sequence: CTT
ttgggggcttaaaatcctgg

SEQ ID NO: 277610 - DNA, 20 bp, Artificial Sequence
  Description of Artificial Sequence: Synthetic oligonucleotide
  Target: ATXN1; (+) strand; PAM type: YTN; PAM sequence: TTT
tgggggcttaaaatcctggg

SEQ ID NO: 277611 - DNA, 20 bp, Artificial Sequence
  Description of Artificial Sequence: Synthetic oligonucleotide
  Target: ATXN1; (+) strand; PAM type: YTN; PAM sequence: TTT
gggggcttaaaatcctgggt

SEQ ID NO: 277612 - DNA, 20 bp, Artificial Sequence
  Description of Artificial Sequence: Synthetic oligonucleotide
  Target: ATXN1; (+) strand; PAM type: YTN; PAM sequence: TTG
ggggcttaaaatcctgggtg

SEQ ID NO: 277613 - DNA, 20 bp, Artificial Sequence
  Description of Artificial Sequence: Synthetic oligonucleotide
  Target: ATXN1; (+) strand; PAM type: YTN; PAM sequence: CTT
aaaatcctgggtgtagctac

SEQ ID NO: 277614 - DNA, 20 bp, Artificial Sequence
  Description of Artificial Sequence: Synthetic oligonucleotide
  Target: ATXN1; (+) strand; PAM type: YTN; PAM sequence: TTA
aaatcctgggtgtagctaca

SEQ ID NO: 277615 - DNA, 20 bp, Artificial Sequence
  Description of Artificial Sequence: Synthetic oligonucleotide
  Target: ATXN1; (+) strand; PAM type: YTN; PAM sequence: CTG
ggtgtagctacaatcatgtg

SEQ ID NO: 277616 - DNA, 20 bp, Artificial Sequence
  Description of Artificial Sequence: Synthetic oligonucleotide
  Target: ATXN1; (+) strand; PAM type: YTN; PAM sequence: CTA
caatcatgtgaaactccccc

SEQ ID NO: 277617 - DNA, 20 bp, Artificial Sequence
  Description of Artificial Sequence: Synthetic oligonucleotide
  Target: ATXN1; (+) strand; PAM type: YTN; PAM sequence: CTC
cccctaatgacagctagagg

SEQ ID NO: 277618 - DNA, 20 bp, Artificial Sequence
  Description of Artificial Sequence: Synthetic oligonucleotide
  Target: ATXN1; (+) strand; PAM type: YTN; PAM sequence: CTA
atgacagctagaggatttgg

SEQ ID NO: 277619 - DNA, 20 bp, Artificial Sequence
  Description of Artificial Sequence: Synthetic oligonucleotide
  Target: ATXN1; (+) strand; PAM type: YTN; PAM sequence: CTA
gaggatttgggtgtgtattc

SEQ ID NO: 277620 - DNA, 20 bp, Artificial Sequence
  Description of Artificial Sequence: Synthetic oligonucleotide
  Target: ATXN1; (+) strand; PAM type: YTN; PAM sequence: TTT
gggtgtgtattcaattctct

SEQ ID NO: 277621 - DNA, 20 bp, Artificial Sequence
  Description of Artificial Sequence: Synthetic oligonucleotide
  Target: ATXN1; (+) strand; PAM type: YTN; PAM sequence: TTG
ggtgtgtattcaattctctg

SEQ ID NO: 277622 - DNA, 20 bp, Artificial Sequence
  Description of Artificial Sequence: Synthetic oligonucleotide
  Target: ATXN1; (+) strand; PAM type: YTN; PAM sequence: TTC
aattctctgagtctatgacc

SEQ ID NO: 277623 - DNA, 20 bp, Artificial Sequence
  Description of Artificial Sequence: Synthetic oligonucleotide
  Target: ATXN1; (+) strand; PAM type: YTN; PAM sequence: TTC
tctgagtctatgaccctaca

SEQ ID NO: 277624 - DNA, 20 bp, Artificial Sequence
  Description of Artificial Sequence: Synthetic oligonucleotide
  Target: ATXN1; (+) strand; PAM type: YTN; PAM sequence: CTC
tgagtctatgaccctacatc

SEQ ID NO: 277625 - DNA, 20 bp, Artificial Sequence
  Description of Artificial Sequence: Synthetic oligonucleotide
  Target: ATXN1; (+) strand; PAM type: YTN; PAM sequence: CTG
agtctatgaccctacatctg

SEQ ID NO: 277626 - DNA, 20 bp, Artificial Sequence
  Description of Artificial Sequence: Synthetic oligonucleotide
  Target: ATXN1; (+) strand; PAM type: YTN; PAM sequence: CTA
tgaccctacatctgggatgc

SEQ ID NO: 277627 - DNA, 20 bp, Artificial Sequence
  Description of Artificial Sequence: Synthetic oligonucleotide
  Target: ATXN1; (+) strand; PAM type: YTN; PAM sequence: CTA
catctgggatgctgtggggt

SEQ ID NO: 277628 - DNA, 20 bp, Artificial Sequence
  Description of Artificial Sequence: Synthetic oligonucleotide
  Target: ATXN1; (+) strand; PAM type: YTN; PAM sequence: CTG
ggatgctgtggggtgcttgc

SEQ ID NO: 277629 - DNA, 20 bp, Artificial Sequence
  Description of Artificial Sequence: Synthetic oligonucleotide
  Target: ATXN1; (+) strand; PAM type: YTN; PAM sequence: CTG
tggggtgcttgcaacctata

SEQ ID NO: 277630 - DNA, 20 bp, Artificial Sequence
  Description of Artificial Sequence: Synthetic oligonucleotide
  Target: ATXN1; (+) strand; PAM type: YTN; PAM sequence: CTT
gcaacctatagacagcaggt

SEQ ID NO: 277631 - DNA, 20 bp, Artificial Sequence
  Description of Artificial Sequence: Synthetic oligonucleotide
  Target: ATXN1; (+) strand; PAM type: YTN; PAM sequence: TTG
caacctatagacagcaggtg

SEQ ID NO: 277632 - DNA, 20 bp, Artificial Sequence
  Description of Artificial Sequence: Synthetic oligonucleotide
  Target: ATXN1; (+) strand; PAM type: YTN; PAM sequence: CTA
tagacagcaggtgttttcca

SEQ ID NO: 277633 - DNA, 20 bp, Artificial Sequence
  Description of Artificial Sequence: Synthetic oligonucleotide
  Target: ATXN1; (+) strand; PAM type: YTN; PAM sequence: TTT
tccaggcgcgttggcgtgtt

SEQ ID NO: 277634 - DNA, 20 bp, Artificial Sequence
  Description of Artificial Sequence: Synthetic oligonucleotide
  Target: ATXN1; (+) strand; PAM type: YTN; PAM sequence: TTT
ccaggcgcgttggcgtgtta

SEQ ID NO: 277635 - DNA, 20 bp, Artificial Sequence
  Description of Artificial Sequence: Synthetic oligonucleotide
  Target: ATXN1; (+) strand; PAM type: YTN; PAM sequence: TTC
caggcgcgttggcgtgttat

SEQ ID NO: 277636 - DNA, 20 bp, Artificial Sequence
  Description of Artificial Sequence: Synthetic oligonucleotide
  Target: ATXN1; (+) strand; PAM type: YTN; PAM sequence: TTG
gcgtgttatggcactgggat

SEQ ID NO: 277637 - DNA, 20 bp, Artificial Sequence
  Description of Artificial Sequence: Synthetic oligonucleotide
  Target: ATXN1; (+) strand; PAM type: YTN; PAM sequence: TTA
tggcactgggattcaagtga

SEQ ID NO: 277638 - DNA, 20 bp, Artificial Sequence
  Description of Artificial Sequence: Synthetic oligonucleotide
  Target: ATXN1; (+) strand; PAM type: YTN; PAM sequence: CTG
ggattcaagtgaggatgaac

SEQ ID NO: 277639 - DNA, 20 bp, Artificial Sequence
  Description of Artificial Sequence: Synthetic oligonucleotide
  Target: ATXN1; (+) strand; PAM type: YTN; PAM sequence: TTC
aagtgaggatgaacatctaa

SEQ ID NO: 277640 - DNA, 20 bp, Artificial Sequence
  Description of Artificial Sequence: Synthetic oligonucleotide
  Target: ATXN1; (+) strand; PAM type: YTN; PAM sequence: CTA
agatgagagctggagtgagc

SEQ ID NO: 277641 - DNA, 20 bp, Artificial Sequence
  Description of Artificial Sequence: Synthetic oligonucleotide
  Target: ATXN1; (+) strand; PAM type: YTN; PAM sequence: CTG
gagtgagccacgatttgtaa

SEQ ID NO: 277642 - DNA, 20 bp, Artificial Sequence
  Description of Artificial Sequence: Synthetic oligonucleotide
  Target: ATXN1; (+) strand; PAM type: YTN; PAM sequence: TTT
gtaaccatgcagatgtgagc

SEQ ID NO: 277643 - DNA, 20 bp, Artificial Sequence
  Description of Artificial Sequence: Synthetic oligonucleotide
  Target: ATXN1; (+) strand; PAM type: YTN; PAM sequence: TTG
taaccatgcagatgtgagca

SEQ ID NO: 277644 - DNA, 20 bp, Artificial Sequence
  Description of Artificial Sequence: Synthetic oligonucleotide
  Target: ATXN1; (+) strand; PAM type: YTN; PAM sequence: CTT
tcctccttgcctgcagcttg

SEQ ID NO: 277645 - DNA, 20 bp, Artificial Sequence
  Description of Artificial Sequence: Synthetic oligonucleotide
  Target: ATXN1; (+) strand; PAM type: YTN; PAM sequence: TTT
cctccttgcctgcagcttgc

SEQ ID NO: 277646 - DNA, 20 bp, Artificial Sequence
  Description of Artificial Sequence: Synthetic oligonucleotide
  Target: ATXN1; (+) strand; PAM type: YTN; PAM sequence: TTC
ctccttgcctgcagcttgca

SEQ ID NO: 277647 - DNA, 20 bp, Artificial Sequence
  Description of Artificial Sequence: Synthetic oligonucleotide
  Target: ATXN1; (+) strand; PAM type: YTN; PAM sequence: CTC
cttgcctgcagcttgcatct

SEQ ID NO: 277648 - DNA, 20 bp, Artificial Sequence
  Description of Artificial Sequence: Synthetic oligonucleotide
  Target: ATXN1; (+) strand; PAM type: YTN; PAM sequence: CTT
gcctgcagcttgcatctgag

SEQ ID NO: 277649 - DNA, 20 bp, Artificial Sequence
  Description of Artificial Sequence: Synthetic oligonucleotide
  Target: ATXN1; (+) strand; PAM type: YTN; PAM sequence: TTG
cctgcagcttgcatctgaga

SEQ ID NO: 277650 - DNA, 20 bp, Artificial Sequence
  Description of Artificial Sequence: Synthetic oligonucleotide
  Target: ATXN1; (+) strand; PAM type: YTN; PAM sequence: CTG
cagcttgcatctgagatcct

SEQ ID NO: 277651 - DNA, 20 bp, Artificial Sequence
  Description of Artificial Sequence: Synthetic oligonucleotide
  Target: ATXN1; (+) strand; PAM type: YTN; PAM sequence: CTT
gcatctgagatcctaataag

SEQ ID NO: 277652 - DNA, 20 bp, Artificial Sequence
  Description of Artificial Sequence: Synthetic oligonucleotide
  Target: ATXN1; (+) strand; PAM type: YTN; PAM sequence: TTG
catctgagatcctaataagg

SEQ ID NO: 277653 - DNA, 20 bp, Artificial Sequence
  Description of Artificial Sequence: Synthetic oligonucleotide
  Target: ATXN1; (+) strand; PAM type: YTN; PAM sequence: CTG
agatcctaataagggaggat

SEQ ID NO: 277654 - DNA, 20 bp, Artificial Sequence
  Description of Artificial Sequence: Synthetic oligonucleotide
  Target: ATXN1; (+) strand; PAM type: YTN; PAM sequence: CTA
ataagggaggatcactggaa

SEQ ID NO: 277655 - DNA, 20 bp, Artificial Sequence
  Description of Artificial Sequence: Synthetic oligonucleotide
  Target: ATXN1; (+) strand; PAM type: YTN; PAM sequence: CTG
gaaagtattaccattatttt

SEQ ID NO: 277656 - DNA, 20 bp, Artificial Sequence
  Description of Artificial Sequence: Synthetic oligonucleotide
  Target: ATXN1; (+) strand; PAM type: YTN; PAM sequence: TTA
ccattatttttagcttttct

SEQ ID NO: 277657 - DNA, 20 bp, Artificial Sequence
  Description of Artificial Sequence: Synthetic oligonucleotide
  Target: ATXN1; (+) strand; PAM type: YTN; PAM sequence: TTA
tttttagcttttctaaggga

SEQ ID NO: 277658 - DNA, 20 bp, Artificial Sequence
  Description of Artificial Sequence: Synthetic oligonucleotide
  Target: ATXN1; (+) strand; PAM type: YTN; PAM sequence: TTT
ttagcttttctaagggaggg

SEQ ID NO: 277659 - DNA, 20 bp, Artificial Sequence
  Description of Artificial Sequence: Synthetic oligonucleotide
  Target: ATXN1; (+) strand; PAM type: YTN; PAM sequence: TTT
tagcttttctaagggaggga

SEQ ID NO: 277660 - DNA, 20 bp, Artificial Sequence
  Description of Artificial Sequence: Synthetic oligonucleotide
  Target: ATXN1; (+) strand; PAM type: YTN; PAM sequence: TTT
agcttttctaagggagggag

SEQ ID NO: 277661 - DNA, 20 bp, Artificial Sequence
  Description of Artificial Sequence: Synthetic oligonucleotide
  Target: ATXN1; (+) strand; PAM type: YTN; PAM sequence: TTA
gcttttctaagggagggagg

SEQ ID NO: 277662 - DNA, 20 bp, Artificial Sequence
  Description of Artificial Sequence: Synthetic oligonucleotide
  Target: ATXN1; (+) strand; PAM type: YTN; PAM sequence: CTT
ttctaagggagggaggagtt

SEQ ID NO: 277663 - DNA, 20 bp, Artificial Sequence
  Description of Artificial Sequence: Synthetic oligonucleotide
  Target: ATXN1; (+) strand; PAM type: YTN; PAM sequence: TTT
tctaagggagggaggagttt

SEQ ID NO: 277664 - DNA, 20 bp, Artificial Sequence
  Description of Artificial Sequence: Synthetic oligonucleotide
  Target: ATXN1; (+) strand; PAM type: YTN; PAM sequence: TTT
ctaagggagggaggagtttt

SEQ ID NO: 277665 - DNA, 20 bp, Artificial Sequence
  Description of Artificial Sequence: Synthetic oligonucleotide
  Target: ATXN1; (+) strand; PAM type: YTN; PAM sequence: TTC
taagggagggaggagttttc

SEQ ID NO: 277666 - DNA, 20 bp, Artificial Sequence
  Description of Artificial Sequence: Synthetic oligonucleotide
  Target: ATXN1; (+) strand; PAM type: YTN; PAM sequence: CTA
agggagggaggagttttcga

SEQ ID NO: 277667 - DNA, 20 bp, Artificial Sequence
  Description of Artificial Sequence: Synthetic oligonucleotide
  Target: ATXN1; (+) strand; PAM type: YTN; PAM sequence: TTT
tcgaaaggacaaaatggaaa

SEQ ID NO: 277668 - DNA, 20 bp, Artificial Sequence
  Description of Artificial Sequence: Synthetic oligonucleotide
  Target: ATXN1; (+) strand; PAM type: YTN; PAM sequence: TTT
cgaaaggacaaaatggaaag

SEQ ID NO: 277669 - DNA, 20 bp, Artificial Sequence
  Description of Artificial Sequence: Synthetic oligonucleotide
  Target: ATXN1; (+) strand; PAM type: YTN; PAM sequence: TTC
gaaaggacaaaatggaaagg

SEQ ID NO: 277670 - DNA, 20 bp, Artificial Sequence
  Description of Artificial Sequence: Synthetic oligonucleotide
  Target: ATXN1; (+) strand; PAM type: YTN; PAM sequence: TTT
agggcaagggtgtgtgtagg

SEQ ID NO: 277671 - DNA, 20 bp, Artificial Sequence
  Description of Artificial Sequence: Synthetic oligonucleotide
  Target: ATXN1; (+) strand; PAM type: YTN; PAM sequence: TTA
gggcaagggtgtgtgtaggt

SEQ ID NO: 277672 - DNA, 20 bp, Artificial Sequence
  Description of Artificial Sequence: Synthetic oligonucleotide
  Target: ATXN1; (+) strand; PAM type: YTN; PAM sequence: CTT
tcaggacagataagcagctt

SEQ ID NO: 277673 - DNA, 20 bp, Artificial Sequence
  Description of Artificial Sequence: Synthetic oligonucleotide
  Target: ATXN1; (+) strand; PAM type: YTN; PAM sequence: TTT
caggacagataagcagcttc

SEQ ID NO: 277674 - DNA, 20 bp, Artificial Sequence
  Description of Artificial Sequence: Synthetic oligonucleotide
  Target: ATXN1; (+) strand; PAM type: YTN; PAM sequence: TTC
aggacagataagcagcttcc

SEQ ID NO: 277675 - DNA, 20 bp, Artificial Sequence
  Description of Artificial Sequence: Synthetic oligonucleotide
  Target: ATXN1; (+) strand; PAM type: YTN; PAM sequence: CTT
ccttctccttccttaataga

SEQ ID NO: 277676 - DNA, 20 bp, Artificial Sequence
  Description of Artificial Sequence: Synthetic oligonucleotide
  Target: ATXN1; (+) strand; PAM type: YTN; PAM sequence: TTC
cttctccttccttaatagat

SEQ ID NO: 277677 - DNA, 20 bp, Artificial Sequence
  Description of Artificial Sequence: Synthetic oligonucleotide
  Target: ATXN1; (+) strand; PAM type: YTN; PAM sequence: CTT
ctccttccttaatagatgat

SEQ ID NO: 277678 - DNA, 20 bp, Artificial Sequence
  Description of Artificial Sequence: Synthetic oligonucleotide
  Target: ATXN1; (+) strand; PAM type: YTN; PAM sequence: TTC
tccttccttaatagatgatc

SEQ ID NO: 277679 - DNA, 20 bp, Artificial Sequence
  Description of Artificial Sequence: Synthetic oligonucleotide
  Target: ATXN1; (+) strand; PAM type: YTN; PAM sequence: CTC
cttccttaatagatgatcac

SEQ ID NO: 277680 - DNA, 20 bp, Artificial Sequence
  Description of Artificial Sequence: Synthetic oligonucleotide
  Target: ATXN1; (+) strand; PAM type: YTN; PAM sequence: CTT
ccttaatagatgatcacagc

SEQ ID NO: 277681 - DNA, 20 bp, Artificial Sequence
  Description of Artificial Sequence: Synthetic oligonucleotide
  Target: ATXN1; (+) strand; PAM type: YTN; PAM sequence: TTC
cttaatagatgatcacagcc

SEQ ID NO: 277682 - DNA, 20 bp, Artificial Sequence
  Description of Artificial Sequence: Synthetic oligonucleotide
  Target: ATXN1; (+) strand; PAM type: YTN; PAM sequence: CTT
aatagatgatcacagccagg

SEQ ID NO: 277683 - DNA, 20 bp, Artificial Sequence
  Description of Artificial Sequence: Synthetic oligonucleotide
  Target: ATXN1; (+) strand; PAM type: YTN; PAM sequence: TTA
atagatgatcacagccaggc

SEQ ID NO: 277684 - DNA, 20 bp, Artificial Sequence
  Description of Artificial Sequence: Synthetic oligonucleotide
  Target: ATXN1; (+) strand; PAM type: YTN; PAM sequence: CTT
ccagggttataaaacaacac

SEQ ID NO: 277685 - DNA, 20 bp, Artificial Sequence
  Description of Artificial Sequence: Synthetic oligonucleotide
  Target: ATXN1; (+) strand; PAM type: YTN; PAM sequence: TTC
cagggttataaaacaacacc

SEQ ID NO: 277686 - DNA, 20 bp, Artificial Sequence
  Description of Artificial Sequence: Synthetic oligonucleotide
  Target: ATXN1; (+) strand; PAM type: YTN; PAM sequence: TTA
taaaacaacaccaaggtctt

SEQ ID NO: 277687 - DNA, 20 bp, Artificial Sequence
  Description of Artificial Sequence: Synthetic oligonucleotide
  Target: ATXN1; (+) strand; PAM type: YTN; PAM sequence: CTT
caggtccaggtatgtagaga

SEQ ID NO: 277688 - DNA, 20 bp, Artificial Sequence
  Description of Artificial Sequence: Synthetic oligonucleotide
  Target: ATXN1; (+) strand; PAM type: YTN; PAM sequence: TTC
aggtccaggtatgtagagac

SEQ ID NO: 277689 - DNA, 20 bp, Artificial Sequence
  Description of Artificial Sequence: Synthetic oligonucleotide
  Target: ATXN1; (+) strand; PAM type: YTN; PAM sequence: CTT
cgcaaggaaaccatttttct

SEQ ID NO: 277690 - DNA, 20 bp, Artificial Sequence
  Description of Artificial Sequence: Synthetic oligonucleotide
  Target: ATXN1; (+) strand; PAM type: YTN; PAM sequence: TTC
gcaaggaaaccatttttcta

SEQ ID NO: 277691 - DNA, 20 bp, Artificial Sequence
  Description of Artificial Sequence: Synthetic oligonucleotide
  Target: ATXN1; (+) strand; PAM type: YTN; PAM sequence: TTT
ttctaagagcatggcaaata

SEQ ID NO: 277692 - DNA, 20 bp, Artificial Sequence
  Description of Artificial Sequence: Synthetic oligonucleotide
  Target: ATXN1; (+) strand; PAM type: YTN; PAM sequence: TTT
tctaagagcatggcaaatac

SEQ ID NO: 277693 - DNA, 20 bp, Artificial Sequence
  Description of Artificial Sequence: Synthetic oligonucleotide
  Target: ATXN1; (+) strand; PAM type: YTN; PAM sequence: TTT
ctaagagcatggcaaatacg

SEQ ID NO: 277694 - DNA, 20 bp, Artificial Sequence
  Description of Artificial Sequence: Synthetic oligonucleotide
  Target: ATXN1; (+) strand; PAM type: YTN; PAM sequence: TTC
taagagcatggcaaatacgc

SEQ ID NO: 277695 - DNA, 20 bp, Artificial Sequence
  Description of Artificial Sequence: Synthetic oligonucleotide
  Target: ATXN1; (+) strand; PAM type: YTN; PAM sequence: CTA
agagcatggcaaatacgcat

SEQ ID NO: 277696 - DNA, 20 bp, Artificial Sequence
  Description of Artificial Sequence: Synthetic oligonucleotide
  Target: ATXN1; (+) strand; PAM type: YTN; PAM sequence: TTC
catgttgtgggatttttttt

SEQ ID NO: 277697 - DNA, 20 bp, Artificial Sequence
  Description of Artificial Sequence: Synthetic oligonucleotide
  Target: ATXN1; (+) strand; PAM type: YTN; PAM sequence: TTG
tgggattttttttcaacttc

SEQ ID NO: 277698 - DNA, 20 bp, Artificial Sequence
  Description of Artificial Sequence: Synthetic oligonucleotide
  Target: ATXN1; (+) strand; PAM type: YTN; PAM sequence: TTT
tttttcaacttcctttcttg

SEQ ID NO: 277699 - DNA, 20 bp, Artificial Sequence
  Description of Artificial Sequence: Synthetic oligonucleotide
  Target: ATXN1; (+) strand; PAM type: YTN; PAM sequence: TTT
ttttcaacttcctttcttga

SEQ ID NO: 277700 - DNA, 20 bp, Artificial Sequence
  Description of Artificial Sequence: Synthetic oligonucleotide
  Target: ATXN1; (+) strand; PAM type: YTN; PAM sequence: TTT
tttcaacttcctttcttgaa

SEQ ID NO: 277701 - DNA, 20 bp, Artificial Sequence
  Description of Artificial Sequence: Synthetic oligonucleotide
  Target: ATXN1; (+) strand; PAM type: YTN; PAM sequence: TTT
ttcaacttcctttcttgaaa

SEQ ID NO: 277702 - DNA, 20 bp, Artificial Sequence
  Description of Artificial Sequence: Synthetic oligonucleotide
  Target: ATXN1; (+) strand; PAM type: YTN; PAM sequence: TTT
tcaacttcctttcttgaaac

SEQ ID NO: 277703 - DNA, 20 bp, Artificial Sequence
  Description of Artificial Sequence: Synthetic oligonucleotide
  Target: ATXN1; (+) strand; PAM type: YTN; PAM sequence: TTT
caacttcctttcttgaaaca

SEQ ID NO: 277704 - DNA, 20 bp, Artificial Sequence
  Description of Artificial Sequence: Synthetic oligonucleotide
  Target: ATXN1; (+) strand; PAM type: YTN; PAM sequence: TTC
aacttcctttcttgaaacat

SEQ ID NO: 277705 - DNA, 20 bp, Artificial Sequence
  Description of Artificial Sequence: Synthetic oligonucleotide
  Target: ATXN1; (+) strand; PAM type: YTN; PAM sequence: CTT
cctttcttgaaacatagctg

SEQ ID NO: 277706 - DNA, 20 bp, Artificial Sequence
  Description of Artificial Sequence: Synthetic oligonucleotide
  Target: ATXN1; (+) strand; PAM type: YTN; PAM sequence: TTC
ctttcttgaaacatagctga

SEQ ID NO: 277707 - DNA, 20 bp, Artificial Sequence
  Description of Artificial Sequence: Synthetic oligonucleotide
  Target: ATXN1; (+) strand; PAM type: YTN; PAM sequence: CTT
tcttgaaacatagctgatga

SEQ ID NO: 277708 - DNA, 20 bp, Artificial Sequence
  Description of Artificial Sequence: Synthetic oligonucleotide
  Target: ATXN1; (+) strand; PAM type: YTN; PAM sequence: TTT
cttgaaacatagctgatgag

SEQ ID NO: 277709 - DNA, 20 bp, Artificial Sequence
  Description of Artificial Sequence: Synthetic oligonucleotide
  Target: ATXN1; (+) strand; PAM type: YTN; PAM sequence: TTC
ttgaaacatagctgatgagg

SEQ ID NO: 277710 - DNA, 20 bp, Artificial Sequence
  Description of Artificial Sequence: Synthetic oligonucleotide
  Target: ATXN1; (+) strand; PAM type: YTN; PAM sequence: CTT
gaaacatagctgatgaggcc

SEQ ID NO: 277711 - DNA, 20 bp, Artificial Sequence
  Description of Artificial Sequence: Synthetic oligonucleotide
  Target: ATXN1; (+) strand; PAM type: YTN; PAM sequence: TTG
aaacatagctgatgaggcca

SEQ ID NO: 277712 - DNA, 20 bp, Artificial Sequence
  Description of Artificial Sequence: Synthetic oligonucleotide
  Target: ATXN1; (+) strand; PAM type: YTN; PAM sequence: CTG
atgaggccactaatagaagc

SEQ ID NO: 277713 - DNA, 20 bp, Artificial Sequence
  Description of Artificial Sequence: Synthetic oligonucleotide
  Target: ATXN1; (+) strand; PAM type: YTN; PAM sequence: CTA
atagaagcttcttggaaaag

SEQ ID NO: 277714 - DNA, 20 bp, Artificial Sequence
  Description of Artificial Sequence: Synthetic oligonucleotide
  Target: ATXN1; (+) strand; PAM type: YTN; PAM sequence: CTT
cttggaaaagagtttcataa

SEQ ID NO: 277715 - DNA, 20 bp, Artificial Sequence
  Description of Artificial Sequence: Synthetic oligonucleotide
  Target: ATXN1; (+) strand; PAM type: YTN; PAM sequence: TTC
ttggaaaagagtttcataat

SEQ ID NO: 277716 - DNA, 20 bp, Artificial Sequence
  Description of Artificial Sequence: Synthetic oligonucleotide
  Target: ATXN1; (+) strand; PAM type: YTN; PAM sequence: CTT
ggaaaagagtttcataattc

SEQ ID NO: 277717 - DNA, 20 bp, Artificial Sequence
  Description of Artificial Sequence: Synthetic oligonucleotide
  Target: ATXN1; (+) strand; PAM type: YTN; PAM sequence: TTG
gaaaagagtttcataattca

SEQ ID NO: 277718 - DNA, 20 bp, Artificial Sequence
  Description of Artificial Sequence: Synthetic oligonucleotide
  Target: ATXN1; (+) strand; PAM type: YTN; PAM sequence: TTT
cataattcacgtttgatttg

SEQ ID NO: 277719 - DNA, 20 bp, Artificial Sequence
  Description of Artificial Sequence: Synthetic oligonucleotide
  Target: ATXN1; (+) strand; PAM type: YTN; PAM sequence: TTC
ataattcacgtttgatttga

SEQ ID NO: 277720 - DNA, 20 bp, Artificial Sequence
  Description of Artificial Sequence: Synthetic oligonucleotide
  Target: ATXN1; (+) strand; PAM type: YTN; PAM sequence: TTC
acgtttgatttgaaggcagc

SEQ ID NO: 277721 - DNA, 20 bp, Artificial Sequence
  Description of Artificial Sequence: Synthetic oligonucleotide
  Target: ATXN1; (+) strand; PAM type: YTN; PAM sequence: TTT
gatttgaaggcagctttaac

SEQ ID NO: 277722 - DNA, 20 bp, Artificial Sequence
  Description of Artificial Sequence: Synthetic oligonucleotide
  Target: ATXN1; (+) strand; PAM type: YTN; PAM sequence: TTG
atttgaaggcagctttaact

SEQ ID NO: 277723 - DNA, 20 bp, Artificial Sequence
  Description of Artificial Sequence: Synthetic oligonucleotide
  Target: ATXN1; (+) strand; PAM type: YTN; PAM sequence: TTT
gaaggcagctttaactttct

SEQ ID NO: 277724 - DNA, 20 bp, Artificial Sequence
  Description of Artificial Sequence: Synthetic oligonucleotide
  Target: ATXN1; (+) strand; PAM type: YTN; PAM sequence: TTG
aaggcagctttaactttctt

SEQ ID NO: 277725 - DNA, 20 bp, Artificial Sequence
  Description of Artificial Sequence: Synthetic oligonucleotide
  Target: ATXN1; (+) strand; PAM type: YTN; PAM sequence: CTT
taactttcttattacccccc

SEQ ID NO: 277726 - DNA, 20 bp, Artificial Sequence
  Description of Artificial Sequence: Synthetic oligonucleotide
  Target: ATXN1; (+) strand; PAM type: YTN; PAM sequence: TTT
aactttcttattacccccca

SEQ ID NO: 277727 - DNA, 20 bp, Artificial Sequence
  Description of Artificial Sequence: Synthetic oligonucleotide
  Target: ATXN1; (+) strand; PAM type: YTN; PAM sequence: TTA
actttcttattaccccccaa

SEQ ID NO: 277728 - DNA, 20 bp, Artificial Sequence
  Description of Artificial Sequence: Synthetic oligonucleotide
  Target: ATXN1; (+) strand; PAM type: YTN; PAM sequence: CTT
tcttattaccccccaaaatg

SEQ ID NO: 277729 - DNA, 20 bp, Artificial Sequence
  Description of Artificial Sequence: Synthetic oligonucleotide
  Target: ATXN1; (+) strand; PAM type: YTN; PAM sequence: TTT
cttattaccccccaaaatgt

SEQ ID NO: 277730 - DNA, 20 bp, Artificial Sequence
  Description of Artificial Sequence: Synthetic oligonucleotide
  Target: ATXN1; (+) strand; PAM type: YTN; PAM sequence: TTC
ttattaccccccaaaatgtc

SEQ ID NO: 277731 - DNA, 20 bp, Artificial Sequence
  Description of Artificial Sequence: Synthetic oligonucleotide
  Target: ATXN1; (+) strand; PAM type: YTN; PAM sequence: CTT
attaccccccaaaatgtcct

SEQ ID NO: 277732 - DNA, 20 bp, Artificial Sequence
  Description of Artificial Sequence: Synthetic oligonucleotide
  Target: ATXN1; (+) strand; PAM type: YTN; PAM sequence: TTA
ttaccccccaaaatgtcctc

SEQ ID NO: 277733 - DNA, 20 bp, Artificial Sequence
  Description of Artificial Sequence: Synthetic oligonucleotide
  Target: ATXN1; (+) strand; PAM type: YTN; PAM sequence: TTA
ccccccaaaatgtcctcttt

SEQ ID NO: 277734 - DNA, 20 bp, Artificial Sequence
  Description of Artificial Sequence: Synthetic oligonucleotide
  Target: ATXN1; (+) strand; PAM type: YTN; PAM sequence: CTC
tttggtcttacagcgatcat

SEQ ID NO: 277735 - DNA, 20 bp, Artificial Sequence
  Description of Artificial Sequence: Synthetic oligonucleotide
  Target: ATXN1; (+) strand; PAM type: YTN; PAM sequence: CTT
tggtcttacagcgatcatga

SEQ ID NO: 277736 - DNA, 20 bp, Artificial Sequence
  Description of Artificial Sequence: Synthetic oligonucleotide
  Target: ATXN1; (+) strand; PAM type: YTN; PAM sequence: TTT
ggtcttacagcgatcatgaa

SEQ ID NO: 277737 - DNA, 20 bp, Artificial Sequence
  Description of Artificial Sequence: Synthetic oligonucleotide
  Target: ATXN1; (+) strand; PAM type: YTN; PAM sequence: TTG
gtcttacagcgatcatgaat

SEQ ID NO: 277738 - DNA, 20 bp, Artificial Sequence
  Description of Artificial Sequence: Synthetic oligonucleotide
  Target: ATXN1; (+) strand; PAM type: YTN; PAM sequence: CTT
acagcgatcatgaatgttcc

SEQ ID NO: 277739 - DNA, 20 bp, Artificial Sequence
  Description of Artificial Sequence: Synthetic oligonucleotide
  Target: ATXN1; (+) strand; PAM type: YTN; PAM sequence: TTA
cagcgatcatgaatgttcca

SEQ ID NO: 277740 - DNA, 20 bp, Artificial Sequence
  Description of Artificial Sequence: Synthetic oligonucleotide
  Target: ATXN1; (+) strand; PAM type: YTN; PAM sequence: TTC
cagattaataggagatgaat

SEQ ID NO: 277741 - DNA, 20 bp, Artificial Sequence
  Description of Artificial Sequence: Synthetic oligonucleotide
  Target: ATXN1; (+) strand; PAM type: YTN; PAM sequence: TTA
ataggagatgaatgaattct

SEQ ID NO: 277742 - DNA, 20 bp, Artificial Sequence
  Description of Artificial Sequence: Synthetic oligonucleotide
  Target: ATXN1; (+) strand; PAM type: YTN; PAM sequence: TTC
tccttaaatgaccttaatat

SEQ ID NO: 277743 - DNA, 20 bp, Artificial Sequence
  Description of Artificial Sequence: Synthetic oligonucleotide
  Target: ATXN1; (+) strand; PAM type: YTN; PAM sequence: CTC
cttaaatgaccttaatatgt

SEQ ID NO: 277744 - DNA, 20 bp, Artificial Sequence
  Description of Artificial Sequence: Synthetic oligonucleotide
  Target: ATXN1; (+) strand; PAM type: YTN; PAM sequence: CTT
aaatgaccttaatatgttca

SEQ ID NO: 277745 - DNA, 20 bp, Artificial Sequence
  Description of Artificial Sequence: Synthetic oligonucleotide
  Target: ATXN1; (+) strand; PAM type: YTN; PAM sequence: TTA
aatgaccttaatatgttcaa

SEQ ID NO: 277746 - DNA, 20 bp, Artificial Sequence
  Description of Artificial Sequence: Synthetic oligonucleotide
  Target: ATXN1; (+) strand; PAM type: YTN; PAM sequence: CTT
aatatgttcaagtagcaaag

SEQ ID NO: 277747 - DNA, 20 bp, Artificial Sequence
  Description of Artificial Sequence: Synthetic oligonucleotide
  Target: ATXN1; (+) strand; PAM type: YTN; PAM sequence: TTA
atatgttcaagtagcaaagt

SEQ ID NO: 277748 - DNA, 20 bp, Artificial Sequence
  Description of Artificial Sequence: Synthetic oligonucleotide
  Target: ATXN1; (+) strand; PAM type: YTN; PAM sequence: TTC
aagtagcaaagtggaggttt

SEQ ID NO: 277749 - DNA, 20 bp, Artificial Sequence
  Description of Artificial Sequence: Synthetic oligonucleotide
  Target: ATXN1; (+) strand; PAM type: YTN; PAM sequence: TTT
gagtccagtgacttctgggg

SEQ ID NO: 277750 - DNA, 20 bp, Artificial Sequence
  Description of Artificial Sequence: Synthetic oligonucleotide
  Target: ATXN1; (+) strand; PAM type: YTN; PAM sequence: TTG
agtccagtgacttctgggga

SEQ ID NO: 277751 - DNA, 20 bp, Artificial Sequence
  Description of Artificial Sequence: Synthetic oligonucleotide
  Target: ATXN1; (+) strand; PAM type: YTN; PAM sequence: CTT
ctggggagacagttgtatgg

SEQ ID NO: 277752 - DNA, 20 bp, Artificial Sequence
  Description of Artificial Sequence: Synthetic oligonucleotide
  Target: ATXN1; (+) strand; PAM type: YTN; PAM sequence: TTC
tggggagacagttgtatggg

SEQ ID NO: 277753 - DNA, 20 bp, Artificial Sequence
  Description of Artificial Sequence: Synthetic oligonucleotide
  Target: ATXN1; (+) strand; PAM type: YTN; PAM sequence: CTG
gggagacagttgtatgggct

SEQ ID NO: 277754 - DNA, 20 bp, Artificial Sequence
  Description of Artificial Sequence: Synthetic oligonucleotide
  Target: ATXN1; (+) strand; PAM type: YTN; PAM sequence: TTG
tatgggctaagaacacataa

SEQ ID NO: 277755 - DNA, 20 bp, Artificial Sequence
  Description of Artificial Sequence: Synthetic oligonucleotide
  Target: ATXN1; (+) strand; PAM type: YTN; PAM sequence: CTA
agaacacataacattttgag

SEQ ID NO: 277756 - DNA, 20 bp, Artificial Sequence
  Description of Artificial Sequence: Synthetic oligonucleotide
  Target: ATXN1; (+) strand; PAM type: YTN; PAM sequence: TTT
tgaggaaggatttcttgtct

SEQ ID NO: 277757 - DNA, 20 bp, Artificial Sequence
  Description of Artificial Sequence: Synthetic oligonucleotide
  Target: ATXN1; (+) strand; PAM type: YTN; PAM sequence: TTT
gaggaaggatttcttgtctt

SEQ ID NO: 277758 - DNA, 20 bp, Artificial Sequence
  Description of Artificial Sequence: Synthetic oligonucleotide
  Target: ATXN1; (+) strand; PAM type: YTN; PAM sequence: TTG
aggaaggatttcttgtcttt

SEQ ID NO: 277759 - DNA, 20 bp, Artificial Sequence
  Description of Artificial Sequence: Synthetic oligonucleotide
  Target: ATXN1; (+) strand; PAM type: YTN; PAM sequence: TTT
cttgtcttttttttttttgg

SEQ ID NO: 277760 - DNA, 20 bp, Artificial Sequence
  Description of Artificial Sequence: Synthetic oligonucleotide
  Target: ATXN1; (+) strand; PAM type: YTN; PAM sequence: TTC
ttgtcttttttttttttggc

SEQ ID NO: 277761 - DNA, 20 bp, Artificial Sequence
  Description of Artificial Sequence: Synthetic oligonucleotide
  Target: ATXN1; (+) strand; PAM type: YTN; PAM sequence: CTT
gtcttttttttttttggcaa

SEQ ID NO: 277762 - DNA, 20 bp, Artificial Sequence
  Description of Artificial Sequence: Synthetic oligonucleotide
  Target: ATXN1; (+) strand; PAM type: YTN; PAM sequence: TTG
tcttttttttttttggcaat

SEQ ID NO: 277763 - DNA, 20 bp, Artificial Sequence
  Description of Artificial Sequence: Synthetic oligonucleotide
  Target: ATXN1; (+) strand; PAM type: YTN; PAM sequence: CTT
ttttttttttggcaatagaa

SEQ ID NO: 277764 - DNA, 20 bp, Artificial Sequence
  Description of Artificial Sequence: Synthetic oligonucleotide
  Target: ATXN1; (+) strand; PAM type: YTN; PAM sequence: TTT
tttttttttggcaatagaaa

SEQ ID NO: 277765 - DNA, 20 bp, Artificial Sequence
  Description of Artificial Sequence: Synthetic oligonucleotide
  Target: ATXN1; (+) strand; PAM type: YTN; PAM sequence: TTT
ttttttttggcaatagaaag

SEQ ID NO: 277766 - DNA, 20 bp, Artificial Sequence
  Description of Artificial Sequence: Synthetic oligonucleotide
  Target: ATXN1; (+) strand; PAM type: YTN; PAM sequence: TTT
tttttttggcaatagaaagt

SEQ ID NO: 277767 - DNA, 20 bp, Artificial Sequence
  Description of Artificial Sequence: Synthetic oligonucleotide
  Target: ATXN1; (+) strand; PAM type: YTN; PAM sequence: TTT
ttttttggcaatagaaagta

SEQ ID NO: 277768 - DNA, 20 bp, Artificial Sequence
  Description of Artificial Sequence: Synthetic oligonucleotide
  Target: ATXN1; (+) strand; PAM type: YTN; PAM sequence: TTT
tttttggcaatagaaagtaa

SEQ ID NO: 277769 - DNA, 20 bp, Artificial Sequence
  Description of Artificial Sequence: Synthetic oligonucleotide
  Target: ATXN1; (+) strand; PAM type: YTN; PAM sequence: TTT
ttttggcaatagaaagtaaa

SEQ ID NO: 277770 - DNA, 20 bp, Artificial Sequence
  Description of Artificial Sequence: Synthetic oligonucleotide
  Target: ATXN1; (+) strand; PAM type: YTN; PAM sequence: TTT
tttggcaatagaaagtaaaa

SEQ ID NO: 277771 - DNA, 20 bp, Artificial Sequence
  Description of Artificial Sequence: Synthetic oligonucleotide
  Target: ATXN1; (+) strand; PAM type: YTN; PAM sequence: TTT
ttggcaatagaaagtaaaaa

SEQ ID NO: 277772 - DNA, 20 bp, Artificial Sequence
  Description of Artificial Sequence: Synthetic oligonucleotide
  Target: ATXN1; (+) strand; PAM type: YTN; PAM sequence: TTT
tggcaatagaaagtaaaaag

SEQ ID NO: 277773 - DNA, 20 bp, Artificial Sequence
  Description of Artificial Sequence: Synthetic oligonucleotide
  Target: ATXN1; (+) strand; PAM type: YTN; PAM sequence: TTT
ggcaatagaaagtaaaaagt

SEQ ID NO: 277774 - DNA, 20 bp, Artificial Sequence
  Description of Artificial Sequence: Synthetic oligonucleotide
  Target: ATXN1; (+) strand; PAM type: YTN; PAM sequence: TTG
gcaatagaaagtaaaaagtt

SEQ ID NO: 277775 - DNA, 20 bp, Artificial Sequence
  Description of Artificial Sequence: Synthetic oligonucleotide
  Target: ATXN1; (+) strand; PAM type: YTN; PAM sequence: TTT
cctgagctgaaaaggccaca

SEQ ID NO: 277776 - DNA, 20 bp, Artificial Sequence
  Description of Artificial Sequence: Synthetic oligonucleotide
  Target: ATXN1; (+) strand; PAM type: YTN; PAM sequence: TTC
ctgagctgaaaaggccacag

SEQ ID NO: 277777 - DNA, 20 bp, Artificial Sequence
  Description of Artificial Sequence: Synthetic oligonucleotide
  Target: ATXN1; (+) strand; PAM type: YTN; PAM sequence: CTG
agctgaaaaggccacagcat

SEQ ID NO: 277778 - DNA, 20 bp, Artificial Sequence
  Description of Artificial Sequence: Synthetic oligonucleotide
  Target: ATXN1; (+) strand; PAM type: YTN; PAM sequence: CTG
aaaaggccacagcatgtatt

SEQ ID NO: 277779 - DNA, 20 bp, Artificial Sequence
  Description of Artificial Sequence: Synthetic oligonucleotide
  Target: ATXN1; (+) strand; PAM type: YTN; PAM sequence: TTC
ttcaattcagggtcctggta

SEQ ID NO: 277780 - DNA, 20 bp, Artificial Sequence
  Description of Artificial Sequence: Synthetic oligonucleotide
  Target: ATXN1; (+) strand; PAM type: YTN; PAM sequence: CTT
caattcagggtcctggtaat

SEQ ID NO: 277781 - DNA, 20 bp, Artificial Sequence
  Description of Artificial Sequence: Synthetic oligonucleotide
  Target: ATXN1; (+) strand; PAM type: YTN; PAM sequence: TTC
aattcagggtcctggtaatc

SEQ ID NO: 277782 - DNA, 20 bp, Artificial Sequence
  Description of Artificial Sequence: Synthetic oligonucleotide
  Target: ATXN1; (+) strand; PAM type: YTN; PAM sequence: TTC
agggtcctggtaatcactgg

SEQ ID NO: 277783 - DNA, 20 bp, Artificial Sequence
  Description of Artificial Sequence: Synthetic oligonucleotide
  Target: ATXN1; (+) strand; PAM type: YTN; PAM sequence: CTG
gtaatcactggaaccacaag

SEQ ID NO: 277784 - DNA, 20 bp, Artificial Sequence
  Description of Artificial Sequence: Synthetic oligonucleotide
  Target: ATXN1; (+) strand; PAM type: YTN; PAM sequence: CTG
gaaccacaagttcaaatgcc

SEQ ID NO: 277785 - DNA, 20 bp, Artificial Sequence
  Description of Artificial Sequence: Synthetic oligonucleotide
  Target: ATXN1; (+) strand; PAM type: YTN; PAM sequence: TTC
aaatgccatctagaccataa

SEQ ID NO: 277786 - DNA, 20 bp, Artificial Sequence
  Description of Artificial Sequence: Synthetic oligonucleotide
  Target: ATXN1; (+) strand; PAM type: YTN; PAM sequence: CTA
gaccataaggactcttataa

SEQ ID NO: 277787 - DNA, 20 bp, Artificial Sequence
  Description of Artificial Sequence: Synthetic oligonucleotide
  Target: ATXN1; (+) strand; PAM type: YTN; PAM sequence: CTC
ttataaaacacaaaccactt

SEQ ID NO: 277788 - DNA, 20 bp, Artificial Sequence
  Description of Artificial Sequence: Synthetic oligonucleotide
  Target: ATXN1; (+) strand; PAM type: YTN; PAM sequence: CTT
ataaaacacaaaccacttca

SEQ ID NO: 277789 - DNA, 20 bp, Artificial Sequence
  Description of Artificial Sequence: Synthetic oligonucleotide
  Target: ATXN1; (+) strand; PAM type: YTN; PAM sequence: TTA
taaaacacaaaccacttcat

SEQ ID NO: 277790 - DNA, 20 bp, Artificial Sequence
  Description of Artificial Sequence: Synthetic oligonucleotide
  Target: ATXN1; (+) strand; PAM type: YTN; PAM sequence: CTT
catcatcaacaaacctattt

SEQ ID NO: 277791 - DNA, 20 bp, Artificial Sequence
  Description of Artificial Sequence: Synthetic oligonucleotide
  Target: ATXN1; (+) strand; PAM type: YTN; PAM sequence: TTC
atcatcaacaaacctatttg

SEQ ID NO: 277792 - DNA, 20 bp, Artificial Sequence
  Description of Artificial Sequence: Synthetic oligonucleotide
  Target: ATXN1; (+) strand; PAM type: YTN; PAM sequence: CTA
tttgcctactagaactttta

SEQ ID NO: 277793 - DNA, 20 bp, Artificial Sequence
  Description of Artificial Sequence: Synthetic oligonucleotide
  Target: ATXN1; (+) strand; PAM type: YTN; PAM sequence: TTT
gcctactagaacttttaaag

SEQ ID NO: 277794 - DNA, 20 bp, Artificial Sequence
  Description of Artificial Sequence: Synthetic oligonucleotide
  Target: ATXN1; (+) strand; PAM type: YTN; PAM sequence: TTG
cctactagaacttttaaagc

SEQ ID NO: 277795 - DNA, 20 bp, Artificial Sequence
  Description of Artificial Sequence: Synthetic oligonucleotide
  Target: ATXN1; (+) strand; PAM type: YTN; PAM sequence: CTA
ctagaacttttaaagcaagg

SEQ ID NO: 277796 - DNA, 20 bp, Artificial Sequence
  Description of Artificial Sequence: Synthetic oligonucleotide
  Target: ATXN1; (+) strand; PAM type: YTN; PAM sequence: CTA
gaacttttaaagcaaggctg

SEQ ID NO: 277797 - DNA, 20 bp, Artificial Sequence
  Description of Artificial Sequence: Synthetic oligonucleotide
  Target: ATXN1; (+) strand; PAM type: YTN; PAM sequence: CTT
ttaaagcaaggctgcaaact

SEQ ID NO: 277798 - DNA, 20 bp, Artificial Sequence
  Description of Artificial Sequence: Synthetic oligonucleotide
  Target: ATXN1; (+) strand; PAM type: YTN; PAM sequence: TTT
taaagcaaggctgcaaacta

SEQ ID NO: 277799 - DNA, 20 bp, Artificial Sequence
  Description of Artificial Sequence: Synthetic oligonucleotide
  Target: ATXN1; (+) strand; PAM type: YTN; PAM sequence: TTT
aaagcaaggctgcaaactat

SEQ ID NO: 277800 - DNA, 20 bp, Artificial Sequence
  Description of Artificial Sequence: Synthetic oligonucleotide
  Target: ATXN1; (+) strand; PAM type: YTN; PAM sequence: TTA
aagcaaggctgcaaactatt

SEQ ID NO: 277801 - DNA, 20 bp, Artificial Sequence
  Description of Artificial Sequence: Synthetic oligonucleotide
  Target: ATXN1; (+) strand; PAM type: YTN; PAM sequence: CTG
caaactattcaagtaaacaa

SEQ ID NO: 277802 - DNA, 20 bp, Artificial Sequence
  Description of Artificial Sequence: Synthetic oligonucleotide
  Target: ATXN1; (+) strand; PAM type: YTN; PAM sequence: CTA
ttcaagtaaacaaccttgtg

SEQ ID NO: 277803 - DNA, 20 bp, Artificial Sequence
  Description of Artificial Sequence: Synthetic oligonucleotide
  Target: ATXN1; (+) strand; PAM type: YTN; PAM sequence: TTC
aagtaaacaaccttgtgggg

SEQ ID NO: 277804 - DNA, 20 bp, Artificial Sequence
  Description of Artificial Sequence: Synthetic oligonucleotide
  Target: ATXN1; (+) strand; PAM type: YTN; PAM sequence: CTT
gtggggtggttgacatggac

SEQ ID NO: 277805 - DNA, 20 bp, Artificial Sequence
  Description of Artificial Sequence: Synthetic oligonucleotide
  Target: ATXN1; (+) strand; PAM type: YTN; PAM sequence: TTG
tggggtggttgacatggacc

SEQ ID NO: 277806 - DNA, 20 bp, Artificial Sequence
  Description of Artificial Sequence: Synthetic oligonucleotide
  Target: ATXN1; (+) strand; PAM type: YTN; PAM sequence: TTG
acatggaccgagagctaaca

SEQ ID NO: 277807 - DNA, 20 bp, Artificial Sequence
  Description of Artificial Sequence: Synthetic oligonucleotide
  Target: ATXN1; (+) strand; PAM type: YTN; PAM sequence: CTA
acaagagaacactggaatta

SEQ ID NO: 277808 - DNA, 20 bp, Artificial Sequence
  Description of Artificial Sequence: Synthetic oligonucleotide
  Target: ATXN1; (+) strand; PAM type: YTN; PAM sequence: CTG
gaattagcttctcagtttca

SEQ ID NO: 277809 - DNA, 20 bp, Artificial Sequence
  Description of Artificial Sequence: Synthetic oligonucleotide
  Target: ATXN1; (+) strand; PAM type: YTN; PAM sequence: TTA
gcttctcagtttcaaaatag

SEQ ID NO: 277810 - DNA, 20 bp, Artificial Sequence
  Description of Artificial Sequence: Synthetic oligonucleotide
  Target: ATXN1; (+) strand; PAM type: YTN; PAM sequence: CTT
ctcagtttcaaaataggacc

SEQ ID NO: 277811 - DNA, 20 bp, Artificial Sequence
  Description of Artificial Sequence: Synthetic oligonucleotide
  Target: ATXN1; (+) strand; PAM type: YTN; PAM sequence: TTC
tcagtttcaaaataggacct

SEQ ID NO: 277812 - DNA, 20 bp, Artificial Sequence
  Description of Artificial Sequence: Synthetic oligonucleotide
  Target: ATXN1; (+) strand; PAM type: YTN; PAM sequence: CTC
agtttcaaaataggacctaa

SEQ ID NO: 277813 - DNA, 20 bp, Artificial Sequence
  Description of Artificial Sequence: Synthetic oligonucleotide
  Target: ATXN1; (+) strand; PAM type: YTN; PAM sequence: TTT
caaaataggacctaaaggag

SEQ ID NO: 277814 - DNA, 20 bp, Artificial Sequence
  Description of Artificial Sequence: Synthetic oligonucleotide
  Target: ATXN1; (+) strand; PAM type: YTN; PAM sequence: TTC
aaaataggacctaaaggagt

SEQ ID NO: 277815 - DNA, 20 bp, Artificial Sequence
  Description of Artificial Sequence: Synthetic oligonucleotide
  Target: ATXN1; (+) strand; PAM type: YTN; PAM sequence: CTA
aaggagtttgcgctatagga

SEQ ID NO: 277816 - DNA, 20 bp, Artificial Sequence
  Description of Artificial Sequence: Synthetic oligonucleotide
  Target: ATXN1; (+) strand; PAM type: YTN; PAM sequence: TTT
gcgctataggagaagagttg

SEQ ID NO: 277817 - DNA, 20 bp, Artificial Sequence
  Description of Artificial Sequence: Synthetic oligonucleotide
  Target: ATXN1; (+) strand; PAM type: YTN; PAM sequence: TTG
cgctataggagaagagttgc

SEQ ID NO: 277818 - DNA, 20 bp, Artificial Sequence
  Description of Artificial Sequence: Synthetic oligonucleotide
  Target: ATXN1; (+) strand; PAM type: YTN; PAM sequence: CTA
taggagaagagttgctgcat

SEQ ID NO: 277819 - DNA, 20 bp, Artificial Sequence
  Description of Artificial Sequence: Synthetic oligonucleotide
  Target: ATXN1; (+) strand; PAM type: YTN; PAM sequence: TTG
ctgcattttgtttaatggaa

SEQ ID NO: 277820 - DNA, 20 bp, Artificial Sequence
  Description of Artificial Sequence: Synthetic oligonucleotide
  Target: ATXN1; (+) strand; PAM type: YTN; PAM sequence: CTG
cattttgtttaatggaacta

SEQ ID NO: 277821 - DNA, 20 bp, Artificial Sequence
  Description of Artificial Sequence: Synthetic oligonucleotide
  Target: ATXN1; (+) strand; PAM type: YTN; PAM sequence: TTT
tgtttaatggaactaaattt

SEQ ID NO: 277822 - DNA, 20 bp, Artificial Sequence
  Description of Artificial Sequence: Synthetic oligonucleotide
  Target: ATXN1; (+) strand; PAM type: YTN; PAM sequence: TTT
gtttaatggaactaaatttg

SEQ ID NO: 277823 - DNA, 20 bp, Artificial Sequence
  Description of Artificial Sequence: Synthetic oligonucleotide
  Target: ATXN1; (+) strand; PAM type: YTN; PAM sequence: TTG
tttaatggaactaaatttgt

SEQ ID NO: 277824 - DNA, 20 bp, Artificial Sequence
  Description of Artificial Sequence: Synthetic oligonucleotide
  Target: ATXN1; (+) strand; PAM type: YTN; PAM sequence: TTT
aatggaactaaatttgtgcc

SEQ ID NO: 277825 - DNA, 20 bp, Artificial Sequence
  Description of Artificial Sequence: Synthetic oligonucleotide
  Target: ATXN1; (+) strand; PAM type: YTN; PAM sequence: TTA
atggaactaaatttgtgccc

SEQ ID NO: 277826 - DNA, 20 bp, Artificial Sequence
  Description of Artificial Sequence: Synthetic oligonucleotide
  Target: ATXN1; (+) strand; PAM type: YTN; PAM sequence: CTA
aatttgtgcccatttaaatc

SEQ ID NO: 277827 - DNA, 20 bp, Artificial Sequence
  Description of Artificial Sequence: Synthetic oligonucleotide
  Target: ATXN1; (+) strand; PAM type: YTN; PAM sequence: TTT
gtgcccatttaaatcatgag

SEQ ID NO: 277828 - DNA, 20 bp, Artificial Sequence
  Description of Artificial Sequence: Synthetic oligonucleotide
  Target: ATXN1; (+) strand; PAM type: YTN; PAM sequence: TTG
tgcccatttaaatcatgagc

SEQ ID NO: 277829 - DNA, 20 bp, Artificial Sequence
  Description of Artificial Sequence: Synthetic oligonucleotide
  Target: ATXN1; (+) strand; PAM type: YTN; PAM sequence: TTT
aaatcatgagcaggtggcac

SEQ ID NO: 277830 - DNA, 20 bp, Artificial Sequence
  Description of Artificial Sequence: Synthetic oligonucleotide
  Target: ATXN1; (+) strand; PAM type: YTN; PAM sequence: TTA
aatcatgagcaggtggcact

SEQ ID NO: 277831 - DNA, 20 bp, Artificial Sequence
  Description of Artificial Sequence: Synthetic oligonucleotide
  Target: ATXN1; (+) strand; PAM type: YTN; PAM sequence: CTT
ggtagcaaagaaagcctgaa

SEQ ID NO: 277832 - DNA, 20 bp, Artificial Sequence
  Description of Artificial Sequence: Synthetic oligonucleotide
  Target: ATXN1; (+) strand; PAM type: YTN; PAM sequence: TTG
gtagcaaagaaagcctgaaa

SEQ ID NO: 277833 - DNA, 20 bp, Artificial Sequence
  Description of Artificial Sequence: Synthetic oligonucleotide
  Target: ATXN1; (+) strand; PAM type: YTN; PAM sequence: CTG
aaaatattcacatttagtga

SEQ ID NO: 277834 - DNA, 20 bp, Artificial Sequence
  Description of Artificial Sequence: Synthetic oligonucleotide
  Target: ATXN1; (+) strand; PAM type: YTN; PAM sequence: TTC
acatttagtgaatgcagttg

SEQ ID NO: 277835 - DNA, 20 bp, Artificial Sequence
  Description of Artificial Sequence: Synthetic oligonucleotide
  Target: ATXN1; (+) strand; PAM type: YTN; PAM sequence: TTT
agtgaatgcagttgtatgta

SEQ ID NO: 277836 - DNA, 20 bp, Artificial Sequence
  Description of Artificial Sequence: Synthetic oligonucleotide
  Target: ATXN1; (+) strand; PAM type: YTN; PAM sequence: TTA
gtgaatgcagttgtatgtat

SEQ ID NO: 277837 - DNA, 20 bp, Artificial Sequence
  Description of Artificial Sequence: Synthetic oligonucleotide
  Target: ATXN1; (+) strand; PAM type: YTN; PAM sequence: TTG
tatgtataattagctgagat

SEQ ID NO: 277838 - DNA, 20 bp, Artificial Sequence
  Description of Artificial Sequence: Synthetic oligonucleotide
  Target: ATXN1; (+) strand; PAM type: YTN; PAM sequence: TTA
gctgagatttattttaaagt

SEQ ID NO: 277839 - DNA, 20 bp, Artificial Sequence
  Description of Artificial Sequence: Synthetic oligonucleotide
  Target: ATXN1; (+) strand; PAM type: YTN; PAM sequence: CTG
agatttattttaaagtactc

SEQ ID NO: 277840 - DNA, 20 bp, Artificial Sequence
  Description of Artificial Sequence: Synthetic oligonucleotide
  Target: ATXN1; (+) strand; PAM type: YTN; PAM sequence: TTT
attttaaagtactctaatct

SEQ ID NO: 277841 - DNA, 20 bp, Artificial Sequence
  Description of Artificial Sequence: Synthetic oligonucleotide
  Target: ATXN1; (+) strand; PAM type: YTN; PAM sequence: TTA
ttttaaagtactctaatctt

SEQ ID NO: 277842 - DNA, 20 bp, Artificial Sequence
  Description of Artificial Sequence: Synthetic oligonucleotide
  Target: ATXN1; (+) strand; PAM type: YTN; PAM sequence: TTT
taaagtactctaatcttttg

SEQ ID NO: 277843 - DNA, 20 bp, Artificial Sequence
  Description of Artificial Sequence: Synthetic oligonucleotide
  Target: ATXN1; (+) strand; PAM type: YTN; PAM sequence: TTT
aaagtactctaatcttttgt

SEQ ID NO: 277844 - DNA, 20 bp, Artificial Sequence
  Description of Artificial Sequence: Synthetic oligonucleotide
  Target: ATXN1; (+) strand; PAM type: YTN; PAM sequence: TTA
aagtactctaatcttttgta

SEQ ID NO: 277845 - DNA, 20 bp, Artificial Sequence
  Description of Artificial Sequence: Synthetic oligonucleotide
  Target: ATXN1; (+) strand; PAM type: YTN; PAM sequence: CTC
taatcttttgtactcttttc

SEQ ID NO: 277846 - DNA, 20 bp, Artificial Sequence
  Description of Artificial Sequence: Synthetic oligonucleotide
  Target: ATXN1; (+) strand; PAM type: YTN; PAM sequence: CTA
atcttttgtactcttttcta

SEQ ID NO: 277847 - DNA, 20 bp, Artificial Sequence
  Description of Artificial Sequence: Synthetic oligonucleotide
  Target: ATXN1; (+) strand; PAM type: YTN; PAM sequence: CTT
ttgtactcttttctacaatt

SEQ ID NO: 277848 - DNA, 20 bp, Artificial Sequence
  Description of Artificial Sequence: Synthetic oligonucleotide
  Target: ATXN1; (+) strand; PAM type: YTN; PAM sequence: TTT
tgtactcttttctacaattc

SEQ ID NO: 277849 - DNA, 20 bp, Artificial Sequence
  Description of Artificial Sequence: Synthetic oligonucleotide
  Target: ATXN1; (+) strand; PAM type: YTN; PAM sequence: TTT
gtactcttttctacaattca

SEQ ID NO: 277850 - DNA, 20 bp, Artificial Sequence
  Description of Artificial Sequence: Synthetic oligonucleotide
  Target: ATXN1; (+) strand; PAM type: YTN; PAM sequence: TTG
tactcttttctacaattcaa

SEQ ID NO: 277851 - DNA, 20 bp, Artificial Sequence
  Description of Artificial Sequence: Synthetic oligonucleotide
  Target: ATXN1; (+) strand; PAM type: YTN; PAM sequence: CTC
ttttctacaattcaaactgg

SEQ ID NO: 277852 - DNA, 20 bp, Artificial Sequence
  Description of Artificial Sequence: Synthetic oligonucleotide
  Target: ATXN1; (+) strand; PAM type: YTN; PAM sequence: CTT
ttctacaattcaaactggtg

SEQ ID NO: 277853 - DNA, 20 bp, Artificial Sequence
  Description of Artificial Sequence: Synthetic oligonucleotide
  Target: ATXN1; (+) strand; PAM type: YTN; PAM sequence: TTT
tctacaattcaaactggtga

SEQ ID NO: 277854 - DNA, 20 bp, Artificial Sequence
  Description of Artificial Sequence: Synthetic oligonucleotide
  Target: ATXN1; (+) strand; PAM type: YTN; PAM sequence: TTT
ctacaattcaaactggtgag

SEQ ID NO: 277855 - DNA, 20 bp, Artificial Sequence
  Description of Artificial Sequence: Synthetic oligonucleotide
  Target: ATXN1; (+) strand; PAM type: YTN; PAM sequence: TTC
tacaattcaaactggtgaga

SEQ ID NO: 277856 - DNA, 20 bp, Artificial Sequence
  Description of Artificial Sequence: Synthetic oligonucleotide
  Target: ATXN1; (+) strand; PAM type: YTN; PAM sequence: CTA
caattcaaactggtgagaaa

SEQ ID NO: 277857 - DNA, 20 bp, Artificial Sequence
  Description of Artificial Sequence: Synthetic oligonucleotide
  Target: ATXN1; (+) strand; PAM type: YTN; PAM sequence: TTC
aaactggtgagaaatagaga

SEQ ID NO: 277858 - DNA, 20 bp, Artificial Sequence
  Description of Artificial Sequence: Synthetic oligonucleotide
  Target: ATXN1; (+) strand; PAM type: YTN; PAM sequence: CTG
gtgagaaatagagagcagct

SEQ ID NO: 277859 - DNA, 20 bp, Artificial Sequence
  Description of Artificial Sequence: Synthetic oligonucleotide
  Target: ATXN1; (+) strand; PAM type: YTN; PAM sequence: CTT
ttgaatttattatgaaagca

SEQ ID NO: 277860 - DNA, 20 bp, Artificial Sequence
  Description of Artificial Sequence: Synthetic oligonucleotide
  Target: ATXN1; (+) strand; PAM type: YTN; PAM sequence: TTT
tgaatttattatgaaagcac

SEQ ID NO: 277861 - DNA, 20 bp, Artificial Sequence
  Description of Artificial Sequence: Synthetic oligonucleotide
  Target: ATXN1; (+) strand; PAM type: YTN; PAM sequence: TTT
gaatttattatgaaagcaca

SEQ ID NO: 277862 - DNA, 20 bp, Artificial Sequence
  Description of Artificial Sequence: Synthetic oligonucleotide
  Target: ATXN1; (+) strand; PAM type: YTN; PAM sequence: TTG
aatttattatgaaagcacag

SEQ ID NO: 277863 - DNA, 20 bp, Artificial Sequence
  Description of Artificial Sequence: Synthetic oligonucleotide
  Target: ATXN1; (+) strand; PAM type: YTN; PAM sequence: TTT
attatgaaagcacagctatc

SEQ ID NO: 277864 - DNA, 20 bp, Artificial Sequence
  Description of Artificial Sequence: Synthetic oligonucleotide
  Target: ATXN1; (+) strand; PAM type: YTN; PAM sequence: TTA
ttatgaaagcacagctatcg

SEQ ID NO: 277865 - DNA, 20 bp, Artificial Sequence
  Description of Artificial Sequence: Synthetic oligonucleotide
  Target: ATXN1; (+) strand; PAM type: YTN; PAM sequence: TTA
tgaaagcacagctatcgtat

SEQ ID NO: 277866 - DNA, 20 bp, Artificial Sequence
  Description of Artificial Sequence: Synthetic oligonucleotide
  Target: ATXN1; (+) strand; PAM type: YTN; PAM sequence: CTA
tcgtattagctgttaagaaa

SEQ ID NO: 277867 - DNA, 20 bp, Artificial Sequence
  Description of Artificial Sequence: Synthetic oligonucleotide
  Target: ATXN1; (+) strand; PAM type: YTN; PAM sequence: TTA
gctgttaagaaataaaaaat

SEQ ID NO: 277868 - DNA, 20 bp, Artificial Sequence
  Description of Artificial Sequence: Synthetic oligonucleotide
  Target: ATXN1; (+) strand; PAM type: YTN; PAM sequence: CTG
ttaagaaataaaaaatgggg

SEQ ID NO: 277869 - DNA, 20 bp, Artificial Sequence
  Description of Artificial Sequence: Synthetic oligonucleotide
  Target: ATXN1; (+) strand; PAM type: YTN; PAM sequence: TTA
agaaataaaaaatggggagg

SEQ ID NO: 277870 - DNA, 20 bp, Artificial Sequence
  Description of Artificial Sequence: Synthetic oligonucleotide
  Target: ATXN1; (+) strand; PAM type: YTN; PAM sequence: CTC
taataatatgtacattagga

SEQ ID NO: 277871 - DNA, 20 bp, Artificial Sequence
  Description of Artificial Sequence: Synthetic oligonucleotide
  Target: ATXN1; (+) strand; PAM type: YTN; PAM sequence: CTA
ataatatgtacattaggaac

SEQ ID NO: 277872 - DNA, 20 bp, Artificial Sequence
  Description of Artificial Sequence: Synthetic oligonucleotide
  Target: ATXN1; (+) strand; PAM type: YTN; PAM sequence: TTA
ggaacagaccaaagcaaagg

SEQ ID NO: 277873 - DNA, 20 bp, Artificial Sequence
  Description of Artificial Sequence: Synthetic oligonucleotide
  Target: ATXN1; (+) strand; PAM type: YTN; PAM sequence: CTT
tctttccttcagagtagtga

SEQ ID NO: 277874 - DNA, 20 bp, Artificial Sequence
  Description of Artificial Sequence: Synthetic oligonucleotide
  Target: ATXN1; (+) strand; PAM type: YTN; PAM sequence: TTT
ctttccttcagagtagtgag

SEQ ID NO: 277875 - DNA, 20 bp, Artificial Sequence
  Description of Artificial Sequence: Synthetic oligonucleotide
  Target: ATXN1; (+) strand; PAM type: YTN; PAM sequence: TTC
tttccttcagagtagtgagt

SEQ ID NO: 277876 - DNA, 20 bp, Artificial Sequence
  Description of Artificial Sequence: Synthetic oligonucleotide
  Target: ATXN1; (+) strand; PAM type: YTN; PAM sequence: CTT
tccttcagagtagtgagtct

SEQ ID NO: 277877 - DNA, 20 bp, Artificial Sequence
  Description of Artificial Sequence: Synthetic oligonucleotide
  Target: ATXN1; (+) strand; PAM type: YTN; PAM sequence: TTT
ccttcagagtagtgagtctg

SEQ ID NO: 277878 - DNA, 20 bp, Artificial Sequence
  Description of Artificial Sequence: Synthetic oligonucleotide
  Target: ATXN1; (+) strand; PAM type: YTN; PAM sequence: TTC
cttcagagtagtgagtctgc

SEQ ID NO: 277879 - DNA, 20 bp, Artificial Sequence
  Description of Artificial Sequence: Synthetic oligonucleotide
  Target: ATXN1; (+) strand; PAM type: YTN; PAM sequence: CTT
cagagtagtgagtctgctgc

SEQ ID NO: 277880 - DNA, 20 bp, Artificial Sequence
  Description of Artificial Sequence: Synthetic oligonucleotide
  Target: ATXN1; (+) strand; PAM type: YTN; PAM sequence: TTC
agagtagtgagtctgctgct

SEQ ID NO: 277881 - DNA, 20 bp, Artificial Sequence
  Description of Artificial Sequence: Synthetic oligonucleotide
  Target: ATXN1; (+) strand; PAM type: YTN; PAM sequence: CTG
ctgctgttcctgagaaatga

SEQ ID NO: 277882 - DNA, 20 bp, Artificial Sequence
  Description of Artificial Sequence: Synthetic oligonucleotide
  Target: ATXN1; (+) strand; PAM type: YTN; PAM sequence: CTG
ctgttcctgagaaatgagtg

SEQ ID NO: 277883 - DNA, 20 bp, Artificial Sequence
  Description of Artificial Sequence: Synthetic oligonucleotide
  Target: ATXN1; (+) strand; PAM type: YTN; PAM sequence: CTG
ttcctgagaaatgagtgagc

SEQ ID NO: 277884 - DNA, 20 bp, Artificial Sequence
  Description of Artificial Sequence: Synthetic oligonucleotide
  Target: ATXN1; (+) strand; PAM type: YTN; PAM sequence: TTC
ctgagaaatgagtgagctgc

SEQ ID NO: 277885 - DNA, 20 bp, Artificial Sequence
  Description of Artificial Sequence: Synthetic oligonucleotide
  Target: ATXN1; (+) strand; PAM type: YTN; PAM sequence: CTG
agaaatgagtgagctgcaca

SEQ ID NO: 277886 - DNA, 20 bp, Artificial Sequence
  Description of Artificial Sequence: Synthetic oligonucleotide
  Target: ATXN1; (+) strand; PAM type: YTN; PAM sequence: CTG
cacaggaccagccagtagga

SEQ ID NO: 277887 - DNA, 20 bp, Artificial Sequence
  Description of Artificial Sequence: Synthetic oligonucleotide
  Target: ATXN1; (+) strand; PAM type: YTN; PAM sequence: TTT
tagaagcagaaggttttttc

SEQ ID NO: 277888 - DNA, 20 bp, Artificial Sequence
  Description of Artificial Sequence: Synthetic oligonucleotide
  Target: ATXN1; (+) strand; PAM type: YTN; PAM sequence: TTT
agaagcagaaggttttttca

SEQ ID NO: 277889 - DNA, 20 bp, Artificial Sequence
  Description of Artificial Sequence: Synthetic oligonucleotide
  Target: ATXN1; (+) strand; PAM type: YTN; PAM sequence: TTA
gaagcagaaggttttttcat

SEQ ID NO: 277890 - DNA, 20 bp, Artificial Sequence
  Description of Artificial Sequence: Synthetic oligonucleotide
  Target: ATXN1; (+) strand; PAM type: YTN; PAM sequence: TTT
tttcatggaaaattccaaac

SEQ ID NO: 277891 - DNA, 20 bp, Artificial Sequence
  Description of Artificial Sequence: Synthetic oligonucleotide
  Target: ATXN1; (+) strand; PAM type: YTN; PAM sequence: TTT
ttcatggaaaattccaaaca

SEQ ID NO: 277892 - DNA, 20 bp, Artificial Sequence
  Description of Artificial Sequence: Synthetic oligonucleotide
  Target: ATXN1; (+) strand; PAM type: YTN; PAM sequence: TTT
tcatggaaaattccaaacat

SEQ ID NO: 277893 - DNA, 20 bp, Artificial Sequence
  Description of Artificial Sequence: Synthetic oligonucleotide
  Target: ATXN1; (+) strand; PAM type: YTN; PAM sequence: TTT
catggaaaattccaaacatg

SEQ ID NO: 277894 - DNA, 20 bp, Artificial Sequence
  Description of Artificial Sequence: Synthetic oligonucleotide
  Target: ATXN1; (+) strand; PAM type: YTN; PAM sequence: TTC
atggaaaattccaaacatgt

SEQ ID NO: 277895 - DNA, 20 bp, Artificial Sequence
  Description of Artificial Sequence: Synthetic oligonucleotide
  Target: ATXN1; (+) strand; PAM type: YTN; PAM sequence: TTC
caaacatgtaccaaagactc

SEQ ID NO: 277896 - DNA, 20 bp, Artificial Sequence
  Description of Artificial Sequence: Synthetic oligonucleotide
  Target: ATXN1; (+) strand; PAM type: YTN; PAM sequence: CTC
acaatagaacaccaaatatc

SEQ ID NO: 277897 - DNA, 20 bp, Artificial Sequence
  Description of Artificial Sequence: Synthetic oligonucleotide
  Target: ATXN1; (+) strand; PAM type: YTN; PAM sequence: TTA
ctcagcatcaacagtgacaa

SEQ ID NO: 277898 - DNA, 20 bp, Artificial Sequence
  Description of Artificial Sequence: Synthetic oligonucleotide
  Target: ATXN1; (+) strand; PAM type: YTN; PAM sequence: CTC
agcatcaacagtgacaaacc

SEQ ID NO: 277899 - DNA, 20 bp, Artificial Sequence
  Description of Artificial Sequence: Synthetic oligonucleotide
  Target: ATXN1; (+) strand; PAM type: YTN; PAM sequence: CTG
attgtgtcttcaagcaaatc

SEQ ID NO: 277900 - DNA, 20 bp, Artificial Sequence
  Description of Artificial Sequence: Synthetic oligonucleotide
  Target: ATXN1; (+) strand; PAM type: YTN; PAM sequence: TTG
tgtcttcaagcaaatcccag

SEQ ID NO: 277901 - DNA, 20 bp, Artificial Sequence
  Description of Artificial Sequence: Synthetic oligonucleotide
  Target: ATXN1; (+) strand; PAM type: YTN; PAM sequence: CTT
caagcaaatcccagaactgt

SEQ ID NO: 277902 - DNA, 20 bp, Artificial Sequence
  Description of Artificial Sequence: Synthetic oligonucleotide
  Target: ATXN1; (+) strand; PAM type: YTN; PAM sequence: TTC
aagcaaatcccagaactgta

SEQ ID NO: 277903 - DNA, 20 bp, Artificial Sequence
  Description of Artificial Sequence: Synthetic oligonucleotide
  Target: ATXN1; (+) strand; PAM type: YTN; PAM sequence: CTG
taatttcatccctaagtatt

SEQ ID NO: 277904 - DNA, 20 bp, Artificial Sequence
  Description of Artificial Sequence: Synthetic oligonucleotide
  Target: ATXN1; (+) strand; PAM type: YTN; PAM sequence: TTT
catccctaagtatttcatta

SEQ ID NO: 277905 - DNA, 20 bp, Artificial Sequence
  Description of Artificial Sequence: Synthetic oligonucleotide
  Target: ATXN1; (+) strand; PAM type: YTN; PAM sequence: TTC
atccctaagtatttcattag

SEQ ID NO: 277906 - DNA, 20 bp, Artificial Sequence
  Description of Artificial Sequence: Synthetic oligonucleotide
  Target: ATXN1; (+) strand; PAM type: YTN; PAM sequence: CTA
agtatttcattaggaaccat

SEQ ID NO: 277907 - DNA, 20 bp, Artificial Sequence
  Description of Artificial Sequence: Synthetic oligonucleotide
  Target: ATXN1; (+) strand; PAM type: YTN; PAM sequence: TTT
cattaggaaccatagaattt

SEQ ID NO: 277908 - DNA, 20 bp, Artificial Sequence
  Description of Artificial Sequence: Synthetic oligonucleotide
  Target: ATXN1; (+) strand; PAM type: YTN; PAM sequence: TTC
attaggaaccatagaatttt

SEQ ID NO: 277909 - DNA, 20 bp, Artificial Sequence
  Description of Artificial Sequence: Synthetic oligonucleotide
  Target: ATXN1; (+) strand; PAM type: YTN; PAM sequence: TTA
ggaaccatagaattttttaa

SEQ ID NO: 277910 - DNA, 20 bp, Artificial Sequence
  Description of Artificial Sequence: Synthetic oligonucleotide
  Target: ATXN1; (+) strand; PAM type: YTN; PAM sequence: TTT
tttaagctccctcattttcc

SEQ ID NO: 277911 - DNA, 20 bp, Artificial Sequence
  Description of Artificial Sequence: Synthetic oligonucleotide
  Target: ATXN1; (+) strand; PAM type: YTN; PAM sequence: TTT
ttaagctccctcattttcct

SEQ ID NO: 277912 - DNA, 20 bp, Artificial Sequence
  Description of Artificial Sequence: Synthetic oligonucleotide
  Target: ATXN1; (+) strand; PAM type: YTN; PAM sequence: TTT
taagctccctcattttcctg

SEQ ID NO: 277913 - DNA, 20 bp, Artificial Sequence
  Description of Artificial Sequence: Synthetic oligonucleotide
  Target: ATXN1; (+) strand; PAM type: YTN; PAM sequence: TTT
aagctccctcattttcctga

SEQ ID NO: 277914 - DNA, 20 bp, Artificial Sequence
  Description of Artificial Sequence: Synthetic oligonucleotide
  Target: ATXN1; (+) strand; PAM type: YTN; PAM sequence: TTA
agctccctcattttcctgag

SEQ ID NO: 277915 - DNA, 20 bp, Artificial Sequence
  Description of Artificial Sequence: Synthetic oligonucleotide
  Target: ATXN1; (+) strand; PAM type: YTN; PAM sequence: CTC
cctcattttcctgaggtcct

SEQ ID NO: 277916 - DNA, 20 bp, Artificial Sequence
  Description of Artificial Sequence: Synthetic oligonucleotide
  Target: ATXN1; (+) strand; PAM type: YTN; PAM sequence: CTC
attttcctgaggtcctcaaa

SEQ ID NO: 277917 - DNA, 20 bp, Artificial Sequence
  Description of Artificial Sequence: Synthetic oligonucleotide
  Target: ATXN1; (+) strand; PAM type: YTN; PAM sequence: TTT
tcctgaggtcctcaaaagtc

SEQ ID NO: 277918 - DNA, 20 bp, Artificial Sequence
  Description of Artificial Sequence: Synthetic oligonucleotide
  Target: ATXN1; (+) strand; PAM type: YTN; PAM sequence: TTT
cctgaggtcctcaaaagtca

SEQ ID NO: 277919 - DNA, 20 bp, Artificial Sequence
  Description of Artificial Sequence: Synthetic oligonucleotide
  Target: ATXN1; (+) strand; PAM type: YTN; PAM sequence: TTC
ctgaggtcctcaaaagtcaa

SEQ ID NO: 277920 - DNA, 20 bp, Artificial Sequence
  Description of Artificial Sequence: Synthetic oligonucleotide
  Target: ATXN1; (+) strand; PAM type: YTN; PAM sequence: CTG
aggtcctcaaaagtcaaatg

SEQ ID NO: 277921 - DNA, 20 bp, Artificial Sequence
  Description of Artificial Sequence: Synthetic oligonucleotide
  Target: ATXN1; (+) strand; PAM type: YTN; PAM sequence: CTC
aaaagtcaaatgacccaggg

SEQ ID NO: 277922 - DNA, 20 bp, Artificial Sequence
  Description of Artificial Sequence: Synthetic oligonucleotide
  Target: ATXN1; (+) strand; PAM type: YTN; PAM sequence: CTG
tgatgaggcagggctggagc

SEQ ID NO: 277923 - DNA, 20 bp, Artificial Sequence
  Description of Artificial Sequence: Synthetic oligonucleotide
  Target: ATXN1; (+) strand; PAM type: YTN; PAM sequence: CTG
gagcccagtcttgtcacctg

SEQ ID NO: 277924 - DNA, 20 bp, Artificial Sequence
  Description of Artificial Sequence: Synthetic oligonucleotide
  Target: ATXN1; (+) strand; PAM type: YTN; PAM sequence: CTT
gtcacctggggccaggtgtg

SEQ ID NO: 277925 - DNA, 20 bp, Artificial Sequence
  Description of Artificial Sequence: Synthetic oligonucleotide
  Target: ATXN1; (+) strand; PAM type: YTN; PAM sequence: TTG
tcacctggggccaggtgtgc

SEQ ID NO: 277926 - DNA, 20 bp, Artificial Sequence
  Description of Artificial Sequence: Synthetic oligonucleotide
  Target: ATXN1; (+) strand; PAM type: YTN; PAM sequence: CTG
gggccaggtgtgctctcctt

SEQ ID NO: 277927 - DNA, 20 bp, Artificial Sequence
  Description of Artificial Sequence: Synthetic oligonucleotide
  Target: ATXN1; (+) strand; PAM type: YTN; PAM sequence: CTC
tccttcaagccccaccccca

SEQ ID NO: 277928 - DNA, 20 bp, Artificial Sequence
  Description of Artificial Sequence: Synthetic oligonucleotide
  Target: ATXN1; (+) strand; PAM type: YTN; PAM sequence: CTC
cttcaagccccacccccaac

SEQ ID NO: 277929 - DNA, 20 bp, Artificial Sequence
  Description of Artificial Sequence: Synthetic oligonucleotide
  Target: ATXN1; (+) strand; PAM type: YTN; PAM sequence: CTT
caagccccacccccaactcc

SEQ ID NO: 277930 - DNA, 20 bp, Artificial Sequence
  Description of Artificial Sequence: Synthetic oligonucleotide
  Target: ATXN1; (+) strand; PAM type: YTN; PAM sequence: TTC
aagccccacccccaactccc

SEQ ID NO: 277931 - DNA, 20 bp, Artificial Sequence
  Description of Artificial Sequence: Synthetic oligonucleotide
  Target: ATXN1; (+) strand; PAM type: YTN; PAM sequence: CTC
ccatctctcttgtacttacc

SEQ ID NO: 277932 - DNA, 20 bp, Artificial Sequence
  Description of Artificial Sequence: Synthetic oligonucleotide
  Target: ATXN1; (+) strand; PAM type: YTN; PAM sequence: CTC
tcttgtacttaccactccct

SEQ ID NO: 277933 - DNA, 20 bp, Artificial Sequence
  Description of Artificial Sequence: Synthetic oligonucleotide
  Target: ATXN1; (+) strand; PAM type: YTN; PAM sequence: CTC
ttgtacttaccactcccttc

SEQ ID NO: 277934 - DNA, 20 bp, Artificial Sequence
  Description of Artificial Sequence: Synthetic oligonucleotide
  Target: ATXN1; (+) strand; PAM type: YTN; PAM sequence: CTT
gtacttaccactcccttcag

SEQ ID NO: 277935 - DNA, 20 bp, Artificial Sequence
  Description of Artificial Sequence: Synthetic oligonucleotide
  Target: ATXN1; (+) strand; PAM type: YTN; PAM sequence: TTG
tacttaccactcccttcaga

SEQ ID NO: 277936 - DNA, 20 bp, Artificial Sequence
  Description of Artificial Sequence: Synthetic oligonucleotide
  Target: ATXN1; (+) strand; PAM type: YTN; PAM sequence: CTT
accactcccttcagacgttt

SEQ ID NO: 277937 - DNA, 20 bp, Artificial Sequence
  Description of Artificial Sequence: Synthetic oligonucleotide
  Target: ATXN1; (+) strand; PAM type: YTN; PAM sequence: TTA
ccactcccttcagacgtttt

SEQ ID NO: 277938 - DNA, 20 bp, Artificial Sequence
  Description of Artificial Sequence: Synthetic oligonucleotide
  Target: ATXN1; (+) strand; PAM type: YTN; PAM sequence: CTC
ccttcagacgtttttaactg

SEQ ID NO: 277939 - DNA, 20 bp, Artificial Sequence
  Description of Artificial Sequence: Synthetic oligonucleotide
  Target: ATXN1; (+) strand; PAM type: YTN; PAM sequence: CTT
cagacgtttttaactggacc

SEQ ID NO: 277940 - DNA, 20 bp, Artificial Sequence
  Description of Artificial Sequence: Synthetic oligonucleotide
  Target: ATXN1; (+) strand; PAM type: YTN; PAM sequence: TTC
agacgtttttaactggaccc

SEQ ID NO: 277941 - DNA, 20 bp, Artificial Sequence
  Description of Artificial Sequence: Synthetic oligonucleotide
  Target: ATXN1; (+) strand; PAM type: YTN; PAM sequence: TTT
ttaactggaccctgagccat

SEQ ID NO: 277942 - DNA, 20 bp, Artificial Sequence
  Description of Artificial Sequence: Synthetic oligonucleotide
  Target: ATXN1; (+) strand; PAM type: YTN; PAM sequence: TTT
taactggaccctgagccata

SEQ ID NO: 277943 - DNA, 20 bp, Artificial Sequence
  Description of Artificial Sequence: Synthetic oligonucleotide
  Target: ATXN1; (+) strand; PAM type: YTN; PAM sequence: TTT
aactggaccctgagccataa

SEQ ID NO: 277944 - DNA, 20 bp, Artificial Sequence
  Description of Artificial Sequence: Synthetic oligonucleotide
  Target: ATXN1; (+) strand; PAM type: YTN; PAM sequence: TTA
actggaccctgagccataaa

SEQ ID NO: 277945 - DNA, 20 bp, Artificial Sequence
  Description of Artificial Sequence: Synthetic oligonucleotide
  Target: ATXN1; (+) strand; PAM type: YTN; PAM sequence: CTG
gaccctgagccataaaatta

SEQ ID NO: 277946 - DNA, 20 bp, Artificial Sequence
  Description of Artificial Sequence: Synthetic oligonucleotide
  Target: ATXN1; (+) strand; PAM type: YTN; PAM sequence: CTG
agccataaaattaacacaga

SEQ ID NO: 277947 - DNA, 20 bp, Artificial Sequence
  Description of Artificial Sequence: Synthetic oligonucleotide
  Target: ATXN1; (+) strand; PAM type: YTN; PAM sequence: TTA
acacagaaaatgagcatgac

SEQ ID NO: 277948 - DNA, 20 bp, Artificial Sequence
  Description of Artificial Sequence: Synthetic oligonucleotide
  Target: ATXN1; (+) strand; PAM type: YTN; PAM sequence: TTG
gctagaaatcagaaaatcct

SEQ ID NO: 277949 - DNA, 20 bp, Artificial Sequence
  Description of Artificial Sequence: Synthetic oligonucleotide
  Target: ATXN1; (+) strand; PAM type: YTN; PAM sequence: CTA
gaaatcagaaaatcctgaat

SEQ ID NO: 277950 - DNA, 20 bp, Artificial Sequence
  Description of Artificial Sequence: Synthetic oligonucleotide
  Target: ATXN1; (+) strand; PAM type: YTN; PAM sequence: CTG
aattttaatctcagctttgc

SEQ ID NO: 277951 - DNA, 20 bp, Artificial Sequence
  Description of Artificial Sequence: Synthetic oligonucleotide
  Target: ATXN1; (+) strand; PAM type: YTN; PAM sequence: TTT
taatctcagctttgccattt

SEQ ID NO: 277952 - DNA, 20 bp, Artificial Sequence
  Description of Artificial Sequence: Synthetic oligonucleotide
  Target: ATXN1; (+) strand; PAM type: YTN; PAM sequence: TTT
aatctcagctttgccatttt

SEQ ID NO: 277953 - DNA, 20 bp, Artificial Sequence
  Description of Artificial Sequence: Synthetic oligonucleotide
  Target: ATXN1; (+) strand; PAM type: YTN; PAM sequence: TTA
atctcagctttgccattttt

SEQ ID NO: 277954 - DNA, 20 bp, Artificial Sequence
  Description of Artificial Sequence: Synthetic oligonucleotide
  Target: ATXN1; (+) strand; PAM type: YTN; PAM sequence: CTC
agctttgccatttttctgag

SEQ ID NO: 277955 - DNA, 20 bp, Artificial Sequence
  Description of Artificial Sequence: Synthetic oligonucleotide
  Target: ATXN1; (+) strand; PAM type: YTN; PAM sequence: CTT
tgccatttttctgagcctta

SEQ ID NO: 277956 - DNA, 20 bp, Artificial Sequence
  Description of Artificial Sequence: Synthetic oligonucleotide
  Target: ATXN1; (+) strand; PAM type: YTN; PAM sequence: TTT
gccatttttctgagccttaa

SEQ ID NO: 277957 - DNA, 20 bp, Artificial Sequence
  Description of Artificial Sequence: Synthetic oligonucleotide
  Target: ATXN1; (+) strand; PAM type: YTN; PAM sequence: TTG
ccatttttctgagccttaat

SEQ ID NO: 277958 - DNA, 20 bp, Artificial Sequence
  Description of Artificial Sequence: Synthetic oligonucleotide
  Target: ATXN1; (+) strand; PAM type: YTN; PAM sequence: TTT
ttctgagccttaattgtccc

SEQ ID NO: 277959 - DNA, 20 bp, Artificial Sequence
  Description of Artificial Sequence: Synthetic oligonucleotide
  Target: ATXN1; (+) strand; PAM type: YTN; PAM sequence: TTT
tctgagccttaattgtccca

SEQ ID NO: 277960 - DNA, 20 bp, Artificial Sequence
  Description of Artificial Sequence: Synthetic oligonucleotide
  Target: ATXN1; (+) strand; PAM type: YTN; PAM sequence: TTT
ctgagccttaattgtcccaa

SEQ ID NO: 277961 - DNA, 20 bp, Artificial Sequence
  Description of Artificial Sequence: Synthetic oligonucleotide
  Target: ATXN1; (+) strand; PAM type: YTN; PAM sequence: TTC
tgagccttaattgtcccaac

SEQ ID NO: 277962 - DNA, 20 bp, Artificial Sequence
  Description of Artificial Sequence: Synthetic oligonucleotide
  Target: ATXN1; (+) strand; PAM type: YTN; PAM sequence: CTG
agccttaattgtcccaacta

SEQ ID NO: 277963 - DNA, 20 bp, Artificial Sequence
  Description of Artificial Sequence: Synthetic oligonucleotide
  Target: ATXN1; (+) strand; PAM type: YTN; PAM sequence: CTT
aattgtcccaactataagta

SEQ ID NO: 277964 - DNA, 20 bp, Artificial Sequence
  Description of Artificial Sequence: Synthetic oligonucleotide
  Target: ATXN1; (+) strand; PAM type: YTN; PAM sequence: TTA
attgtcccaactataagtag

SEQ ID NO: 277965 - DNA, 20 bp, Artificial Sequence
  Description of Artificial Sequence: Synthetic oligonucleotide
  Target: ATXN1; (+) strand; PAM type: YTN; PAM sequence: TTG
tcccaactataagtagagat

SEQ ID NO: 277966 - DNA, 20 bp, Artificial Sequence
  Description of Artificial Sequence: Synthetic oligonucleotide
  Target: ATXN1; (+) strand; PAM type: YTN; PAM sequence: CTA
taagtagagatatgaaattg

SEQ ID NO: 277967 - DNA, 20 bp, Artificial Sequence
  Description of Artificial Sequence: Synthetic oligonucleotide
  Target: ATXN1; (+) strand; PAM type: YTN; PAM sequence: TTG
ctactacaagatataattac

SEQ ID NO: 277968 - DNA, 20 bp, Artificial Sequence
  Description of Artificial Sequence: Synthetic oligonucleotide
  Target: ATXN1; (+) strand; PAM type: YTN; PAM sequence: CTA
ctacaagatataattacttc

SEQ ID NO: 277969 - DNA, 20 bp, Artificial Sequence
  Description of Artificial Sequence: Synthetic oligonucleotide
  Target: ATXN1; (+) strand; PAM type: YTN; PAM sequence: CTA
caagatataattacttctga

SEQ ID NO: 277970 - DNA, 20 bp, Artificial Sequence
  Description of Artificial Sequence: Synthetic oligonucleotide
  Target: ATXN1; (+) strand; PAM type: YTN; PAM sequence: TTA
cttctgacatacttataaaa

SEQ ID NO: 277971 - DNA, 20 bp, Artificial Sequence
  Description of Artificial Sequence: Synthetic oligonucleotide
  Target: ATXN1; (+) strand; PAM type: YTN; PAM sequence: CTT
ctgacatacttataaaaagg

SEQ ID NO: 277972 - DNA, 20 bp, Artificial Sequence
  Description of Artificial Sequence: Synthetic oligonucleotide
  Target: ATXN1; (+) strand; PAM type: YTN; PAM sequence: TTC
tgacatacttataaaaaggg

SEQ ID NO: 277973 - DNA, 20 bp, Artificial Sequence
  Description of Artificial Sequence: Synthetic oligonucleotide
  Target: ATXN1; (+) strand; PAM type: YTN; PAM sequence: CTG
acatacttataaaaagggtt

SEQ ID NO: 277974 - DNA, 20 bp, Artificial Sequence
  Description of Artificial Sequence: Synthetic oligonucleotide
  Target: ATXN1; (+) strand; PAM type: YTN; PAM sequence: CTT
ataaaaagggttgactttca

SEQ ID NO: 277975 - DNA, 20 bp, Artificial Sequence
  Description of Artificial Sequence: Synthetic oligonucleotide
  Target: ATXN1; (+) strand; PAM type: YTN; PAM sequence: TTA
taaaaagggttgactttcaa

SEQ ID NO: 277976 - DNA, 20 bp, Artificial Sequence
  Description of Artificial Sequence: Synthetic oligonucleotide
  Target: ATXN1; (+) strand; PAM type: YTN; PAM sequence: TTG
actttcaacttgtaacagtt

SEQ ID NO: 277977 - DNA, 20 bp, Artificial Sequence
  Description of Artificial Sequence: Synthetic oligonucleotide
  Target: ATXN1; (+) strand; PAM type: YTN; PAM sequence: CTT
tcaacttgtaacagttatgt

SEQ ID NO: 277978 - DNA, 20 bp, Artificial Sequence
  Description of Artificial Sequence: Synthetic oligonucleotide
  Target: ATXN1; (+) strand; PAM type: YTN; PAM sequence: TTT
caacttgtaacagttatgtt

SEQ ID NO: 277979 - DNA, 20 bp, Artificial Sequence
  Description of Artificial Sequence: Synthetic oligonucleotide
  Target: ATXN1; (+) strand; PAM type: YTN; PAM sequence: TTC
aacttgtaacagttatgttt

SEQ ID NO: 277980 - DNA, 20 bp, Artificial Sequence
  Description of Artificial Sequence: Synthetic oligonucleotide
  Target: ATXN1; (+) strand; PAM type: YTN; PAM sequence: CTT
gtaacagttatgtttaaggt

SEQ ID NO: 277981 - DNA, 20 bp, Artificial Sequence
  Description of Artificial Sequence: Synthetic oligonucleotide
  Target: ATXN1; (+) strand; PAM type: YTN; PAM sequence: TTG
taacagttatgtttaaggta

SEQ ID NO: 277982 - DNA, 20 bp, Artificial Sequence
  Description of Artificial Sequence: Synthetic oligonucleotide
  Target: ATXN1; (+) strand; PAM type: YTN; PAM sequence: TTA
tgtttaaggtattttcatgg

SEQ ID NO: 277983 - DNA, 20 bp, Artificial Sequence
  Description of Artificial Sequence: Synthetic oligonucleotide
  Target: ATXN1; (+) strand; PAM type: YTN; PAM sequence: TTT
aaggtattttcatggagttt

SEQ ID NO: 277984 - DNA, 20 bp, Artificial Sequence
  Description of Artificial Sequence: Synthetic oligonucleotide
  Target: ATXN1; (+) strand; PAM type: YTN; PAM sequence: TTA
aggtattttcatggagtttc

SEQ ID NO: 277985 - DNA, 20 bp, Artificial Sequence
  Description of Artificial Sequence: Synthetic oligonucleotide
  Target: ATXN1; (+) strand; PAM type: YTN; PAM sequence: TTT
tcatggagtttcgtaaaagc

SEQ ID NO: 277986 - DNA, 20 bp, Artificial Sequence
  Description of Artificial Sequence: Synthetic oligonucleotide
  Target: ATXN1; (+) strand; PAM type: YTN; PAM sequence: TTT
catggagtttcgtaaaagct

SEQ ID NO: 277987 - DNA, 20 bp, Artificial Sequence
  Description of Artificial Sequence: Synthetic oligonucleotide
  Target: ATXN1; (+) strand; PAM type: YTN; PAM sequence: TTC
atggagtttcgtaaaagctg

SEQ ID NO: 277988 - DNA, 20 bp, Artificial Sequence
  Description of Artificial Sequence: Synthetic oligonucleotide
  Target: ATXN1; (+) strand; PAM type: YTN; PAM sequence: TTT
cgtaaaagctgttagaagcc

SEQ ID NO: 277989 - DNA, 20 bp, Artificial Sequence
  Description of Artificial Sequence: Synthetic oligonucleotide
  Target: ATXN1; (+) strand; PAM type: YTN; PAM sequence: TTC
gtaaaagctgttagaagcca

SEQ ID NO: 277990 - DNA, 20 bp, Artificial Sequence
  Description of Artificial Sequence: Synthetic oligonucleotide
  Target: ATXN1; (+) strand; PAM type: YTN; PAM sequence: CTG
ttagaagccataaagcttag

SEQ ID NO: 277991 - DNA, 20 bp, Artificial Sequence
  Description of Artificial Sequence: Synthetic oligonucleotide
  Target: ATXN1; (+) strand; PAM type: YTN; PAM sequence: TTA
gaagccataaagcttagact

SEQ ID NO: 277992 - DNA, 20 bp, Artificial Sequence
  Description of Artificial Sequence: Synthetic oligonucleotide
  Target: ATXN1; (+) strand; PAM type: YTN; PAM sequence: CTT
agactatgagatgacttccg

SEQ ID NO: 277993 - DNA, 20 bp, Artificial Sequence
  Description of Artificial Sequence: Synthetic oligonucleotide
  Target: ATXN1; (+) strand; PAM type: YTN; PAM sequence: TTA
gactatgagatgacttccgt

SEQ ID NO: 277994 - DNA, 20 bp, Artificial Sequence
  Description of Artificial Sequence: Synthetic oligonucleotide
  Target: ATXN1; (+) strand; PAM type: YTN; PAM sequence: CTA
tgagatgacttccgtgaggt

SEQ ID NO: 277995 - DNA, 20 bp, Artificial Sequence
  Description of Artificial Sequence: Synthetic oligonucleotide
  Target: ATXN1; (+) strand; PAM type: YTN; PAM sequence: CTT
ccgtgaggtgagatctccta

SEQ ID NO: 277996 - DNA, 20 bp, Artificial Sequence
  Description of Artificial Sequence: Synthetic oligonucleotide
  Target: ATXN1; (+) strand; PAM type: YTN; PAM sequence: TTC
cgtgaggtgagatctcctat

SEQ ID NO: 277997 - DNA, 20 bp, Artificial Sequence
  Description of Artificial Sequence: Synthetic oligonucleotide
  Target: ATXN1; (+) strand; PAM type: YTN; PAM sequence: CTC
ctatgttaatgagtggtggg

SEQ ID NO: 277998 - DNA, 20 bp, Artificial Sequence
  Description of Artificial Sequence: Synthetic oligonucleotide
  Target: ATXN1; (+) strand; PAM type: YTN; PAM sequence: CTA
tgttaatgagtggtggggag

SEQ ID NO: 277999 - DNA, 20 bp, Artificial Sequence
  Description of Artificial Sequence: Synthetic oligonucleotide
  Target: ATXN1; (+) strand; PAM type: YTN; PAM sequence: TTA
atgagtggtggggaggcata

SEQ ID NO: 278000 - DNA, 20 bp, Artificial Sequence
  Description of Artificial Sequence: Synthetic oligonucleotide
  Target: ATXN1; (+) strand; PAM type: YTN; PAM sequence: TTA
ttatgtaactgtaccctgag

SEQ ID NO: 278001 - DNA, 20 bp, Artificial Sequence
  Description of Artificial Sequence: Synthetic oligonucleotide
  Target: ATXN1; (+) strand; PAM type: YTN; PAM sequence: TTA
tgtaactgtaccctgagagt

SEQ ID NO: 278002 - DNA, 20 bp, Artificial Sequence
  Description of Artificial Sequence: Synthetic oligonucleotide
  Target: ATXN1; (+) strand; PAM type: YTN; PAM sequence: CTG
taccctgagagtattgccac

SEQ ID NO: 278003 - DNA, 20 bp, Artificial Sequence
  Description of Artificial Sequence: Synthetic oligonucleotide
  Target: ATXN1; (+) strand; PAM type: YTN; PAM sequence: CTG
agagtattgccacgacaagt

SEQ ID NO: 278004 - DNA, 20 bp, Artificial Sequence
  Description of Artificial Sequence: Synthetic oligonucleotide
  Target: ATXN1; (+) strand; PAM type: YTN; PAM sequence: TTG
ccacgacaagtttatttatt

SEQ ID NO: 278005 - DNA, 20 bp, Artificial Sequence
  Description of Artificial Sequence: Synthetic oligonucleotide
  Target: ATXN1; (+) strand; PAM type: YTN; PAM sequence: TTT
atttatttttcacataaaaa

SEQ ID NO: 278006 - DNA, 20 bp, Artificial Sequence
  Description of Artificial Sequence: Synthetic oligonucleotide
  Target: ATXN1; (+) strand; PAM type: YTN; PAM sequence: TTA
tttatttttcacataaaaat

SEQ ID NO: 278007 - DNA, 20 bp, Artificial Sequence
  Description of Artificial Sequence: Synthetic oligonucleotide
  Target: ATXN1; (+) strand; PAM type: YTN; PAM sequence: TTT
atttttcacataaaaattag

SEQ ID NO: 278008 - DNA, 20 bp, Artificial Sequence
  Description of Artificial Sequence: Synthetic oligonucleotide
  Target: ATXN1; (+) strand; PAM type: YTN; PAM sequence: TTA
tttttcacataaaaattaga

SEQ ID NO: 278009 - DNA, 20 bp, Artificial Sequence
  Description of Artificial Sequence: Synthetic oligonucleotide
  Target: ATXN1; (+) strand; PAM type: YTN; PAM sequence: TTT
ttcacataaaaattagaacc

SEQ ID NO: 278010 - DNA, 20 bp, Artificial Sequence
  Description of Artificial Sequence: Synthetic oligonucleotide
  Target: ATXN1; (+) strand; PAM type: YTN; PAM sequence: TTT
tcacataaaaattagaacca

SEQ ID NO: 278011 - DNA, 20 bp, Artificial Sequence
  Description of Artificial Sequence: Synthetic oligonucleotide
  Target: ATXN1; (+) strand; PAM type: YTN; PAM sequence: TTT
cacataaaaattagaaccaa

SEQ ID NO: 278012 - DNA, 20 bp, Artificial Sequence
  Description of Artificial Sequence: Synthetic oligonucleotide
  Target: ATXN1; (+) strand; PAM type: YTN; PAM sequence: TTC
acataaaaattagaaccaac

SEQ ID NO: 278013 - DNA, 20 bp, Artificial Sequence
  Description of Artificial Sequence: Synthetic oligonucleotide
  Target: ATXN1; (+) strand; PAM type: YTN; PAM sequence: TTA
gaaccaactatttcaacatg

SEQ ID NO: 278014 - DNA, 20 bp, Artificial Sequence
  Description of Artificial Sequence: Synthetic oligonucleotide
  Target: ATXN1; (+) strand; PAM type: YTN; PAM sequence: CTA
tttcaacatgctgaaatgga

SEQ ID NO: 278015 - DNA, 20 bp, Artificial Sequence
  Description of Artificial Sequence: Synthetic oligonucleotide
  Target: ATXN1; (+) strand; PAM type: YTN; PAM sequence: TTT
caacatgctgaaatggaagt

SEQ ID NO: 278016 - DNA, 20 bp, Artificial Sequence
  Description of Artificial Sequence: Synthetic oligonucleotide
  Target: ATXN1; (+) strand; PAM type: YTN; PAM sequence: TTC
aacatgctgaaatggaagtt

SEQ ID NO: 278017 - DNA, 20 bp, Artificial Sequence
  Description of Artificial Sequence: Synthetic oligonucleotide
  Target: ATXN1; (+) strand; PAM type: YTN; PAM sequence: CTG
aaatggaagtttctatgaaa

SEQ ID NO: 278018 - DNA, 20 bp, Artificial Sequence
  Description of Artificial Sequence: Synthetic oligonucleotide
  Target: ATXN1; (+) strand; PAM type: YTN; PAM sequence: TTT
ctatgaaaaacaaatgtttc

SEQ ID NO: 278019 - DNA, 20 bp, Artificial Sequence
  Description of Artificial Sequence: Synthetic oligonucleotide
  Target: ATXN1; (+) strand; PAM type: YTN; PAM sequence: TTC
tatgaaaaacaaatgtttca

SEQ ID NO: 278020 - DNA, 20 bp, Artificial Sequence
  Description of Artificial Sequence: Synthetic oligonucleotide
  Target: ATXN1; (+) strand; PAM type: YTN; PAM sequence: CTA
tgaaaaacaaatgtttcata

SEQ ID NO: 278021 - DNA, 20 bp, Artificial Sequence
  Description of Artificial Sequence: Synthetic oligonucleotide
  Target: ATXN1; (+) strand; PAM type: YTN; PAM sequence: TTT
catataatataaatcaacat

SEQ ID NO: 278022 - DNA, 20 bp, Artificial Sequence
  Description of Artificial Sequence: Synthetic oligonucleotide
  Target: ATXN1; (+) strand; PAM type: YTN; PAM sequence: TTC
atataatataaatcaacatt

SEQ ID NO: 278023 - DNA, 20 bp, Artificial Sequence
  Description of Artificial Sequence: Synthetic oligonucleotide
  Target: ATXN1; (+) strand; PAM type: YTN; PAM sequence: TTT
cccaaggaggaaaaaggcag

SEQ ID NO: 278024 - DNA, 20 bp, Artificial Sequence
  Description of Artificial Sequence: Synthetic oligonucleotide
  Target: ATXN1; (+) strand; PAM type: YTN; PAM sequence: TTC
ccaaggaggaaaaaggcagg

SEQ ID NO: 278025 - DNA, 20 bp, Artificial Sequence
  Description of Artificial Sequence: Synthetic oligonucleotide
  Target: ATXN1; (+) strand; PAM type: YTN; PAM sequence: CTC
cccttggggaagttctagca

SEQ ID NO: 278026 - DNA, 20 bp, Artificial Sequence
  Description of Artificial Sequence: Synthetic oligonucleotide
  Target: ATXN1; (+) strand; PAM type: YTN; PAM sequence: CTT
ggggaagttctagcatcttt

SEQ ID NO: 278027 - DNA, 20 bp, Artificial Sequence
  Description of Artificial Sequence: Synthetic oligonucleotide
  Target: ATXN1; (+) strand; PAM type: YTN; PAM sequence: TTG
gggaagttctagcatctttc

SEQ ID NO: 278028 - DNA, 20 bp, Artificial Sequence
  Description of Artificial Sequence: Synthetic oligonucleotide
  Target: ATXN1; (+) strand; PAM type: YTN; PAM sequence: TTC
tagcatctttcagagaaaga

SEQ ID NO: 278029 - DNA, 20 bp, Artificial Sequence
  Description of Artificial Sequence: Synthetic oligonucleotide
  Target: ATXN1; (+) strand; PAM type: YTN; PAM sequence: CTA
gcatctttcagagaaagaac

SEQ ID NO: 278030 - DNA, 20 bp, Artificial Sequence
  Description of Artificial Sequence: Synthetic oligonucleotide
  Target: ATXN1; (+) strand; PAM type: YTN; PAM sequence: CTT
tcagagaaagaacaggcaag

SEQ ID NO: 278031 - DNA, 20 bp, Artificial Sequence
  Description of Artificial Sequence: Synthetic oligonucleotide
  Target: ATXN1; (+) strand; PAM type: YTN; PAM sequence: TTT
cagagaaagaacaggcaagc

SEQ ID NO: 278032 - DNA, 20 bp, Artificial Sequence
  Description of Artificial Sequence: Synthetic oligonucleotide
  Target: ATXN1; (+) strand; PAM type: YTN; PAM sequence: TTC
agagaaagaacaggcaagcc

SEQ ID NO: 278033 - DNA, 20 bp, Artificial Sequence
  Description of Artificial Sequence: Synthetic oligonucleotide
  Target: ATXN1; (+) strand; PAM type: YTN; PAM sequence: TTC
cctctctttgttgtggactt

SEQ ID NO: 278034 - DNA, 20 bp, Artificial Sequence
  Description of Artificial Sequence: Synthetic oligonucleotide
  Target: ATXN1; (+) strand; PAM type: YTN; PAM sequence: CTC
tctttgttgtggacttgcca

SEQ ID NO: 278035 - DNA, 20 bp, Artificial Sequence
  Description of Artificial Sequence: Synthetic oligonucleotide
  Target: ATXN1; (+) strand; PAM type: YTN; PAM sequence: CTC
tttgttgtggacttgccaaa

SEQ ID NO: 278036 - DNA, 20 bp, Artificial Sequence
  Description of Artificial Sequence: Synthetic oligonucleotide
  Target: ATXN1; (+) strand; PAM type: YTN; PAM sequence: CTT
tgttgtggacttgccaaatc

SEQ ID NO: 278037 - DNA, 20 bp, Artificial Sequence
  Description of Artificial Sequence: Synthetic oligonucleotide
  Target: ATXN1; (+) strand; PAM type: YTN; PAM sequence: TTT
gttgtggacttgccaaatcc

SEQ ID NO: 278038 - DNA, 20 bp, Artificial Sequence
  Description of Artificial Sequence: Synthetic oligonucleotide
  Target: ATXN1; (+) strand; PAM type: YTN; PAM sequence: TTG
ttgtggacttgccaaatccc

SEQ ID NO: 278039 - DNA, 20 bp, Artificial Sequence
  Description of Artificial Sequence: Synthetic oligonucleotide
  Target: ATXN1; (+) strand; PAM type: YTN; PAM sequence: TTG
tggacttgccaaatccctga

SEQ ID NO: 278040 - DNA, 20 bp, Artificial Sequence
  Description of Artificial Sequence: Synthetic oligonucleotide
  Target: ATXN1; (+) strand; PAM type: YTN; PAM sequence: CTT
gccaaatccctgaccgaagt

SEQ ID NO: 278041 - DNA, 20 bp, Artificial Sequence
  Description of Artificial Sequence: Synthetic oligonucleotide
  Target: ATXN1; (+) strand; PAM type: YTN; PAM sequence: TTG
ccaaatccctgaccgaagtg

SEQ ID NO: 278042 - DNA, 20 bp, Artificial Sequence
  Description of Artificial Sequence: Synthetic oligonucleotide
  Target: ATXN1; (+) strand; PAM type: YTN; PAM sequence: CTG
accgaagtggacttacaaca

SEQ ID NO: 278043 - DNA, 20 bp, Artificial Sequence
  Description of Artificial Sequence: Synthetic oligonucleotide
  Target: ATXN1; (+) strand; PAM type: YTN; PAM sequence: CTT
acaacagaactgcaaatatt

SEQ ID NO: 278044 - DNA, 20 bp, Artificial Sequence
  Description of Artificial Sequence: Synthetic oligonucleotide
  Target: ATXN1; (+) strand; PAM type: YTN; PAM sequence: TTA
caacagaactgcaaatattc

SEQ ID NO: 278045 - DNA, 20 bp, Artificial Sequence
  Description of Artificial Sequence: Synthetic oligonucleotide
  Target: ATXN1; (+) strand; PAM type: YTN; PAM sequence: CTG
caaatattctcacgaaagtg

SEQ ID NO: 278046 - DNA, 20 bp, Artificial Sequence
  Description of Artificial Sequence: Synthetic oligonucleotide
  Target: ATXN1; (+) strand; PAM type: YTN; PAM sequence: TTC
tcacgaaagtgtccaagcct

SEQ ID NO: 278047 - DNA, 20 bp, Artificial Sequence
  Description of Artificial Sequence: Synthetic oligonucleotide
  Target: ATXN1; (+) strand; PAM type: YTN; PAM sequence: CTC
acgaaagtgtccaagcctgg

SEQ ID NO: 278048 - DNA, 20 bp, Artificial Sequence
  Description of Artificial Sequence: Synthetic oligonucleotide
  Target: ATXN1; (+) strand; PAM type: YTN; PAM sequence: CTG
gaaaaataagaagcaaataa

SEQ ID NO: 278049 - DNA, 20 bp, Artificial Sequence
  Description of Artificial Sequence: Synthetic oligonucleotide
  Target: ATXN1; (+) strand; PAM type: YTN; PAM sequence: TTT
tgcctaacagacggaaatat

SEQ ID NO: 278050 - DNA, 20 bp, Artificial Sequence
  Description of Artificial Sequence: Synthetic oligonucleotide
  Target: ATXN1; (+) strand; PAM type: YTN; PAM sequence: TTT
gcctaacagacggaaatata

SEQ ID NO: 278051 - DNA, 20 bp, Artificial Sequence
  Description of Artificial Sequence: Synthetic oligonucleotide
  Target: ATXN1; (+) strand; PAM type: YTN; PAM sequence: TTG
cctaacagacggaaatatac

SEQ ID NO: 278052 - DNA, 20 bp, Artificial Sequence
  Description of Artificial Sequence: Synthetic oligonucleotide
  Target: ATXN1; (+) strand; PAM type: YTN; PAM sequence: CTA
acagacggaaatatactgtt

SEQ ID NO: 278053 - DNA, 20 bp, Artificial Sequence
  Description of Artificial Sequence: Synthetic oligonucleotide
  Target: ATXN1; (+) strand; PAM type: YTN; PAM sequence: CTG
ttcaattgcactccttttcc

SEQ ID NO: 278054 - DNA, 20 bp, Artificial Sequence
  Description of Artificial Sequence: Synthetic oligonucleotide
  Target: ATXN1; (+) strand; PAM type: YTN; PAM sequence: TTC
aattgcactccttttccttc

SEQ ID NO: 278055 - DNA, 20 bp, Artificial Sequence
  Description of Artificial Sequence: Synthetic oligonucleotide
  Target: ATXN1; (+) strand; PAM type: YTN; PAM sequence: TTG
cactccttttccttccaaat

SEQ ID NO: 278056 - DNA, 20 bp, Artificial Sequence
  Description of Artificial Sequence: Synthetic oligonucleotide
  Target: ATXN1; (+) strand; PAM type: YTN; PAM sequence: CTC
cttttccttccaaatgcaca

SEQ ID NO: 278057 - DNA, 20 bp, Artificial Sequence
  Description of Artificial Sequence: Synthetic oligonucleotide
  Target: ATXN1; (+) strand; PAM type: YTN; PAM sequence: CTT
ttccttccaaatgcacataa

SEQ ID NO: 278058 - DNA, 20 bp, Artificial Sequence
  Description of Artificial Sequence: Synthetic oligonucleotide
  Target: ATXN1; (+) strand; PAM type: YTN; PAM sequence: TTT
tccttccaaatgcacataaa

SEQ ID NO: 278059 - DNA, 20 bp, Artificial Sequence
  Description of Artificial Sequence: Synthetic oligonucleotide
  Target: ATXN1; (+) strand; PAM type: YTN; PAM sequence: TTT
ccttccaaatgcacataaag

SEQ ID NO: 278060 - DNA, 20 bp, Artificial Sequence
  Description of Artificial Sequence: Synthetic oligonucleotide
  Target: ATXN1; (+) strand; PAM type: YTN; PAM sequence: TTC
cttccaaatgcacataaaga

SEQ ID NO: 278061 - DNA, 20 bp, Artificial Sequence
  Description of Artificial Sequence: Synthetic oligonucleotide
  Target: ATXN1; (+) strand; PAM type: YTN; PAM sequence: CTT
ccaaatgcacataaagatac

SEQ ID NO: 278062 - DNA, 20 bp, Artificial Sequence
  Description of Artificial Sequence: Synthetic oligonucleotide
  Target: ATXN1; (+) strand; PAM type: YTN; PAM sequence: TTC
caaatgcacataaagataca

SEQ ID NO: 278063 - DNA, 20 bp, Artificial Sequence
  Description of Artificial Sequence: Synthetic oligonucleotide
  Target: ATXN1; (+) strand; PAM type: YTN; PAM sequence: TTT
ggggaggtgatggcaatgag

SEQ ID NO: 278064 - DNA, 20 bp, Artificial Sequence
  Description of Artificial Sequence: Synthetic oligonucleotide
  Target: ATXN1; (+) strand; PAM type: YTN; PAM sequence: TTG
gggaggtgatggcaatgaga

SEQ ID NO: 278065 - DNA, 20 bp, Artificial Sequence
  Description of Artificial Sequence: Synthetic oligonucleotide
  Target: ATXN1; (+) strand; PAM type: YTN; PAM sequence: TTA
gaatgtttcagaaatcccat

SEQ ID NO: 278066 - DNA, 20 bp, Artificial Sequence
  Description of Artificial Sequence: Synthetic oligonucleotide
  Target: ATXN1; (+) strand; PAM type: YTN; PAM sequence: TTT
cagaaatcccattctaaacc

SEQ ID NO: 278067 - DNA, 20 bp, Artificial Sequence
  Description of Artificial Sequence: Synthetic oligonucleotide
  Target: ATXN1; (+) strand; PAM type: YTN; PAM sequence: TTC
agaaatcccattctaaacca

SEQ ID NO: 278068 - DNA, 20 bp, Artificial Sequence
  Description of Artificial Sequence: Synthetic oligonucleotide
  Target: ATXN1; (+) strand; PAM type: YTN; PAM sequence: TTC
taaaccaaccccaaaccctg

SEQ ID NO: 278069 - DNA, 20 bp, Artificial Sequence
  Description of Artificial Sequence: Synthetic oligonucleotide
  Target: ATXN1; (+) strand; PAM type: YTN; PAM sequence: CTA
aaccaaccccaaaccctgag

SEQ ID NO: 278070 - DNA, 20 bp, Artificial Sequence
  Description of Artificial Sequence: Synthetic oligonucleotide
  Target: ATXN1; (+) strand; PAM type: YTN; PAM sequence: CTG
agatttggctttcaatgcac

SEQ ID NO: 278071 - DNA, 20 bp, Artificial Sequence
  Description of Artificial Sequence: Synthetic oligonucleotide
  Target: ATXN1; (+) strand; PAM type: YTN; PAM sequence: TTT
ggctttcaatgcacctgctt

SEQ ID NO: 278072 - DNA, 20 bp, Artificial Sequence
  Description of Artificial Sequence: Synthetic oligonucleotide
  Target: ATXN1; (+) strand; PAM type: YTN; PAM sequence: TTG
gctttcaatgcacctgcttt

SEQ ID NO: 278073 - DNA, 20 bp, Artificial Sequence
  Description of Artificial Sequence: Synthetic oligonucleotide
  Target: ATXN1; (+) strand; PAM type: YTN; PAM sequence: CTT
tcaatgcacctgctttcaaa

SEQ ID NO: 278074 - DNA, 20 bp, Artificial Sequence
  Description of Artificial Sequence: Synthetic oligonucleotide
  Target: ATXN1; (+) strand; PAM type: YTN; PAM sequence: TTT
caatgcacctgctttcaaaa

SEQ ID NO: 278075 - DNA, 20 bp, Artificial Sequence
  Description of Artificial Sequence: Synthetic oligonucleotide
  Target: ATXN1; (+) strand; PAM type: YTN; PAM sequence: TTC
aatgcacctgctttcaaaag

SEQ ID NO: 278076 - DNA, 20 bp, Artificial Sequence
  Description of Artificial Sequence: Synthetic oligonucleotide
  Target: ATXN1; (+) strand; PAM type: YTN; PAM sequence: CTG
ctttcaaaagtcaaaccaga

SEQ ID NO: 278077 - DNA, 20 bp, Artificial Sequence
  Description of Artificial Sequence: Synthetic oligonucleotide
  Target: ATXN1; (+) strand; PAM type: YTN; PAM sequence: CTT
tcaaaagtcaaaccagagga

SEQ ID NO: 278078 - DNA, 20 bp, Artificial Sequence
  Description of Artificial Sequence: Synthetic oligonucleotide
  Target: ATXN1; (+) strand; PAM type: YTN; PAM sequence: TTT
caaaagtcaaaccagaggaa

SEQ ID NO: 278079 - DNA, 20 bp, Artificial Sequence
  Description of Artificial Sequence: Synthetic oligonucleotide
  Target: ATXN1; (+) strand; PAM type: YTN; PAM sequence: TTC
aaaagtcaaaccagaggaaa

SEQ ID NO: 278080 - DNA, 20 bp, Artificial Sequence
  Description of Artificial Sequence: Synthetic oligonucleotide
  Target: ATXN1; (+) strand; PAM type: YTN; PAM sequence: CTT
gtcatttttaacatccaccg

SEQ ID NO: 278081 - DNA, 20 bp, Artificial Sequence
  Description of Artificial Sequence: Synthetic oligonucleotide
  Target: ATXN1; (+) strand; PAM type: YTN; PAM sequence: TTG
tcatttttaacatccaccgc

SEQ ID NO: 278082 - DNA, 20 bp, Artificial Sequence
  Description of Artificial Sequence: Synthetic oligonucleotide
  Target: ATXN1; (+) strand; PAM type: YTN; PAM sequence: TTT
ttaacatccaccgccagcaa

SEQ ID NO: 278083 - DNA, 20 bp, Artificial Sequence
  Description of Artificial Sequence: Synthetic oligonucleotide
  Target: ATXN1; (+) strand; PAM type: YTN; PAM sequence: TTT
taacatccaccgccagcaaa

SEQ ID NO: 278084 - DNA, 20 bp, Artificial Sequence
  Description of Artificial Sequence: Synthetic oligonucleotide
  Target: ATXN1; (+) strand; PAM type: YTN; PAM sequence: TTT
aacatccaccgccagcaaat

SEQ ID NO: 278085 - DNA, 20 bp, Artificial Sequence
  Description of Artificial Sequence: Synthetic oligonucleotide
  Target: ATXN1; (+) strand; PAM type: YTN; PAM sequence: TTA
acatccaccgccagcaaatg

SEQ ID NO: 278086 - DNA, 20 bp, Artificial Sequence
  Description of Artificial Sequence: Synthetic oligonucleotide
  Target: ATXN1; (+) strand; PAM type: YTN; PAM sequence: CTA
ccatgtggagtctcaccaca

SEQ ID NO: 278087 - DNA, 20 bp, Artificial Sequence
  Description of Artificial Sequence: Synthetic oligonucleotide
  Target: ATXN1; (+) strand; PAM type: YTN; PAM sequence: CTC
accacaagacccaagctgtg

SEQ ID NO: 278088 - DNA, 20 bp, Artificial Sequence
  Description of Artificial Sequence: Synthetic oligonucleotide
  Target: ATXN1; (+) strand; PAM type: YTN; PAM sequence: CTG
tgcaccaggcgtcagagaga

SEQ ID NO: 278089 - DNA, 20 bp, Artificial Sequence
  Description of Artificial Sequence: Synthetic oligonucleotide
  Target: ATXN1; (+) strand; PAM type: YTN; PAM sequence: CTA
cctgcctgtgttagtttcct

SEQ ID NO: 278090 - DNA, 20 bp, Artificial Sequence
  Description of Artificial Sequence: Synthetic oligonucleotide
  Target: ATXN1; (+) strand; PAM type: YTN; PAM sequence: CTG
cctgtgttagtttcctgggg

SEQ ID NO: 278091 - DNA, 20 bp, Artificial Sequence
  Description of Artificial Sequence: Synthetic oligonucleotide
  Target: ATXN1; (+) strand; PAM type: YTN; PAM sequence: CTG
tgttagtttcctggggttgc

SEQ ID NO: 278092 - DNA, 20 bp, Artificial Sequence
  Description of Artificial Sequence: Synthetic oligonucleotide
  Target: ATXN1; (+) strand; PAM type: YTN; PAM sequence: TTA
gtttcctggggttgcaataa

SEQ ID NO: 278093 - DNA, 20 bp, Artificial Sequence
  Description of Artificial Sequence: Synthetic oligonucleotide
  Target: ATXN1; (+) strand; PAM type: YTN; PAM sequence: TTT
cctggggttgcaataacaca

SEQ ID NO: 278094 - DNA, 20 bp, Artificial Sequence
  Description of Artificial Sequence: Synthetic oligonucleotide
  Target: ATXN1; (+) strand; PAM type: YTN; PAM sequence: TTC
ctggggttgcaataacacag

SEQ ID NO: 278095 - DNA, 20 bp, Artificial Sequence
  Description of Artificial Sequence: Synthetic oligonucleotide
  Target: ATXN1; (+) strand; PAM type: YTN; PAM sequence: CTG
gggttgcaataacacagtac

SEQ ID NO: 278096 - DNA, 20 bp, Artificial Sequence
  Description of Artificial Sequence: Synthetic oligonucleotide
  Target: ATXN1; (+) strand; PAM type: YTN; PAM sequence: TTG
caataacacagtaccacaga

SEQ ID NO: 278097 - DNA, 20 bp, Artificial Sequence
  Description of Artificial Sequence: Synthetic oligonucleotide
  Target: ATXN1; (+) strand; PAM type: YTN; PAM sequence: CTG
gggggcttcaacaatagaaa

SEQ ID NO: 278098 - DNA, 20 bp, Artificial Sequence
  Description of Artificial Sequence: Synthetic oligonucleotide
  Target: ATXN1; (+) strand; PAM type: YTN; PAM sequence: CTT
caacaatagaaatgcattgt

SEQ ID NO: 278099 - DNA, 20 bp, Artificial Sequence
  Description of Artificial Sequence: Synthetic oligonucleotide
  Target: ATXN1; (+) strand; PAM type: YTN; PAM sequence: TTC
aacaatagaaatgcattgtc

SEQ ID NO: 278100 - DNA, 20 bp, Artificial Sequence
  Description of Artificial Sequence: Synthetic oligonucleotide
  Target: ATXN1; (+) strand; PAM type: YTN; PAM sequence: TTG
tcttacagtcctggaggcta

SEQ ID NO: 278101 - DNA, 20 bp, Artificial Sequence
  Description of Artificial Sequence: Synthetic oligonucleotide
  Target: ATXN1; (+) strand; PAM type: YTN; PAM sequence: CTT
acagtcctggaggctagaaa

SEQ ID NO: 278102 - DNA, 20 bp, Artificial Sequence
  Description of Artificial Sequence: Synthetic oligonucleotide
  Target: ATXN1; (+) strand; PAM type: YTN; PAM sequence: TTA
cagtcctggaggctagaaat

SEQ ID NO: 278103 - DNA, 20 bp, Artificial Sequence
  Description of Artificial Sequence: Synthetic oligonucleotide
  Target: ATXN1; (+) strand; PAM type: YTN; PAM sequence: CTG
gaggctagaaatccgagatc

SEQ ID NO: 278104 - DNA, 20 bp, Artificial Sequence
  Description of Artificial Sequence: Synthetic oligonucleotide
  Target: ATXN1; (+) strand; PAM type: YTN; PAM sequence: CTA
gaaatccgagatcaaggtgt

SEQ ID NO: 278105 - DNA, 20 bp, Artificial Sequence
  Description of Artificial Sequence: Synthetic oligonucleotide
  Target: ATXN1; (+) strand; PAM type: YTN; PAM sequence: CTG
cagggctggttccttccagg

SEQ ID NO: 278106 - DNA, 20 bp, Artificial Sequence
  Description of Artificial Sequence: Synthetic oligonucleotide
  Target: ATXN1; (+) strand; PAM type: YTN; PAM sequence: CTG
gttccttccaggaggtgcaa

SEQ ID NO: 278107 - DNA, 20 bp, Artificial Sequence
  Description of Artificial Sequence: Synthetic oligonucleotide
  Target: ATXN1; (+) strand; PAM type: YTN; PAM sequence: TTC
cttccaggaggtgcaaagga

SEQ ID NO: 278108 - DNA, 20 bp, Artificial Sequence
  Description of Artificial Sequence: Synthetic oligonucleotide
  Target: ATXN1; (+) strand; PAM type: YTN; PAM sequence: CTT
ccaggaggtgcaaaggagaa

SEQ ID NO: 278109 - DNA, 20 bp, Artificial Sequence
  Description of Artificial Sequence: Synthetic oligonucleotide
  Target: ATXN1; (+) strand; PAM type: YTN; PAM sequence: TTC
caggaggtgcaaaggagaat

SEQ ID NO: 278110 - DNA, 20 bp, Artificial Sequence
  Description of Artificial Sequence: Synthetic oligonucleotide
  Target: ATXN1; (+) strand; PAM type: YTN; PAM sequence: CTG
ttccatgcccctctcccagc

SEQ ID NO: 278111 - DNA, 20 bp, Artificial Sequence
  Description of Artificial Sequence: Synthetic oligonucleotide
  Target: ATXN1; (+) strand; PAM type: YTN; PAM sequence: TTC
catgcccctctcccagcttc

SEQ ID NO: 278112 - DNA, 20 bp, Artificial Sequence
  Description of Artificial Sequence: Synthetic oligonucleotide
  Target: ATXN1; (+) strand; PAM type: YTN; PAM sequence: CTC
tcccagcttctggtggcttt

SEQ ID NO: 278113 - DNA, 20 bp, Artificial Sequence
  Description of Artificial Sequence: Synthetic oligonucleotide
  Target: ATXN1; (+) strand; PAM type: YTN; PAM sequence: CTC
ccagcttctggtggctttcc

SEQ ID NO: 278114 - DNA, 20 bp, Artificial Sequence
  Description of Artificial Sequence: Synthetic oligonucleotide
  Target: ATXN1; (+) strand; PAM type: YTN; PAM sequence: CTT
ctggtggctttccggatatc

SEQ ID NO: 278115 - DNA, 20 bp, Artificial Sequence
  Description of Artificial Sequence: Synthetic oligonucleotide
  Target: ATXN1; (+) strand; PAM type: YTN; PAM sequence: TTC
tggtggctttccggatatct

SEQ ID NO: 278116 - DNA, 20 bp, Artificial Sequence
  Description of Artificial Sequence: Synthetic oligonucleotide
  Target: ATXN1; (+) strand; PAM type: YTN; PAM sequence: CTG
gtggctttccggatatcttt

SEQ ID NO: 278117 - DNA, 20 bp, Artificial Sequence
  Description of Artificial Sequence: Synthetic oligonucleotide
  Target: ATXN1; (+) strand; PAM type: YTN; PAM sequence: CTT
tccggatatctttggtgttt

SEQ ID NO: 278118 - DNA, 20 bp, Artificial Sequence
  Description of Artificial Sequence: Synthetic oligonucleotide
  Target: ATXN1; (+) strand; PAM type: YTN; PAM sequence: TTT
ccggatatctttggtgtttc

SEQ ID NO: 278119 - DNA, 20 bp, Artificial Sequence
  Description of Artificial Sequence: Synthetic oligonucleotide
  Target: ATXN1; (+) strand; PAM type: YTN; PAM sequence: TTC
cggatatctttggtgtttct

SEQ ID NO: 278120 - DNA, 20 bp, Artificial Sequence
  Description of Artificial Sequence: Synthetic oligonucleotide
  Target: ATXN1; (+) strand; PAM type: YTN; PAM sequence: CTT
tggtgtttcttggctttggg

SEQ ID NO: 278121 - DNA, 20 bp, Artificial Sequence
  Description of Artificial Sequence: Synthetic oligonucleotide
  Target: ATXN1; (+) strand; PAM type: YTN; PAM sequence: TTT
ggtgtttcttggctttgggc

SEQ ID NO: 278122 - DNA, 20 bp, Artificial Sequence
  Description of Artificial Sequence: Synthetic oligonucleotide
  Target: ATXN1; (+) strand; PAM type: YTN; PAM sequence: TTG
gtgtttcttggctttgggca

SEQ ID NO: 278123 - DNA, 20 bp, Artificial Sequence
  Description of Artificial Sequence: Synthetic oligonucleotide
  Target: ATXN1; (+) strand; PAM type: YTN; PAM sequence: TTT
cttggctttgggcagcataa

SEQ ID NO: 278124 - DNA, 20 bp, Artificial Sequence
  Description of Artificial Sequence: Synthetic oligonucleotide
  Target: ATXN1; (+) strand; PAM type: YTN; PAM sequence: TTC
ttggctttgggcagcataac

SEQ ID NO: 278125 - DNA, 20 bp, Artificial Sequence
  Description of Artificial Sequence: Synthetic oligonucleotide
  Target: ATXN1; (+) strand; PAM type: YTN; PAM sequence: CTT
ggctttgggcagcataactc

SEQ ID NO: 278126 - DNA, 20 bp, Artificial Sequence
  Description of Artificial Sequence: Synthetic oligonucleotide
  Target: ATXN1; (+) strand; PAM type: YTN; PAM sequence: TTG
gctttgggcagcataactcc

SEQ ID NO: 278127 - DNA, 20 bp, Artificial Sequence
  Description of Artificial Sequence: Synthetic oligonucleotide
  Target: ATXN1; (+) strand; PAM type: YTN; PAM sequence: CTT
tgggcagcataactccagtc

SEQ ID NO: 278128 - DNA, 20 bp, Artificial Sequence
  Description of Artificial Sequence: Synthetic oligonucleotide
  Target: ATXN1; (+) strand; PAM type: YTN; PAM sequence: TTT
gggcagcataactccagtct

SEQ ID NO: 278129 - DNA, 20 bp, Artificial Sequence
  Description of Artificial Sequence: Synthetic oligonucleotide
  Target: ATXN1; (+) strand; PAM type: YTN; PAM sequence: TTG
ggcagcataactccagtctt

SEQ ID NO: 278130 - DNA, 20 bp, Artificial Sequence
  Description of Artificial Sequence: Synthetic oligonucleotide
  Target: ATXN1; (+) strand; PAM type: YTN; PAM sequence: CTC
cagtctttacacggtaatag

SEQ ID NO: 278131 - DNA, 20 bp, Artificial Sequence
  Description of Artificial Sequence: Synthetic oligonucleotide
  Target: ATXN1; (+) strand; PAM type: YTN; PAM sequence: CTT
tacacggtaatagcctcaga

SEQ ID NO: 278132 - DNA, 20 bp, Artificial Sequence
  Description of Artificial Sequence: Synthetic oligonucleotide
  Target: ATXN1; (+) strand; PAM type: YTN; PAM sequence: TTT
acacggtaatagcctcagag

SEQ ID NO: 278133 - DNA, 20 bp, Artificial Sequence
  Description of Artificial Sequence: Synthetic oligonucleotide
  Target: ATXN1; (+) strand; PAM type: YTN; PAM sequence: TTA
cacggtaatagcctcagagg

SEQ ID NO: 278134 - DNA, 20 bp, Artificial Sequence
  Description of Artificial Sequence: Synthetic oligonucleotide
  Target: ATXN1; (+) strand; PAM type: YTN; PAM sequence: CTC
agagggaggctatctctgag

SEQ ID NO: 278135 - DNA, 20 bp, Artificial Sequence
  Description of Artificial Sequence: Synthetic oligonucleotide
  Target: ATXN1; (+) strand; PAM type: YTN; PAM sequence: CTA
tctctgagcccaagtttccc

SEQ ID NO: 278136 - DNA, 20 bp, Artificial Sequence
  Description of Artificial Sequence: Synthetic oligonucleotide
  Target: ATXN1; (+) strand; PAM type: YTN; PAM sequence: CTC
tgagcccaagtttccccttt

SEQ ID NO: 278137 - DNA, 20 bp, Artificial Sequence
  Description of Artificial Sequence: Synthetic oligonucleotide
  Target: ATXN1; (+) strand; PAM type: YTN; PAM sequence: CTG
agcccaagtttccccttttt

SEQ ID NO: 278138 - DNA, 20 bp, Artificial Sequence
  Description of Artificial Sequence: Synthetic oligonucleotide
  Target: ATXN1; (+) strand; PAM type: YTN; PAM sequence: TTT
cccctttttacaaggagatg

SEQ ID NO: 278139 - DNA, 20 bp, Artificial Sequence
  Description of Artificial Sequence: Synthetic oligonucleotide
  Target: ATXN1; (+) strand; PAM type: YTN; PAM sequence: TTC
ccctttttacaaggagatga

SEQ ID NO: 278140 - DNA, 20 bp, Artificial Sequence
  Description of Artificial Sequence: Synthetic oligonucleotide
  Target: ATXN1; (+) strand; PAM type: YTN; PAM sequence: CTT
tttacaaggagatgagtcat

SEQ ID NO: 278141 - DNA, 20 bp, Artificial Sequence
  Description of Artificial Sequence: Synthetic oligonucleotide
  Target: ATXN1; (+) strand; PAM type: YTN; PAM sequence: TTT
ttacaaggagatgagtcata

SEQ ID NO: 278142 - DNA, 20 bp, Artificial Sequence
  Description of Artificial Sequence: Synthetic oligonucleotide
  Target: ATXN1; (+) strand; PAM type: YTN; PAM sequence: TTT
tacaaggagatgagtcatat

SEQ ID NO: 278143 - DNA, 20 bp, Artificial Sequence
  Description of Artificial Sequence: Synthetic oligonucleotide
  Target: ATXN1; (+) strand; PAM type: YTN; PAM sequence: TTT
acaaggagatgagtcatatc

SEQ ID NO: 278144 - DNA, 20 bp, Artificial Sequence
  Description of Artificial Sequence: Synthetic oligonucleotide
  Target: ATXN1; (+) strand; PAM type: YTN; PAM sequence: TTA
caaggagatgagtcatatca

SEQ ID NO: 278145 - DNA, 20 bp, Artificial Sequence
  Description of Artificial Sequence: Synthetic oligonucleotide
  Target: ATXN1; (+) strand; PAM type: YTN; PAM sequence: TTA
gagcccactctaataacctc

SEQ ID NO: 278146 - DNA, 20 bp, Artificial Sequence
  Description of Artificial Sequence: Synthetic oligonucleotide
  Target: ATXN1; (+) strand; PAM type: YTN; PAM sequence: CTC
taataacctcatctgaactt

SEQ ID NO: 278147 - DNA, 20 bp, Artificial Sequence
  Description of Artificial Sequence: Synthetic oligonucleotide
  Target: ATXN1; (+) strand; PAM type: YTN; PAM sequence: CTA
ataacctcatctgaacttgg

SEQ ID NO: 278148 - DNA, 20 bp, Artificial Sequence
  Description of Artificial Sequence: Synthetic oligonucleotide
  Target: ATXN1; (+) strand; PAM type: YTN; PAM sequence: CTC
atctgaacttggtcatatgc

SEQ ID NO: 278149 - DNA, 20 bp, Artificial Sequence
  Description of Artificial Sequence: Synthetic oligonucleotide
  Target: ATXN1; (+) strand; PAM type: YTN; PAM sequence: CTG
aacttggtcatatgcaaaat

SEQ ID NO: 278150 - DNA, 20 bp, Artificial Sequence
  Description of Artificial Sequence: Synthetic oligonucleotide
  Target: ATXN1; (+) strand; PAM type: YTN; PAM sequence: CTT
ggtcatatgcaaaatctcct

SEQ ID NO: 278151 - DNA, 20 bp, Artificial Sequence
  Description of Artificial Sequence: Synthetic oligonucleotide
  Target: ATXN1; (+) strand; PAM type: YTN; PAM sequence: TTG
gtcatatgcaaaatctcctt

SEQ ID NO: 278152 - DNA, 20 bp, Artificial Sequence
  Description of Artificial Sequence: Synthetic oligonucleotide
  Target: ATXN1; (+) strand; PAM type: YTN; PAM sequence: CTC
cttccaaataaagccattgt

SEQ ID NO: 278153 - DNA, 20 bp, Artificial Sequence
  Description of Artificial Sequence: Synthetic oligonucleotide
  Target: ATXN1; (+) strand; PAM type: YTN; PAM sequence: CTT
ccaaataaagccattgttca

SEQ ID NO: 278154 - DNA, 20 bp, Artificial Sequence
  Description of Artificial Sequence: Synthetic oligonucleotide
  Target: ATXN1; (+) strand; PAM type: YTN; PAM sequence: TTC
caaataaagccattgttcat

SEQ ID NO: 278155 - DNA, 20 bp, Artificial Sequence
  Description of Artificial Sequence: Synthetic oligonucleotide
  Target: ATXN1; (+) strand; PAM type: YTN; PAM sequence: TTG
ttcatggacactgggaggtt

SEQ ID NO: 278156 - DNA, 20 bp, Artificial Sequence
  Description of Artificial Sequence: Synthetic oligonucleotide
  Target: ATXN1; (+) strand; PAM type: YTN; PAM sequence: TTC
atggacactgggaggtttag

SEQ ID NO: 278157 - DNA, 20 bp, Artificial Sequence
  Description of Artificial Sequence: Synthetic oligonucleotide
  Target: ATXN1; (+) strand; PAM type: YTN; PAM sequence: CTG
ggaggtttagcctgtcaaca

SEQ ID NO: 278158 - DNA, 20 bp, Artificial Sequence
  Description of Artificial Sequence: Synthetic oligonucleotide
  Target: ATXN1; (+) strand; PAM type: YTN; PAM sequence: TTT
agcctgtcaacattttggtg

SEQ ID NO: 278159 - DNA, 20 bp, Artificial Sequence
  Description of Artificial Sequence: Synthetic oligonucleotide
  Target: ATXN1; (+) strand; PAM type: YTN; PAM sequence: TTA
gcctgtcaacattttggtgg

SEQ ID NO: 278160 - DNA, 20 bp, Artificial Sequence
  Description of Artificial Sequence: Synthetic oligonucleotide
  Target: ATXN1; (+) strand; PAM type: YTN; PAM sequence: CTG
tcaacattttggtgggggac

SEQ ID NO: 278161 - DNA, 20 bp, Artificial Sequence
  Description of Artificial Sequence: Synthetic oligonucleotide
  Target: ATXN1; (+) strand; PAM type: YTN; PAM sequence: TTT
tggtgggggacacagtttaa

SEQ ID NO: 278162 - DNA, 20 bp, Artificial Sequence
  Description of Artificial Sequence: Synthetic oligonucleotide
  Target: ATXN1; (+) strand; PAM type: YTN; PAM sequence: TTT
ggtgggggacacagtttaac

SEQ ID NO: 278163 - DNA, 20 bp, Artificial Sequence
  Description of Artificial Sequence: Synthetic oligonucleotide
  Target: ATXN1; (+) strand; PAM type: YTN; PAM sequence: TTG
gtgggggacacagtttaaca

SEQ ID NO: 278164 - DNA, 20 bp, Artificial Sequence
  Description of Artificial Sequence: Synthetic oligonucleotide
  Target: ATXN1; (+) strand; PAM type: YTN; PAM sequence: TTT
aacacagatacctcctcatc

SEQ ID NO: 278165 - DNA, 20 bp, Artificial Sequence
  Description of Artificial Sequence: Synthetic oligonucleotide
  Target: ATXN1; (+) strand; PAM type: YTN; PAM sequence: TTA
acacagatacctcctcatcc

SEQ ID NO: 278166 - DNA, 20 bp, Artificial Sequence
  Description of Artificial Sequence: Synthetic oligonucleotide
  Target: ATXN1; (+) strand; PAM type: YTN; PAM sequence: CTC
ctcatcctcacctacaggca

SEQ ID NO: 278167 - DNA, 20 bp, Artificial Sequence
  Description of Artificial Sequence: Synthetic oligonucleotide
  Target: ATXN1; (+) strand; PAM type: YTN; PAM sequence: CTC
atcctcacctacaggcatgt

SEQ ID NO: 278168 - DNA, 20 bp, Artificial Sequence
  Description of Artificial Sequence: Synthetic oligonucleotide
  Target: ATXN1; (+) strand; PAM type: YTN; PAM sequence: CTC
acctacaggcatgtgttggg

SEQ ID NO: 278169 - DNA, 20 bp, Artificial Sequence
  Description of Artificial Sequence: Synthetic oligonucleotide
  Target: ATXN1; (+) strand; PAM type: YTN; PAM sequence: CTA
caggcatgtgttgggtagcg

SEQ ID NO: 278170 - DNA, 20 bp, Artificial Sequence
  Description of Artificial Sequence: Synthetic oligonucleotide
  Target: ATXN1; (+) strand; PAM type: YTN; PAM sequence: TTG
ggtagcggtgggctatgctc

SEQ ID NO: 278171 - DNA, 20 bp, Artificial Sequence
  Description of Artificial Sequence: Synthetic oligonucleotide
  Target: ATXN1; (+) strand; PAM type: YTN; PAM sequence: CTA
tgctctgagaaatgcatctt

SEQ ID NO: 278172 - DNA, 20 bp, Artificial Sequence
  Description of Artificial Sequence: Synthetic oligonucleotide
  Target: ATXN1; (+) strand; PAM type: YTN; PAM sequence: CTC
tgagaaatgcatcttcacgt

SEQ ID NO: 278173 - DNA, 20 bp, Artificial Sequence
  Description of Artificial Sequence: Synthetic oligonucleotide
  Target: ATXN1; (+) strand; PAM type: YTN; PAM sequence: CTG
agaaatgcatcttcacgtga

SEQ ID NO: 278174 - DNA, 20 bp, Artificial Sequence
  Description of Artificial Sequence: Synthetic oligonucleotide
  Target: ATXN1; (+) strand; PAM type: YTN; PAM sequence: CTT
cacgtgattctgttgtgtga

SEQ ID NO: 278175 - DNA, 20 bp, Artificial Sequence
  Description of Artificial Sequence: Synthetic oligonucleotide
  Target: ATXN1; (+) strand; PAM type: YTN; PAM sequence: TTC
acgtgattctgttgtgtgaa

SEQ ID NO: 278176 - DNA, 20 bp, Artificial Sequence
  Description of Artificial Sequence: Synthetic oligonucleotide
  Target: ATXN1; (+) strand; PAM type: YTN; PAM sequence: TTC
tgttgtgtgaacatcgtaga

SEQ ID NO: 278177 - DNA, 20 bp, Artificial Sequence
  Description of Artificial Sequence: Synthetic oligonucleotide
  Target: ATXN1; (+) strand; PAM type: YTN; PAM sequence: CTG
ttgtgtgaacatcgtagagt

SEQ ID NO: 278178 - DNA, 20 bp, Artificial Sequence
  Description of Artificial Sequence: Synthetic oligonucleotide
  Target: ATXN1; (+) strand; PAM type: YTN; PAM sequence: TTG
tgtgaacatcgtagagtcta

SEQ ID NO: 278179 - DNA, 20 bp, Artificial Sequence
  Description of Artificial Sequence: Synthetic oligonucleotide
  Target: ATXN1; (+) strand; PAM type: YTN; PAM sequence: CTA
ctcacacaaacctagatggg

SEQ ID NO: 278180 - DNA, 20 bp, Artificial Sequence
  Description of Artificial Sequence: Synthetic oligonucleotide
  Target: ATXN1; (+) strand; PAM type: YTN; PAM sequence: CTC
acacaaacctagatgggaca

SEQ ID NO: 278181 - DNA, 20 bp, Artificial Sequence
  Description of Artificial Sequence: Synthetic oligonucleotide
  Target: ATXN1; (+) strand; PAM type: YTN; PAM sequence: CTA
gatgggacagcctactacac

SEQ ID NO: 278182 - DNA, 20 bp, Artificial Sequence
  Description of Artificial Sequence: Synthetic oligonucleotide
  Target: ATXN1; (+) strand; PAM type: YTN; PAM sequence: CTA
ctacacatctaggctacatg

SEQ ID NO: 278183 - DNA, 20 bp, Artificial Sequence
  Description of Artificial Sequence: Synthetic oligonucleotide
  Target: ATXN1; (+) strand; PAM type: YTN; PAM sequence: CTA
cacatctaggctacatggta

SEQ ID NO: 278184 - DNA, 20 bp, Artificial Sequence
  Description of Artificial Sequence: Synthetic oligonucleotide
  Target: ATXN1; (+) strand; PAM type: YTN; PAM sequence: CTA
ggctacatggtacaatgtat

SEQ ID NO: 278185 - DNA, 20 bp, Artificial Sequence
  Description of Artificial Sequence: Synthetic oligonucleotide
  Target: ATXN1; (+) strand; PAM type: YTN; PAM sequence: CTA
catggtacaatgtattgctt

SEQ ID NO: 278186 - DNA, 20 bp, Artificial Sequence
  Description of Artificial Sequence: Synthetic oligonucleotide
  Target: ATXN1; (+) strand; PAM type: YTN; PAM sequence: TTG
cttcccggctacaaacctac

SEQ ID NO: 278187 - DNA, 20 bp, Artificial Sequence
  Description of Artificial Sequence: Synthetic oligonucleotide
  Target: ATXN1; (+) strand; PAM type: YTN; PAM sequence: CTT
cccggctacaaacctacact

SEQ ID NO: 278188 - DNA, 20 bp, Artificial Sequence
  Description of Artificial Sequence: Synthetic oligonucleotide
  Target: ATXN1; (+) strand; PAM type: YTN; PAM sequence: TTC
ccggctacaaacctacactg

SEQ ID NO: 278189 - DNA, 20 bp, Artificial Sequence
  Description of Artificial Sequence: Synthetic oligonucleotide
  Target: ATXN1; (+) strand; PAM type: YTN; PAM sequence: CTA
caaacctacactgcatgata

SEQ ID NO: 278190 - DNA, 20 bp, Artificial Sequence
  Description of Artificial Sequence: Synthetic oligonucleotide
  Target: ATXN1; (+) strand; PAM type: YTN; PAM sequence: CTA
cactgcatgatactgtactg

SEQ ID NO: 278191 - DNA, 20 bp, Artificial Sequence
  Description of Artificial Sequence: Synthetic oligonucleotide
  Target: ATXN1; (+) strand; PAM type: YTN; PAM sequence: CTG
catgatactgtactgaatac

SEQ ID NO: 278192 - DNA, 20 bp, Artificial Sequence
  Description of Artificial Sequence: Synthetic oligonucleotide
  Target: ATXN1; (+) strand; PAM type: YTN; PAM sequence: CTG
tactgaatactgcaggcaaa

SEQ ID NO: 278193 - DNA, 20 bp, Artificial Sequence
  Description of Artificial Sequence: Synthetic oligonucleotide
  Target: ATXN1; (+) strand; PAM type: YTN; PAM sequence: CTG
aatactgcaggcaaatgtat

SEQ ID NO: 278194 - DNA, 20 bp, Artificial Sequence
  Description of Artificial Sequence: Synthetic oligonucleotide
  Target: ATXN1; (+) strand; PAM type: YTN; PAM sequence: CTG
caggcaaatgtattacaatg

SEQ ID NO: 278195 - DNA, 20 bp, Artificial Sequence
  Description of Artificial Sequence: Synthetic oligonucleotide
  Target: ATXN1; (+) strand; PAM type: YTN; PAM sequence: TTA
caatggtaagtatttgtgca

SEQ ID NO: 278196 - DNA, 20 bp, Artificial Sequence
  Description of Artificial Sequence: Synthetic oligonucleotide
  Target: ATXN1; (+) strand; PAM type: YTN; PAM sequence: TTT
gtgcattcaaacatacctaa

SEQ ID NO: 278197 - DNA, 20 bp, Artificial Sequence
  Description of Artificial Sequence: Synthetic oligonucleotide
  Target: ATXN1; (+) strand; PAM type: YTN; PAM sequence: TTG
tgcattcaaacatacctaaa

SEQ ID NO: 278198 - DNA, 20 bp, Artificial Sequence
  Description of Artificial Sequence: Synthetic oligonucleotide
  Target: ATXN1; (+) strand; PAM type: YTN; PAM sequence: TTC
aaacatacctaaatatagaa

SEQ ID NO: 278199 - DNA, 20 bp, Artificial Sequence
  Description of Artificial Sequence: Synthetic oligonucleotide
  Target: ATXN1; (+) strand; PAM type: YTN; PAM sequence: CTA
aatatagaaaagatacagtc

SEQ ID NO: 278200 - DNA, 20 bp, Artificial Sequence
  Description of Artificial Sequence: Synthetic oligonucleotide
  Target: ATXN1; (+) strand; PAM type: YTN; PAM sequence: CTG
tatagggcacttcccatgaa

SEQ ID NO: 278201 - DNA, 20 bp, Artificial Sequence
  Description of Artificial Sequence: Synthetic oligonucleotide
  Target: ATXN1; (+) strand; PAM type: YTN; PAM sequence: CTT
cccatgaatggagcttgcag

SEQ ID NO: 278202 - DNA, 20 bp, Artificial Sequence
  Description of Artificial Sequence: Synthetic oligonucleotide
  Target: ATXN1; (+) strand; PAM type: YTN; PAM sequence: TTC
ccatgaatggagcttgcagg

SEQ ID NO: 278203 - DNA, 20 bp, Artificial Sequence
  Description of Artificial Sequence: Synthetic oligonucleotide
  Target: ATXN1; (+) strand; PAM type: YTN; PAM sequence: CTT
gcaggattggaagttgctct

SEQ ID NO: 278204 - DNA, 20 bp, Artificial Sequence
  Description of Artificial Sequence: Synthetic oligonucleotide
  Target: ATXN1; (+) strand; PAM type: YTN; PAM sequence: TTG
caggattggaagttgctctg

SEQ ID NO: 278205 - DNA, 20 bp, Artificial Sequence
  Description of Artificial Sequence: Synthetic oligonucleotide
  Target: ATXN1; (+) strand; PAM type: YTN; PAM sequence: TTG
gaagttgctctgggtgagtc

SEQ ID NO: 278206 - DNA, 20 bp, Artificial Sequence
  Description of Artificial Sequence: Synthetic oligonucleotide
  Target: ATXN1; (+) strand; PAM type: YTN; PAM sequence: TTG
ctctgggtgagtcagtgagt

SEQ ID NO: 278207 - DNA, 20 bp, Artificial Sequence
  Description of Artificial Sequence: Synthetic oligonucleotide
  Target: ATXN1; (+) strand; PAM type: YTN; PAM sequence: CTC
tgggtgagtcagtgagtggg

SEQ ID NO: 278208 - DNA, 20 bp, Artificial Sequence
  Description of Artificial Sequence: Synthetic oligonucleotide
  Target: ATXN1; (+) strand; PAM type: YTN; PAM sequence: CTG
ggtgagtcagtgagtgggtg

SEQ ID NO: 278209 - DNA, 20 bp, Artificial Sequence
  Description of Artificial Sequence: Synthetic oligonucleotide
  Target: ATXN1; (+) strand; PAM type: YTN; PAM sequence: CTA
ggacattactgtacactact

SEQ ID NO: 278210 - DNA, 20 bp, Artificial Sequence
  Description of Artificial Sequence: Synthetic oligonucleotide
  Target: ATXN1; (+) strand; PAM type: YTN; PAM sequence: TTA
ctgtacactactgcagactt

SEQ ID NO: 278211 - DNA, 20 bp, Artificial Sequence
  Description of Artificial Sequence: Synthetic oligonucleotide
  Target: ATXN1; (+) strand; PAM type: YTN; PAM sequence: CTG
tacactactgcagactttat

SEQ ID NO: 278212 - DNA, 20 bp, Artificial Sequence
  Description of Artificial Sequence: Synthetic oligonucleotide
  Target: ATXN1; (+) strand; PAM type: YTN; PAM sequence: CTA
ctgcagactttataaacact

SEQ ID NO: 278213 - DNA, 20 bp, Artificial Sequence
  Description of Artificial Sequence: Synthetic oligonucleotide
  Target: ATXN1; (+) strand; PAM type: YTN; PAM sequence: CTG
cagactttataaacactgta

SEQ ID NO: 278214 - DNA, 20 bp, Artificial Sequence
  Description of Artificial Sequence: Synthetic oligonucleotide
  Target: ATXN1; (+) strand; PAM type: YTN; PAM sequence: CTT
tataaacactgtatacactt

SEQ ID NO: 278215 - DNA, 20 bp, Artificial Sequence
  Description of Artificial Sequence: Synthetic oligonucleotide
  Target: ATXN1; (+) strand; PAM type: YTN; PAM sequence: TTT
ataaacactgtatacactta

SEQ ID NO: 278216 - DNA, 20 bp, Artificial Sequence
  Description of Artificial Sequence: Synthetic oligonucleotide
  Target: ATXN1; (+) strand; PAM type: YTN; PAM sequence: TTA
taaacactgtatacacttag

SEQ ID NO: 278217 - DNA, 20 bp, Artificial Sequence
  Description of Artificial Sequence: Synthetic oligonucleotide
  Target: ATXN1; (+) strand; PAM type: YTN; PAM sequence: CTG
tatacacttaggctgcacca

SEQ ID NO: 278218 - DNA, 20 bp, Artificial Sequence
  Description of Artificial Sequence: Synthetic oligonucleotide
  Target: ATXN1; (+) strand; PAM type: YTN; PAM sequence: CTT
aggctgcaccaaatttattt

SEQ ID NO: 278219 - DNA, 20 bp, Artificial Sequence
  Description of Artificial Sequence: Synthetic oligonucleotide
  Target: ATXN1; (+) strand; PAM type: YTN; PAM sequence: TTA
ggctgcaccaaatttatttt

SEQ ID NO: 278220 - DNA, 20 bp, Artificial Sequence
  Description of Artificial Sequence: Synthetic oligonucleotide
  Target: ATXN1; (+) strand; PAM type: YTN; PAM sequence: CTG
caccaaatttatttttgaaa

SEQ ID NO: 278221 - DNA, 20 bp, Artificial Sequence
  Description of Artificial Sequence: Synthetic oligonucleotide
  Target: ATXN1; (+) strand; PAM type: YTN; PAM sequence: TTT
atttttgaaatttctttctt

SEQ ID NO: 278222 - DNA, 20 bp, Artificial Sequence
  Description of Artificial Sequence: Synthetic oligonucleotide
  Target: ATXN1; (+) strand; PAM type: YTN; PAM sequence: TTA
tttttgaaatttctttcttc

SEQ ID NO: 278223 - DNA, 20 bp, Artificial Sequence
  Description of Artificial Sequence: Synthetic oligonucleotide
  Target: ATXN1; (+) strand; PAM type: YTN; PAM sequence: TTT
ttgaaatttctttcttcaat

SEQ ID NO: 278224 - DNA, 20 bp, Artificial Sequence
  Description of Artificial Sequence: Synthetic oligonucleotide
  Target: ATXN1; (+) strand; PAM type: YTN; PAM sequence: TTT
tgaaatttctttcttcaata

SEQ ID NO: 278225 - DNA, 20 bp, Artificial Sequence
  Description of Artificial Sequence: Synthetic oligonucleotide
  Target: ATXN1; (+) strand; PAM type: YTN; PAM sequence: TTT
gaaatttctttcttcaataa

SEQ ID NO: 278226 - DNA, 20 bp, Artificial Sequence
  Description of Artificial Sequence: Synthetic oligonucleotide
  Target: ATXN1; (+) strand; PAM type: YTN; PAM sequence: TTG
aaatttctttcttcaataat

SEQ ID NO: 278227 - DNA, 20 bp, Artificial Sequence
  Description of Artificial Sequence: Synthetic oligonucleotide
  Target: ATXN1; (+) strand; PAM type: YTN; PAM sequence: TTT
ctttcttcaataataaatta

SEQ ID NO: 278228 - DNA, 20 bp, Artificial Sequence
  Description of Artificial Sequence: Synthetic oligonucleotide
  Target: ATXN1; (+) strand; PAM type: YTN; PAM sequence: TTC
tttcttcaataataaattaa

SEQ ID NO: 278229 - DNA, 20 bp, Artificial Sequence
  Description of Artificial Sequence: Synthetic oligonucleotide
  Target: ATXN1; (+) strand; PAM type: YTN; PAM sequence: CTT
tcttcaataataaattaaac

SEQ ID NO: 278230 - DNA, 20 bp, Artificial Sequence
  Description of Artificial Sequence: Synthetic oligonucleotide
  Target: ATXN1; (+) strand; PAM type: YTN; PAM sequence: TTT
cttcaataataaattaaact

SEQ ID NO: 278231 - DNA, 20 bp, Artificial Sequence
  Description of Artificial Sequence: Synthetic oligonucleotide
  Target: ATXN1; (+) strand; PAM type: YTN; PAM sequence: TTC
ttcaataataaattaaactt

SEQ ID NO: 278232 - DNA, 20 bp, Artificial Sequence
  Description of Artificial Sequence: Synthetic oligonucleotide
  Target: ATXN1; (+) strand; PAM type: YTN; PAM sequence: CTT
caataataaattaaacttag

SEQ ID NO: 278233 - DNA, 20 bp, Artificial Sequence
  Description of Artificial Sequence: Synthetic oligonucleotide
  Target: ATXN1; (+) strand; PAM type: YTN; PAM sequence: TTC
aataataaattaaacttagc

SEQ ID NO: 278234 - DNA, 20 bp, Artificial Sequence
  Description of Artificial Sequence: Synthetic oligonucleotide
  Target: ATXN1; (+) strand; PAM type: YTN; PAM sequence: TTA
aacttagcttactgtaactt

SEQ ID NO: 278235 - DNA, 20 bp, Artificial Sequence
  Description of Artificial Sequence: Synthetic oligonucleotide
  Target: ATXN1; (+) strand; PAM type: YTN; PAM sequence: CTT
agcttactgtaactttttta

SEQ ID NO: 278236 - DNA, 20 bp, Artificial Sequence
  Description of Artificial Sequence: Synthetic oligonucleotide
  Target: ATXN1; (+) strand; PAM type: YTN; PAM sequence: TTA
gcttactgtaacttttttac

SEQ ID NO: 278237 - DNA, 20 bp, Artificial Sequence
  Description of Artificial Sequence: Synthetic oligonucleotide
  Target: ATXN1; (+) strand; PAM type: YTN; PAM sequence: CTT
actgtaacttttttacttta

SEQ ID NO: 278238 - DNA, 20 bp, Artificial Sequence
  Description of Artificial Sequence: Synthetic oligonucleotide
  Target: ATXN1; (+) strand; PAM type: YTN; PAM sequence: TTA
ctgtaacttttttactttat

SEQ ID NO: 278239 - DNA, 20 bp, Artificial Sequence
  Description of Artificial Sequence: Synthetic oligonucleotide
  Target: ATXN1; (+) strand; PAM type: YTN; PAM sequence: CTG
taacttttttactttataaa

SEQ ID NO: 278240 - DNA, 20 bp, Artificial Sequence
  Description of Artificial Sequence: Synthetic oligonucleotide
  Target: ATXN1; (+) strand; PAM type: YTN; PAM sequence: CTT
ttttactttataaacacatt

SEQ ID NO: 278241 - DNA, 20 bp, Artificial Sequence
  Description of Artificial Sequence: Synthetic oligonucleotide
  Target: ATXN1; (+) strand; PAM type: YTN; PAM sequence: TTT
tttactttataaacacatta

SEQ ID NO: 278242 - DNA, 20 bp, Artificial Sequence
  Description of Artificial Sequence: Synthetic oligonucleotide
  Target: ATXN1; (+) strand; PAM type: YTN; PAM sequence: TTT
ttactttataaacacattat

SEQ ID NO: 278243 - DNA, 20 bp, Artificial Sequence
  Description of Artificial Sequence: Synthetic oligonucleotide
  Target: ATXN1; (+) strand; PAM type: YTN; PAM sequence: TTT
tactttataaacacattatt

SEQ ID NO: 278244 - DNA, 20 bp, Artificial Sequence
  Description of Artificial Sequence: Synthetic oligonucleotide
  Target: ATXN1; (+) strand; PAM type: YTN; PAM sequence: TTT
actttataaacacattattt

SEQ ID NO: 278245 - DNA, 20 bp, Artificial Sequence
  Description of Artificial Sequence: Synthetic oligonucleotide
  Target: ATXN1; (+) strand; PAM type: YTN; PAM sequence: TTA
ctttataaacacattattta

SEQ ID NO: 278246 - DNA, 20 bp, Artificial Sequence
  Description of Artificial Sequence: Synthetic oligonucleotide
  Target: ATXN1; (+) strand; PAM type: YTN; PAM sequence: CTT
tataaacacattatttaaaa

SEQ ID NO: 278247 - DNA, 20 bp, Artificial Sequence
  Description of Artificial Sequence: Synthetic oligonucleotide
  Target: ATXN1; (+) strand; PAM type: YTN; PAM sequence: TTT
ataaacacattatttaaaac

SEQ ID NO: 278248 - DNA, 20 bp, Artificial Sequence
  Description of Artificial Sequence: Synthetic oligonucleotide
  Target: ATXN1; (+) strand; PAM type: YTN; PAM sequence: TTA
taaacacattatttaaaact

SEQ ID NO: 278249 - DNA, 20 bp, Artificial Sequence
  Description of Artificial Sequence: Synthetic oligonucleotide
  Target: ATXN1; (+) strand; PAM type: YTN; PAM sequence: TTA
tttaaaacttttcgactctt

SEQ ID NO: 278250 - DNA, 20 bp, Artificial Sequence
  Description of Artificial Sequence: Synthetic oligonucleotide
  Target: ATXN1; (+) strand; PAM type: YTN; PAM sequence: TTT
aaaacttttcgactcttgta

SEQ ID NO: 278251 - DNA, 20 bp, Artificial Sequence
  Description of Artificial Sequence: Synthetic oligonucleotide
  Target: ATXN1; (+) strand; PAM type: YTN; PAM sequence: TTA
aaacttttcgactcttgtaa

SEQ ID NO: 278252 - DNA, 20 bp, Artificial Sequence
  Description of Artificial Sequence: Synthetic oligonucleotide
  Target: ATXN1; (+) strand; PAM type: YTN; PAM sequence: CTT
ttcgactcttgtaataatac

SEQ ID NO: 278253 - DNA, 20 bp, Artificial Sequence
  Description of Artificial Sequence: Synthetic oligonucleotide
  Target: ATXN1; (+) strand; PAM type: YTN; PAM sequence: TTT
tcgactcttgtaataatact

SEQ ID NO: 278254 - DNA, 20 bp, Artificial Sequence
  Description of Artificial Sequence: Synthetic oligonucleotide
  Target: ATXN1; (+) strand; PAM type: YTN; PAM sequence: TTT
cgactcttgtaataatactt

SEQ ID NO: 278255 - DNA, 20 bp, Artificial Sequence
  Description of Artificial Sequence: Synthetic oligonucleotide
  Target: ATXN1; (+) strand; PAM type: YTN; PAM sequence: TTC
gactcttgtaataatactta

SEQ ID NO: 278256 - DNA, 20 bp, Artificial Sequence
  Description of Artificial Sequence: Synthetic oligonucleotide
  Target: ATXN1; (+) strand; PAM type: YTN; PAM sequence: CTC
ttgtaataatacttagctta

SEQ ID NO: 278257 - DNA, 20 bp, Artificial Sequence
  Description of Artificial Sequence: Synthetic oligonucleotide
  Target: ATXN1; (+) strand; PAM type: YTN; PAM sequence: CTT
gtaataatacttagcttaaa

SEQ ID NO: 278258 - DNA, 20 bp, Artificial Sequence
  Description of Artificial Sequence: Synthetic oligonucleotide
  Target: ATXN1; (+) strand; PAM type: YTN; PAM sequence: TTG
taataatacttagcttaaaa

SEQ ID NO: 278259 - DNA, 20 bp, Artificial Sequence
  Description of Artificial Sequence: Synthetic oligonucleotide
  Target: ATXN1; (+) strand; PAM type: YTN; PAM sequence: CTT
agcttaaaacatcatccact

SEQ ID NO: 278260 - DNA, 20 bp, Artificial Sequence
  Description of Artificial Sequence: Synthetic oligonucleotide
  Target: ATXN1; (+) strand; PAM type: YTN; PAM sequence: TTA
gcttaaaacatcatccactt

SEQ ID NO: 278261 - DNA, 20 bp, Artificial Sequence
  Description of Artificial Sequence: Synthetic oligonucleotide
  Target: ATXN1; (+) strand; PAM type: YTN; PAM sequence: CTT
aaaacatcatccactttaaa

SEQ ID NO: 278262 - DNA, 20 bp, Artificial Sequence
  Description of Artificial Sequence: Synthetic oligonucleotide
  Target: ATXN1; (+) strand; PAM type: YTN; PAM sequence: TTA
aaacatcatccactttaaag

SEQ ID NO: 278263 - DNA, 20 bp, Artificial Sequence
  Description of Artificial Sequence: Synthetic oligonucleotide
  Target: ATXN1; (+) strand; PAM type: YTN; PAM sequence: CTT
taaagttgtacgaaaatatt

SEQ ID NO: 278264 - DNA, 20 bp, Artificial Sequence
  Description of Artificial Sequence: Synthetic oligonucleotide
  Target: ATXN1; (+) strand; PAM type: YTN; PAM sequence: TTT
aaagttgtacgaaaatattt

SEQ ID NO: 278265 - DNA, 20 bp, Artificial Sequence
  Description of Artificial Sequence: Synthetic oligonucleotide
  Target: ATXN1; (+) strand; PAM type: YTN; PAM sequence: TTA
aagttgtacgaaaatatttt

SEQ ID NO: 278266 - DNA, 20 bp, Artificial Sequence
  Description of Artificial Sequence: Synthetic oligonucleotide
  Target: ATXN1; (+) strand; PAM type: YTN; PAM sequence: TTG
tacgaaaatattttcttctt

SEQ ID NO: 278267 - DNA, 20 bp, Artificial Sequence
  Description of Artificial Sequence: Synthetic oligonucleotide
  Target: ATXN1; (+) strand; PAM type: YTN; PAM sequence: TTT
tcttcttttatatctttatt

SEQ ID NO: 278268 - DNA, 20 bp, Artificial Sequence
  Description of Artificial Sequence: Synthetic oligonucleotide
  Target: ATXN1; (+) strand; PAM type: YTN; PAM sequence: TTT
cttcttttatatctttattc

SEQ ID NO: 278269 - DNA, 20 bp, Artificial Sequence
  Description of Artificial Sequence: Synthetic oligonucleotide
  Target: ATXN1; (+) strand; PAM type: YTN; PAM sequence: TTC
ttcttttatatctttattca

SEQ ID NO: 278270 - DNA, 20 bp, Artificial Sequence
  Description of Artificial Sequence: Synthetic oligonucleotide
  Target: ATXN1; (+) strand; PAM type: YTN; PAM sequence: CTT
cttttatatctttattcaat

SEQ ID NO: 278271 - DNA, 20 bp, Artificial Sequence
  Description of Artificial Sequence: Synthetic oligonucleotide
  Target: ATXN1; (+) strand; PAM type: YTN; PAM sequence: TTC
ttttatatctttattcaata

SEQ ID NO: 278272 - DNA, 20 bp, Artificial Sequence
  Description of Artificial Sequence: Synthetic oligonucleotide
  Target: ATXN1; (+) strand; PAM type: YTN; PAM sequence: CTT
ttatatctttattcaataaa

SEQ ID NO: 278273 - DNA, 20 bp, Artificial Sequence
  Description of Artificial Sequence: Synthetic oligonucleotide
  Target: ATXN1; (+) strand; PAM type: YTN; PAM sequence: TTT
tatatctttattcaataaac

SEQ ID NO: 278274 - DNA, 20 bp, Artificial Sequence
  Description of Artificial Sequence: Synthetic oligonucleotide
  Target: ATXN1; (+) strand; PAM type: YTN; PAM sequence: TTT
atatctttattcaataaaca

SEQ ID NO: 278275 - DNA, 20 bp, Artificial Sequence
  Description of Artificial Sequence: Synthetic oligonucleotide
  Target: ATXN1; (+) strand; PAM type: YTN; PAM sequence: TTA
tatctttattcaataaacat

SEQ ID NO: 278276 - DNA, 20 bp, Artificial Sequence
  Description of Artificial Sequence: Synthetic oligonucleotide
  Target: ATXN1; (+) strand; PAM type: YTN; PAM sequence: CTT
tattcaataaacatttttct

SEQ ID NO: 278277 - DNA, 20 bp, Artificial Sequence
  Description of Artificial Sequence: Synthetic oligonucleotide
  Target: ATXN1; (+) strand; PAM type: YTN; PAM sequence: TTT
attcaataaacatttttcta

SEQ ID NO: 278278 - DNA, 20 bp, Artificial Sequence
  Description of Artificial Sequence: Synthetic oligonucleotide
  Target: ATXN1; (+) strand; PAM type: YTN; PAM sequence: TTA
ttcaataaacatttttctat

SEQ ID NO: 278279 - DNA, 20 bp, Artificial Sequence
  Description of Artificial Sequence: Synthetic oligonucleotide
  Target: ATXN1; (+) strand; PAM type: YTN; PAM sequence: TTC
aataaacatttttctatttt

SEQ ID NO: 278280 - DNA, 20 bp, Artificial Sequence
  Description of Artificial Sequence: Synthetic oligonucleotide
  Target: ATXN1; (+) strand; PAM type: YTN; PAM sequence: TTT
ttctattttcatttttaaaa

SEQ ID NO: 278281 - DNA, 20 bp, Artificial Sequence
  Description of Artificial Sequence: Synthetic oligonucleotide
  Target: ATXN1; (+) strand; PAM type: YTN; PAM sequence: TTT
tctattttcatttttaaaaa

SEQ ID NO: 278282 - DNA, 20 bp, Artificial Sequence
  Description of Artificial Sequence: Synthetic oligonucleotide
  Target: ATXN1; (+) strand; PAM type: YTN; PAM sequence: TTT
ctattttcatttttaaaaaa

SEQ ID NO: 278283 - DNA, 20 bp, Artificial Sequence
  Description of Artificial Sequence: Synthetic oligonucleotide
  Target: ATXN1; (+) strand; PAM type: YTN; PAM sequence: TTC
tattttcatttttaaaaaat

SEQ ID NO: 278284 - DNA, 20 bp, Artificial Sequence
  Description of Artificial Sequence: Synthetic oligonucleotide
  Target: ATXN1; (+) strand; PAM type: YTN; PAM sequence: CTA
ttttcatttttaaaaaattt

SEQ ID NO: 278285 - DNA, 20 bp, Artificial Sequence
  Description of Artificial Sequence: Synthetic oligonucleotide
  Target: ATXN1; (+) strand; PAM type: YTN; PAM sequence: TTT
tcatttttaaaaaattttaa

SEQ ID NO: 278286 - DNA, 20 bp, Artificial Sequence
  Description of Artificial Sequence: Synthetic oligonucleotide
  Target: ATXN1; (+) strand; PAM type: YTN; PAM sequence: TTT
catttttaaaaaattttaaa

SEQ ID NO: 278287 - DNA, 20 bp, Artificial Sequence
  Description of Artificial Sequence: Synthetic oligonucleotide
  Target: ATXN1; (+) strand; PAM type: YTN; PAM sequence: TTC
atttttaaaaaattttaaac

SEQ ID NO: 278288 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaattttaaactttt

SEQ ID NO: 278289 - DNA, 20 bp, Artificial Sequence
  Description of Artificial Sequence: Synthetic oligonucleotide
  Target: ATXN1; (+) strand; PAM type: YTN; PAM sequence: TTT
taaaaaattttaaacttttt

SEQ ID NO: 278290 - DNA, 20 bp, Artificial Sequence
  Description of Artificial Sequence: Synthetic oligonucleotide
  Target: ATXN1; (+) strand; PAM type: YTN; PAM sequence: TTT
aaaaaattttaaactttttt

SEQ ID NO: 278291 - DNA, 20 bp, Artificial Sequence
  Description of Artificial Sequence: Synthetic oligonucleotide
  Target: ATXN1; (+) strand; PAM type: YTN; PAM sequence: TTA
aaaaattttaaacttttttt

SEQ ID NO: 278292 - DNA, 20 bp, Artificial Sequence
  Description of Artificial Sequence: Synthetic oligonucleotide
  Target: ATXN1; (+) strand; PAM type: YTN; PAM sequence: TTT
taaacttttttttttaaaac

SEQ ID NO: 278293 - DNA, 20 bp, Artificial Sequence
  Description of Artificial Sequence: Synthetic oligonucleotide
  Target: ATXN1; (+) strand; PAM type: YTN; PAM sequence: TTT
aaacttttttttttaaaaca

SEQ ID NO: 278294 - DNA, 20 bp, Artificial Sequence
  Description of Artificial Sequence: Synthetic oligonucleotide
  Target: ATXN1; (+) strand; PAM type: YTN; PAM sequence: TTA
aacttttttttttaaaacaa

SEQ ID NO: 278295 - DNA, 20 bp, Artificial Sequence
  Description of Artificial Sequence: Synthetic oligonucleotide
  Target: ATXN1; (+) strand; PAM type: YTN; PAM sequence: CTT
ttttttttaaaacaatacta

SEQ ID NO: 278296 - DNA, 20 bp, Artificial Sequence
  Description of Artificial Sequence: Synthetic oligonucleotide
  Target: ATXN1; (+) strand; PAM type: YTN; PAM sequence: TTT
tttttttaaaacaatactaa

SEQ ID NO: 278297 - DNA, 20 bp, Artificial Sequence
  Description of Artificial Sequence: Synthetic oligonucleotide
  Target: ATXN1; (+) strand; PAM type: YTN; PAM sequence: TTT
ttttttaaaacaatactaag

SEQ ID NO: 278298 - DNA, 20 bp, Artificial Sequence
  Description of Artificial Sequence: Synthetic oligonucleotide
  Target: ATXN1; (+) strand; PAM type: YTN; PAM sequence: TTT
tttttaaaacaatactaagg

SEQ ID NO: 278299 - DNA, 20 bp, Artificial Sequence
  Description of Artificial Sequence: Synthetic oligonucleotide
  Target: ATXN1; (+) strand; PAM type: YTN; PAM sequence: TTT
ttttaaaacaatactaaggc

SEQ ID NO: 278300 - DNA, 20 bp, Artificial Sequence
  Description of Artificial Sequence: Synthetic oligonucleotide
  Target: ATXN1; (+) strand; PAM type: YTN; PAM sequence: TTT
tttaaaacaatactaaggca

SEQ ID NO: 278301 - DNA, 20 bp, Artificial Sequence
  Description of Artificial Sequence: Synthetic oligonucleotide
  Target: ATXN1; (+) strand; PAM type: YTN; PAM sequence: TTT
ttaaaacaatactaaggcag

SEQ ID NO: 278302 - DNA, 20 bp, Artificial Sequence
  Description of Artificial Sequence: Synthetic oligonucleotide
  Target: ATXN1; (+) strand; PAM type: YTN; PAM sequence: TTT
taaaacaatactaaggcagg

SEQ ID NO: 278303 - DNA, 20 bp, Artificial Sequence
  Description of Artificial Sequence: Synthetic oligonucleotide
  Target: ATXN1; (+) strand; PAM type: YTN; PAM sequence: TTT
aaaacaatactaaggcagga

SEQ ID NO: 278304 - DNA, 20 bp, Artificial Sequence
  Description of Artificial Sequence: Synthetic oligonucleotide
  Target: ATXN1; (+) strand; PAM type: YTN; PAM sequence: TTA
aaacaatactaaggcaggag

SEQ ID NO: 278305 - DNA, 20 bp, Artificial Sequence
  Description of Artificial Sequence: Synthetic oligonucleotide
  Target: ATXN1; (+) strand; PAM type: YTN; PAM sequence: CTA
aggcaggagcagtggtgcac

SEQ ID NO: 278306 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 278307 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggtgg

SEQ ID NO: 278308 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggtgga

SEQ ID NO: 278309 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggtggat

SEQ ID NO: 278310 - DNA, 20 bp, Artificial Sequence
  Description of Artificial Sequence: Synthetic oligonucleotide
  Target: ATXN1; (+) strand; PAM type: YTN; PAM sequence: TTG
cttgaggccaggagtttgag

SEQ ID NO: 278311 - DNA, 20 bp, Artificial Sequence
  Description of Artificial Sequence: Synthetic oligonucleotide
  Target: ATXN1; (+) strand; PAM type: YTN; PAM sequence: CTT
gaggccaggagtttgagacc

SEQ ID NO: 278312 - DNA, 20 bp, Artificial Sequence
  Description of Artificial Sequence: Synthetic oligonucleotide
  Target: ATXN1; (+) strand; PAM type: YTN; PAM sequence: TTG
aggccaggagtttgagacca

SEQ ID NO: 278313 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctgaccaacag

SEQ ID NO: 278314 - DNA, 20 bp, Artificial Sequence
  Description of Artificial Sequence: Synthetic oligonucleotide
  Target: ATXN1; (+) strand; PAM type: YTN; PAM sequence: TTG
agaccagcctgaccaacaga

SEQ ID NO: 278315 - DNA, 20 bp, Artificial Sequence
  Description of Artificial Sequence: Synthetic oligonucleotide
  Target: ATXN1; (+) strand; PAM type: YTN; PAM sequence: CTG
accaacagagtaaaactccg

SEQ ID NO: 278316 - DNA, 20 bp, Artificial Sequence
  Description of Artificial Sequence: Synthetic oligonucleotide
  Target: ATXN1; (+) strand; PAM type: YTN; PAM sequence: CTC
cgtctctgctaaaaatacaa

SEQ ID NO: 278317 - DNA, 20 bp, Artificial Sequence
  Description of Artificial Sequence: Synthetic oligonucleotide
  Target: ATXN1; (+) strand; PAM type: YTN; PAM sequence: CTC
tgctaaaaatacaaaaatta

SEQ ID NO: 278318 - DNA, 20 bp, Artificial Sequence
  Description of Artificial Sequence: Synthetic oligonucleotide
  Target: ATXN1; (+) strand; PAM type: YTN; PAM sequence: CTG
ctaaaaatacaaaaattagc

SEQ ID NO: 278319 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccgg

SEQ ID NO: 278320 - DNA, 20 bp, Artificial Sequence
  Description of Artificial Sequence: Synthetic oligonucleotide
  Target: ATXN1; (+) strand; PAM type: YTN; PAM sequence: TTA
gccggcgtggtggtgcatgc

SEQ ID NO: 278321 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcaggag

SEQ ID NO: 278322 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 278323 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 278324 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcttgaa

SEQ ID NO: 278325 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcagaggtt

SEQ ID NO: 278326 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcagaggttg

SEQ ID NO: 278327 - DNA, 20 bp, Artificial Sequence
  Description of Artificial Sequence: Synthetic oligonucleotide
  Target: ATXN1; (+) strand; PAM type: YTN; PAM sequence: TTG
cagtgagcagagattgcacc

SEQ ID NO: 278328 - DNA, 20 bp, Artificial Sequence
  Description of Artificial Sequence: Synthetic oligonucleotide
  Target: ATXN1; (+) strand; PAM type: YTN; PAM sequence: TTG
caccactgcactccagcctg

SEQ ID NO: 278329 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacaa

SEQ ID NO: 278330 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacaaagtaa

SEQ ID NO: 278331 - DNA, 20 bp, Artificial Sequence
  Description of Artificial Sequence: Synthetic oligonucleotide
  Target: ATXN1; (+) strand; PAM type: YTN; PAM sequence: CTG
ggcgacaaagtaaggctgtc

SEQ ID NO: 278332 - DNA, 20 bp, Artificial Sequence
  Description of Artificial Sequence: Synthetic oligonucleotide
  Target: ATXN1; (+) strand; PAM type: YTN; PAM sequence: CTG
tctcaataaataaataaata

SEQ ID NO: 278333 - DNA, 20 bp, Artificial Sequence
  Description of Artificial Sequence: Synthetic oligonucleotide
  Target: ATXN1; (+) strand; PAM type: YTN; PAM sequence: CTC
aataaataaataaatacata

SEQ ID NO: 278334 - DNA, 20 bp, Artificial Sequence
  Description of Artificial Sequence: Synthetic oligonucleotide
  Target: ATXN1; (+) strand; PAM type: YTN; PAM sequence: CTA
agaaacaaacacgcattagt

SEQ ID NO: 278335 - DNA, 20 bp, Artificial Sequence
  Description of Artificial Sequence: Synthetic oligonucleotide
  Target: ATXN1; (+) strand; PAM type: YTN; PAM sequence: TTA
gtctaggcctatacagggtc

SEQ ID NO: 278336 - DNA, 20 bp, Artificial Sequence
  Description of Artificial Sequence: Synthetic oligonucleotide
  Target: ATXN1; (+) strand; PAM type: YTN; PAM sequence: CTA
ggcctatacagggtcaggat

SEQ ID NO: 278337 - DNA, 20 bp, Artificial Sequence
  Description of Artificial Sequence: Synthetic oligonucleotide
  Target: ATXN1; (+) strand; PAM type: YTN; PAM sequence: CTA
tacagggtcaggatcattca

SEQ ID NO: 278338 - DNA, 20 bp, Artificial Sequence
  Description of Artificial Sequence: Synthetic oligonucleotide
  Target: ATXN1; (+) strand; PAM type: YTN; PAM sequence: TTC
atatcacctctacctccaca

SEQ ID NO: 278339 - DNA, 20 bp, Artificial Sequence
  Description of Artificial Sequence: Synthetic oligonucleotide
  Target: ATXN1; (+) strand; PAM type: YTN; PAM sequence: CTC
tacctccacatcttgtccca

SEQ ID NO: 278340 - DNA, 20 bp, Artificial Sequence
  Description of Artificial Sequence: Synthetic oligonucleotide
  Target: ATXN1; (+) strand; PAM type: YTN; PAM sequence: CTA
cctccacatcttgtcccact

SEQ ID NO: 278341 - DNA, 20 bp, Artificial Sequence
  Description of Artificial Sequence: Synthetic oligonucleotide
  Target: ATXN1; (+) strand; PAM type: YTN; PAM sequence: CTC
cacatcttgtcccactgaga

SEQ ID NO: 278342 - DNA, 20 bp, Artificial Sequence
  Description of Artificial Sequence: Synthetic oligonucleotide
  Target: ATXN1; (+) strand; PAM type: YTN; PAM sequence: CTT
gtcccactgagaggtcttca

SEQ ID NO: 278343 - DNA, 20 bp, Artificial Sequence
  Description of Artificial Sequence: Synthetic oligonucleotide
  Target: ATXN1; (+) strand; PAM type: YTN; PAM sequence: TTG
tcccactgagaggtcttcag

SEQ ID NO: 278344 - DNA, 20 bp, Artificial Sequence
  Description of Artificial Sequence: Synthetic oligonucleotide
  Target: ATXN1; (+) strand; PAM type: YTN; PAM sequence: CTG
agaggtcttcagggcaataa

SEQ ID NO: 278345 - DNA, 20 bp, Artificial Sequence
  Description of Artificial Sequence: Synthetic oligonucleotide
  Target: ATXN1; (+) strand; PAM type: YTN; PAM sequence: CTT
cagggcaataacacacatgg

SEQ ID NO: 278346 - DNA, 20 bp, Artificial Sequence
  Description of Artificial Sequence: Synthetic oligonucleotide
  Target: ATXN1; (+) strand; PAM type: YTN; PAM sequence: TTC
agggcaataacacacatgga

SEQ ID NO: 278347 - DNA, 20 bp, Artificial Sequence
  Description of Artificial Sequence: Synthetic oligonucleotide
  Target: ATXN1; (+) strand; PAM type: YTN; PAM sequence: CTG
tcatctcctatgacaacagt

SEQ ID NO: 278348 - DNA, 20 bp, Artificial Sequence
  Description of Artificial Sequence: Synthetic oligonucleotide
  Target: ATXN1; (+) strand; PAM type: YTN; PAM sequence: CTC
ctatgacaacagtgccttct

SEQ ID NO: 278349 - DNA, 20 bp, Artificial Sequence
  Description of Artificial Sequence: Synthetic oligonucleotide
  Target: ATXN1; (+) strand; PAM type: YTN; PAM sequence: CTA
tgacaacagtgccttcttct

SEQ ID NO: 278350 - DNA, 20 bp, Artificial Sequence
  Description of Artificial Sequence: Synthetic oligonucleotide
  Target: ATXN1; (+) strand; PAM type: YTN; PAM sequence: CTT
cttcttacacatctatggaa

SEQ ID NO: 278351 - DNA, 20 bp, Artificial Sequence
  Description of Artificial Sequence: Synthetic oligonucleotide
  Target: ATXN1; (+) strand; PAM type: YTN; PAM sequence: TTC
ttcttacacatctatggaag

SEQ ID NO: 278352 - DNA, 20 bp, Artificial Sequence
  Description of Artificial Sequence: Synthetic oligonucleotide
  Target: ATXN1; (+) strand; PAM type: YTN; PAM sequence: CTT
cttacacatctatggaagga

SEQ ID NO: 278353 - DNA, 20 bp, Artificial Sequence
  Description of Artificial Sequence: Synthetic oligonucleotide
  Target: ATXN1; (+) strand; PAM type: YTN; PAM sequence: TTC
ttacacatctatggaaggac

SEQ ID NO: 278354 - DNA, 20 bp, Artificial Sequence
  Description of Artificial Sequence: Synthetic oligonucleotide
  Target: ATXN1; (+) strand; PAM type: YTN; PAM sequence: CTT
acacatctatggaaggacct

SEQ ID NO: 278355 - DNA, 20 bp, Artificial Sequence
  Description of Artificial Sequence: Synthetic oligonucleotide
  Target: ATXN1; (+) strand; PAM type: YTN; PAM sequence: TTA
cacatctatggaaggacctg

SEQ ID NO: 278356 - DNA, 20 bp, Artificial Sequence
  Description of Artificial Sequence: Synthetic oligonucleotide
  Target: ATXN1; (+) strand; PAM type: YTN; PAM sequence: CTA
tggaaggacctgcctgaagt

SEQ ID NO: 278357 - DNA, 20 bp, Artificial Sequence
  Description of Artificial Sequence: Synthetic oligonucleotide
  Target: ATXN1; (+) strand; PAM type: YTN; PAM sequence: CTG
cctgaagttggtttgcagtt

SEQ ID NO: 278358 - DNA, 20 bp, Artificial Sequence
  Description of Artificial Sequence: Synthetic oligonucleotide
  Target: ATXN1; (+) strand; PAM type: YTN; PAM sequence: CTG
aagttggtttgcagttaact

SEQ ID NO: 278359 - DNA, 20 bp, Artificial Sequence
  Description of Artificial Sequence: Synthetic oligonucleotide
  Target: ATXN1; (+) strand; PAM type: YTN; PAM sequence: TTG
gtttgcagttaacttttttt

SEQ ID NO: 278360 - DNA, 20 bp, Artificial Sequence
  Description of Artificial Sequence: Synthetic oligonucleotide
  Target: ATXN1; (+) strand; PAM type: YTN; PAM sequence: TTT
gcagttaacttttttttttt

SEQ ID NO: 278361 - DNA, 20 bp, Artificial Sequence
  Description of Artificial Sequence: Synthetic oligonucleotide
  Target: ATXN1; (+) strand; PAM type: YTN; PAM sequence: TTG
cagttaactttttttttttt

SEQ ID NO: 278362 - DNA, 20 bp, Artificial Sequence
  Description of Artificial Sequence: Synthetic oligonucleotide
  Target: ATXN1; (+) strand; PAM type: YTN; PAM sequence: TTA
acttttttttttttaaataa

SEQ ID NO: 278363 - DNA, 20 bp, Artificial Sequence
  Description of Artificial Sequence: Synthetic oligonucleotide
  Target: ATXN1; (+) strand; PAM type: YTN; PAM sequence: CTT
ttttttttttaaataagtag

SEQ ID NO: 278364 - DNA, 20 bp, Artificial Sequence
  Description of Artificial Sequence: Synthetic oligonucleotide
  Target: ATXN1; (+) strand; PAM type: YTN; PAM sequence: TTT
tttttttttaaataagtaga

SEQ ID NO: 278365 - DNA, 20 bp, Artificial Sequence
  Description of Artificial Sequence: Synthetic oligonucleotide
  Target: ATXN1; (+) strand; PAM type: YTN; PAM sequence: TTT
ttttttttaaataagtagaa

SEQ ID NO: 278366 - DNA, 20 bp, Artificial Sequence
  Description of Artificial Sequence: Synthetic oligonucleotide
  Target: ATXN1; (+) strand; PAM type: YTN; PAM sequence: TTT
tttttttaaataagtagaag

SEQ ID NO: 278367 - DNA, 20 bp, Artificial Sequence
  Description of Artificial Sequence: Synthetic oligonucleotide
  Target: ATXN1; (+) strand; PAM type: YTN; PAM sequence: TTT
ttttttaaataagtagaaga

SEQ ID NO: 278368 - DNA, 20 bp, Artificial Sequence
  Description of Artificial Sequence: Synthetic oligonucleotide
  Target: ATXN1; (+) strand; PAM type: YTN; PAM sequence: TTT
tttttaaataagtagaagaa

SEQ ID NO: 278369 - DNA, 20 bp, Artificial Sequence
  Description of Artificial Sequence: Synthetic oligonucleotide
  Target: ATXN1; (+) strand; PAM type: YTN; PAM sequence: TTT
ttttaaataagtagaagaaa

SEQ ID NO: 278370 - DNA, 20 bp, Artificial Sequence
  Description of Artificial Sequence: Synthetic oligonucleotide
  Target: ATXN1; (+) strand; PAM type: YTN; PAM sequence: TTT
tttaaataagtagaagaaat

SEQ ID NO: 278371 - DNA, 20 bp, Artificial Sequence
  Description of Artificial Sequence: Synthetic oligonucleotide
  Target: ATXN1; (+) strand; PAM type: YTN; PAM sequence: TTT
ttaaataagtagaagaaata

SEQ ID NO: 278372 - DNA, 20 bp, Artificial Sequence
  Description of Artificial Sequence: Synthetic oligonucleotide
  Target: ATXN1; (+) strand; PAM type: YTN; PAM sequence: TTT
taaataagtagaagaaatac

SEQ ID NO: 278373 - DNA, 20 bp, Artificial Sequence
  Description of Artificial Sequence: Synthetic oligonucleotide
  Target: ATXN1; (+) strand; PAM type: YTN; PAM sequence: TTT
aaataagtagaagaaataca

SEQ ID NO: 278374 - DNA, 20 bp, Artificial Sequence
  Description of Artificial Sequence: Synthetic oligonucleotide
  Target: ATXN1; (+) strand; PAM type: YTN; PAM sequence: TTA
aataagtagaagaaatacag

SEQ ID NO: 278375 - DNA, 20 bp, Artificial Sequence
  Description of Artificial Sequence: Synthetic oligonucleotide
  Target: ATXN1; (+) strand; PAM type: YTN; PAM sequence: CTA
aaacaatgatcaaaagtata

SEQ ID NO: 278376 - DNA, 20 bp, Artificial Sequence
  Description of Artificial Sequence: Synthetic oligonucleotide
  Target: ATXN1; (+) strand; PAM type: YTN; PAM sequence: TTG
tttattaccattatcaagca

SEQ ID NO: 278377 - DNA, 20 bp, Artificial Sequence
  Description of Artificial Sequence: Synthetic oligonucleotide
  Target: ATXN1; (+) strand; PAM type: YTN; PAM sequence: TTT
attaccattatcaagcatta

SEQ ID NO: 278378 - DNA, 20 bp, Artificial Sequence
  Description of Artificial Sequence: Synthetic oligonucleotide
  Target: ATXN1; (+) strand; PAM type: YTN; PAM sequence: TTA
ttaccattatcaagcattat

SEQ ID NO: 278379 - DNA, 20 bp, Artificial Sequence
  Description of Artificial Sequence: Synthetic oligonucleotide
  Target: ATXN1; (+) strand; PAM type: YTN; PAM sequence: TTA
ccattatcaagcattatgtg

SEQ ID NO: 278380 - DNA, 20 bp, Artificial Sequence
  Description of Artificial Sequence: Synthetic oligonucleotide
  Target: ATXN1; (+) strand; PAM type: YTN; PAM sequence: TTA
tcaagcattatgtgctgtac

SEQ ID NO: 278381 - DNA, 20 bp, Artificial Sequence
  Description of Artificial Sequence: Synthetic oligonucleotide
  Target: ATXN1; (+) strand; PAM type: YTN; PAM sequence: TTA
tgtgctgtaccgaattgcat

SEQ ID NO: 278382 - DNA, 20 bp, Artificial Sequence
  Description of Artificial Sequence: Synthetic oligonucleotide
  Target: ATXN1; (+) strand; PAM type: YTN; PAM sequence: CTG
taccgaattgcatgtgctct

SEQ ID NO: 278383 - DNA, 20 bp, Artificial Sequence
  Description of Artificial Sequence: Synthetic oligonucleotide
  Target: ATXN1; (+) strand; PAM type: YTN; PAM sequence: TTG
catgtgctctactcttacat

SEQ ID NO: 278384 - DNA, 20 bp, Artificial Sequence
  Description of Artificial Sequence: Synthetic oligonucleotide
  Target: ATXN1; (+) strand; PAM type: YTN; PAM sequence: CTC
tactcttacatgactggcag

SEQ ID NO: 278385 - DNA, 20 bp, Artificial Sequence
  Description of Artificial Sequence: Synthetic oligonucleotide
  Target: ATXN1; (+) strand; PAM type: YTN; PAM sequence: CTA
ctcttacatgactggcagca

SEQ ID NO: 278386 - DNA, 20 bp, Artificial Sequence
  Description of Artificial Sequence: Synthetic oligonucleotide
  Target: ATXN1; (+) strand; PAM type: YTN; PAM sequence: CTC
ttacatgactggcagcacag

SEQ ID NO: 278387 - DNA, 20 bp, Artificial Sequence
  Description of Artificial Sequence: Synthetic oligonucleotide
  Target: ATXN1; (+) strand; PAM type: YTN; PAM sequence: CTT
acatgactggcagcacagta

SEQ ID NO: 278388 - DNA, 20 bp, Artificial Sequence
  Description of Artificial Sequence: Synthetic oligonucleotide
  Target: ATXN1; (+) strand; PAM type: YTN; PAM sequence: TTA
catgactggcagcacagtag

SEQ ID NO: 278389 - DNA, 20 bp, Artificial Sequence
  Description of Artificial Sequence: Synthetic oligonucleotide
  Target: ATXN1; (+) strand; PAM type: YTN; PAM sequence: CTG
gcagcacagtagggttgcag

SEQ ID NO: 278390 - DNA, 20 bp, Artificial Sequence
  Description of Artificial Sequence: Synthetic oligonucleotide
  Target: ATXN1; (+) strand; PAM type: YTN; PAM sequence: TTG
cagcatcacagcaaacatat

SEQ ID NO: 278391 - DNA, 20 bp, Artificial Sequence
  Description of Artificial Sequence: Synthetic oligonucleotide
  Target: ATXN1; (+) strand; PAM type: YTN; PAM sequence: TTG
cactaggacattacaatggc

SEQ ID NO: 278392 - DNA, 20 bp, Artificial Sequence
  Description of Artificial Sequence: Synthetic oligonucleotide
  Target: ATXN1; (+) strand; PAM type: YTN; PAM sequence: CTA
ggacattacaatggctacaa

SEQ ID NO: 278393 - DNA, 20 bp, Artificial Sequence
  Description of Artificial Sequence: Synthetic oligonucleotide
  Target: ATXN1; (+) strand; PAM type: YTN; PAM sequence: TTA
caatggctacaacattacta

SEQ ID NO: 278394 - DNA, 20 bp, Artificial Sequence
  Description of Artificial Sequence: Synthetic oligonucleotide
  Target: ATXN1; (+) strand; PAM type: YTN; PAM sequence: CTA
caacattactaggcgataaa

SEQ ID NO: 278395 - DNA, 20 bp, Artificial Sequence
  Description of Artificial Sequence: Synthetic oligonucleotide
  Target: ATXN1; (+) strand; PAM type: YTN; PAM sequence: TTA
ctaggcgataaaaattcttc

SEQ ID NO: 278396 - DNA, 20 bp, Artificial Sequence
  Description of Artificial Sequence: Synthetic oligonucleotide
  Target: ATXN1; (+) strand; PAM type: YTN; PAM sequence: CTA
ggcgataaaaattcttcagc

SEQ ID NO: 278397 - DNA, 20 bp, Artificial Sequence
  Description of Artificial Sequence: Synthetic oligonucleotide
  Target: ATXN1; (+) strand; PAM type: YTN; PAM sequence: TTC
ttcagcttcattataatctt

SEQ ID NO: 278398 - DNA, 20 bp, Artificial Sequence
  Description of Artificial Sequence: Synthetic oligonucleotide
  Target: ATXN1; (+) strand; PAM type: YTN; PAM sequence: CTT
cagcttcattataatcttat

SEQ ID NO: 278399 - DNA, 20 bp, Artificial Sequence
  Description of Artificial Sequence: Synthetic oligonucleotide
  Target: ATXN1; (+) strand; PAM type: YTN; PAM sequence: TTC
agcttcattataatcttatg

SEQ ID NO: 278400 - DNA, 20 bp, Artificial Sequence
  Description of Artificial Sequence: Synthetic oligonucleotide
  Target: ATXN1; (+) strand; PAM type: YTN; PAM sequence: CTT
cattataatcttatgggact

SEQ ID NO: 278401 - DNA, 20 bp, Artificial Sequence
  Description of Artificial Sequence: Synthetic oligonucleotide
  Target: ATXN1; (+) strand; PAM type: YTN; PAM sequence: TTC
attataatcttatgggacta

SEQ ID NO: 278402 - DNA, 20 bp, Artificial Sequence
  Description of Artificial Sequence: Synthetic oligonucleotide
  Target: ATXN1; (+) strand; PAM type: YTN; PAM sequence: TTA
taatcttatgggactatcat

SEQ ID NO: 278403 - DNA, 20 bp, Artificial Sequence
  Description of Artificial Sequence: Synthetic oligonucleotide
  Target: ATXN1; (+) strand; PAM type: YTN; PAM sequence: CTT
atgggactatcatgatatat

SEQ ID NO: 278404 - DNA, 20 bp, Artificial Sequence
  Description of Artificial Sequence: Synthetic oligonucleotide
  Target: ATXN1; (+) strand; PAM type: YTN; PAM sequence: TTA
tgggactatcatgatatatg

SEQ ID NO: 278405 - DNA, 20 bp, Artificial Sequence
  Description of Artificial Sequence: Synthetic oligonucleotide
  Target: ATXN1; (+) strand; PAM type: YTN; PAM sequence: CTA
tcatgatatatgtgacccac

SEQ ID NO: 278406 - DNA, 20 bp, Artificial Sequence
  Description of Artificial Sequence: Synthetic oligonucleotide
  Target: ATXN1; (+) strand; PAM type: YTN; PAM sequence: CTG
ttgacccaaatgtcgttatg

SEQ ID NO: 278407 - DNA, 20 bp, Artificial Sequence
  Description of Artificial Sequence: Synthetic oligonucleotide
  Target: ATXN1; (+) strand; PAM type: YTN; PAM sequence: TTG
acccaaatgtcgttatgcgg

SEQ ID NO: 278408 - DNA, 20 bp, Artificial Sequence
  Description of Artificial Sequence: Synthetic oligonucleotide
  Target: ATXN1; (+) strand; PAM type: YTN; PAM sequence: TTA
tgcggcacatggctgtaaaa

SEQ ID NO: 278409 - DNA, 20 bp, Artificial Sequence
  Description of Artificial Sequence: Synthetic oligonucleotide
  Target: ATXN1; (+) strand; PAM type: YTN; PAM sequence: CTG
taaaaagccataagtgaggg

SEQ ID NO: 278410 - DNA, 20 bp, Artificial Sequence
  Description of Artificial Sequence: Synthetic oligonucleotide
  Target: ATXN1; (+) strand; PAM type: YTN; PAM sequence: CTC
ccatataggtgtctgttgtc

SEQ ID NO: 278411 - DNA, 20 bp, Artificial Sequence
  Description of Artificial Sequence: Synthetic oligonucleotide
  Target: ATXN1; (+) strand; PAM type: YTN; PAM sequence: CTG
ttgtcccacagaggatacca

SEQ ID NO: 278412 - DNA, 20 bp, Artificial Sequence
  Description of Artificial Sequence: Synthetic oligonucleotide
  Target: ATXN1; (+) strand; PAM type: YTN; PAM sequence: TTG
tcccacagaggataccaccg

SEQ ID NO: 278413 - DNA, 20 bp, Artificial Sequence
  Description of Artificial Sequence: Synthetic oligonucleotide
  Target: ATXN1; (+) strand; PAM type: YTN; PAM sequence: TTG
tccactactgcttaaagggc

SEQ ID NO: 278414 - DNA, 20 bp, Artificial Sequence
  Description of Artificial Sequence: Synthetic oligonucleotide
  Target: ATXN1; (+) strand; PAM type: YTN; PAM sequence: CTA
ctgcttaaagggcacattca

SEQ ID NO: 278415 - DNA, 20 bp, Artificial Sequence
  Description of Artificial Sequence: Synthetic oligonucleotide
  Target: ATXN1; (+) strand; PAM type: YTN; PAM sequence: CTG
cttaaagggcacattcaaga

SEQ ID NO: 278416 - DNA, 20 bp, Artificial Sequence
  Description of Artificial Sequence: Synthetic oligonucleotide
  Target: ATXN1; (+) strand; PAM type: YTN; PAM sequence: CTT
aaagggcacattcaagaata

SEQ ID NO: 278417 - DNA, 20 bp, Artificial Sequence
  Description of Artificial Sequence: Synthetic oligonucleotide
  Target: ATXN1; (+) strand; PAM type: YTN; PAM sequence: TTA
aagggcacattcaagaatag

SEQ ID NO: 278418 - DNA, 20 bp, Artificial Sequence
  Description of Artificial Sequence: Synthetic oligonucleotide
  Target: ATXN1; (+) strand; PAM type: YTN; PAM sequence: TTC
aagaataggcatgctggcca

SEQ ID NO: 278419 - DNA, 20 bp, Artificial Sequence
  Description of Artificial Sequence: Synthetic oligonucleotide
  Target: ATXN1; (+) strand; PAM type: YTN; PAM sequence: CTG
gccaggtgcagcggcttacg

SEQ ID NO: 278420 - DNA, 20 bp, Artificial Sequence
  Description of Artificial Sequence: Synthetic oligonucleotide
  Target: ATXN1; (+) strand; PAM type: YTN; PAM sequence: CTT
acgcctgtaatcccagcact

SEQ ID NO: 278421 - DNA, 20 bp, Artificial Sequence
  Description of Artificial Sequence: Synthetic oligonucleotide
  Target: ATXN1; (+) strand; PAM type: YTN; PAM sequence: TTA
cgcctgtaatcccagcactt

SEQ ID NO: 278422 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 278423 - DNA, 20 bp, Artificial Sequence
  Description of Artificial Sequence: Synthetic oligonucleotide
  Target: ATXN1; (+) strand; PAM type: YTN; PAM sequence: CTT
tgggaggcagagatgggcgg

SEQ ID NO: 278424 - DNA, 20 bp, Artificial Sequence
  Description of Artificial Sequence: Synthetic oligonucleotide
  Target: ATXN1; (+) strand; PAM type: YTN; PAM sequence: TTT
gggaggcagagatgggcgga

SEQ ID NO: 278425 - DNA, 20 bp, Artificial Sequence
  Description of Artificial Sequence: Synthetic oligonucleotide
  Target: ATXN1; (+) strand; PAM type: YTN; PAM sequence: TTG
ggaggcagagatgggcggat

SEQ ID NO: 278426 - DNA, 20 bp, Artificial Sequence
  Description of Artificial Sequence: Synthetic oligonucleotide
  Target: ATXN1; (+) strand; PAM type: YTN; PAM sequence: CTG
aggctgggagttcgagacca

SEQ ID NO: 278427 - DNA, 20 bp, Artificial Sequence
  Description of Artificial Sequence: Synthetic oligonucleotide
  Target: ATXN1; (+) strand; PAM type: YTN; PAM sequence: CTG
ggagttcgagaccagcctga

SEQ ID NO: 278428 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgaccaacat

SEQ ID NO: 278429 - DNA, 20 bp, Artificial Sequence
  Description of Artificial Sequence: Synthetic oligonucleotide
  Target: ATXN1; (+) strand; PAM type: YTN; PAM sequence: CTG
accaacatggtgaaaccccg

SEQ ID NO: 278430 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatgcaaaattag

SEQ ID NO: 278431 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatgcaaaattagca

SEQ ID NO: 278432 - DNA, 20 bp, Artificial Sequence
  Description of Artificial Sequence: Synthetic oligonucleotide
  Target: ATXN1; (+) strand; PAM type: YTN; PAM sequence: CTA
aaaatgcaaaattagcaggg

SEQ ID NO: 278433 - DNA, 20 bp, Artificial Sequence
  Description of Artificial Sequence: Synthetic oligonucleotide
  Target: ATXN1; (+) strand; PAM type: YTN; PAM sequence: TTA
gcagggcatggaggtgcatg

SEQ ID NO: 278434 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctcaggcagta

SEQ ID NO: 278435 - DNA, 20 bp, Artificial Sequence
  Description of Artificial Sequence: Synthetic oligonucleotide
  Target: ATXN1; (+) strand; PAM type: YTN; PAM sequence: CTC
aggaggctcaggcagtagaa

SEQ ID NO: 278436 - DNA, 20 bp, Artificial Sequence
  Description of Artificial Sequence: Synthetic oligonucleotide
  Target: ATXN1; (+) strand; PAM type: YTN; PAM sequence: CTC
aggcagtagaataacttgaa

SEQ ID NO: 278437 - DNA, 20 bp, Artificial Sequence
  Description of Artificial Sequence: Synthetic oligonucleotide
  Target: ATXN1; (+) strand; PAM type: YTN; PAM sequence: CTT
gaactcaggagcaaagattg

SEQ ID NO: 278438 - DNA, 20 bp, Artificial Sequence
  Description of Artificial Sequence: Synthetic oligonucleotide
  Target: ATXN1; (+) strand; PAM type: YTN; PAM sequence: TTG
aactcaggagcaaagattgt

SEQ ID NO: 278439 - DNA, 20 bp, Artificial Sequence
  Description of Artificial Sequence: Synthetic oligonucleotide
  Target: ATXN1; (+) strand; PAM type: YTN; PAM sequence: CTC
aggagcaaagattgtggtga

SEQ ID NO: 278440 - DNA, 20 bp, Artificial Sequence
  Description of Artificial Sequence: Synthetic oligonucleotide
  Target: ATXN1; (+) strand; PAM type: YTN; PAM sequence: TTG
tggtgagccgagatcgcacc

SEQ ID NO: 278441 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggcaacaa

SEQ ID NO: 278442 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagagcg

SEQ ID NO: 278443 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcgaaactct

SEQ ID NO: 278444 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 278445 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 278446 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 278447 - DNA, 20 bp, Artificial Sequence
  Description of Artificial Sequence: Synthetic oligonucleotide
  Target: ATXN1; (+) strand; PAM type: YTN; PAM sequence: TTC
tcactcataagtgggagttg

SEQ ID NO: 278448 - DNA, 20 bp, Artificial Sequence
  Description of Artificial Sequence: Synthetic oligonucleotide
  Target: ATXN1; (+) strand; PAM type: YTN; PAM sequence: CTC
actcataagtgggagttgaa

SEQ ID NO: 278449 - DNA, 20 bp, Artificial Sequence
  Description of Artificial Sequence: Synthetic oligonucleotide
  Target: ATXN1; (+) strand; PAM type: YTN; PAM sequence: CTC
ataagtgggagttgaaaaat

SEQ ID NO: 278450 - DNA, 20 bp, Artificial Sequence
  Description of Artificial Sequence: Synthetic oligonucleotide
  Target: ATXN1; (+) strand; PAM type: YTN; PAM sequence: TTG
aaaaatgagaacacatggac

SEQ ID NO: 278451 - DNA, 20 bp, Artificial Sequence
  Description of Artificial Sequence: Synthetic oligonucleotide
  Target: ATXN1; (+) strand; PAM type: YTN; PAM sequence: CTG
ttggggactggggtggggag

SEQ ID NO: 278452 - DNA, 20 bp, Artificial Sequence
  Description of Artificial Sequence: Synthetic oligonucleotide
  Target: ATXN1; (+) strand; PAM type: YTN; PAM sequence: TTG
gggactggggtggggagggg

SEQ ID NO: 278453 - DNA, 20 bp, Artificial Sequence
  Description of Artificial Sequence: Synthetic oligonucleotide
  Target: ATXN1; (+) strand; PAM type: YTN; PAM sequence: CTG
gggtggggaggggagggaac

SEQ ID NO: 278454 - DNA, 20 bp, Artificial Sequence
  Description of Artificial Sequence: Synthetic oligonucleotide
  Target: ATXN1; (+) strand; PAM type: YTN; PAM sequence: CTA
gatgacaggttaataggtgc

SEQ ID NO: 278455 - DNA, 20 bp, Artificial Sequence
  Description of Artificial Sequence: Synthetic oligonucleotide
  Target: ATXN1; (+) strand; PAM type: YTN; PAM sequence: TTA
ataggtgcagcaaaccacca

SEQ ID NO: 278456 - DNA, 20 bp, Artificial Sequence
  Description of Artificial Sequence: Synthetic oligonucleotide
  Target: ATXN1; (+) strand; PAM type: YTN; PAM sequence: CTA
tgcaacagacctgcatgttc

SEQ ID NO: 278457 - DNA, 20 bp, Artificial Sequence
  Description of Artificial Sequence: Synthetic oligonucleotide
  Target: ATXN1; (+) strand; PAM type: YTN; PAM sequence: CTG
catgttctacatatgtaccc

SEQ ID NO: 278458 - DNA, 20 bp, Artificial Sequence
  Description of Artificial Sequence: Synthetic oligonucleotide
  Target: ATXN1; (+) strand; PAM type: YTN; PAM sequence: TTC
tacatatgtaccccagaact

SEQ ID NO: 278459 - DNA, 20 bp, Artificial Sequence
  Description of Artificial Sequence: Synthetic oligonucleotide
  Target: ATXN1; (+) strand; PAM type: YTN; PAM sequence: CTA
catatgtaccccagaactta

SEQ ID NO: 278460 - DNA, 20 bp, Artificial Sequence
  Description of Artificial Sequence: Synthetic oligonucleotide
  Target: ATXN1; (+) strand; PAM type: YTN; PAM sequence: CTT
aaagtaaaataaataaataa

SEQ ID NO: 278461 - DNA, 20 bp, Artificial Sequence
  Description of Artificial Sequence: Synthetic oligonucleotide
  Target: ATXN1; (+) strand; PAM type: YTN; PAM sequence: TTA
aagtaaaataaataaataaa

SEQ ID NO: 278462 - DNA, 20 bp, Artificial Sequence
  Description of Artificial Sequence: Synthetic oligonucleotide
  Target: ATXN1; (+) strand; PAM type: YTN; PAM sequence: CTT
atggacacaccctagcaagt

SEQ ID NO: 278463 - DNA, 20 bp, Artificial Sequence
  Description of Artificial Sequence: Synthetic oligonucleotide
  Target: ATXN1; (+) strand; PAM type: YTN; PAM sequence: TTA
tggacacaccctagcaagtg

SEQ ID NO: 278464 - DNA, 20 bp, Artificial Sequence
  Description of Artificial Sequence: Synthetic oligonucleotide
  Target: ATXN1; (+) strand; PAM type: YTN; PAM sequence: CTA
gcaagtggtcactggtttta

SEQ ID NO: 278465 - DNA, 20 bp, Artificial Sequence
  Description of Artificial Sequence: Synthetic oligonucleotide
  Target: ATXN1; (+) strand; PAM type: YTN; PAM sequence: CTG
gttttacatggataccaagg

SEQ ID NO: 278466 - DNA, 20 bp, Artificial Sequence
  Description of Artificial Sequence: Synthetic oligonucleotide
  Target: ATXN1; (+) strand; PAM type: YTN; PAM sequence: TTT
tacatggataccaaggcttc

SEQ ID NO: 278467 - DNA, 20 bp, Artificial Sequence
  Description of Artificial Sequence: Synthetic oligonucleotide
  Target: ATXN1; (+) strand; PAM type: YTN; PAM sequence: TTT
acatggataccaaggcttcc

SEQ ID NO: 278468 - DNA, 20 bp, Artificial Sequence
  Description of Artificial Sequence: Synthetic oligonucleotide
  Target: ATXN1; (+) strand; PAM type: YTN; PAM sequence: TTA
catggataccaaggcttccc

SEQ ID NO: 278469 - DNA, 20 bp, Artificial Sequence
  Description of Artificial Sequence: Synthetic oligonucleotide
  Target: ATXN1; (+) strand; PAM type: YTN; PAM sequence: CTT
ccctcttgccttccctcctg

SEQ ID NO: 278470 - DNA, 20 bp, Artificial Sequence
  Description of Artificial Sequence: Synthetic oligonucleotide
  Target: ATXN1; (+) strand; PAM type: YTN; PAM sequence: TTC
cctcttgccttccctcctgc

SEQ ID NO: 278471 - DNA, 20 bp, Artificial Sequence
  Description of Artificial Sequence: Synthetic oligonucleotide
  Target: ATXN1; (+) strand; PAM type: YTN; PAM sequence: CTC
ttgccttccctcctgcaccc

SEQ ID NO: 278472 - DNA, 20 bp, Artificial Sequence
  Description of Artificial Sequence: Synthetic oligonucleotide
  Target: ATXN1; (+) strand; PAM type: YTN; PAM sequence: CTT
gccttccctcctgcaccctc

SEQ ID NO: 278473 - DNA, 20 bp, Artificial Sequence
  Description of Artificial Sequence: Synthetic oligonucleotide
  Target: ATXN1; (+) strand; PAM type: YTN; PAM sequence: TTG
ccttccctcctgcaccctct

SEQ ID NO: 278474 - DNA, 20 bp, Artificial Sequence
  Description of Artificial Sequence: Synthetic oligonucleotide
  Target: ATXN1; (+) strand; PAM type: YTN; PAM sequence: CTT
ccctcctgcaccctctcagc

SEQ ID NO: 278475 - DNA, 20 bp, Artificial Sequence
  Description of Artificial Sequence: Synthetic oligonucleotide
  Target: ATXN1; (+) strand; PAM type: YTN; PAM sequence: TTC
cctcctgcaccctctcagct

SEQ ID NO: 278476 - DNA, 20 bp, Artificial Sequence
  Description of Artificial Sequence: Synthetic oligonucleotide
  Target: ATXN1; (+) strand; PAM type: YTN; PAM sequence: CTC
ctgcaccctctcagctctgg

SEQ ID NO: 278477 - DNA, 20 bp, Artificial Sequence
  Description of Artificial Sequence: Synthetic oligonucleotide
  Target: ATXN1; (+) strand; PAM type: YTN; PAM sequence: CTG
caccctctcagctctggcaa

SEQ ID NO: 278478 - DNA, 20 bp, Artificial Sequence
  Description of Artificial Sequence: Synthetic oligonucleotide
  Target: ATXN1; (+) strand; PAM type: YTN; PAM sequence: CTC
tcagctctggcaatgtggct

SEQ ID NO: 278479 - DNA, 20 bp, Artificial Sequence
  Description of Artificial Sequence: Synthetic oligonucleotide
  Target: ATXN1; (+) strand; PAM type: YTN; PAM sequence: CTC
agctctggcaatgtggctat

SEQ ID NO: 278480 - DNA, 20 bp, Artificial Sequence
  Description of Artificial Sequence: Synthetic oligonucleotide
  Target: ATXN1; (+) strand; PAM type: YTN; PAM sequence: CTC
tggcaatgtggctatcacac

SEQ ID NO: 278481 - DNA, 20 bp, Artificial Sequence
  Description of Artificial Sequence: Synthetic oligonucleotide
  Target: ATXN1; (+) strand; PAM type: YTN; PAM sequence: CTG
gcaatgtggctatcacacaa

SEQ ID NO: 278482 - DNA, 20 bp, Artificial Sequence
  Description of Artificial Sequence: Synthetic oligonucleotide
  Target: ATXN1; (+) strand; PAM type: YTN; PAM sequence: CTA
tcacacaatctgcatgtcaa

SEQ ID NO: 278483 - DNA, 20 bp, Artificial Sequence
  Description of Artificial Sequence: Synthetic oligonucleotide
  Target: ATXN1; (+) strand; PAM type: YTN; PAM sequence: CTG
catgtcaacatggcctcttc

SEQ ID NO: 278484 - DNA, 20 bp, Artificial Sequence
  Description of Artificial Sequence: Synthetic oligonucleotide
  Target: ATXN1; (+) strand; PAM type: YTN; PAM sequence: CTC
ttccaaccacatgctcctgt

SEQ ID NO: 278485 - DNA, 20 bp, Artificial Sequence
  Description of Artificial Sequence: Synthetic oligonucleotide
  Target: ATXN1; (+) strand; PAM type: YTN; PAM sequence: CTT
ccaaccacatgctcctgtca

SEQ ID NO: 278486 - DNA, 20 bp, Artificial Sequence
  Description of Artificial Sequence: Synthetic oligonucleotide
  Target: ATXN1; (+) strand; PAM type: YTN; PAM sequence: TTC
caaccacatgctcctgtcaa

SEQ ID NO: 278487 - DNA, 20 bp, Artificial Sequence
  Description of Artificial Sequence: Synthetic oligonucleotide
  Target: ATXN1; (+) strand; PAM type: YTN; PAM sequence: CTC
ctgtcaactttccatcctct

SEQ ID NO: 278488 - DNA, 20 bp, Artificial Sequence
  Description of Artificial Sequence: Synthetic oligonucleotide
  Target: ATXN1; (+) strand; PAM type: YTN; PAM sequence: CTG
tcaactttccatcctcttct

SEQ ID NO: 278489 - DNA, 20 bp, Artificial Sequence
  Description of Artificial Sequence: Synthetic oligonucleotide
  Target: ATXN1; (+) strand; PAM type: YTN; PAM sequence: CTT
tccatcctcttctgcatatt

SEQ ID NO: 278490 - DNA, 20 bp, Artificial Sequence
  Description of Artificial Sequence: Synthetic oligonucleotide
  Target: ATXN1; (+) strand; PAM type: YTN; PAM sequence: TTT
ccatcctcttctgcatattc

SEQ ID NO: 278491 - DNA, 20 bp, Artificial Sequence
  Description of Artificial Sequence: Synthetic oligonucleotide
  Target: ATXN1; (+) strand; PAM type: YTN; PAM sequence: TTC
catcctcttctgcatattca

SEQ ID NO: 278492 - DNA, 20 bp, Artificial Sequence
  Description of Artificial Sequence: Synthetic oligonucleotide
  Target: ATXN1; (+) strand; PAM type: YTN; PAM sequence: CTC
ttctgcatattcagcccaca

SEQ ID NO: 278493 - DNA, 20 bp, Artificial Sequence
  Description of Artificial Sequence: Synthetic oligonucleotide
  Target: ATXN1; (+) strand; PAM type: YTN; PAM sequence: CTT
ctgcatattcagcccacact

SEQ ID NO: 278494 - DNA, 20 bp, Artificial Sequence
  Description of Artificial Sequence: Synthetic oligonucleotide
  Target: ATXN1; (+) strand; PAM type: YTN; PAM sequence: TTC
tgcatattcagcccacactt

SEQ ID NO: 278495 - DNA, 20 bp, Artificial Sequence
  Description of Artificial Sequence: Synthetic oligonucleotide
  Target: ATXN1; (+) strand; PAM type: YTN; PAM sequence: CTG
catattcagcccacacttgt

SEQ ID NO: 278496 - DNA, 20 bp, Artificial Sequence
  Description of Artificial Sequence: Synthetic oligonucleotide
  Target: ATXN1; (+) strand; PAM type: YTN; PAM sequence: TTC
agcccacacttgttccttct

SEQ ID NO: 278497 - DNA, 20 bp, Artificial Sequence
  Description of Artificial Sequence: Synthetic oligonucleotide
  Target: ATXN1; (+) strand; PAM type: YTN; PAM sequence: CTT
gttccttcttctttcatccc

SEQ ID NO: 278498 - DNA, 20 bp, Artificial Sequence
  Description of Artificial Sequence: Synthetic oligonucleotide
  Target: ATXN1; (+) strand; PAM type: YTN; PAM sequence: TTG
ttccttcttctttcatccct

SEQ ID NO: 278499 - DNA, 20 bp, Artificial Sequence
  Description of Artificial Sequence: Synthetic oligonucleotide
  Target: ATXN1; (+) strand; PAM type: YTN; PAM sequence: TTC
cttcttctttcatcccttgt

SEQ ID NO: 278500 - DNA, 20 bp, Artificial Sequence
  Description of Artificial Sequence: Synthetic oligonucleotide
  Target: ATXN1; (+) strand; PAM type: YTN; PAM sequence: CTT
cttctttcatcccttgtata

SEQ ID NO: 278501 - DNA, 20 bp, Artificial Sequence
  Description of Artificial Sequence: Synthetic oligonucleotide
  Target: ATXN1; (+) strand; PAM type: YTN; PAM sequence: TTC
ttctttcatcccttgtatat

SEQ ID NO: 278502 - DNA, 20 bp, Artificial Sequence
  Description of Artificial Sequence: Synthetic oligonucleotide
  Target: ATXN1; (+) strand; PAM type: YTN; PAM sequence: CTT
ctttcatcccttgtatattt

SEQ ID NO: 278503 - DNA, 20 bp, Artificial Sequence
  Description of Artificial Sequence: Synthetic oligonucleotide
  Target: ATXN1; (+) strand; PAM type: YTN; PAM sequence: TTC
tttcatcccttgtatatttg

SEQ ID NO: 278504 - DNA, 20 bp, Artificial Sequence
  Description of Artificial Sequence: Synthetic oligonucleotide
  Target: ATXN1; (+) strand; PAM type: YTN; PAM sequence: CTT
tcatcccttgtatatttggg

SEQ ID NO: 278505 - DNA, 20 bp, Artificial Sequence
  Description of Artificial Sequence: Synthetic oligonucleotide
  Target: ATXN1; (+) strand; PAM type: YTN; PAM sequence: TTT
catcccttgtatatttggga

SEQ ID NO: 278506 - DNA, 20 bp, Artificial Sequence
  Description of Artificial Sequence: Synthetic oligonucleotide
  Target: ATXN1; (+) strand; PAM type: YTN; PAM sequence: TTC
atcccttgtatatttgggac

SEQ ID NO: 278507 - DNA, 20 bp, Artificial Sequence
  Description of Artificial Sequence: Synthetic oligonucleotide
  Target: ATXN1; (+) strand; PAM type: YTN; PAM sequence: CTT
gtatatttgggacaatctga

SEQ ID NO: 278508 - DNA, 20 bp, Artificial Sequence
  Description of Artificial Sequence: Synthetic oligonucleotide
  Target: ATXN1; (+) strand; PAM type: YTN; PAM sequence: TTG
tatatttgggacaatctgag

SEQ ID NO: 278509 - DNA, 20 bp, Artificial Sequence
  Description of Artificial Sequence: Synthetic oligonucleotide
  Target: ATXN1; (+) strand; PAM type: YTN; PAM sequence: TTT
gggacaatctgagagggtat

SEQ ID NO: 278510 - DNA, 20 bp, Artificial Sequence
  Description of Artificial Sequence: Synthetic oligonucleotide
  Target: ATXN1; (+) strand; PAM type: YTN; PAM sequence: TTG
ggacaatctgagagggtatc

SEQ ID NO: 278511 - DNA, 20 bp, Artificial Sequence
  Description of Artificial Sequence: Synthetic oligonucleotide
  Target: ATXN1; (+) strand; PAM type: YTN; PAM sequence: CTG
agagggtatcctagaaaagg

SEQ ID NO: 278512 - DNA, 20 bp, Artificial Sequence
  Description of Artificial Sequence: Synthetic oligonucleotide
  Target: ATXN1; (+) strand; PAM type: YTN; PAM sequence: CTA
gaaaagggaatccaaataca

SEQ ID NO: 278513 - DNA, 20 bp, Artificial Sequence
  Description of Artificial Sequence: Synthetic oligonucleotide
  Target: ATXN1; (+) strand; PAM type: YTN; PAM sequence: TTT
tgatctatttctacagtagg

SEQ ID NO: 278514 - DNA, 20 bp, Artificial Sequence
  Description of Artificial Sequence: Synthetic oligonucleotide
  Target: ATXN1; (+) strand; PAM type: YTN; PAM sequence: TTT
gatctatttctacagtaggc

SEQ ID NO: 278515 - DNA, 20 bp, Artificial Sequence
  Description of Artificial Sequence: Synthetic oligonucleotide
  Target: ATXN1; (+) strand; PAM type: YTN; PAM sequence: TTG
atctatttctacagtaggca

SEQ ID NO: 278516 - DNA, 20 bp, Artificial Sequence
  Description of Artificial Sequence: Synthetic oligonucleotide
  Target: ATXN1; (+) strand; PAM type: YTN; PAM sequence: CTA
tttctacagtaggcataatt

SEQ ID NO: 278517 - DNA, 20 bp, Artificial Sequence
  Description of Artificial Sequence: Synthetic oligonucleotide
  Target: ATXN1; (+) strand; PAM type: YTN; PAM sequence: TTT
ctacagtaggcataattatt

SEQ ID NO: 278518 - DNA, 20 bp, Artificial Sequence
  Description of Artificial Sequence: Synthetic oligonucleotide
  Target: ATXN1; (+) strand; PAM type: YTN; PAM sequence: TTC
tacagtaggcataattatta

SEQ ID NO: 278519 - DNA, 20 bp, Artificial Sequence
  Description of Artificial Sequence: Synthetic oligonucleotide
  Target: ATXN1; (+) strand; PAM type: YTN; PAM sequence: CTA
cagtaggcataattattagg

SEQ ID NO: 278520 - DNA, 20 bp, Artificial Sequence
  Description of Artificial Sequence: Synthetic oligonucleotide
  Target: ATXN1; (+) strand; PAM type: YTN; PAM sequence: TTA
ttaggccataagtgagacca

SEQ ID NO: 278521 - DNA, 20 bp, Artificial Sequence
  Description of Artificial Sequence: Synthetic oligonucleotide
  Target: ATXN1; (+) strand; PAM type: YTN; PAM sequence: TTA
ggccataagtgagaccatga

SEQ ID NO: 278522 - DNA, 20 bp, Artificial Sequence
  Description of Artificial Sequence: Synthetic oligonucleotide
  Target: ATXN1; (+) strand; PAM type: YTN; PAM sequence: TTA
ctgttgactatgctcttctg

SEQ ID NO: 278523 - DNA, 20 bp, Artificial Sequence
  Description of Artificial Sequence: Synthetic oligonucleotide
  Target: ATXN1; (+) strand; PAM type: YTN; PAM sequence: CTG
ttgactatgctcttctgtag

SEQ ID NO: 278524 - DNA, 20 bp, Artificial Sequence
  Description of Artificial Sequence: Synthetic oligonucleotide
  Target: ATXN1; (+) strand; PAM type: YTN; PAM sequence: TTG
actatgctcttctgtagttt

SEQ ID NO: 278525 - DNA, 20 bp, Artificial Sequence
  Description of Artificial Sequence: Synthetic oligonucleotide
  Target: ATXN1; (+) strand; PAM type: YTN; PAM sequence: CTA
tgctcttctgtagttttaaa

SEQ ID NO: 278526 - DNA, 20 bp, Artificial Sequence
  Description of Artificial Sequence: Synthetic oligonucleotide
  Target: ATXN1; (+) strand; PAM type: YTN; PAM sequence: CTC
ttctgtagttttaaaagtgc

SEQ ID NO: 278527 - DNA, 20 bp, Artificial Sequence
  Description of Artificial Sequence: Synthetic oligonucleotide
  Target: ATXN1; (+) strand; PAM type: YTN; PAM sequence: CTT
ctgtagttttaaaagtgcct

SEQ ID NO: 278528 - DNA, 20 bp, Artificial Sequence
  Description of Artificial Sequence: Synthetic oligonucleotide
  Target: ATXN1; (+) strand; PAM type: YTN; PAM sequence: TTC
tgtagttttaaaagtgcctt

SEQ ID NO: 278529 - DNA, 20 bp, Artificial Sequence
  Description of Artificial Sequence: Synthetic oligonucleotide
  Target: ATXN1; (+) strand; PAM type: YTN; PAM sequence: CTG
tagttttaaaagtgcctttc

SEQ ID NO: 278530 - DNA, 20 bp, Artificial Sequence
  Description of Artificial Sequence: Synthetic oligonucleotide
  Target: ATXN1; (+) strand; PAM type: YTN; PAM sequence: TTT
taaaagtgcctttcatgcat

SEQ ID NO: 278531 - DNA, 20 bp, Artificial Sequence
  Description of Artificial Sequence: Synthetic oligonucleotide
  Target: ATXN1; (+) strand; PAM type: YTN; PAM sequence: TTT
aaaagtgcctttcatgcata

SEQ ID NO: 278532 - DNA, 20 bp, Artificial Sequence
  Description of Artificial Sequence: Synthetic oligonucleotide
  Target: ATXN1; (+) strand; PAM type: YTN; PAM sequence: TTA
aaagtgcctttcatgcataa

SEQ ID NO: 278533 - DNA, 20 bp, Artificial Sequence
  Description of Artificial Sequence: Synthetic oligonucleotide
  Target: ATXN1; (+) strand; PAM type: YTN; PAM sequence: CTT
tcatgcataatagttgcaga

SEQ ID NO: 278534 - DNA, 20 bp, Artificial Sequence
  Description of Artificial Sequence: Synthetic oligonucleotide
  Target: ATXN1; (+) strand; PAM type: YTN; PAM sequence: TTT
catgcataatagttgcagaa

SEQ ID NO: 278535 - DNA, 20 bp, Artificial Sequence
  Description of Artificial Sequence: Synthetic oligonucleotide
  Target: ATXN1; (+) strand; PAM type: YTN; PAM sequence: TTC
atgcataatagttgcagaat

SEQ ID NO: 278536 - DNA, 20 bp, Artificial Sequence
  Description of Artificial Sequence: Synthetic oligonucleotide
  Target: ATXN1; (+) strand; PAM type: YTN; PAM sequence: TTG
cagaatataattacttaaca

SEQ ID NO: 278537 - DNA, 20 bp, Artificial Sequence
  Description of Artificial Sequence: Synthetic oligonucleotide
  Target: ATXN1; (+) strand; PAM type: YTN; PAM sequence: TTA
cttaacaaccctaataaata

SEQ ID NO: 278538 - DNA, 20 bp, Artificial Sequence
  Description of Artificial Sequence: Synthetic oligonucleotide
  Target: ATXN1; (+) strand; PAM type: YTN; PAM sequence: CTT
aacaaccctaataaatagta

SEQ ID NO: 278539 - DNA, 20 bp, Artificial Sequence
  Description of Artificial Sequence: Synthetic oligonucleotide
  Target: ATXN1; (+) strand; PAM type: YTN; PAM sequence: TTA
acaaccctaataaatagtaa

SEQ ID NO: 278540 - DNA, 20 bp, Artificial Sequence
  Description of Artificial Sequence: Synthetic oligonucleotide
  Target: ATXN1; (+) strand; PAM type: YTN; PAM sequence: CTA
ataaatagtaacataattat

SEQ ID NO: 278541 - DNA, 20 bp, Artificial Sequence
  Description of Artificial Sequence: Synthetic oligonucleotide
  Target: ATXN1; (+) strand; PAM type: YTN; PAM sequence: TTA
ttcccaatttatagaaaaga

SEQ ID NO: 278542 - DNA, 20 bp, Artificial Sequence
  Description of Artificial Sequence: Synthetic oligonucleotide
  Target: ATXN1; (+) strand; PAM type: YTN; PAM sequence: TTC
ccaatttatagaaaagaaac

SEQ ID NO: 278543 - DNA, 20 bp, Artificial Sequence
  Description of Artificial Sequence: Synthetic oligonucleotide
  Target: ATXN1; (+) strand; PAM type: YTN; PAM sequence: TTT
atagaaaagaaactgaagct

SEQ ID NO: 278544 - DNA, 20 bp, Artificial Sequence
  Description of Artificial Sequence: Synthetic oligonucleotide
  Target: ATXN1; (+) strand; PAM type: YTN; PAM sequence: TTA
tagaaaagaaactgaagctc

SEQ ID NO: 278545 - DNA, 20 bp, Artificial Sequence
  Description of Artificial Sequence: Synthetic oligonucleotide
  Target: ATXN1; (+) strand; PAM type: YTN; PAM sequence: CTG
aagctcaaaaaggttaggta

SEQ ID NO: 278546 - DNA, 20 bp, Artificial Sequence
  Description of Artificial Sequence: Synthetic oligonucleotide
  Target: ATXN1; (+) strand; PAM type: YTN; PAM sequence: CTC
aaaaaggttaggtaagtcag

SEQ ID NO: 278547 - DNA, 20 bp, Artificial Sequence
  Description of Artificial Sequence: Synthetic oligonucleotide
  Target: ATXN1; (+) strand; PAM type: YTN; PAM sequence: TTA
ggtaagtcagccatggacac

SEQ ID NO: 278548 - DNA, 20 bp, Artificial Sequence
  Description of Artificial Sequence: Synthetic oligonucleotide
  Target: ATXN1; (+) strand; PAM type: YTN; PAM sequence: CTA
ataaaccacagagccaaaat

SEQ ID NO: 278549 - DNA, 20 bp, Artificial Sequence
  Description of Artificial Sequence: Synthetic oligonucleotide
  Target: ATXN1; (+) strand; PAM type: YTN; PAM sequence: CTC
atctcttcgaatgtcaagtt

SEQ ID NO: 278550 - DNA, 20 bp, Artificial Sequence
  Description of Artificial Sequence: Synthetic oligonucleotide
  Target: ATXN1; (+) strand; PAM type: YTN; PAM sequence: CTC
ttcgaatgtcaagttctata

SEQ ID NO: 278551 - DNA, 20 bp, Artificial Sequence
  Description of Artificial Sequence: Synthetic oligonucleotide
  Target: ATXN1; (+) strand; PAM type: YTN; PAM sequence: CTT
cgaatgtcaagttctataca

SEQ ID NO: 278552 - DNA, 20 bp, Artificial Sequence
  Description of Artificial Sequence: Synthetic oligonucleotide
  Target: ATXN1; (+) strand; PAM type: YTN; PAM sequence: TTC
gaatgtcaagttctatacat

SEQ ID NO: 278553 - DNA, 20 bp, Artificial Sequence
  Description of Artificial Sequence: Synthetic oligonucleotide
  Target: ATXN1; (+) strand; PAM type: YTN; PAM sequence: TTC
tatacattttttgcaacata

SEQ ID NO: 278554 - DNA, 20 bp, Artificial Sequence
  Description of Artificial Sequence: Synthetic oligonucleotide
  Target: ATXN1; (+) strand; PAM type: YTN; PAM sequence: CTA
tacattttttgcaacatata

SEQ ID NO: 278555 - DNA, 20 bp, Artificial Sequence
  Description of Artificial Sequence: Synthetic oligonucleotide
  Target: ATXN1; (+) strand; PAM type: YTN; PAM sequence: TTT
tttgcaacatatagtatgac

SEQ ID NO: 278556 - DNA, 20 bp, Artificial Sequence
  Description of Artificial Sequence: Synthetic oligonucleotide
  Target: ATXN1; (+) strand; PAM type: YTN; PAM sequence: TTT
ttgcaacatatagtatgaca

SEQ ID NO: 278557 - DNA, 20 bp, Artificial Sequence
  Description of Artificial Sequence: Synthetic oligonucleotide
  Target: ATXN1; (+) strand; PAM type: YTN; PAM sequence: TTT
tgcaacatatagtatgacac

SEQ ID NO: 278558 - DNA, 20 bp, Artificial Sequence
  Description of Artificial Sequence: Synthetic oligonucleotide
  Target: ATXN1; (+) strand; PAM type: YTN; PAM sequence: TTT
gcaacatatagtatgacaca

SEQ ID NO: 278559 - DNA, 20 bp, Artificial Sequence
  Description of Artificial Sequence: Synthetic oligonucleotide
  Target: ATXN1; (+) strand; PAM type: YTN; PAM sequence: TTG
caacatatagtatgacacag

SEQ ID NO: 278560 - DNA, 20 bp, Artificial Sequence
  Description of Artificial Sequence: Synthetic oligonucleotide
  Target: ATXN1; (+) strand; PAM type: YTN; PAM sequence: CTG
tattagattatcaaaaagga

SEQ ID NO: 278561 - DNA, 20 bp, Artificial Sequence
  Description of Artificial Sequence: Synthetic oligonucleotide
  Target: ATXN1; (+) strand; PAM type: YTN; PAM sequence: TTA
gattatcaaaaaggattaag

SEQ ID NO: 278562 - DNA, 20 bp, Artificial Sequence
  Description of Artificial Sequence: Synthetic oligonucleotide
  Target: ATXN1; (+) strand; PAM type: YTN; PAM sequence: TTA
tcaaaaaggattaagttttt

SEQ ID NO: 278563 - DNA, 20 bp, Artificial Sequence
  Description of Artificial Sequence: Synthetic oligonucleotide
  Target: ATXN1; (+) strand; PAM type: YTN; PAM sequence: TTA
agtttttttcttgactataa

SEQ ID NO: 278564 - DNA, 20 bp, Artificial Sequence
  Description of Artificial Sequence: Synthetic oligonucleotide
  Target: ATXN1; (+) strand; PAM type: YTN; PAM sequence: TTT
ttttcttgactataagcaat

SEQ ID NO: 278565 - DNA, 20 bp, Artificial Sequence
  Description of Artificial Sequence: Synthetic oligonucleotide
  Target: ATXN1; (+) strand; PAM type: YTN; PAM sequence: TTT
tttcttgactataagcaata

SEQ ID NO: 278566 - DNA, 20 bp, Artificial Sequence
  Description of Artificial Sequence: Synthetic oligonucleotide
  Target: ATXN1; (+) strand; PAM type: YTN; PAM sequence: TTT
ttcttgactataagcaatat

SEQ ID NO: 278567 - DNA, 20 bp, Artificial Sequence
  Description of Artificial Sequence: Synthetic oligonucleotide
  Target: ATXN1; (+) strand; PAM type: YTN; PAM sequence: TTT
tcttgactataagcaatatg

SEQ ID NO: 278568 - DNA, 20 bp, Artificial Sequence
  Description of Artificial Sequence: Synthetic oligonucleotide
  Target: ATXN1; (+) strand; PAM type: YTN; PAM sequence: TTT
cttgactataagcaatatgg

SEQ ID NO: 278569 - DNA, 20 bp, Artificial Sequence
  Description of Artificial Sequence: Synthetic oligonucleotide
  Target: ATXN1; (+) strand; PAM type: YTN; PAM sequence: TTC
ttgactataagcaatatggt

SEQ ID NO: 278570 - DNA, 20 bp, Artificial Sequence
  Description of Artificial Sequence: Synthetic oligonucleotide
  Target: ATXN1; (+) strand; PAM type: YTN; PAM sequence: CTT
gactataagcaatatggtag

SEQ ID NO: 278571 - DNA, 20 bp, Artificial Sequence
  Description of Artificial Sequence: Synthetic oligonucleotide
  Target: ATXN1; (+) strand; PAM type: YTN; PAM sequence: TTG
actataagcaatatggtagc

SEQ ID NO: 278572 - DNA, 20 bp, Artificial Sequence
  Description of Artificial Sequence: Synthetic oligonucleotide
  Target: ATXN1; (+) strand; PAM type: YTN; PAM sequence: CTA
taagcaatatggtagcaata

SEQ ID NO: 278573 - DNA, 20 bp, Artificial Sequence
  Description of Artificial Sequence: Synthetic oligonucleotide
  Target: ATXN1; (+) strand; PAM type: YTN; PAM sequence: CTC
atgtttgtattccatatttg

SEQ ID NO: 278574 - DNA, 20 bp, Artificial Sequence
  Description of Artificial Sequence: Synthetic oligonucleotide
  Target: ATXN1; (+) strand; PAM type: YTN; PAM sequence: TTT
gtattccatatttgaaaaca

SEQ ID NO: 278575 - DNA, 20 bp, Artificial Sequence
  Description of Artificial Sequence: Synthetic oligonucleotide
  Target: ATXN1; (+) strand; PAM type: YTN; PAM sequence: TTG
tattccatatttgaaaacat

SEQ ID NO: 278576 - DNA, 20 bp, Artificial Sequence
  Description of Artificial Sequence: Synthetic oligonucleotide
  Target: ATXN1; (+) strand; PAM type: YTN; PAM sequence: TTC
catatttgaaaacattttcc

SEQ ID NO: 278577 - DNA, 20 bp, Artificial Sequence
  Description of Artificial Sequence: Synthetic oligonucleotide
  Target: ATXN1; (+) strand; PAM type: YTN; PAM sequence: TTT
gaaaacattttccaaaatgt

SEQ ID NO: 278578 - DNA, 20 bp, Artificial Sequence
  Description of Artificial Sequence: Synthetic oligonucleotide
  Target: ATXN1; (+) strand; PAM type: YTN; PAM sequence: TTG
aaaacattttccaaaatgtt

SEQ ID NO: 278579 - DNA, 20 bp, Artificial Sequence
  Description of Artificial Sequence: Synthetic oligonucleotide
  Target: ATXN1; (+) strand; PAM type: YTN; PAM sequence: TTT
tccaaaatgttttaacttca

SEQ ID NO: 278580 - DNA, 20 bp, Artificial Sequence
  Description of Artificial Sequence: Synthetic oligonucleotide
  Target: ATXN1; (+) strand; PAM type: YTN; PAM sequence: TTT
ccaaaatgttttaacttcag

SEQ ID NO: 278581 - DNA, 20 bp, Artificial Sequence
  Description of Artificial Sequence: Synthetic oligonucleotide
  Target: ATXN1; (+) strand; PAM type: YTN; PAM sequence: TTC
caaaatgttttaacttcagg

SEQ ID NO: 278582 - DNA, 20 bp, Artificial Sequence
  Description of Artificial Sequence: Synthetic oligonucleotide
  Target: ATXN1; (+) strand; PAM type: YTN; PAM sequence: TTT
taacttcaggtcttattttt

SEQ ID NO: 278583 - DNA, 20 bp, Artificial Sequence
  Description of Artificial Sequence: Synthetic oligonucleotide
  Target: ATXN1; (+) strand; PAM type: YTN; PAM sequence: TTT
aacttcaggtcttatttttc

SEQ ID NO: 278584 - DNA, 20 bp, Artificial Sequence
  Description of Artificial Sequence: Synthetic oligonucleotide
  Target: ATXN1; (+) strand; PAM type: YTN; PAM sequence: TTA
acttcaggtcttatttttcc

SEQ ID NO: 278585 - DNA, 20 bp, Artificial Sequence
  Description of Artificial Sequence: Synthetic oligonucleotide
  Target: ATXN1; (+) strand; PAM type: YTN; PAM sequence: CTT
caggtcttatttttccttat

SEQ ID NO: 278586 - DNA, 20 bp, Artificial Sequence
  Description of Artificial Sequence: Synthetic oligonucleotide
  Target: ATXN1; (+) strand; PAM type: YTN; PAM sequence: TTC
aggtcttatttttccttata

SEQ ID NO: 278587 - DNA, 20 bp, Artificial Sequence
  Description of Artificial Sequence: Synthetic oligonucleotide
  Target: ATXN1; (+) strand; PAM type: YTN; PAM sequence: CTT
atttttccttataaaaatca

SEQ ID NO: 278588 - DNA, 20 bp, Artificial Sequence
  Description of Artificial Sequence: Synthetic oligonucleotide
  Target: ATXN1; (+) strand; PAM type: YTN; PAM sequence: TTA
tttttccttataaaaatcat

SEQ ID NO: 278589 - DNA, 20 bp, Artificial Sequence
  Description of Artificial Sequence: Synthetic oligonucleotide
  Target: ATXN1; (+) strand; PAM type: YTN; PAM sequence: TTT
ttccttataaaaatcatgag

SEQ ID NO: 278590 - DNA, 20 bp, Artificial Sequence
  Description of Artificial Sequence: Synthetic oligonucleotide
  Target: ATXN1; (+) strand; PAM type: YTN; PAM sequence: TTT
tccttataaaaatcatgagt

SEQ ID NO: 278591 - DNA, 20 bp, Artificial Sequence
  Description of Artificial Sequence: Synthetic oligonucleotide
  Target: ATXN1; (+) strand; PAM type: YTN; PAM sequence: TTT
ccttataaaaatcatgagtt

SEQ ID NO: 278592 - DNA, 20 bp, Artificial Sequence
  Description of Artificial Sequence: Synthetic oligonucleotide
  Target: ATXN1; (+) strand; PAM type: YTN; PAM sequence: TTC
cttataaaaatcatgagtta

SEQ ID NO: 278593 - DNA, 20 bp, Artificial Sequence
  Description of Artificial Sequence: Synthetic oligonucleotide
  Target: ATXN1; (+) strand; PAM type: YTN; PAM sequence: CTT
ataaaaatcatgagttactc

SEQ ID NO: 278594 - DNA, 20 bp, Artificial Sequence
  Description of Artificial Sequence: Synthetic oligonucleotide
  Target: ATXN1; (+) strand; PAM type: YTN; PAM sequence: TTA
taaaaatcatgagttactcc

SEQ ID NO: 278595 - DNA, 20 bp, Artificial Sequence
  Description of Artificial Sequence: Synthetic oligonucleotide
  Target: ATXN1; (+) strand; PAM type: YTN; PAM sequence: TTA
ctcctagccccattttacag

SEQ ID NO: 278596 - DNA, 20 bp, Artificial Sequence
  Description of Artificial Sequence: Synthetic oligonucleotide
  Target: ATXN1; (+) strand; PAM type: YTN; PAM sequence: CTC
ctagccccattttacagatg

SEQ ID NO: 278597 - DNA, 20 bp, Artificial Sequence
  Description of Artificial Sequence: Synthetic oligonucleotide
  Target: ATXN1; (+) strand; PAM type: YTN; PAM sequence: CTA
gccccattttacagatgata

SEQ ID NO: 278598 - DNA, 20 bp, Artificial Sequence
  Description of Artificial Sequence: Synthetic oligonucleotide
  Target: ATXN1; (+) strand; PAM type: YTN; PAM sequence: TTT
tacagatgataaattaaggc

SEQ ID NO: 278599 - DNA, 20 bp, Artificial Sequence
  Description of Artificial Sequence: Synthetic oligonucleotide
  Target: ATXN1; (+) strand; PAM type: YTN; PAM sequence: TTT
acagatgataaattaaggca

SEQ ID NO: 278600 - DNA, 20 bp, Artificial Sequence
  Description of Artificial Sequence: Synthetic oligonucleotide
  Target: ATXN1; (+) strand; PAM type: YTN; PAM sequence: TTA
cagatgataaattaaggcag

SEQ ID NO: 278601 - DNA, 20 bp, Artificial Sequence
  Description of Artificial Sequence: Synthetic oligonucleotide
  Target: ATXN1; (+) strand; PAM type: YTN; PAM sequence: TTA
aggcagaggttatgcaactt

SEQ ID NO: 278602 - DNA, 20 bp, Artificial Sequence
  Description of Artificial Sequence: Synthetic oligonucleotide
  Target: ATXN1; (+) strand; PAM type: YTN; PAM sequence: TTA
tgcaacttgcctaaataaac

SEQ ID NO: 278603 - DNA, 20 bp, Artificial Sequence
  Description of Artificial Sequence: Synthetic oligonucleotide
  Target: ATXN1; (+) strand; PAM type: YTN; PAM sequence: CTT
gcctaaataaactaatgagt

SEQ ID NO: 278604 - DNA, 20 bp, Artificial Sequence
  Description of Artificial Sequence: Synthetic oligonucleotide
  Target: ATXN1; (+) strand; PAM type: YTN; PAM sequence: TTG
cctaaataaactaatgagtt

SEQ ID NO: 278605 - DNA, 20 bp, Artificial Sequence
  Description of Artificial Sequence: Synthetic oligonucleotide
  Target: ATXN1; (+) strand; PAM type: YTN; PAM sequence: CTA
aataaactaatgagttgaca

SEQ ID NO: 278606 - DNA, 20 bp, Artificial Sequence
  Description of Artificial Sequence: Synthetic oligonucleotide
  Target: ATXN1; (+) strand; PAM type: YTN; PAM sequence: CTA
atgagttgacagtggacctg

SEQ ID NO: 278607 - DNA, 20 bp, Artificial Sequence
  Description of Artificial Sequence: Synthetic oligonucleotide
  Target: ATXN1; (+) strand; PAM type: YTN; PAM sequence: TTG
acagtggacctgaagttaga

SEQ ID NO: 278608 - DNA, 20 bp, Artificial Sequence
  Description of Artificial Sequence: Synthetic oligonucleotide
  Target: ATXN1; (+) strand; PAM type: YTN; PAM sequence: CTG
aagttagaatcactgcatcc

SEQ ID NO: 278609 - DNA, 20 bp, Artificial Sequence
  Description of Artificial Sequence: Synthetic oligonucleotide
  Target: ATXN1; (+) strand; PAM type: YTN; PAM sequence: TTA
gaatcactgcatcctaattc

SEQ ID NO: 278610 - DNA, 20 bp, Artificial Sequence
  Description of Artificial Sequence: Synthetic oligonucleotide
  Target: ATXN1; (+) strand; PAM type: YTN; PAM sequence: CTG
catcctaattcaaaaactag

SEQ ID NO: 278611 - DNA, 20 bp, Artificial Sequence
  Description of Artificial Sequence: Synthetic oligonucleotide
  Target: ATXN1; (+) strand; PAM type: YTN; PAM sequence: CTA
attcaaaaactagtatggct

SEQ ID NO: 278612 - DNA, 20 bp, Artificial Sequence
  Description of Artificial Sequence: Synthetic oligonucleotide
  Target: ATXN1; (+) strand; PAM type: YTN; PAM sequence: TTC
aaaaactagtatggcttttc

SEQ ID NO: 278613 - DNA, 20 bp, Artificial Sequence
  Description of Artificial Sequence: Synthetic oligonucleotide
  Target: ATXN1; (+) strand; PAM type: YTN; PAM sequence: CTA
gtatggcttttcagagggga

SEQ ID NO: 278614 - DNA, 20 bp, Artificial Sequence
  Description of Artificial Sequence: Synthetic oligonucleotide
  Target: ATXN1; (+) strand; PAM type: YTN; PAM sequence: CTT
ttcagaggggataattcaac

SEQ ID NO: 278615 - DNA, 20 bp, Artificial Sequence
  Description of Artificial Sequence: Synthetic oligonucleotide
  Target: ATXN1; (+) strand; PAM type: YTN; PAM sequence: TTT
tcagaggggataattcaacc

SEQ ID NO: 278616 - DNA, 20 bp, Artificial Sequence
  Description of Artificial Sequence: Synthetic oligonucleotide
  Target: ATXN1; (+) strand; PAM type: YTN; PAM sequence: TTT
cagaggggataattcaacct

SEQ ID NO: 278617 - DNA, 20 bp, Artificial Sequence
  Description of Artificial Sequence: Synthetic oligonucleotide
  Target: ATXN1; (+) strand; PAM type: YTN; PAM sequence: TTC
agaggggataattcaaccta

SEQ ID NO: 278618 - DNA, 20 bp, Artificial Sequence
  Description of Artificial Sequence: Synthetic oligonucleotide
  Target: ATXN1; (+) strand; PAM type: YTN; PAM sequence: TTC
aacctaacatccttggagac

SEQ ID NO: 278619 - DNA, 20 bp, Artificial Sequence
  Description of Artificial Sequence: Synthetic oligonucleotide
  Target: ATXN1; (+) strand; PAM type: YTN; PAM sequence: CTA
acatccttggagacataaca

SEQ ID NO: 278620 - DNA, 20 bp, Artificial Sequence
  Description of Artificial Sequence: Synthetic oligonucleotide
  Target: ATXN1; (+) strand; PAM type: YTN; PAM sequence: CTT
ggagacataacactggagat

SEQ ID NO: 278621 - DNA, 20 bp, Artificial Sequence
  Description of Artificial Sequence: Synthetic oligonucleotide
  Target: ATXN1; (+) strand; PAM type: YTN; PAM sequence: TTG
gagacataacactggagata

SEQ ID NO: 278622 - DNA, 20 bp, Artificial Sequence
  Description of Artificial Sequence: Synthetic oligonucleotide
  Target: ATXN1; (+) strand; PAM type: YTN; PAM sequence: CTG
gagataaaataacataaatg

SEQ ID NO: 278623 - DNA, 20 bp, Artificial Sequence
  Description of Artificial Sequence: Synthetic oligonucleotide
  Target: ATXN1; (+) strand; PAM type: YTN; PAM sequence: CTT
ggataagttcctacatattt

SEQ ID NO: 278624 - DNA, 20 bp, Artificial Sequence
  Description of Artificial Sequence: Synthetic oligonucleotide
  Target: ATXN1; (+) strand; PAM type: YTN; PAM sequence: TTG
gataagttcctacatatttt

SEQ ID NO: 278625 - DNA, 20 bp, Artificial Sequence
  Description of Artificial Sequence: Synthetic oligonucleotide
  Target: ATXN1; (+) strand; PAM type: YTN; PAM sequence: TTC
ctacatattttactgcagga

SEQ ID NO: 278626 - DNA, 20 bp, Artificial Sequence
  Description of Artificial Sequence: Synthetic oligonucleotide
  Target: ATXN1; (+) strand; PAM type: YTN; PAM sequence: CTA
catattttactgcaggaaga

SEQ ID NO: 278627 - DNA, 20 bp, Artificial Sequence
  Description of Artificial Sequence: Synthetic oligonucleotide
  Target: ATXN1; (+) strand; PAM type: YTN; PAM sequence: TTT
tactgcaggaagaagccaca

SEQ ID NO: 278628 - DNA, 20 bp, Artificial Sequence
  Description of Artificial Sequence: Synthetic oligonucleotide
  Target: ATXN1; (+) strand; PAM type: YTN; PAM sequence: TTT
actgcaggaagaagccacat

SEQ ID NO: 278629 - DNA, 20 bp, Artificial Sequence
  Description of Artificial Sequence: Synthetic oligonucleotide
  Target: ATXN1; (+) strand; PAM type: YTN; PAM sequence: TTA
ctgcaggaagaagccacatg

SEQ ID NO: 278630 - DNA, 20 bp, Artificial Sequence
  Description of Artificial Sequence: Synthetic oligonucleotide
  Target: ATXN1; (+) strand; PAM type: YTN; PAM sequence: CTG
caggaagaagccacatgtat

SEQ ID NO: 278631 - DNA, 20 bp, Artificial Sequence
  Description of Artificial Sequence: Synthetic oligonucleotide
  Target: ATXN1; (+) strand; PAM type: YTN; PAM sequence: TTT
ctgtgatgggtttgcagaac

SEQ ID NO: 278632 - DNA, 20 bp, Artificial Sequence
  Description of Artificial Sequence: Synthetic oligonucleotide
  Target: ATXN1; (+) strand; PAM type: YTN; PAM sequence: TTC
tgtgatgggtttgcagaacg

SEQ ID NO: 278633 - DNA, 20 bp, Artificial Sequence
  Description of Artificial Sequence: Synthetic oligonucleotide
  Target: ATXN1; (+) strand; PAM type: YTN; PAM sequence: CTG
tgatgggtttgcagaacgga

SEQ ID NO: 278634 - DNA, 20 bp, Artificial Sequence
  Description of Artificial Sequence: Synthetic oligonucleotide
  Target: ATXN1; (+) strand; PAM type: YTN; PAM sequence: TTT
gcagaacggatcccagcgct

SEQ ID NO: 278635 - DNA, 20 bp, Artificial Sequence
  Description of Artificial Sequence: Synthetic oligonucleotide
  Target: ATXN1; (+) strand; PAM type: YTN; PAM sequence: TTG
cagaacggatcccagcgctg

SEQ ID NO: 278636 - DNA, 20 bp, Artificial Sequence
  Description of Artificial Sequence: Synthetic oligonucleotide
  Target: ATXN1; (+) strand; PAM type: YTN; PAM sequence: CTG
tgaaggaggccagtctagac

SEQ ID NO: 278637 - DNA, 20 bp, Artificial Sequence
  Description of Artificial Sequence: Synthetic oligonucleotide
  Target: ATXN1; (+) strand; PAM type: YTN; PAM sequence: CTA
gacgggctcccatatccctt

SEQ ID NO: 278638 - DNA, 20 bp, Artificial Sequence
  Description of Artificial Sequence: Synthetic oligonucleotide
  Target: ATXN1; (+) strand; PAM type: YTN; PAM sequence: CTC
ccatatcccttagaacacat

SEQ ID NO: 278639 - DNA, 20 bp, Artificial Sequence
  Description of Artificial Sequence: Synthetic oligonucleotide
  Target: ATXN1; (+) strand; PAM type: YTN; PAM sequence: CTT
agaacacataaaggaagcta

SEQ ID NO: 278640 - DNA, 20 bp, Artificial Sequence
  Description of Artificial Sequence: Synthetic oligonucleotide
  Target: ATXN1; (+) strand; PAM type: YTN; PAM sequence: TTA
gaacacataaaggaagctat

SEQ ID NO: 278641 - DNA, 20 bp, Artificial Sequence
  Description of Artificial Sequence: Synthetic oligonucleotide
  Target: ATXN1; (+) strand; PAM type: YTN; PAM sequence: CTA
ttctaggcaagtcatacaag

SEQ ID NO: 278642 - DNA, 20 bp, Artificial Sequence
  Description of Artificial Sequence: Synthetic oligonucleotide
  Target: ATXN1; (+) strand; PAM type: YTN; PAM sequence: TTC
taggcaagtcatacaagact

SEQ ID NO: 278643 - DNA, 20 bp, Artificial Sequence
  Description of Artificial Sequence: Synthetic oligonucleotide
  Target: ATXN1; (+) strand; PAM type: YTN; PAM sequence: CTA
ggcaagtcatacaagacttg

SEQ ID NO: 278644 - DNA, 20 bp, Artificial Sequence
  Description of Artificial Sequence: Synthetic oligonucleotide
  Target: ATXN1; (+) strand; PAM type: YTN; PAM sequence: CTT
gtgattggtgaaaacagaga

SEQ ID NO: 278645 - DNA, 20 bp, Artificial Sequence
  Description of Artificial Sequence: Synthetic oligonucleotide
  Target: ATXN1; (+) strand; PAM type: YTN; PAM sequence: TTG
tgattggtgaaaacagagaa

SEQ ID NO: 278646 - DNA, 20 bp, Artificial Sequence
  Description of Artificial Sequence: Synthetic oligonucleotide
  Target: ATXN1; (+) strand; PAM type: YTN; PAM sequence: TTG
gtgaaaacagagaatatatt

SEQ ID NO: 278647 - DNA, 20 bp, Artificial Sequence
  Description of Artificial Sequence: Synthetic oligonucleotide
  Target: ATXN1; (+) strand; PAM type: YTN; PAM sequence: TTT
tctaattcatgacaggcccc

SEQ ID NO: 278648 - DNA, 20 bp, Artificial Sequence
  Description of Artificial Sequence: Synthetic oligonucleotide
  Target: ATXN1; (+) strand; PAM type: YTN; PAM sequence: TTT
ctaattcatgacaggcccca

SEQ ID NO: 278649 - DNA, 20 bp, Artificial Sequence
  Description of Artificial Sequence: Synthetic oligonucleotide
  Target: ATXN1; (+) strand; PAM type: YTN; PAM sequence: TTC
taattcatgacaggccccaa

SEQ ID NO: 278650 - DNA, 20 bp, Artificial Sequence
  Description of Artificial Sequence: Synthetic oligonucleotide
  Target: ATXN1; (+) strand; PAM type: YTN; PAM sequence: CTA
attcatgacaggccccaaca

SEQ ID NO: 278651 - DNA, 20 bp, Artificial Sequence
  Description of Artificial Sequence: Synthetic oligonucleotide
  Target: ATXN1; (+) strand; PAM type: YTN; PAM sequence: TTC
atgacaggccccaacattcc

SEQ ID NO: 278652 - DNA, 20 bp, Artificial Sequence
  Description of Artificial Sequence: Synthetic oligonucleotide
  Target: ATXN1; (+) strand; PAM type: YTN; PAM sequence: TTC
cctttggtctttcacgatct

SEQ ID NO: 278653 - DNA, 20 bp, Artificial Sequence
  Description of Artificial Sequence: Synthetic oligonucleotide
  Target: ATXN1; (+) strand; PAM type: YTN; PAM sequence: CTT
tggtctttcacgatctgaat

SEQ ID NO: 278654 - DNA, 20 bp, Artificial Sequence
  Description of Artificial Sequence: Synthetic oligonucleotide
  Target: ATXN1; (+) strand; PAM type: YTN; PAM sequence: TTT
ggtctttcacgatctgaatt

SEQ ID NO: 278655 - DNA, 20 bp, Artificial Sequence
  Description of Artificial Sequence: Synthetic oligonucleotide
  Target: ATXN1; (+) strand; PAM type: YTN; PAM sequence: TTG
gtctttcacgatctgaattc

SEQ ID NO: 278656 - DNA, 20 bp, Artificial Sequence
  Description of Artificial Sequence: Synthetic oligonucleotide
  Target: ATXN1; (+) strand; PAM type: YTN; PAM sequence: CTT
tcacgatctgaattcatgaa

SEQ ID NO: 278657 - DNA, 20 bp, Artificial Sequence
  Description of Artificial Sequence: Synthetic oligonucleotide
  Target: ATXN1; (+) strand; PAM type: YTN; PAM sequence: TTT
cacgatctgaattcatgaaa

SEQ ID NO: 278658 - DNA, 20 bp, Artificial Sequence
  Description of Artificial Sequence: Synthetic oligonucleotide
  Target: ATXN1; (+) strand; PAM type: YTN; PAM sequence: TTC
acgatctgaattcatgaaag

SEQ ID NO: 278659 - DNA, 20 bp, Artificial Sequence
  Description of Artificial Sequence: Synthetic oligonucleotide
  Target: ATXN1; (+) strand; PAM type: YTN; PAM sequence: CTG
aattcatgaaagaaagattc

SEQ ID NO: 278660 - DNA, 20 bp, Artificial Sequence
  Description of Artificial Sequence: Synthetic oligonucleotide
  Target: ATXN1; (+) strand; PAM type: YTN; PAM sequence: TTC
atgaaagaaagattccagaa

SEQ ID NO: 278661 - DNA, 20 bp, Artificial Sequence
  Description of Artificial Sequence: Synthetic oligonucleotide
  Target: ATXN1; (+) strand; PAM type: YTN; PAM sequence: TTC
cagaaggaagtggaatctga

SEQ ID NO: 278662 - DNA, 20 bp, Artificial Sequence
  Description of Artificial Sequence: Synthetic oligonucleotide
  Target: ATXN1; (+) strand; PAM type: YTN; PAM sequence: CTG
agctaatgctaaagaaataa

SEQ ID NO: 278663 - DNA, 20 bp, Artificial Sequence
  Description of Artificial Sequence: Synthetic oligonucleotide
  Target: ATXN1; (+) strand; PAM type: YTN; PAM sequence: CTA
atgctaaagaaataaaacag

SEQ ID NO: 278664 - DNA, 20 bp, Artificial Sequence
  Description of Artificial Sequence: Synthetic oligonucleotide
  Target: ATXN1; (+) strand; PAM type: YTN; PAM sequence: CTA
aagaaataaaacagcttgag

SEQ ID NO: 278665 - DNA, 20 bp, Artificial Sequence
  Description of Artificial Sequence: Synthetic oligonucleotide
  Target: ATXN1; (+) strand; PAM type: YTN; PAM sequence: CTT
gagaaaaagtgggaagaaac

SEQ ID NO: 278666 - DNA, 20 bp, Artificial Sequence
  Description of Artificial Sequence: Synthetic oligonucleotide
  Target: ATXN1; (+) strand; PAM type: YTN; PAM sequence: TTG
agaaaaagtgggaagaaacg

SEQ ID NO: 278667 - DNA, 20 bp, Artificial Sequence
  Description of Artificial Sequence: Synthetic oligonucleotide
  Target: ATXN1; (+) strand; PAM type: YTN; PAM sequence: CTA
atatgttcaagagaccattg

SEQ ID NO: 278668 - DNA, 20 bp, Artificial Sequence
  Description of Artificial Sequence: Synthetic oligonucleotide
  Target: ATXN1; (+) strand; PAM type: YTN; PAM sequence: TTC
aagagaccattgcggttgga

SEQ ID NO: 278669 - DNA, 20 bp, Artificial Sequence
  Description of Artificial Sequence: Synthetic oligonucleotide
  Target: ATXN1; (+) strand; PAM type: YTN; PAM sequence: TTG
cggttggaggtgtatgtgtg

SEQ ID NO: 278670 - DNA, 20 bp, Artificial Sequence
  Description of Artificial Sequence: Synthetic oligonucleotide
  Target: ATXN1; (+) strand; PAM type: YTN; PAM sequence: TTG
gaggtgtatgtgtgtgggga

SEQ ID NO: 278671 - DNA, 20 bp, Artificial Sequence
  Description of Artificial Sequence: Synthetic oligonucleotide
  Target: ATXN1; (+) strand; PAM type: YTN; PAM sequence: TTA
catggtggagggtgtcaaag

SEQ ID NO: 278672 - DNA, 20 bp, Artificial Sequence
  Description of Artificial Sequence: Synthetic oligonucleotide
  Target: ATXN1; (+) strand; PAM type: YTN; PAM sequence: CTT
gctgagtaatttgagttgat

SEQ ID NO: 278673 - DNA, 20 bp, Artificial Sequence
  Description of Artificial Sequence: Synthetic oligonucleotide
  Target: ATXN1; (+) strand; PAM type: YTN; PAM sequence: TTG
ctgagtaatttgagttgatt

SEQ ID NO: 278674 - DNA, 20 bp, Artificial Sequence
  Description of Artificial Sequence: Synthetic oligonucleotide
  Target: ATXN1; (+) strand; PAM type: YTN; PAM sequence: CTG
agtaatttgagttgattctg

SEQ ID NO: 278675 - DNA, 20 bp, Artificial Sequence
  Description of Artificial Sequence: Synthetic oligonucleotide
  Target: ATXN1; (+) strand; PAM type: YTN; PAM sequence: TTT
gagttgattctgtaaaatct

SEQ ID NO: 278676 - DNA, 20 bp, Artificial Sequence
  Description of Artificial Sequence: Synthetic oligonucleotide
  Target: ATXN1; (+) strand; PAM type: YTN; PAM sequence: TTG
agttgattctgtaaaatctg

SEQ ID NO: 278677 - DNA, 20 bp, Artificial Sequence
  Description of Artificial Sequence: Synthetic oligonucleotide
  Target: ATXN1; (+) strand; PAM type: YTN; PAM sequence: TTG
attctgtaaaatctgaggga

SEQ ID NO: 278678 - DNA, 20 bp, Artificial Sequence
  Description of Artificial Sequence: Synthetic oligonucleotide
  Target: ATXN1; (+) strand; PAM type: YTN; PAM sequence: TTC
tgtaaaatctgagggacttc

SEQ ID NO: 278679 - DNA, 20 bp, Artificial Sequence
  Description of Artificial Sequence: Synthetic oligonucleotide
  Target: ATXN1; (+) strand; PAM type: YTN; PAM sequence: CTG
taaaatctgagggacttctg

SEQ ID NO: 278680 - DNA, 20 bp, Artificial Sequence
  Description of Artificial Sequence: Synthetic oligonucleotide
  Target: ATXN1; (+) strand; PAM type: YTN; PAM sequence: CTG
agggacttctgaagatttcc

SEQ ID NO: 278681 - DNA, 20 bp, Artificial Sequence
  Description of Artificial Sequence: Synthetic oligonucleotide
  Target: ATXN1; (+) strand; PAM type: YTN; PAM sequence: CTT
ctgaagatttccgagcaggg

SEQ ID NO: 278682 - DNA, 20 bp, Artificial Sequence
  Description of Artificial Sequence: Synthetic oligonucleotide
  Target: ATXN1; (+) strand; PAM type: YTN; PAM sequence: TTC
tgaagatttccgagcagggg

SEQ ID NO: 278683 - DNA, 20 bp, Artificial Sequence
  Description of Artificial Sequence: Synthetic oligonucleotide
  Target: ATXN1; (+) strand; PAM type: YTN; PAM sequence: CTG
aagatttccgagcaggggaa

SEQ ID NO: 278684 - DNA, 20 bp, Artificial Sequence
  Description of Artificial Sequence: Synthetic oligonucleotide
  Target: ATXN1; (+) strand; PAM type: YTN; PAM sequence: TTT
ccgagcaggggaatgctttc

SEQ ID NO: 278685 - DNA, 20 bp, Artificial Sequence
  Description of Artificial Sequence: Synthetic oligonucleotide
  Target: ATXN1; (+) strand; PAM type: YTN; PAM sequence: TTC
cgagcaggggaatgctttca

SEQ ID NO: 278686 - DNA, 20 bp, Artificial Sequence
  Description of Artificial Sequence: Synthetic oligonucleotide
  Target: ATXN1; (+) strand; PAM type: YTN; PAM sequence: CTT
tcattagatgtgtactatgt

SEQ ID NO: 278687 - DNA, 20 bp, Artificial Sequence
  Description of Artificial Sequence: Synthetic oligonucleotide
  Target: ATXN1; (+) strand; PAM type: YTN; PAM sequence: TTT
cattagatgtgtactatgtc

SEQ ID NO: 278688 - DNA, 20 bp, Artificial Sequence
  Description of Artificial Sequence: Synthetic oligonucleotide
  Target: ATXN1; (+) strand; PAM type: YTN; PAM sequence: TTC
attagatgtgtactatgtct

SEQ ID NO: 278689 - DNA, 20 bp, Artificial Sequence
  Description of Artificial Sequence: Synthetic oligonucleotide
  Target: ATXN1; (+) strand; PAM type: YTN; PAM sequence: TTA
gatgtgtactatgtctactg

SEQ ID NO: 278690 - DNA, 20 bp, Artificial Sequence
  Description of Artificial Sequence: Synthetic oligonucleotide
  Target: ATXN1; (+) strand; PAM type: YTN; PAM sequence: CTA
tgtctactgcttctaagtga

SEQ ID NO: 278691 - DNA, 20 bp, Artificial Sequence
  Description of Artificial Sequence: Synthetic oligonucleotide
  Target: ATXN1; (+) strand; PAM type: YTN; PAM sequence: CTA
ctgcttctaagtgagtgact

SEQ ID NO: 278692 - DNA, 20 bp, Artificial Sequence
  Description of Artificial Sequence: Synthetic oligonucleotide
  Target: ATXN1; (+) strand; PAM type: YTN; PAM sequence: CTG
cttctaagtgagtgactctg

SEQ ID NO: 278693 - DNA, 20 bp, Artificial Sequence
  Description of Artificial Sequence: Synthetic oligonucleotide
  Target: ATXN1; (+) strand; PAM type: YTN; PAM sequence: CTT
ctaagtgagtgactctgaaa

SEQ ID NO: 278694 - DNA, 20 bp, Artificial Sequence
  Description of Artificial Sequence: Synthetic oligonucleotide
  Target: ATXN1; (+) strand; PAM type: YTN; PAM sequence: TTC
taagtgagtgactctgaaat

SEQ ID NO: 278695 - DNA, 20 bp, Artificial Sequence
  Description of Artificial Sequence: Synthetic oligonucleotide
  Target: ATXN1; (+) strand; PAM type: YTN; PAM sequence: CTA
agtgagtgactctgaaatcc

SEQ ID NO: 278696 - DNA, 20 bp, Artificial Sequence
  Description of Artificial Sequence: Synthetic oligonucleotide
  Target: ATXN1; (+) strand; PAM type: YTN; PAM sequence: CTC
tgaaatccacaagtcgagcc

SEQ ID NO: 278697 - DNA, 20 bp, Artificial Sequence
  Description of Artificial Sequence: Synthetic oligonucleotide
  Target: ATXN1; (+) strand; PAM type: YTN; PAM sequence: CTG
aaatccacaagtcgagccct

SEQ ID NO: 278698 - DNA, 20 bp, Artificial Sequence
  Description of Artificial Sequence: Synthetic oligonucleotide
  Target: ATXN1; (+) strand; PAM type: YTN; PAM sequence: CTG
acctctctttccaagatgca

SEQ ID NO: 278699 - DNA, 20 bp, Artificial Sequence
  Description of Artificial Sequence: Synthetic oligonucleotide
  Target: ATXN1; (+) strand; PAM type: YTN; PAM sequence: CTC
tctttccaagatgcagatct

SEQ ID NO: 278700 - DNA, 20 bp, Artificial Sequence
  Description of Artificial Sequence: Synthetic oligonucleotide
  Target: ATXN1; (+) strand; PAM type: YTN; PAM sequence: CTC
tttccaagatgcagatctgt

SEQ ID NO: 278701 - DNA, 20 bp, Artificial Sequence
  Description of Artificial Sequence: Synthetic oligonucleotide
  Target: ATXN1; (+) strand; PAM type: YTN; PAM sequence: CTT
tccaagatgcagatctgttt

SEQ ID NO: 278702 - DNA, 20 bp, Artificial Sequence
  Description of Artificial Sequence: Synthetic oligonucleotide
  Target: ATXN1; (+) strand; PAM type: YTN; PAM sequence: TTT
ccaagatgcagatctgtttt

SEQ ID NO: 278703 - DNA, 20 bp, Artificial Sequence
  Description of Artificial Sequence: Synthetic oligonucleotide
  Target: ATXN1; (+) strand; PAM type: YTN; PAM sequence: TTC
caagatgcagatctgttttt

SEQ ID NO: 278704 - DNA, 20 bp, Artificial Sequence
  Description of Artificial Sequence: Synthetic oligonucleotide
  Target: ATXN1; (+) strand; PAM type: YTN; PAM sequence: CTG
tttttctgaatgcctgctgc

SEQ ID NO: 278705 - DNA, 20 bp, Artificial Sequence
  Description of Artificial Sequence: Synthetic oligonucleotide
  Target: ATXN1; (+) strand; PAM type: YTN; PAM sequence: TTT
ttctgaatgcctgctgcacg

SEQ ID NO: 278706 - DNA, 20 bp, Artificial Sequence
  Description of Artificial Sequence: Synthetic oligonucleotide
  Target: ATXN1; (+) strand; PAM type: YTN; PAM sequence: TTT
tctgaatgcctgctgcacgt

SEQ ID NO: 278707 - DNA, 20 bp, Artificial Sequence
  Description of Artificial Sequence: Synthetic oligonucleotide
  Target: ATXN1; (+) strand; PAM type: YTN; PAM sequence: TTT
ctgaatgcctgctgcacgtc

SEQ ID NO: 278708 - DNA, 20 bp, Artificial Sequence
  Description of Artificial Sequence: Synthetic oligonucleotide
  Target: ATXN1; (+) strand; PAM type: YTN; PAM sequence: TTC
tgaatgcctgctgcacgtct

SEQ ID NO: 278709 - DNA, 20 bp, Artificial Sequence
  Description of Artificial Sequence: Synthetic oligonucleotide
  Target: ATXN1; (+) strand; PAM type: YTN; PAM sequence: CTG
aatgcctgctgcacgtctct

SEQ ID NO: 278710 - DNA, 20 bp, Artificial Sequence
  Description of Artificial Sequence: Synthetic oligonucleotide
  Target: ATXN1; (+) strand; PAM type: YTN; PAM sequence: CTG
ctgcacgtctctacacagct

SEQ ID NO: 278711 - DNA, 20 bp, Artificial Sequence
  Description of Artificial Sequence: Synthetic oligonucleotide
  Target: ATXN1; (+) strand; PAM type: YTN; PAM sequence: CTG
cacgtctctacacagctatc

SEQ ID NO: 278712 - DNA, 20 bp, Artificial Sequence
  Description of Artificial Sequence: Synthetic oligonucleotide
  Target: ATXN1; (+) strand; PAM type: YTN; PAM sequence: CTC
tacacagctatcctgctgtg

SEQ ID NO: 278713 - DNA, 20 bp, Artificial Sequence
  Description of Artificial Sequence: Synthetic oligonucleotide
  Target: ATXN1; (+) strand; PAM type: YTN; PAM sequence: CTA
cacagctatcctgctgtggc

SEQ ID NO: 278714 - DNA, 20 bp, Artificial Sequence
  Description of Artificial Sequence: Synthetic oligonucleotide
  Target: ATXN1; (+) strand; PAM type: YTN; PAM sequence: CTA
tcctgctgtggcgcttccag

SEQ ID NO: 278715 - DNA, 20 bp, Artificial Sequence
  Description of Artificial Sequence: Synthetic oligonucleotide
  Target: ATXN1; (+) strand; PAM type: YTN; PAM sequence: CTG
ctgtggcgcttccagctggg

SEQ ID NO: 278716 - DNA, 20 bp, Artificial Sequence
  Description of Artificial Sequence: Synthetic oligonucleotide
  Target: ATXN1; (+) strand; PAM type: YTN; PAM sequence: CTG
tggcgcttccagctgggcat

SEQ ID NO: 278717 - DNA, 20 bp, Artificial Sequence
  Description of Artificial Sequence: Synthetic oligonucleotide
  Target: ATXN1; (+) strand; PAM type: YTN; PAM sequence: CTT
ccagctgggcatgttagatc

SEQ ID NO: 278718 - DNA, 20 bp, Artificial Sequence
  Description of Artificial Sequence: Synthetic oligonucleotide
  Target: ATXN1; (+) strand; PAM type: YTN; PAM sequence: TTC
cagctgggcatgttagatct

SEQ ID NO: 278719 - DNA, 20 bp, Artificial Sequence
  Description of Artificial Sequence: Synthetic oligonucleotide
  Target: ATXN1; (+) strand; PAM type: YTN; PAM sequence: CTG
ggcatgttagatctctacag

SEQ ID NO: 278720 - DNA, 20 bp, Artificial Sequence
  Description of Artificial Sequence: Synthetic oligonucleotide
  Target: ATXN1; (+) strand; PAM type: YTN; PAM sequence: TTA
gatctctacagtccctaatg

SEQ ID NO: 278721 - DNA, 20 bp, Artificial Sequence
  Description of Artificial Sequence: Synthetic oligonucleotide
  Target: ATXN1; (+) strand; PAM type: YTN; PAM sequence: CTC
tacagtccctaatggtctgt

SEQ ID NO: 278722 - DNA, 20 bp, Artificial Sequence
  Description of Artificial Sequence: Synthetic oligonucleotide
  Target: ATXN1; (+) strand; PAM type: YTN; PAM sequence: CTA
cagtccctaatggtctgtga

SEQ ID NO: 278723 - DNA, 20 bp, Artificial Sequence
  Description of Artificial Sequence: Synthetic oligonucleotide
  Target: ATXN1; (+) strand; PAM type: YTN; PAM sequence: CTA
atggtctgtgattctagcag

SEQ ID NO: 278724 - DNA, 20 bp, Artificial Sequence
  Description of Artificial Sequence: Synthetic oligonucleotide
  Target: ATXN1; (+) strand; PAM type: YTN; PAM sequence: CTG
tgattctagcagaagttacg

SEQ ID NO: 278725 - DNA, 20 bp, Artificial Sequence
  Description of Artificial Sequence: Synthetic oligonucleotide
  Target: ATXN1; (+) strand; PAM type: YTN; PAM sequence: TTC
tagcagaagttacgggtctg

SEQ ID NO: 278726 - DNA, 20 bp, Artificial Sequence
  Description of Artificial Sequence: Synthetic oligonucleotide
  Target: ATXN1; (+) strand; PAM type: YTN; PAM sequence: CTA
gcagaagttacgggtctgaa

SEQ ID NO: 278727 - DNA, 20 bp, Artificial Sequence
  Description of Artificial Sequence: Synthetic oligonucleotide
  Target: ATXN1; (+) strand; PAM type: YTN; PAM sequence: TTA
cgggtctgaaaatttgacat

SEQ ID NO: 278728 - DNA, 20 bp, Artificial Sequence
  Description of Artificial Sequence: Synthetic oligonucleotide
  Target: ATXN1; (+) strand; PAM type: YTN; PAM sequence: CTG
aaaatttgacatttcccttg

SEQ ID NO: 278729 - DNA, 20 bp, Artificial Sequence
  Description of Artificial Sequence: Synthetic oligonucleotide
  Target: ATXN1; (+) strand; PAM type: YTN; PAM sequence: TTT
gacatttcccttgaaaacac

SEQ ID NO: 278730 - DNA, 20 bp, Artificial Sequence
  Description of Artificial Sequence: Synthetic oligonucleotide
  Target: ATXN1; (+) strand; PAM type: YTN; PAM sequence: TTG
acatttcccttgaaaacact

SEQ ID NO: 278731 - DNA, 20 bp, Artificial Sequence
  Description of Artificial Sequence: Synthetic oligonucleotide
  Target: ATXN1; (+) strand; PAM type: YTN; PAM sequence: TTT
cccttgaaaacactgaaaat

SEQ ID NO: 278732 - DNA, 20 bp, Artificial Sequence
  Description of Artificial Sequence: Synthetic oligonucleotide
  Target: ATXN1; (+) strand; PAM type: YTN; PAM sequence: TTC
ccttgaaaacactgaaaata

SEQ ID NO: 278733 - DNA, 20 bp, Artificial Sequence
  Description of Artificial Sequence: Synthetic oligonucleotide
  Target: ATXN1; (+) strand; PAM type: YTN; PAM sequence: CTT
gaaaacactgaaaataagga

SEQ ID NO: 278734 - DNA, 20 bp, Artificial Sequence
  Description of Artificial Sequence: Synthetic oligonucleotide
  Target: ATXN1; (+) strand; PAM type: YTN; PAM sequence: TTG
aaaacactgaaaataaggaa

SEQ ID NO: 278735 - DNA, 20 bp, Artificial Sequence
  Description of Artificial Sequence: Synthetic oligonucleotide
  Target: ATXN1; (+) strand; PAM type: YTN; PAM sequence: CTG
aaaataaggaaaagaaaagt

SEQ ID NO: 278736 - DNA, 20 bp, Artificial Sequence
  Description of Artificial Sequence: Synthetic oligonucleotide
  Target: ATXN1; (+) strand; PAM type: YTN; PAM sequence: TTC
aagaggaagagcaaaaagag

SEQ ID NO: 278737 - DNA, 20 bp, Artificial Sequence
  Description of Artificial Sequence: Synthetic oligonucleotide
  Target: ATXN1; (+) strand; PAM type: YTN; PAM sequence: CTT
taaatcgaaaaatcaagtct

SEQ ID NO: 278738 - DNA, 20 bp, Artificial Sequence
  Description of Artificial Sequence: Synthetic oligonucleotide
  Target: ATXN1; (+) strand; PAM type: YTN; PAM sequence: TTT
aaatcgaaaaatcaagtcta

SEQ ID NO: 278739 - DNA, 20 bp, Artificial Sequence
  Description of Artificial Sequence: Synthetic oligonucleotide
  Target: ATXN1; (+) strand; PAM type: YTN; PAM sequence: TTA
aatcgaaaaatcaagtctat

SEQ ID NO: 278740 - DNA, 20 bp, Artificial Sequence
  Description of Artificial Sequence: Synthetic oligonucleotide
  Target: ATXN1; (+) strand; PAM type: YTN; PAM sequence: CTA
tgttagtcatttctctctgg

SEQ ID NO: 278741 - DNA, 20 bp, Artificial Sequence
  Description of Artificial Sequence: Synthetic oligonucleotide
  Target: ATXN1; (+) strand; PAM type: YTN; PAM sequence: TTA
gtcatttctctctggctgtg

SEQ ID NO: 278742 - DNA, 20 bp, Artificial Sequence
  Description of Artificial Sequence: Synthetic oligonucleotide
  Target: ATXN1; (+) strand; PAM type: YTN; PAM sequence: TTT
ctctctggctgtgctcgggc

SEQ ID NO: 278743 - DNA, 20 bp, Artificial Sequence
  Description of Artificial Sequence: Synthetic oligonucleotide
  Target: ATXN1; (+) strand; PAM type: YTN; PAM sequence: TTC
tctctggctgtgctcgggct

SEQ ID NO: 278744 - DNA, 20 bp, Artificial Sequence
  Description of Artificial Sequence: Synthetic oligonucleotide
  Target: ATXN1; (+) strand; PAM type: YTN; PAM sequence: CTC
tctggctgtgctcgggctgt

SEQ ID NO: 278745 - DNA, 20 bp, Artificial Sequence
  Description of Artificial Sequence: Synthetic oligonucleotide
  Target: ATXN1; (+) strand; PAM type: YTN; PAM sequence: CTC
tggctgtgctcgggctgtga

SEQ ID NO: 278746 - DNA, 20 bp, Artificial Sequence
  Description of Artificial Sequence: Synthetic oligonucleotide
  Target: ATXN1; (+) strand; PAM type: YTN; PAM sequence: CTG
gctgtgctcgggctgtgaaa

SEQ ID NO: 278747 - DNA, 20 bp, Artificial Sequence
  Description of Artificial Sequence: Synthetic oligonucleotide
  Target: ATXN1; (+) strand; PAM type: YTN; PAM sequence: CTG
tgctcgggctgtgaaactgc

SEQ ID NO: 278748 - DNA, 20 bp, Artificial Sequence
  Description of Artificial Sequence: Synthetic oligonucleotide
  Target: ATXN1; (+) strand; PAM type: YTN; PAM sequence: CTC
gggctgtgaaactgcaagat

SEQ ID NO: 278749 - DNA, 20 bp, Artificial Sequence
  Description of Artificial Sequence: Synthetic oligonucleotide
  Target: ATXN1; (+) strand; PAM type: YTN; PAM sequence: CTG
tgaaactgcaagatgcacct

SEQ ID NO: 278750 - DNA, 20 bp, Artificial Sequence
  Description of Artificial Sequence: Synthetic oligonucleotide
  Target: ATXN1; (+) strand; PAM type: YTN; PAM sequence: CTG
caagatgcacctgtgtgcgt

SEQ ID NO: 278751 - DNA, 20 bp, Artificial Sequence
  Description of Artificial Sequence: Synthetic oligonucleotide
  Target: ATXN1; (+) strand; PAM type: YTN; PAM sequence: CTG
tgtgcgtataggatggtgga

SEQ ID NO: 278752 - DNA, 20 bp, Artificial Sequence
  Description of Artificial Sequence: Synthetic oligonucleotide
  Target: ATXN1; (+) strand; PAM type: YTN; PAM sequence: CTG
ctaaggcactctccaaggac

SEQ ID NO: 278753 - DNA, 20 bp, Artificial Sequence
  Description of Artificial Sequence: Synthetic oligonucleotide
  Target: ATXN1; (+) strand; PAM type: YTN; PAM sequence: CTA
aggcactctccaaggacaca

SEQ ID NO: 278754 - DNA, 20 bp, Artificial Sequence
  Description of Artificial Sequence: Synthetic oligonucleotide
  Target: ATXN1; (+) strand; PAM type: YTN; PAM sequence: CTC
tccaaggacacatgctctca

SEQ ID NO: 278755 - DNA, 20 bp, Artificial Sequence
  Description of Artificial Sequence: Synthetic oligonucleotide
  Target: ATXN1; (+) strand; PAM type: YTN; PAM sequence: CTC
caaggacacatgctctcaat

SEQ ID NO: 278756 - DNA, 20 bp, Artificial Sequence
  Description of Artificial Sequence: Synthetic oligonucleotide
  Target: ATXN1; (+) strand; PAM type: YTN; PAM sequence: CTC
tcaatgacaacccagaatgg

SEQ ID NO: 278757 - DNA, 20 bp, Artificial Sequence
  Description of Artificial Sequence: Synthetic oligonucleotide
  Target: ATXN1; (+) strand; PAM type: YTN; PAM sequence: CTC
aatgacaacccagaatggtt

SEQ ID NO: 278758 - DNA, 20 bp, Artificial Sequence
  Description of Artificial Sequence: Synthetic oligonucleotide
  Target: ATXN1; (+) strand; PAM type: YTN; PAM sequence: TTT
tcttgccactcaaagatgct

SEQ ID NO: 278759 - DNA, 20 bp, Artificial Sequence
  Description of Artificial Sequence: Synthetic oligonucleotide
  Target: ATXN1; (+) strand; PAM type: YTN; PAM sequence: TTT
cttgccactcaaagatgcta

SEQ ID NO: 278760 - DNA, 20 bp, Artificial Sequence
  Description of Artificial Sequence: Synthetic oligonucleotide
  Target: ATXN1; (+) strand; PAM type: YTN; PAM sequence: TTC
ttgccactcaaagatgctac

SEQ ID NO: 278761 - DNA, 20 bp, Artificial Sequence
  Description of Artificial Sequence: Synthetic oligonucleotide
  Target: ATXN1; (+) strand; PAM type: YTN; PAM sequence: CTT
gccactcaaagatgctactc

SEQ ID NO: 278762 - DNA, 20 bp, Artificial Sequence
  Description of Artificial Sequence: Synthetic oligonucleotide
  Target: ATXN1; (+) strand; PAM type: YTN; PAM sequence: TTG
ccactcaaagatgctactca

SEQ ID NO: 278763 - DNA, 20 bp, Artificial Sequence
  Description of Artificial Sequence: Synthetic oligonucleotide
  Target: ATXN1; (+) strand; PAM type: YTN; PAM sequence: CTC
aaagatgctactcacacgtg

SEQ ID NO: 278764 - DNA, 20 bp, Artificial Sequence
  Description of Artificial Sequence: Synthetic oligonucleotide
  Target: ATXN1; (+) strand; PAM type: YTN; PAM sequence: CTA
ctcacacgtggagaggctgg

SEQ ID NO: 278765 - DNA, 20 bp, Artificial Sequence
  Description of Artificial Sequence: Synthetic oligonucleotide
  Target: ATXN1; (+) strand; PAM type: YTN; PAM sequence: CTC
acacgtggagaggctggctc

SEQ ID NO: 278766 - DNA, 20 bp, Artificial Sequence
  Description of Artificial Sequence: Synthetic oligonucleotide
  Target: ATXN1; (+) strand; PAM type: YTN; PAM sequence: CTG
gctctagaaacaattaaagt

SEQ ID NO: 278767 - DNA, 20 bp, Artificial Sequence
  Description of Artificial Sequence: Synthetic oligonucleotide
  Target: ATXN1; (+) strand; PAM type: YTN; PAM sequence: CTC
tagaaacaattaaagtccag

SEQ ID NO: 278768 - DNA, 20 bp, Artificial Sequence
  Description of Artificial Sequence: Synthetic oligonucleotide
  Target: ATXN1; (+) strand; PAM type: YTN; PAM sequence: CTA
gaaacaattaaagtccagaa

SEQ ID NO: 278769 - DNA, 20 bp, Artificial Sequence
  Description of Artificial Sequence: Synthetic oligonucleotide
  Target: ATXN1; (+) strand; PAM type: YTN; PAM sequence: TTA
aagtccagaataaggatcct

SEQ ID NO: 278770 - DNA, 20 bp, Artificial Sequence
  Description of Artificial Sequence: Synthetic oligonucleotide
  Target: ATXN1; (+) strand; PAM type: YTN; PAM sequence: CTA
aattgctcaatattttaaac

SEQ ID NO: 278771 - DNA, 20 bp, Artificial Sequence
  Description of Artificial Sequence: Synthetic oligonucleotide
  Target: ATXN1; (+) strand; PAM type: YTN; PAM sequence: TTG
ctcaatattttaaacattct

SEQ ID NO: 278772 - DNA, 20 bp, Artificial Sequence
  Description of Artificial Sequence: Synthetic oligonucleotide
  Target: ATXN1; (+) strand; PAM type: YTN; PAM sequence: CTC
aatattttaaacattctatg

SEQ ID NO: 278773 - DNA, 20 bp, Artificial Sequence
  Description of Artificial Sequence: Synthetic oligonucleotide
  Target: ATXN1; (+) strand; PAM type: YTN; PAM sequence: TTT
taaacattctatgccactgt

SEQ ID NO: 278774 - DNA, 20 bp, Artificial Sequence
  Description of Artificial Sequence: Synthetic oligonucleotide
  Target: ATXN1; (+) strand; PAM type: YTN; PAM sequence: TTT
aaacattctatgccactgta

SEQ ID NO: 278775 - DNA, 20 bp, Artificial Sequence
  Description of Artificial Sequence: Synthetic oligonucleotide
  Target: ATXN1; (+) strand; PAM type: YTN; PAM sequence: TTA
aacattctatgccactgtac

SEQ ID NO: 278776 - DNA, 20 bp, Artificial Sequence
  Description of Artificial Sequence: Synthetic oligonucleotide
  Target: ATXN1; (+) strand; PAM type: YTN; PAM sequence: TTC
tatgccactgtaccccaact

SEQ ID NO: 278777 - DNA, 20 bp, Artificial Sequence
  Description of Artificial Sequence: Synthetic oligonucleotide
  Target: ATXN1; (+) strand; PAM type: YTN; PAM sequence: CTA
tgccactgtaccccaactca

SEQ ID NO: 278778 - DNA, 20 bp, Artificial Sequence
  Description of Artificial Sequence: Synthetic oligonucleotide
  Target: ATXN1; (+) strand; PAM type: YTN; PAM sequence: CTG
taccccaactcacacttgtc

SEQ ID NO: 278779 - DNA, 20 bp, Artificial Sequence
  Description of Artificial Sequence: Synthetic oligonucleotide
  Target: ATXN1; (+) strand; PAM type: YTN; PAM sequence: CTC
acacttgtctttctaaccag

SEQ ID NO: 278780 - DNA, 20 bp, Artificial Sequence
  Description of Artificial Sequence: Synthetic oligonucleotide
  Target: ATXN1; (+) strand; PAM type: YTN; PAM sequence: CTT
gtctttctaaccagctcact

SEQ ID NO: 278781 - DNA, 20 bp, Artificial Sequence
  Description of Artificial Sequence: Synthetic oligonucleotide
  Target: ATXN1; (+) strand; PAM type: YTN; PAM sequence: TTG
tctttctaaccagctcactc

SEQ ID NO: 278782 - DNA, 20 bp, Artificial Sequence
  Description of Artificial Sequence: Synthetic oligonucleotide
  Target: ATXN1; (+) strand; PAM type: YTN; PAM sequence: CTT
tctaaccagctcactctatg

SEQ ID NO: 278783 - DNA, 20 bp, Artificial Sequence
  Description of Artificial Sequence: Synthetic oligonucleotide
  Target: ATXN1; (+) strand; PAM type: YTN; PAM sequence: TTT
ctaaccagctcactctatgt

SEQ ID NO: 278784 - DNA, 20 bp, Artificial Sequence
  Description of Artificial Sequence: Synthetic oligonucleotide
  Target: ATXN1; (+) strand; PAM type: YTN; PAM sequence: TTC
taaccagctcactctatgtc

SEQ ID NO: 278785 - DNA, 20 bp, Artificial Sequence
  Description of Artificial Sequence: Synthetic oligonucleotide
  Target: ATXN1; (+) strand; PAM type: YTN; PAM sequence: CTA
accagctcactctatgtcta

SEQ ID NO: 278786 - DNA, 20 bp, Artificial Sequence
  Description of Artificial Sequence: Synthetic oligonucleotide
  Target: ATXN1; (+) strand; PAM type: YTN; PAM sequence: CTC
actctatgtctaatgagcaa

SEQ ID NO: 278787 - DNA, 20 bp, Artificial Sequence
  Description of Artificial Sequence: Synthetic oligonucleotide
  Target: ATXN1; (+) strand; PAM type: YTN; PAM sequence: CTC
tatgtctaatgagcaagtca

SEQ ID NO: 278788 - DNA, 20 bp, Artificial Sequence
  Description of Artificial Sequence: Synthetic oligonucleotide
  Target: ATXN1; (+) strand; PAM type: YTN; PAM sequence: CTA
tgtctaatgagcaagtcatc

SEQ ID NO: 278789 - DNA, 20 bp, Artificial Sequence
  Description of Artificial Sequence: Synthetic oligonucleotide
  Target: ATXN1; (+) strand; PAM type: YTN; PAM sequence: CTA
atgagcaagtcatccctaaa

SEQ ID NO: 278790 - DNA, 20 bp, Artificial Sequence
  Description of Artificial Sequence: Synthetic oligonucleotide
  Target: ATXN1; (+) strand; PAM type: YTN; PAM sequence: CTA
aatccttatgaagccatgta

SEQ ID NO: 278791 - DNA, 20 bp, Artificial Sequence
  Description of Artificial Sequence: Synthetic oligonucleotide
  Target: ATXN1; (+) strand; PAM type: YTN; PAM sequence: CTT
atgaagccatgtagtgggga

SEQ ID NO: 278792 - DNA, 20 bp, Artificial Sequence
  Description of Artificial Sequence: Synthetic oligonucleotide
  Target: ATXN1; (+) strand; PAM type: YTN; PAM sequence: TTA
tgaagccatgtagtggggag

SEQ ID NO: 278793 - DNA, 20 bp, Artificial Sequence
  Description of Artificial Sequence: Synthetic oligonucleotide
  Target: ATXN1; (+) strand; PAM type: YTN; PAM sequence: CTC
caagatactcctttaacagg

SEQ ID NO: 278794 - DNA, 20 bp, Artificial Sequence
  Description of Artificial Sequence: Synthetic oligonucleotide
  Target: ATXN1; (+) strand; PAM type: YTN; PAM sequence: CTC
ctttaacaggagtaaaggta

SEQ ID NO: 278795 - DNA, 20 bp, Artificial Sequence
  Description of Artificial Sequence: Synthetic oligonucleotide
  Target: ATXN1; (+) strand; PAM type: YTN; PAM sequence: CTT
taacaggagtaaaggtattt

SEQ ID NO: 278796 - DNA, 20 bp, Artificial Sequence
  Description of Artificial Sequence: Synthetic oligonucleotide
  Target: ATXN1; (+) strand; PAM type: YTN; PAM sequence: TTT
aacaggagtaaaggtatttt

SEQ ID NO: 278797 - DNA, 20 bp, Artificial Sequence
  Description of Artificial Sequence: Synthetic oligonucleotide
  Target: ATXN1; (+) strand; PAM type: YTN; PAM sequence: TTA
acaggagtaaaggtattttt

SEQ ID NO: 278798 - DNA, 20 bp, Artificial Sequence
  Description of Artificial Sequence: Synthetic oligonucleotide
  Target: ATXN1; (+) strand; PAM type: YTN; PAM sequence: TTT
ttctattaaaatgtccttct

SEQ ID NO: 278799 - DNA, 20 bp, Artificial Sequence
  Description of Artificial Sequence: Synthetic oligonucleotide
  Target: ATXN1; (+) strand; PAM type: YTN; PAM sequence: TTT
tctattaaaatgtccttctg

SEQ ID NO: 278800 - DNA, 20 bp, Artificial Sequence
  Description of Artificial Sequence: Synthetic oligonucleotide
  Target: ATXN1; (+) strand; PAM type: YTN; PAM sequence: TTT
ctattaaaatgtccttctgc

SEQ ID NO: 278801 - DNA, 20 bp, Artificial Sequence
  Description of Artificial Sequence: Synthetic oligonucleotide
  Target: ATXN1; (+) strand; PAM type: YTN; PAM sequence: TTC
tattaaaatgtccttctgct

SEQ ID NO: 278802 - DNA, 20 bp, Artificial Sequence
  Description of Artificial Sequence: Synthetic oligonucleotide
  Target: ATXN1; (+) strand; PAM type: YTN; PAM sequence: CTA
ttaaaatgtccttctgctgc

SEQ ID NO: 278803 - DNA, 20 bp, Artificial Sequence
  Description of Artificial Sequence: Synthetic oligonucleotide
  Target: ATXN1; (+) strand; PAM type: YTN; PAM sequence: TTA
aaatgtccttctgctgcttc

SEQ ID NO: 278804 - DNA, 20 bp, Artificial Sequence
  Description of Artificial Sequence: Synthetic oligonucleotide
  Target: ATXN1; (+) strand; PAM type: YTN; PAM sequence: CTT
ctgctgcttcaaaagaaaaa

SEQ ID NO: 278805 - DNA, 20 bp, Artificial Sequence
  Description of Artificial Sequence: Synthetic oligonucleotide
  Target: ATXN1; (+) strand; PAM type: YTN; PAM sequence: TTC
tgctgcttcaaaagaaaaaa

SEQ ID NO: 278806 - DNA, 20 bp, Artificial Sequence
  Description of Artificial Sequence: Synthetic oligonucleotide
  Target: ATXN1; (+) strand; PAM type: YTN; PAM sequence: CTG
ctgcttcaaaagaaaaaata

SEQ ID NO: 278807 - DNA, 20 bp, Artificial Sequence
  Description of Artificial Sequence: Synthetic oligonucleotide
  Target: ATXN1; (+) strand; PAM type: YTN; PAM sequence: CTG
cttcaaaagaaaaaatattg

SEQ ID NO: 278808 - DNA, 20 bp, Artificial Sequence
  Description of Artificial Sequence: Synthetic oligonucleotide
  Target: ATXN1; (+) strand; PAM type: YTN; PAM sequence: CTT
caaaagaaaaaatattgtgc

SEQ ID NO: 278809 - DNA, 20 bp, Artificial Sequence
  Description of Artificial Sequence: Synthetic oligonucleotide
  Target: ATXN1; (+) strand; PAM type: YTN; PAM sequence: TTC
aaaagaaaaaatattgtgca

SEQ ID NO: 278810 - DNA, 20 bp, Artificial Sequence
  Description of Artificial Sequence: Synthetic oligonucleotide
  Target: ATXN1; (+) strand; PAM type: YTN; PAM sequence: TTG
tgcacaacgttacgttagca

SEQ ID NO: 278811 - DNA, 20 bp, Artificial Sequence
  Description of Artificial Sequence: Synthetic oligonucleotide
  Target: ATXN1; (+) strand; PAM type: YTN; PAM sequence: TTA
cgttagcagagagaagacga

SEQ ID NO: 278812 - DNA, 20 bp, Artificial Sequence
  Description of Artificial Sequence: Synthetic oligonucleotide
  Target: ATXN1; (+) strand; PAM type: YTN; PAM sequence: TTA
gcagagagaagacgaagcag

SEQ ID NO: 278813 - DNA, 20 bp, Artificial Sequence
  Description of Artificial Sequence: Synthetic oligonucleotide
  Target: ATXN1; (+) strand; PAM type: YTN; PAM sequence: CTT
cattcacacagtgtgttttg

SEQ ID NO: 278814 - DNA, 20 bp, Artificial Sequence
  Description of Artificial Sequence: Synthetic oligonucleotide
  Target: ATXN1; (+) strand; PAM type: YTN; PAM sequence: TTC
attcacacagtgtgttttga

SEQ ID NO: 278815 - DNA, 20 bp, Artificial Sequence
  Description of Artificial Sequence: Synthetic oligonucleotide
  Target: ATXN1; (+) strand; PAM type: YTN; PAM sequence: TTC
acacagtgtgttttgaataa

SEQ ID NO: 278816 - DNA, 20 bp, Artificial Sequence
  Description of Artificial Sequence: Synthetic oligonucleotide
  Target: ATXN1; (+) strand; PAM type: YTN; PAM sequence: TTT
tgaataaggtgtaatttatc

SEQ ID NO: 278817 - DNA, 20 bp, Artificial Sequence
  Description of Artificial Sequence: Synthetic oligonucleotide
  Target: ATXN1; (+) strand; PAM type: YTN; PAM sequence: TTT
gaataaggtgtaatttatca

SEQ ID NO: 278818 - DNA, 20 bp, Artificial Sequence
  Description of Artificial Sequence: Synthetic oligonucleotide
  Target: ATXN1; (+) strand; PAM type: YTN; PAM sequence: TTG
aataaggtgtaatttatcag

SEQ ID NO: 278819 - DNA, 20 bp, Artificial Sequence
  Description of Artificial Sequence: Synthetic oligonucleotide
  Target: ATXN1; (+) strand; PAM type: YTN; PAM sequence: TTT
atcaggtagagaaatttctc

SEQ ID NO: 278820 - DNA, 20 bp, Artificial Sequence
  Description of Artificial Sequence: Synthetic oligonucleotide
  Target: ATXN1; (+) strand; PAM type: YTN; PAM sequence: TTA
tcaggtagagaaatttctct

SEQ ID NO: 278821 - DNA, 20 bp, Artificial Sequence
  Description of Artificial Sequence: Synthetic oligonucleotide
  Target: ATXN1; (+) strand; PAM type: YTN; PAM sequence: TTT
ctcttctcttttctggacat

SEQ ID NO: 278822 - DNA, 20 bp, Artificial Sequence
  Description of Artificial Sequence: Synthetic oligonucleotide
  Target: ATXN1; (+) strand; PAM type: YTN; PAM sequence: TTC
tcttctcttttctggacata

SEQ ID NO: 278823 - DNA, 20 bp, Artificial Sequence
  Description of Artificial Sequence: Synthetic oligonucleotide
  Target: ATXN1; (+) strand; PAM type: YTN; PAM sequence: CTC
ttctcttttctggacatagc

SEQ ID NO: 278824 - DNA, 20 bp, Artificial Sequence
  Description of Artificial Sequence: Synthetic oligonucleotide
  Target: ATXN1; (+) strand; PAM type: YTN; PAM sequence: CTT
ctcttttctggacatagctt

SEQ ID NO: 278825 - DNA, 20 bp, Artificial Sequence
  Description of Artificial Sequence: Synthetic oligonucleotide
  Target: ATXN1; (+) strand; PAM type: YTN; PAM sequence: TTC
tcttttctggacatagcttc

SEQ ID NO: 278826 - DNA, 20 bp, Artificial Sequence
  Description of Artificial Sequence: Synthetic oligonucleotide
  Target: ATXN1; (+) strand; PAM type: YTN; PAM sequence: CTC
ttttctggacatagcttcca

SEQ ID NO: 278827 - DNA, 20 bp, Artificial Sequence
  Description of Artificial Sequence: Synthetic oligonucleotide
  Target: ATXN1; (+) strand; PAM type: YTN; PAM sequence: CTT
ttctggacatagcttccaac

SEQ ID NO: 278828 - DNA, 20 bp, Artificial Sequence
  Description of Artificial Sequence: Synthetic oligonucleotide
  Target: ATXN1; (+) strand; PAM type: YTN; PAM sequence: TTT
tctggacatagcttccaaca

SEQ ID NO: 278829 - DNA, 20 bp, Artificial Sequence
  Description of Artificial Sequence: Synthetic oligonucleotide
  Target: ATXN1; (+) strand; PAM type: YTN; PAM sequence: TTT
ctggacatagcttccaacag

SEQ ID NO: 278830 - DNA, 20 bp, Artificial Sequence
  Description of Artificial Sequence: Synthetic oligonucleotide
  Target: ATXN1; (+) strand; PAM type: YTN; PAM sequence: TTC
tggacatagcttccaacagc

SEQ ID NO: 278831 - DNA, 20 bp, Artificial Sequence
  Description of Artificial Sequence: Synthetic oligonucleotide
  Target: ATXN1; (+) strand; PAM type: YTN; PAM sequence: CTG
gacatagcttccaacagcaa

SEQ ID NO: 278832 - DNA, 20 bp, Artificial Sequence
  Description of Artificial Sequence: Synthetic oligonucleotide
  Target: ATXN1; (+) strand; PAM type: YTN; PAM sequence: CTT
ccaacagcaaaaattagaag

SEQ ID NO: 278833 - DNA, 20 bp, Artificial Sequence
  Description of Artificial Sequence: Synthetic oligonucleotide
  Target: ATXN1; (+) strand; PAM type: YTN; PAM sequence: TTC
caacagcaaaaattagaagt

SEQ ID NO: 278834 - DNA, 20 bp, Artificial Sequence
  Description of Artificial Sequence: Synthetic oligonucleotide
  Target: ATXN1; (+) strand; PAM type: YTN; PAM sequence: TTA
gaagtgtaggtgggttgcca

SEQ ID NO: 278835 - DNA, 20 bp, Artificial Sequence
  Description of Artificial Sequence: Synthetic oligonucleotide
  Target: ATXN1; (+) strand; PAM type: YTN; PAM sequence: TTG
ccactccactcactaaattt

SEQ ID NO: 278836 - DNA, 20 bp, Artificial Sequence
  Description of Artificial Sequence: Synthetic oligonucleotide
  Target: ATXN1; (+) strand; PAM type: YTN; PAM sequence: CTC
cactcactaaatttataaaa

SEQ ID NO: 278837 - DNA, 20 bp, Artificial Sequence
  Description of Artificial Sequence: Synthetic oligonucleotide
  Target: ATXN1; (+) strand; PAM type: YTN; PAM sequence: CTC
actaaatttataaaagatac

SEQ ID NO: 278838 - DNA, 20 bp, Artificial Sequence
  Description of Artificial Sequence: Synthetic oligonucleotide
  Target: ATXN1; (+) strand; PAM type: YTN; PAM sequence: CTA
aatttataaaagatactcaa

SEQ ID NO: 278839 - DNA, 20 bp, Artificial Sequence
  Description of Artificial Sequence: Synthetic oligonucleotide
  Target: ATXN1; (+) strand; PAM type: YTN; PAM sequence: TTT
ataaaagatactcaaagata

SEQ ID NO: 278840 - DNA, 20 bp, Artificial Sequence
  Description of Artificial Sequence: Synthetic oligonucleotide
  Target: ATXN1; (+) strand; PAM type: YTN; PAM sequence: TTA
taaaagatactcaaagatac

SEQ ID NO: 278841 - DNA, 20 bp, Artificial Sequence
  Description of Artificial Sequence: Synthetic oligonucleotide
  Target: ATXN1; (+) strand; PAM type: YTN; PAM sequence: CTC
aaagatactcacacttttca

SEQ ID NO: 278842 - DNA, 20 bp, Artificial Sequence
  Description of Artificial Sequence: Synthetic oligonucleotide
  Target: ATXN1; (+) strand; PAM type: YTN; PAM sequence: CTC
acacttttcacaagtctacc

SEQ ID NO: 278843 - DNA, 20 bp, Artificial Sequence
  Description of Artificial Sequence: Synthetic oligonucleotide
  Target: ATXN1; (+) strand; PAM type: YTN; PAM sequence: CTT
ttcacaagtctacccccatc

SEQ ID NO: 278844 - DNA, 20 bp, Artificial Sequence
  Description of Artificial Sequence: Synthetic oligonucleotide
  Target: ATXN1; (+) strand; PAM type: YTN; PAM sequence: TTT
tcacaagtctacccccatct

SEQ ID NO: 278845 - DNA, 20 bp, Artificial Sequence
  Description of Artificial Sequence: Synthetic oligonucleotide
  Target: ATXN1; (+) strand; PAM type: YTN; PAM sequence: TTT
cacaagtctacccccatctg

SEQ ID NO: 278846 - DNA, 20 bp, Artificial Sequence
  Description of Artificial Sequence: Synthetic oligonucleotide
  Target: ATXN1; (+) strand; PAM type: YTN; PAM sequence: TTC
acaagtctacccccatctgc

SEQ ID NO: 278847 - DNA, 20 bp, Artificial Sequence
  Description of Artificial Sequence: Synthetic oligonucleotide
  Target: ATXN1; (+) strand; PAM type: YTN; PAM sequence: CTA
cccccatctgcccacatcca

SEQ ID NO: 278848 - DNA, 20 bp, Artificial Sequence
  Description of Artificial Sequence: Synthetic oligonucleotide
  Target: ATXN1; (+) strand; PAM type: YTN; PAM sequence: CTG
cccacatccagcatctatct

SEQ ID NO: 278849 - DNA, 20 bp, Artificial Sequence
  Description of Artificial Sequence: Synthetic oligonucleotide
  Target: ATXN1; (+) strand; PAM type: YTN; PAM sequence: CTA
tcttcgctgtgacagaaata

SEQ ID NO: 278850 - DNA, 20 bp, Artificial Sequence
  Description of Artificial Sequence: Synthetic oligonucleotide
  Target: ATXN1; (+) strand; PAM type: YTN; PAM sequence: CTT
cgctgtgacagaaataatta

SEQ ID NO: 278851 - DNA, 20 bp, Artificial Sequence
  Description of Artificial Sequence: Synthetic oligonucleotide
  Target: ATXN1; (+) strand; PAM type: YTN; PAM sequence: TTC
gctgtgacagaaataattac

SEQ ID NO: 278852 - DNA, 20 bp, Artificial Sequence
  Description of Artificial Sequence: Synthetic oligonucleotide
  Target: ATXN1; (+) strand; PAM type: YTN; PAM sequence: CTG
tgacagaaataattactatc

SEQ ID NO: 278853 - DNA, 20 bp, Artificial Sequence
  Description of Artificial Sequence: Synthetic oligonucleotide
  Target: ATXN1; (+) strand; PAM type: YTN; PAM sequence: TTA
ctatccgctgtacagccttg

SEQ ID NO: 278854 - DNA, 20 bp, Artificial Sequence
  Description of Artificial Sequence: Synthetic oligonucleotide
  Target: ATXN1; (+) strand; PAM type: YTN; PAM sequence: CTA
tccgctgtacagccttgact

SEQ ID NO: 278855 - DNA, 20 bp, Artificial Sequence
  Description of Artificial Sequence: Synthetic oligonucleotide
  Target: ATXN1; (+) strand; PAM type: YTN; PAM sequence: CTG
tacagccttgactggcggag

SEQ ID NO: 278856 - DNA, 20 bp, Artificial Sequence
  Description of Artificial Sequence: Synthetic oligonucleotide
  Target: ATXN1; (+) strand; PAM type: YTN; PAM sequence: CTT
gactggcggagctggccaga

SEQ ID NO: 278857 - DNA, 20 bp, Artificial Sequence
  Description of Artificial Sequence: Synthetic oligonucleotide
  Target: ATXN1; (+) strand; PAM type: YTN; PAM sequence: TTG
actggcggagctggccagaa

SEQ ID NO: 278858 - DNA, 20 bp, Artificial Sequence
  Description of Artificial Sequence: Synthetic oligonucleotide
  Target: ATXN1; (+) strand; PAM type: YTN; PAM sequence: CTG
gcggagctggccagaacatt

SEQ ID NO: 278859 - DNA, 20 bp, Artificial Sequence
  Description of Artificial Sequence: Synthetic oligonucleotide
  Target: ATXN1; (+) strand; PAM type: YTN; PAM sequence: CTG
gccagaacattgccttacgg

SEQ ID NO: 278860 - DNA, 20 bp, Artificial Sequence
  Description of Artificial Sequence: Synthetic oligonucleotide
  Target: ATXN1; (+) strand; PAM type: YTN; PAM sequence: TTG
ccttacgggggtgtatcacc

SEQ ID NO: 278861 - DNA, 20 bp, Artificial Sequence
  Description of Artificial Sequence: Synthetic oligonucleotide
  Target: ATXN1; (+) strand; PAM type: YTN; PAM sequence: CTT
acgggggtgtatcaccttga

SEQ ID NO: 278862 - DNA, 20 bp, Artificial Sequence
  Description of Artificial Sequence: Synthetic oligonucleotide
  Target: ATXN1; (+) strand; PAM type: YTN; PAM sequence: TTA
cgggggtgtatcaccttgaa

SEQ ID NO: 278863 - DNA, 20 bp, Artificial Sequence
  Description of Artificial Sequence: Synthetic oligonucleotide
  Target: ATXN1; (+) strand; PAM type: YTN; PAM sequence: CTT
gaagtctgtttacctgctgg

SEQ ID NO: 278864 - DNA, 20 bp, Artificial Sequence
  Description of Artificial Sequence: Synthetic oligonucleotide
  Target: ATXN1; (+) strand; PAM type: YTN; PAM sequence: TTG
aagtctgtttacctgctggt

SEQ ID NO: 278865 - DNA, 20 bp, Artificial Sequence
  Description of Artificial Sequence: Synthetic oligonucleotide
  Target: ATXN1; (+) strand; PAM type: YTN; PAM sequence: CTG
tttacctgctggtccatgtc

SEQ ID NO: 278866 - DNA, 20 bp, Artificial Sequence
  Description of Artificial Sequence: Synthetic oligonucleotide
  Target: ATXN1; (+) strand; PAM type: YTN; PAM sequence: TTT
acctgctggtccatgtcaat

SEQ ID NO: 278867 - DNA, 20 bp, Artificial Sequence
  Description of Artificial Sequence: Synthetic oligonucleotide
  Target: ATXN1; (+) strand; PAM type: YTN; PAM sequence: TTA
cctgctggtccatgtcaatg

SEQ ID NO: 278868 - DNA, 20 bp, Artificial Sequence
  Description of Artificial Sequence: Synthetic oligonucleotide
  Target: ATXN1; (+) strand; PAM type: YTN; PAM sequence: CTG
ctggtccatgtcaatgatgt

SEQ ID NO: 278869 - DNA, 20 bp, Artificial Sequence
  Description of Artificial Sequence: Synthetic oligonucleotide
  Target: ATXN1; (+) strand; PAM type: YTN; PAM sequence: CTG
gtccatgtcaatgatgttca

SEQ ID NO: 278870 - DNA, 20 bp, Artificial Sequence
  Description of Artificial Sequence: Synthetic oligonucleotide
  Target: ATXN1; (+) strand; PAM type: YTN; PAM sequence: TTC
agctgcactctgcgcttcca

SEQ ID NO: 278871 - DNA, 20 bp, Artificial Sequence
  Description of Artificial Sequence: Synthetic oligonucleotide
  Target: ATXN1; (+) strand; PAM type: YTN; PAM sequence: CTG
cactctgcgcttccacatct

SEQ ID NO: 278872 - DNA, 20 bp, Artificial Sequence
  Description of Artificial Sequence: Synthetic oligonucleotide
  Target: ATXN1; (+) strand; PAM type: YTN; PAM sequence: CTC
tgcgcttccacatctgttta

SEQ ID NO: 278873 - DNA, 20 bp, Artificial Sequence
  Description of Artificial Sequence: Synthetic oligonucleotide
  Target: ATXN1; (+) strand; PAM type: YTN; PAM sequence: CTG
cgcttccacatctgtttaac

SEQ ID NO: 278874 - DNA, 20 bp, Artificial Sequence
  Description of Artificial Sequence: Synthetic oligonucleotide
  Target: ATXN1; (+) strand; PAM type: YTN; PAM sequence: CTT
ccacatctgtttaacttcca

SEQ ID NO: 278875 - DNA, 20 bp, Artificial Sequence
  Description of Artificial Sequence: Synthetic oligonucleotide
  Target: ATXN1; (+) strand; PAM type: YTN; PAM sequence: TTC
cacatctgtttaacttccac

SEQ ID NO: 278876 - DNA, 20 bp, Artificial Sequence
  Description of Artificial Sequence: Synthetic oligonucleotide
  Target: ATXN1; (+) strand; PAM type: YTN; PAM sequence: CTG
tttaacttccactcacactc

SEQ ID NO: 278877 - DNA, 20 bp, Artificial Sequence
  Description of Artificial Sequence: Synthetic oligonucleotide
  Target: ATXN1; (+) strand; PAM type: YTN; PAM sequence: TTT
aacttccactcacactcata

SEQ ID NO: 278878 - DNA, 20 bp, Artificial Sequence
  Description of Artificial Sequence: Synthetic oligonucleotide
  Target: ATXN1; (+) strand; PAM type: YTN; PAM sequence: TTA
acttccactcacactcatac

SEQ ID NO: 278879 - DNA, 20 bp, Artificial Sequence
  Description of Artificial Sequence: Synthetic oligonucleotide
  Target: ATXN1; (+) strand; PAM type: YTN; PAM sequence: CTT
ccactcacactcatactaaa

SEQ ID NO: 278880 - DNA, 20 bp, Artificial Sequence
  Description of Artificial Sequence: Synthetic oligonucleotide
  Target: ATXN1; (+) strand; PAM type: YTN; PAM sequence: TTC
cactcacactcatactaaat

SEQ ID NO: 278881 - DNA, 20 bp, Artificial Sequence
  Description of Artificial Sequence: Synthetic oligonucleotide
  Target: ATXN1; (+) strand; PAM type: YTN; PAM sequence: CTC
acactcatactaaattctac

SEQ ID NO: 278882 - DNA, 20 bp, Artificial Sequence
  Description of Artificial Sequence: Synthetic oligonucleotide
  Target: ATXN1; (+) strand; PAM type: YTN; PAM sequence: CTC
atactaaattctactccaga

SEQ ID NO: 278883 - DNA, 20 bp, Artificial Sequence
  Description of Artificial Sequence: Synthetic oligonucleotide
  Target: ATXN1; (+) strand; PAM type: YTN; PAM sequence: CTA
aattctactccagagcaacg

SEQ ID NO: 278884 - DNA, 20 bp, Artificial Sequence
  Description of Artificial Sequence: Synthetic oligonucleotide
  Target: ATXN1; (+) strand; PAM type: YTN; PAM sequence: TTC
tactccagagcaacgtggct

SEQ ID NO: 278885 - DNA, 20 bp, Artificial Sequence
  Description of Artificial Sequence: Synthetic oligonucleotide
  Target: ATXN1; (+) strand; PAM type: YTN; PAM sequence: CTA
ctccagagcaacgtggctgg

SEQ ID NO: 278886 - DNA, 20 bp, Artificial Sequence
  Description of Artificial Sequence: Synthetic oligonucleotide
  Target: ATXN1; (+) strand; PAM type: YTN; PAM sequence: CTC
cagagcaacgtggctgggcc

SEQ ID NO: 278887 - DNA, 20 bp, Artificial Sequence
  Description of Artificial Sequence: Synthetic oligonucleotide
  Target: ATXN1; (+) strand; PAM type: YTN; PAM sequence: CTG
ggcctcttctgtctaaggat

SEQ ID NO: 278888 - DNA, 20 bp, Artificial Sequence
  Description of Artificial Sequence: Synthetic oligonucleotide
  Target: ATXN1; (+) strand; PAM type: YTN; PAM sequence: CTC
ttctgtctaaggatgtggct

SEQ ID NO: 278889 - DNA, 20 bp, Artificial Sequence
  Description of Artificial Sequence: Synthetic oligonucleotide
  Target: ATXN1; (+) strand; PAM type: YTN; PAM sequence: CTT
ctgtctaaggatgtggctgc

SEQ ID NO: 278890 - DNA, 20 bp, Artificial Sequence
  Description of Artificial Sequence: Synthetic oligonucleotide
  Target: ATXN1; (+) strand; PAM type: YTN; PAM sequence: TTC
tgtctaaggatgtggctgct

SEQ ID NO: 278891 - DNA, 20 bp, Artificial Sequence
  Description of Artificial Sequence: Synthetic oligonucleotide
  Target: ATXN1; (+) strand; PAM type: YTN; PAM sequence: CTG
tctaaggatgtggctgctcc

SEQ ID NO: 278892 - DNA, 20 bp, Artificial Sequence
  Description of Artificial Sequence: Synthetic oligonucleotide
  Target: ATXN1; (+) strand; PAM type: YTN; PAM sequence: CTA
aggatgtggctgctccacgt

SEQ ID NO: 278893 - DNA, 20 bp, Artificial Sequence
  Description of Artificial Sequence: Synthetic oligonucleotide
  Target: ATXN1; (+) strand; PAM type: YTN; PAM sequence: CTG
ctccacgtatttccgatgac

SEQ ID NO: 278894 - DNA, 20 bp, Artificial Sequence
  Description of Artificial Sequence: Synthetic oligonucleotide
  Target: ATXN1; (+) strand; PAM type: YTN; PAM sequence: CTC
cacgtatttccgatgacaga

SEQ ID NO: 278895 - DNA, 20 bp, Artificial Sequence
  Description of Artificial Sequence: Synthetic oligonucleotide
  Target: ATXN1; (+) strand; PAM type: YTN; PAM sequence: TTT
ccgatgacagaatagcaaat

SEQ ID NO: 278896 - DNA, 20 bp, Artificial Sequence
  Description of Artificial Sequence: Synthetic oligonucleotide
  Target: ATXN1; (+) strand; PAM type: YTN; PAM sequence: TTC
cgatgacagaatagcaaatc

SEQ ID NO: 278897 - DNA, 20 bp, Artificial Sequence
  Description of Artificial Sequence: Synthetic oligonucleotide
  Target: ATXN1; (+) strand; PAM type: YTN; PAM sequence: TTA
aaacgccagagaaccaaagg

SEQ ID NO: 278898 - DNA, 20 bp, Artificial Sequence
  Description of Artificial Sequence: Synthetic oligonucleotide
  Target: ATXN1; (+) strand; PAM type: YTN; PAM sequence: CTT
cgacttcaggagacctcctt

SEQ ID NO: 278899 - DNA, 20 bp, Artificial Sequence
  Description of Artificial Sequence: Synthetic oligonucleotide
  Target: ATXN1; (+) strand; PAM type: YTN; PAM sequence: TTC
gacttcaggagacctccttg

SEQ ID NO: 278900 - DNA, 20 bp, Artificial Sequence
  Description of Artificial Sequence: Synthetic oligonucleotide
  Target: ATXN1; (+) strand; PAM type: YTN; PAM sequence: CTT
caggagacctccttgtgggc

SEQ ID NO: 278901 - DNA, 20 bp, Artificial Sequence
  Description of Artificial Sequence: Synthetic oligonucleotide
  Target: ATXN1; (+) strand; PAM type: YTN; PAM sequence: TTC
aggagacctccttgtgggca

SEQ ID NO: 278902 - DNA, 20 bp, Artificial Sequence
  Description of Artificial Sequence: Synthetic oligonucleotide
  Target: ATXN1; (+) strand; PAM type: YTN; PAM sequence: CTC
cttgtgggcaatcgcacaga

SEQ ID NO: 278903 - DNA, 20 bp, Artificial Sequence
  Description of Artificial Sequence: Synthetic oligonucleotide
  Target: ATXN1; (+) strand; PAM type: YTN; PAM sequence: CTT
gtgggcaatcgcacagatac

SEQ ID NO: 278904 - DNA, 20 bp, Artificial Sequence
  Description of Artificial Sequence: Synthetic oligonucleotide
  Target: ATXN1; (+) strand; PAM type: YTN; PAM sequence: TTG
tgggcaatcgcacagatacc

SEQ ID NO: 278905 - DNA, 20 bp, Artificial Sequence
  Description of Artificial Sequence: Synthetic oligonucleotide
  Target: ATXN1; (+) strand; PAM type: YTN; PAM sequence: CTT
tccaatcttttcggaggtgt

SEQ ID NO: 278906 - DNA, 20 bp, Artificial Sequence
  Description of Artificial Sequence: Synthetic oligonucleotide
  Target: ATXN1; (+) strand; PAM type: YTN; PAM sequence: TTT
ccaatcttttcggaggtgtt

SEQ ID NO: 278907 - DNA, 20 bp, Artificial Sequence
  Description of Artificial Sequence: Synthetic oligonucleotide
  Target: ATXN1; (+) strand; PAM type: YTN; PAM sequence: TTC
caatcttttcggaggtgttg

SEQ ID NO: 278908 - DNA, 20 bp, Artificial Sequence
  Description of Artificial Sequence: Synthetic oligonucleotide
  Target: ATXN1; (+) strand; PAM type: YTN; PAM sequence: CTT
ttcggaggtgttgttcaaat

SEQ ID NO: 278909 - DNA, 20 bp, Artificial Sequence
  Description of Artificial Sequence: Synthetic oligonucleotide
  Target: ATXN1; (+) strand; PAM type: YTN; PAM sequence: TTT
tcggaggtgttgttcaaatt

SEQ ID NO: 278910 - DNA, 20 bp, Artificial Sequence
  Description of Artificial Sequence: Synthetic oligonucleotide
  Target: ATXN1; (+) strand; PAM type: YTN; PAM sequence: TTT
cggaggtgttgttcaaattc

SEQ ID NO: 278911 - DNA, 20 bp, Artificial Sequence
  Description of Artificial Sequence: Synthetic oligonucleotide
  Target: ATXN1; (+) strand; PAM type: YTN; PAM sequence: TTC
ggaggtgttgttcaaattcc

SEQ ID NO: 278912 - DNA, 20 bp, Artificial Sequence
  Description of Artificial Sequence: Synthetic oligonucleotide
  Target: ATXN1; (+) strand; PAM type: YTN; PAM sequence: TTG
ttcaaattccgctttcgttc

SEQ ID NO: 278913 - DNA, 20 bp, Artificial Sequence
  Description of Artificial Sequence: Synthetic oligonucleotide
  Target: ATXN1; (+) strand; PAM type: YTN; PAM sequence: TTC
aaattccgctttcgttcagg

SEQ ID NO: 278914 - DNA, 20 bp, Artificial Sequence
  Description of Artificial Sequence: Synthetic oligonucleotide
  Target: ATXN1; (+) strand; PAM type: YTN; PAM sequence: TTC
cgctttcgttcaggctatgc

SEQ ID NO: 278915 - DNA, 20 bp, Artificial Sequence
  Description of Artificial Sequence: Synthetic oligonucleotide
  Target: ATXN1; (+) strand; PAM type: YTN; PAM sequence: CTT
tcgttcaggctatgcgcctc

SEQ ID NO: 278916 - DNA, 20 bp, Artificial Sequence
  Description of Artificial Sequence: Synthetic oligonucleotide
  Target: ATXN1; (+) strand; PAM type: YTN; PAM sequence: TTT
cgttcaggctatgcgcctct

SEQ ID NO: 278917 - DNA, 20 bp, Artificial Sequence
  Description of Artificial Sequence: Synthetic oligonucleotide
  Target: ATXN1; (+) strand; PAM type: YTN; PAM sequence: TTC
gttcaggctatgcgcctcta

SEQ ID NO: 278918 - DNA, 20 bp, Artificial Sequence
  Description of Artificial Sequence: Synthetic oligonucleotide
  Target: ATXN1; (+) strand; PAM type: YTN; PAM sequence: TTC
aggctatgcgcctctaggag

SEQ ID NO: 278919 - DNA, 20 bp, Artificial Sequence
  Description of Artificial Sequence: Synthetic oligonucleotide
  Target: ATXN1; (+) strand; PAM type: YTN; PAM sequence: CTA
tgcgcctctaggaggtggcc

SEQ ID NO: 278920 - DNA, 20 bp, Artificial Sequence
  Description of Artificial Sequence: Synthetic oligonucleotide
  Target: ATXN1; (+) strand; PAM type: YTN; PAM sequence: CTC
taggaggtggcctctctacg

SEQ ID NO: 278921 - DNA, 20 bp, Artificial Sequence
  Description of Artificial Sequence: Synthetic oligonucleotide
  Target: ATXN1; (+) strand; PAM type: YTN; PAM sequence: CTA
ggaggtggcctctctacgtg

SEQ ID NO: 278922 - DNA, 20 bp, Artificial Sequence
  Description of Artificial Sequence: Synthetic oligonucleotide
  Target: ATXN1; (+) strand; PAM type: YTN; PAM sequence: CTC
tctacgtggctaccctgcca

SEQ ID NO: 278923 - DNA, 20 bp, Artificial Sequence
  Description of Artificial Sequence: Synthetic oligonucleotide
  Target: ATXN1; (+) strand; PAM type: YTN; PAM sequence: CTC
tacgtggctaccctgccatg

SEQ ID NO: 278924 - DNA, 20 bp, Artificial Sequence
  Description of Artificial Sequence: Synthetic oligonucleotide
  Target: ATXN1; (+) strand; PAM type: YTN; PAM sequence: CTA
cgtggctaccctgccatggc

SEQ ID NO: 278925 - DNA, 20 bp, Artificial Sequence
  Description of Artificial Sequence: Synthetic oligonucleotide
  Target: ATXN1; (+) strand; PAM type: YTN; PAM sequence: CTA
ccctgccatggcccttccag

SEQ ID NO: 278926 - DNA, 20 bp, Artificial Sequence
  Description of Artificial Sequence: Synthetic oligonucleotide
  Target: ATXN1; (+) strand; PAM type: YTN; PAM sequence: CTG
ccatggcccttccagctggc

SEQ ID NO: 278927 - DNA, 20 bp, Artificial Sequence
  Description of Artificial Sequence: Synthetic oligonucleotide
  Target: ATXN1; (+) strand; PAM type: YTN; PAM sequence: CTT
ccagctggccattggcagcg

SEQ ID NO: 278928 - DNA, 20 bp, Artificial Sequence
  Description of Artificial Sequence: Synthetic oligonucleotide
  Target: ATXN1; (+) strand; PAM type: YTN; PAM sequence: TTC
cagctggccattggcagcgc

SEQ ID NO: 278929 - DNA, 20 bp, Artificial Sequence
  Description of Artificial Sequence: Synthetic oligonucleotide
  Target: ATXN1; (+) strand; PAM type: YTN; PAM sequence: CTG
gccattggcagcgccaggac

SEQ ID NO: 278930 - DNA, 20 bp, Artificial Sequence
  Description of Artificial Sequence: Synthetic oligonucleotide
  Target: ATXN1; (+) strand; PAM type: YTN; PAM sequence: TTG
gcagcgccaggacacagcat

SEQ ID NO: 278931 - DNA, 20 bp, Artificial Sequence
  Description of Artificial Sequence: Synthetic oligonucleotide
  Target: ATXN1; (+) strand; PAM type: YTN; PAM sequence: CTG
tggtttgggtcttataagat

SEQ ID NO: 278932 - DNA, 20 bp, Artificial Sequence
  Description of Artificial Sequence: Synthetic oligonucleotide
  Target: ATXN1; (+) strand; PAM type: YTN; PAM sequence: TTT
gggtcttataagatcactga

SEQ ID NO: 278933 - DNA, 20 bp, Artificial Sequence
  Description of Artificial Sequence: Synthetic oligonucleotide
  Target: ATXN1; (+) strand; PAM type: YTN; PAM sequence: TTG
ggtcttataagatcactgac

SEQ ID NO: 278934 - DNA, 20 bp, Artificial Sequence
  Description of Artificial Sequence: Synthetic oligonucleotide
  Target: ATXN1; (+) strand; PAM type: YTN; PAM sequence: CTT
ataagatcactgacagccaa

SEQ ID NO: 278935 - DNA, 20 bp, Artificial Sequence
  Description of Artificial Sequence: Synthetic oligonucleotide
  Target: ATXN1; (+) strand; PAM type: YTN; PAM sequence: TTA
taagatcactgacagccaag

SEQ ID NO: 278936 - DNA, 20 bp, Artificial Sequence
  Description of Artificial Sequence: Synthetic oligonucleotide
  Target: ATXN1; (+) strand; PAM type: YTN; PAM sequence: CTG
acagccaagcatacattcca

SEQ ID NO: 278937 - DNA, 20 bp, Artificial Sequence
  Description of Artificial Sequence: Synthetic oligonucleotide
  Target: ATXN1; (+) strand; PAM type: YTN; PAM sequence: TTC
caaatactgtatgactcaaa

SEQ ID NO: 278938 - DNA, 20 bp, Artificial Sequence
  Description of Artificial Sequence: Synthetic oligonucleotide
  Target: ATXN1; (+) strand; PAM type: YTN; PAM sequence: CTG
tatgactcaaaggctatctc

SEQ ID NO: 278939 - DNA, 20 bp, Artificial Sequence
  Description of Artificial Sequence: Synthetic oligonucleotide
  Target: ATXN1; (+) strand; PAM type: YTN; PAM sequence: CTC
aaaggctatctcgaacactt

SEQ ID NO: 278940 - DNA, 20 bp, Artificial Sequence
  Description of Artificial Sequence: Synthetic oligonucleotide
  Target: ATXN1; (+) strand; PAM type: YTN; PAM sequence: CTA
tctcgaacacttattacaaa

SEQ ID NO: 278941 - DNA, 20 bp, Artificial Sequence
  Description of Artificial Sequence: Synthetic oligonucleotide
  Target: ATXN1; (+) strand; PAM type: YTN; PAM sequence: CTC
gaacacttattacaaatgtg

SEQ ID NO: 278942 - DNA, 20 bp, Artificial Sequence
  Description of Artificial Sequence: Synthetic oligonucleotide
  Target: ATXN1; (+) strand; PAM type: YTN; PAM sequence: CTT
attacaaatgtgtaatactc

SEQ ID NO: 278943 - DNA, 20 bp, Artificial Sequence
  Description of Artificial Sequence: Synthetic oligonucleotide
  Target: ATXN1; (+) strand; PAM type: YTN; PAM sequence: TTA
ttacaaatgtgtaatactcc

SEQ ID NO: 278944 - DNA, 20 bp, Artificial Sequence
  Description of Artificial Sequence: Synthetic oligonucleotide
  Target: ATXN1; (+) strand; PAM type: YTN; PAM sequence: TTA
caaatgtgtaatactccatt

SEQ ID NO: 278945 - DNA, 20 bp, Artificial Sequence
  Description of Artificial Sequence: Synthetic oligonucleotide
  Target: ATXN1; (+) strand; PAM type: YTN; PAM sequence: CTC
catttttccttctagattaa

SEQ ID NO: 278946 - DNA, 20 bp, Artificial Sequence
  Description of Artificial Sequence: Synthetic oligonucleotide
  Target: ATXN1; (+) strand; PAM type: YTN; PAM sequence: TTT
ttccttctagattaaagact

SEQ ID NO: 278947 - DNA, 20 bp, Artificial Sequence
  Description of Artificial Sequence: Synthetic oligonucleotide
  Target: ATXN1; (+) strand; PAM type: YTN; PAM sequence: TTT
tccttctagattaaagacta

SEQ ID NO: 278948 - DNA, 20 bp, Artificial Sequence
  Description of Artificial Sequence: Synthetic oligonucleotide
  Target: ATXN1; (+) strand; PAM type: YTN; PAM sequence: TTT
ccttctagattaaagactat

SEQ ID NO: 278949 - DNA, 20 bp, Artificial Sequence
  Description of Artificial Sequence: Synthetic oligonucleotide
  Target: ATXN1; (+) strand; PAM type: YTN; PAM sequence: TTC
cttctagattaaagactatc

SEQ ID NO: 278950 - DNA, 20 bp, Artificial Sequence
  Description of Artificial Sequence: Synthetic oligonucleotide
  Target: ATXN1; (+) strand; PAM type: YTN; PAM sequence: CTT
ctagattaaagactatccct

SEQ ID NO: 278951 - DNA, 20 bp, Artificial Sequence
  Description of Artificial Sequence: Synthetic oligonucleotide
  Target: ATXN1; (+) strand; PAM type: YTN; PAM sequence: TTC
tagattaaagactatccctt

SEQ ID NO: 278952 - DNA, 20 bp, Artificial Sequence
  Description of Artificial Sequence: Synthetic oligonucleotide
  Target: ATXN1; (+) strand; PAM type: YTN; PAM sequence: CTA
gattaaagactatccctttc

SEQ ID NO: 278953 - DNA, 20 bp, Artificial Sequence
  Description of Artificial Sequence: Synthetic oligonucleotide
  Target: ATXN1; (+) strand; PAM type: YTN; PAM sequence: TTA
aagactatccctttcatggc

SEQ ID NO: 278954 - DNA, 20 bp, Artificial Sequence
  Description of Artificial Sequence: Synthetic oligonucleotide
  Target: ATXN1; (+) strand; PAM type: YTN; PAM sequence: CTA
tccctttcatggcgttattt

SEQ ID NO: 278955 - DNA, 20 bp, Artificial Sequence
  Description of Artificial Sequence: Synthetic oligonucleotide
  Target: ATXN1; (+) strand; PAM type: YTN; PAM sequence: CTT
tcatggcgttatttcacccc

SEQ ID NO: 278956 - DNA, 20 bp, Artificial Sequence
  Description of Artificial Sequence: Synthetic oligonucleotide
  Target: ATXN1; (+) strand; PAM type: YTN; PAM sequence: TTT
catggcgttatttcacccca

SEQ ID NO: 278957 - DNA, 20 bp, Artificial Sequence
  Description of Artificial Sequence: Synthetic oligonucleotide
  Target: ATXN1; (+) strand; PAM type: YTN; PAM sequence: TTC
atggcgttatttcaccccaa

SEQ ID NO: 278958 - DNA, 20 bp, Artificial Sequence
  Description of Artificial Sequence: Synthetic oligonucleotide
  Target: ATXN1; (+) strand; PAM type: YTN; PAM sequence: TTA
tttcaccccaaacctctcta

SEQ ID NO: 278959 - DNA, 20 bp, Artificial Sequence
  Description of Artificial Sequence: Synthetic oligonucleotide
  Target: ATXN1; (+) strand; PAM type: YTN; PAM sequence: TTT
caccccaaacctctctaagg

SEQ ID NO: 278960 - DNA, 20 bp, Artificial Sequence
  Description of Artificial Sequence: Synthetic oligonucleotide
  Target: ATXN1; (+) strand; PAM type: YTN; PAM sequence: TTC
accccaaacctctctaaggt

SEQ ID NO: 278961 - DNA, 20 bp, Artificial Sequence
  Description of Artificial Sequence: Synthetic oligonucleotide
  Target: ATXN1; (+) strand; PAM type: YTN; PAM sequence: CTC
tctaaggtagatcttgctcc

SEQ ID NO: 278962 - DNA, 20 bp, Artificial Sequence
  Description of Artificial Sequence: Synthetic oligonucleotide
  Target: ATXN1; (+) strand; PAM type: YTN; PAM sequence: CTC
taaggtagatcttgctcctg

SEQ ID NO: 278963 - DNA, 20 bp, Artificial Sequence
  Description of Artificial Sequence: Synthetic oligonucleotide
  Target: ATXN1; (+) strand; PAM type: YTN; PAM sequence: CTA
aggtagatcttgctcctgtc

SEQ ID NO: 278964 - DNA, 20 bp, Artificial Sequence
  Description of Artificial Sequence: Synthetic oligonucleotide
  Target: ATXN1; (+) strand; PAM type: YTN; PAM sequence: CTT
gctcctgtccgggttcagga

SEQ ID NO: 278965 - DNA, 20 bp, Artificial Sequence
  Description of Artificial Sequence: Synthetic oligonucleotide
  Target: ATXN1; (+) strand; PAM type: YTN; PAM sequence: TTG
ctcctgtccgggttcaggaa

SEQ ID NO: 278966 - DNA, 20 bp, Artificial Sequence
  Description of Artificial Sequence: Synthetic oligonucleotide
  Target: ATXN1; (+) strand; PAM type: YTN; PAM sequence: CTC
ctgtccgggttcaggaaact

SEQ ID NO: 278967 - DNA, 20 bp, Artificial Sequence
  Description of Artificial Sequence: Synthetic oligonucleotide
  Target: ATXN1; (+) strand; PAM type: YTN; PAM sequence: CTG
tccgggttcaggaaactctt

SEQ ID NO: 278968 - DNA, 20 bp, Artificial Sequence
  Description of Artificial Sequence: Synthetic oligonucleotide
  Target: ATXN1; (+) strand; PAM type: YTN; PAM sequence: TTC
aggaaactcttgaccctcat

SEQ ID NO: 278969 - DNA, 20 bp, Artificial Sequence
  Description of Artificial Sequence: Synthetic oligonucleotide
  Target: ATXN1; (+) strand; PAM type: YTN; PAM sequence: CTC
ttgaccctcatggaagtcct

SEQ ID NO: 278970 - DNA, 20 bp, Artificial Sequence
  Description of Artificial Sequence: Synthetic oligonucleotide
  Target: ATXN1; (+) strand; PAM type: YTN; PAM sequence: CTT
gaccctcatggaagtcctgc

SEQ ID NO: 278971 - DNA, 20 bp, Artificial Sequence
  Description of Artificial Sequence: Synthetic oligonucleotide
  Target: ATXN1; (+) strand; PAM type: YTN; PAM sequence: TTG
accctcatggaagtcctgca

SEQ ID NO: 278972 - DNA, 20 bp, Artificial Sequence
  Description of Artificial Sequence: Synthetic oligonucleotide
  Target: ATXN1; (+) strand; PAM type: YTN; PAM sequence: CTC
atggaagtcctgcatggcct

SEQ ID NO: 278973 - DNA, 20 bp, Artificial Sequence
  Description of Artificial Sequence: Synthetic oligonucleotide
  Target: ATXN1; (+) strand; PAM type: YTN; PAM sequence: CTG
catggccttccaagtgaggg

SEQ ID NO: 278974 - DNA, 20 bp, Artificial Sequence
  Description of Artificial Sequence: Synthetic oligonucleotide
  Target: ATXN1; (+) strand; PAM type: YTN; PAM sequence: CTT
ccaagtgagggtcagttgtc

SEQ ID NO: 278975 - DNA, 20 bp, Artificial Sequence
  Description of Artificial Sequence: Synthetic oligonucleotide
  Target: ATXN1; (+) strand; PAM type: YTN; PAM sequence: TTC
caagtgagggtcagttgtca

SEQ ID NO: 278976 - DNA, 20 bp, Artificial Sequence
  Description of Artificial Sequence: Synthetic oligonucleotide
  Target: ATXN1; (+) strand; PAM type: YTN; PAM sequence: TTG
tcactccaggatgcttccac

SEQ ID NO: 278977 - DNA, 20 bp, Artificial Sequence
  Description of Artificial Sequence: Synthetic oligonucleotide
  Target: ATXN1; (+) strand; PAM type: YTN; PAM sequence: CTC
caggatgcttccaccatact

SEQ ID NO: 278978 - DNA, 20 bp, Artificial Sequence
  Description of Artificial Sequence: Synthetic oligonucleotide
  Target: ATXN1; (+) strand; PAM type: YTN; PAM sequence: CTT
ccaccatactttgtatttcc

SEQ ID NO: 278979 - DNA, 20 bp, Artificial Sequence
  Description of Artificial Sequence: Synthetic oligonucleotide
  Target: ATXN1; (+) strand; PAM type: YTN; PAM sequence: TTC
caccatactttgtatttccg

SEQ ID NO: 278980 - DNA, 20 bp, Artificial Sequence
  Description of Artificial Sequence: Synthetic oligonucleotide
  Target: ATXN1; (+) strand; PAM type: YTN; PAM sequence: CTT
tgtatttccgtctcacagta

SEQ ID NO: 278981 - DNA, 20 bp, Artificial Sequence
  Description of Artificial Sequence: Synthetic oligonucleotide
  Target: ATXN1; (+) strand; PAM type: YTN; PAM sequence: TTT
gtatttccgtctcacagtac

SEQ ID NO: 278982 - DNA, 20 bp, Artificial Sequence
  Description of Artificial Sequence: Synthetic oligonucleotide
  Target: ATXN1; (+) strand; PAM type: YTN; PAM sequence: TTG
tatttccgtctcacagtacc

SEQ ID NO: 278983 - DNA, 20 bp, Artificial Sequence
  Description of Artificial Sequence: Synthetic oligonucleotide
  Target: ATXN1; (+) strand; PAM type: YTN; PAM sequence: TTT
ccgtctcacagtacctttct

SEQ ID NO: 278984 - DNA, 20 bp, Artificial Sequence
  Description of Artificial Sequence: Synthetic oligonucleotide
  Target: ATXN1; (+) strand; PAM type: YTN; PAM sequence: TTC
cgtctcacagtacctttctc

SEQ ID NO: 278985 - DNA, 20 bp, Artificial Sequence
  Description of Artificial Sequence: Synthetic oligonucleotide
  Target: ATXN1; (+) strand; PAM type: YTN; PAM sequence: CTC
acagtacctttctcagtgca

SEQ ID NO: 278986 - DNA, 20 bp, Artificial Sequence
  Description of Artificial Sequence: Synthetic oligonucleotide
  Target: ATXN1; (+) strand; PAM type: YTN; PAM sequence: CTT
tctcagtgcacggtaattga

SEQ ID NO: 278987 - DNA, 20 bp, Artificial Sequence
  Description of Artificial Sequence: Synthetic oligonucleotide
  Target: ATXN1; (+) strand; PAM type: YTN; PAM sequence: TTT
ctcagtgcacggtaattgac

SEQ ID NO: 278988 - DNA, 20 bp, Artificial Sequence
  Description of Artificial Sequence: Synthetic oligonucleotide
  Target: ATXN1; (+) strand; PAM type: YTN; PAM sequence: TTC
tcagtgcacggtaattgact

SEQ ID NO: 278989 - DNA, 20 bp, Artificial Sequence
  Description of Artificial Sequence: Synthetic oligonucleotide
  Target: ATXN1; (+) strand; PAM type: YTN; PAM sequence: CTC
agtgcacggtaattgactag

SEQ ID NO: 278990 - DNA, 20 bp, Artificial Sequence
  Description of Artificial Sequence: Synthetic oligonucleotide
  Target: ATXN1; (+) strand; PAM type: YTN; PAM sequence: TTG
actagatatgttctatccac

SEQ ID NO: 278991 - DNA, 20 bp, Artificial Sequence
  Description of Artificial Sequence: Synthetic oligonucleotide
  Target: ATXN1; (+) strand; PAM type: YTN; PAM sequence: CTA
gatatgttctatccactctc

SEQ ID NO: 278992 - DNA, 20 bp, Artificial Sequence
  Description of Artificial Sequence: Synthetic oligonucleotide
  Target: ATXN1; (+) strand; PAM type: YTN; PAM sequence: TTC
tatccactctcctataataa

SEQ ID NO: 278993 - DNA, 20 bp, Artificial Sequence
  Description of Artificial Sequence: Synthetic oligonucleotide
  Target: ATXN1; (+) strand; PAM type: YTN; PAM sequence: CTA
tccactctcctataataact

SEQ ID NO: 278994 - DNA, 20 bp, Artificial Sequence
  Description of Artificial Sequence: Synthetic oligonucleotide
  Target: ATXN1; (+) strand; PAM type: YTN; PAM sequence: CTC
tcctataataactataatgt

SEQ ID NO: 278995 - DNA, 20 bp, Artificial Sequence
  Description of Artificial Sequence: Synthetic oligonucleotide
  Target: ATXN1; (+) strand; PAM type: YTN; PAM sequence: CTC
ctataataactataatgtag

SEQ ID NO: 278996 - DNA, 20 bp, Artificial Sequence
  Description of Artificial Sequence: Synthetic oligonucleotide
  Target: ATXN1; (+) strand; PAM type: YTN; PAM sequence: CTA
taataactataatgtagtgc

SEQ ID NO: 278997 - DNA, 20 bp, Artificial Sequence
  Description of Artificial Sequence: Synthetic oligonucleotide
  Target: ATXN1; (+) strand; PAM type: YTN; PAM sequence: CTA
taatgtagtgccatgtgggt

SEQ ID NO: 278998 - DNA, 20 bp, Artificial Sequence
  Description of Artificial Sequence: Synthetic oligonucleotide
  Target: ATXN1; (+) strand; PAM type: YTN; PAM sequence: TTT
ttatcttgtctaccttagta

SEQ ID NO: 278999 - DNA, 20 bp, Artificial Sequence
  Description of Artificial Sequence: Synthetic oligonucleotide
  Target: ATXN1; (+) strand; PAM type: YTN; PAM sequence: TTT
tatcttgtctaccttagtat

SEQ ID NO: 279000 - DNA, 20 bp, Artificial Sequence
  Description of Artificial Sequence: Synthetic oligonucleotide
  Target: ATXN1; (+) strand; PAM type: YTN; PAM sequence: TTT
atcttgtctaccttagtatc

SEQ ID NO: 279001 - DNA, 20 bp, Artificial Sequence
  Description of Artificial Sequence: Synthetic oligonucleotide
  Target: ATXN1; (+) strand; PAM type: YTN; PAM sequence: TTA
tcttgtctaccttagtatct

SEQ ID NO: 279002 - DNA, 20 bp, Artificial Sequence
  Description of Artificial Sequence: Synthetic oligonucleotide
  Target: ATXN1; (+) strand; PAM type: YTN; PAM sequence: CTT
gtctaccttagtatcttcag

SEQ ID NO: 279003 - DNA, 20 bp, Artificial Sequence
  Description of Artificial Sequence: Synthetic oligonucleotide
  Target: ATXN1; (+) strand; PAM type: YTN; PAM sequence: TTG
tctaccttagtatcttcaga

SEQ ID NO: 279004 - DNA, 20 bp, Artificial Sequence
  Description of Artificial Sequence: Synthetic oligonucleotide
  Target: ATXN1; (+) strand; PAM type: YTN; PAM sequence: CTA
ccttagtatcttcagaactt

SEQ ID NO: 279005 - DNA, 20 bp, Artificial Sequence
  Description of Artificial Sequence: Synthetic oligonucleotide
  Target: ATXN1; (+) strand; PAM type: YTN; PAM sequence: CTT
agtatcttcagaacttagca

SEQ ID NO: 279006 - DNA, 20 bp, Artificial Sequence
  Description of Artificial Sequence: Synthetic oligonucleotide
  Target: ATXN1; (+) strand; PAM type: YTN; PAM sequence: TTA
gtatcttcagaacttagcac

SEQ ID NO: 279007 - DNA, 20 bp, Artificial Sequence
  Description of Artificial Sequence: Synthetic oligonucleotide
  Target: ATXN1; (+) strand; PAM type: YTN; PAM sequence: CTT
cagaacttagcactctgctt

SEQ ID NO: 279008 - DNA, 20 bp, Artificial Sequence
  Description of Artificial Sequence: Synthetic oligonucleotide
  Target: ATXN1; (+) strand; PAM type: YTN; PAM sequence: TTC
agaacttagcactctgcttg

SEQ ID NO: 279009 - DNA, 20 bp, Artificial Sequence
  Description of Artificial Sequence: Synthetic oligonucleotide
  Target: ATXN1; (+) strand; PAM type: YTN; PAM sequence: CTT
agcactctgcttggtacatg

SEQ ID NO: 279010 - DNA, 20 bp, Artificial Sequence
  Description of Artificial Sequence: Synthetic oligonucleotide
  Target: ATXN1; (+) strand; PAM type: YTN; PAM sequence: TTA
gcactctgcttggtacatgg

SEQ ID NO: 279011 - DNA, 20 bp, Artificial Sequence
  Description of Artificial Sequence: Synthetic oligonucleotide
  Target: ATXN1; (+) strand; PAM type: YTN; PAM sequence: CTC
tgcttggtacatggcagact

SEQ ID NO: 279012 - DNA, 20 bp, Artificial Sequence
  Description of Artificial Sequence: Synthetic oligonucleotide
  Target: ATXN1; (+) strand; PAM type: YTN; PAM sequence: CTG
cttggtacatggcagactct

SEQ ID NO: 279013 - DNA, 20 bp, Artificial Sequence
  Description of Artificial Sequence: Synthetic oligonucleotide
  Target: ATXN1; (+) strand; PAM type: YTN; PAM sequence: CTT
ggtacatggcagactctcaa

SEQ ID NO: 279014 - DNA, 20 bp, Artificial Sequence
  Description of Artificial Sequence: Synthetic oligonucleotide
  Target: ATXN1; (+) strand; PAM type: YTN; PAM sequence: TTG
gtacatggcagactctcaaa

SEQ ID NO: 279015 - DNA, 20 bp, Artificial Sequence
  Description of Artificial Sequence: Synthetic oligonucleotide
  Target: ATXN1; (+) strand; PAM type: YTN; PAM sequence: CTC
tcaaaaatatcagttgacag

SEQ ID NO: 279016 - DNA, 20 bp, Artificial Sequence
  Description of Artificial Sequence: Synthetic oligonucleotide
  Target: ATXN1; (+) strand; PAM type: YTN; PAM sequence: CTC
aaaaatatcagttgacagac

SEQ ID NO: 279017 - DNA, 20 bp, Artificial Sequence
  Description of Artificial Sequence: Synthetic oligonucleotide
  Target: ATXN1; (+) strand; PAM type: YTN; PAM sequence: TTG
acagactgattgaaaataga

SEQ ID NO: 279018 - DNA, 20 bp, Artificial Sequence
  Description of Artificial Sequence: Synthetic oligonucleotide
  Target: ATXN1; (+) strand; PAM type: YTN; PAM sequence: CTG
attgaaaatagaatccgtgg

SEQ ID NO: 279019 - DNA, 20 bp, Artificial Sequence
  Description of Artificial Sequence: Synthetic oligonucleotide
  Target: ATXN1; (+) strand; PAM type: YTN; PAM sequence: TTG
aaaatagaatccgtggttct

SEQ ID NO: 279020 - DNA, 20 bp, Artificial Sequence
  Description of Artificial Sequence: Synthetic oligonucleotide
  Target: ATXN1; (+) strand; PAM type: YTN; PAM sequence: TTC
tgaataatggctatttactc

SEQ ID NO: 279021 - DNA, 20 bp, Artificial Sequence
  Description of Artificial Sequence: Synthetic oligonucleotide
  Target: ATXN1; (+) strand; PAM type: YTN; PAM sequence: CTG
aataatggctatttactcac

SEQ ID NO: 279022 - DNA, 20 bp, Artificial Sequence
  Description of Artificial Sequence: Synthetic oligonucleotide
  Target: ATXN1; (+) strand; PAM type: YTN; PAM sequence: CTA
tttactcaccccagtccagc

SEQ ID NO: 279023 - DNA, 20 bp, Artificial Sequence
  Description of Artificial Sequence: Synthetic oligonucleotide
  Target: ATXN1; (+) strand; PAM type: YTN; PAM sequence: TTT
actcaccccagtccagcatg

SEQ ID NO: 279024 - DNA, 20 bp, Artificial Sequence
  Description of Artificial Sequence: Synthetic oligonucleotide
  Target: ATXN1; (+) strand; PAM type: YTN; PAM sequence: TTA
ctcaccccagtccagcatgc

SEQ ID NO: 279025 - DNA, 20 bp, Artificial Sequence
  Description of Artificial Sequence: Synthetic oligonucleotide
  Target: ATXN1; (+) strand; PAM type: YTN; PAM sequence: CTC
accccagtccagcatgcata

SEQ ID NO: 279026 - DNA, 20 bp, Artificial Sequence
  Description of Artificial Sequence: Synthetic oligonucleotide
  Target: ATXN1; (+) strand; PAM type: YTN; PAM sequence: CTG
tctgttaccgcatgggccct

SEQ ID NO: 279027 - DNA, 20 bp, Artificial Sequence
  Description of Artificial Sequence: Synthetic oligonucleotide
  Target: ATXN1; (+) strand; PAM type: YTN; PAM sequence: CTG
ttaccgcatgggccctcacc

SEQ ID NO: 279028 - DNA, 20 bp, Artificial Sequence
  Description of Artificial Sequence: Synthetic oligonucleotide
  Target: ATXN1; (+) strand; PAM type: YTN; PAM sequence: TTA
ccgcatgggccctcaccatg

SEQ ID NO: 279029 - DNA, 20 bp, Artificial Sequence
  Description of Artificial Sequence: Synthetic oligonucleotide
  Target: ATXN1; (+) strand; PAM type: YTN; PAM sequence: CTC
accatggccctcaacagccc

SEQ ID NO: 279030 - DNA, 20 bp, Artificial Sequence
  Description of Artificial Sequence: Synthetic oligonucleotide
  Target: ATXN1; (+) strand; PAM type: YTN; PAM sequence: CTC
aacagcccatggccacagct

SEQ ID NO: 279031 - DNA, 20 bp, Artificial Sequence
  Description of Artificial Sequence: Synthetic oligonucleotide
  Target: ATXN1; (+) strand; PAM type: YTN; PAM sequence: CTA
ttgcctgggactgaccatcc

SEQ ID NO: 279032 - DNA, 20 bp, Artificial Sequence
  Description of Artificial Sequence: Synthetic oligonucleotide
  Target: ATXN1; (+) strand; PAM type: YTN; PAM sequence: TTG
cctgggactgaccatcccta

SEQ ID NO: 279033 - DNA, 20 bp, Artificial Sequence
  Description of Artificial Sequence: Synthetic oligonucleotide
  Target: ATXN1; (+) strand; PAM type: YTN; PAM sequence: CTG
ggactgaccatccctactag

SEQ ID NO: 279034 - DNA, 20 bp, Artificial Sequence
  Description of Artificial Sequence: Synthetic oligonucleotide
  Target: ATXN1; (+) strand; PAM type: YTN; PAM sequence: CTG
accatccctactaggaatgt

SEQ ID NO: 279035 - DNA, 20 bp, Artificial Sequence
  Description of Artificial Sequence: Synthetic oligonucleotide
  Target: ATXN1; (+) strand; PAM type: YTN; PAM sequence: CTA
ctaggaatgtgtcacgcccc

SEQ ID NO: 279036 - DNA, 20 bp, Artificial Sequence
  Description of Artificial Sequence: Synthetic oligonucleotide
  Target: ATXN1; (+) strand; PAM type: YTN; PAM sequence: CTA
ggaatgtgtcacgcccctaa

SEQ ID NO: 279037 - DNA, 20 bp, Artificial Sequence
  Description of Artificial Sequence: Synthetic oligonucleotide
  Target: ATXN1; (+) strand; PAM type: YTN; PAM sequence: CTA
aatgagactgtgagttttct

SEQ ID NO: 279038 - DNA, 20 bp, Artificial Sequence
  Description of Artificial Sequence: Synthetic oligonucleotide
  Target: ATXN1; (+) strand; PAM type: YTN; PAM sequence: CTG
tgagttttctctgcttaaag

SEQ ID NO: 279039 - DNA, 20 bp, Artificial Sequence
  Description of Artificial Sequence: Synthetic oligonucleotide
  Target: ATXN1; (+) strand; PAM type: YTN; PAM sequence: TTT
tctctgcttaaagacaatca

SEQ ID NO: 279040 - DNA, 20 bp, Artificial Sequence
  Description of Artificial Sequence: Synthetic oligonucleotide
  Target: ATXN1; (+) strand; PAM type: YTN; PAM sequence: TTT
ctctgcttaaagacaatcag

SEQ ID NO: 279041 - DNA, 20 bp, Artificial Sequence
  Description of Artificial Sequence: Synthetic oligonucleotide
  Target: ATXN1; (+) strand; PAM type: YTN; PAM sequence: TTC
tctgcttaaagacaatcaga

SEQ ID NO: 279042 - DNA, 20 bp, Artificial Sequence
  Description of Artificial Sequence: Synthetic oligonucleotide
  Target: ATXN1; (+) strand; PAM type: YTN; PAM sequence: CTC
tgcttaaagacaatcagaaa

SEQ ID NO: 279043 - DNA, 20 bp, Artificial Sequence
  Description of Artificial Sequence: Synthetic oligonucleotide
  Target: ATXN1; (+) strand; PAM type: YTN; PAM sequence: CTG
cttaaagacaatcagaaacc

SEQ ID NO: 279044 - DNA, 20 bp, Artificial Sequence
  Description of Artificial Sequence: Synthetic oligonucleotide
  Target: ATXN1; (+) strand; PAM type: YTN; PAM sequence: CTT
aaagacaatcagaaaccaaa

SEQ ID NO: 279045 - DNA, 20 bp, Artificial Sequence
  Description of Artificial Sequence: Synthetic oligonucleotide
  Target: ATXN1; (+) strand; PAM type: YTN; PAM sequence: TTA
aagacaatcagaaaccaaaa

SEQ ID NO: 279046 - DNA, 20 bp, Artificial Sequence
  Description of Artificial Sequence: Synthetic oligonucleotide
  Target: ATXN1; (+) strand; PAM type: YTN; PAM sequence: CTA
ttatagctttctccttccag

SEQ ID NO: 279047 - DNA, 20 bp, Artificial Sequence
  Description of Artificial Sequence: Synthetic oligonucleotide
  Target: ATXN1; (+) strand; PAM type: YTN; PAM sequence: TTA
tagctttctccttccagaga

SEQ ID NO: 279048 - DNA, 20 bp, Artificial Sequence
  Description of Artificial Sequence: Synthetic oligonucleotide
  Target: ATXN1; (+) strand; PAM type: YTN; PAM sequence: CTT
tctccttccagagatccaag

SEQ ID NO: 279049 - DNA, 20 bp, Artificial Sequence
  Description of Artificial Sequence: Synthetic oligonucleotide
  Target: ATXN1; (+) strand; PAM type: YTN; PAM sequence: TTT
ctccttccagagatccaagg

SEQ ID NO: 279050 - DNA, 20 bp, Artificial Sequence
  Description of Artificial Sequence: Synthetic oligonucleotide
  Target: ATXN1; (+) strand; PAM type: YTN; PAM sequence: TTC
tccttccagagatccaaggg

SEQ ID NO: 279051 - DNA, 20 bp, Artificial Sequence
  Description of Artificial Sequence: Synthetic oligonucleotide
  Target: ATXN1; (+) strand; PAM type: YTN; PAM sequence: CTC
cttccagagatccaaggggc

SEQ ID NO: 279052 - DNA, 20 bp, Artificial Sequence
  Description of Artificial Sequence: Synthetic oligonucleotide
  Target: ATXN1; (+) strand; PAM type: YTN; PAM sequence: CTT
ccagagatccaaggggcctc

SEQ ID NO: 279053 - DNA, 20 bp, Artificial Sequence
  Description of Artificial Sequence: Synthetic oligonucleotide
  Target: ATXN1; (+) strand; PAM type: YTN; PAM sequence: TTC
cagagatccaaggggcctca

SEQ ID NO: 279054 - DNA, 20 bp, Artificial Sequence
  Description of Artificial Sequence: Synthetic oligonucleotide
  Target: ATXN1; (+) strand; PAM type: YTN; PAM sequence: CTC
aaaaaatcttaaaataggga

SEQ ID NO: 279055 - DNA, 20 bp, Artificial Sequence
  Description of Artificial Sequence: Synthetic oligonucleotide
  Target: ATXN1; (+) strand; PAM type: YTN; PAM sequence: CTT
aaaatagggaaagctttgaa

SEQ ID NO: 279056 - DNA, 20 bp, Artificial Sequence
  Description of Artificial Sequence: Synthetic oligonucleotide
  Target: ATXN1; (+) strand; PAM type: YTN; PAM sequence: TTA
aaatagggaaagctttgaaa

SEQ ID NO: 279057 - DNA, 20 bp, Artificial Sequence
  Description of Artificial Sequence: Synthetic oligonucleotide
  Target: ATXN1; (+) strand; PAM type: YTN; PAM sequence: CTT
tgaaaggcagtataggcaaa

SEQ ID NO: 279058 - DNA, 20 bp, Artificial Sequence
  Description of Artificial Sequence: Synthetic oligonucleotide
  Target: ATXN1; (+) strand; PAM type: YTN; PAM sequence: TTT
gaaaggcagtataggcaaag

SEQ ID NO: 279059 - DNA, 20 bp, Artificial Sequence
  Description of Artificial Sequence: Synthetic oligonucleotide
  Target: ATXN1; (+) strand; PAM type: YTN; PAM sequence: TTG
aaaggcagtataggcaaagc

SEQ ID NO: 279060 - DNA, 20 bp, Artificial Sequence
  Description of Artificial Sequence: Synthetic oligonucleotide
  Target: ATXN1; (+) strand; PAM type: YTN; PAM sequence: CTA
aagcatttaggggtgggaac

SEQ ID NO: 279061 - DNA, 20 bp, Artificial Sequence
  Description of Artificial Sequence: Synthetic oligonucleotide
  Target: ATXN1; (+) strand; PAM type: YTN; PAM sequence: TTT
aggggtgggaacagttatcc

SEQ ID NO: 279062 - DNA, 20 bp, Artificial Sequence
  Description of Artificial Sequence: Synthetic oligonucleotide
  Target: ATXN1; (+) strand; PAM type: YTN; PAM sequence: TTA
ggggtgggaacagttatccc

SEQ ID NO: 279063 - DNA, 20 bp, Artificial Sequence
  Description of Artificial Sequence: Synthetic oligonucleotide
  Target: ATXN1; (+) strand; PAM type: YTN; PAM sequence: TTA
tccctttgtacataaacatc

SEQ ID NO: 279064 - DNA, 20 bp, Artificial Sequence
  Description of Artificial Sequence: Synthetic oligonucleotide
  Target: ATXN1; (+) strand; PAM type: YTN; PAM sequence: CTT
tgtacataaacatctttgaa

SEQ ID NO: 279065 - DNA, 20 bp, Artificial Sequence
  Description of Artificial Sequence: Synthetic oligonucleotide
  Target: ATXN1; (+) strand; PAM type: YTN; PAM sequence: TTT
gtacataaacatctttgaag

SEQ ID NO: 279066 - DNA, 20 bp, Artificial Sequence
  Description of Artificial Sequence: Synthetic oligonucleotide
  Target: ATXN1; (+) strand; PAM type: YTN; PAM sequence: TTG
tacataaacatctttgaagg

SEQ ID NO: 279067 - DNA, 20 bp, Artificial Sequence
  Description of Artificial Sequence: Synthetic oligonucleotide
  Target: ATXN1; (+) strand; PAM type: YTN; PAM sequence: CTT
tgaaggacagggcagcactg

SEQ ID NO: 279068 - DNA, 20 bp, Artificial Sequence
  Description of Artificial Sequence: Synthetic oligonucleotide
  Target: ATXN1; (+) strand; PAM type: YTN; PAM sequence: TTT
gaaggacagggcagcactgt

SEQ ID NO: 279069 - DNA, 20 bp, Artificial Sequence
  Description of Artificial Sequence: Synthetic oligonucleotide
  Target: ATXN1; (+) strand; PAM type: YTN; PAM sequence: TTG
aaggacagggcagcactgtg

SEQ ID NO: 279070 - DNA, 20 bp, Artificial Sequence
  Description of Artificial Sequence: Synthetic oligonucleotide
  Target: ATXN1; (+) strand; PAM type: YTN; PAM sequence: CTG
tgagtctccattttcatgga

SEQ ID NO: 279071 - DNA, 20 bp, Artificial Sequence
  Description of Artificial Sequence: Synthetic oligonucleotide
  Target: ATXN1; (+) strand; PAM type: YTN; PAM sequence: CTC
cattttcatggagtgctagg

SEQ ID NO: 279072 - DNA, 20 bp, Artificial Sequence
  Description of Artificial Sequence: Synthetic oligonucleotide
  Target: ATXN1; (+) strand; PAM type: YTN; PAM sequence: TTT
tcatggagtgctaggctagc

SEQ ID NO: 279073 - DNA, 20 bp, Artificial Sequence
  Description of Artificial Sequence: Synthetic oligonucleotide
  Target: ATXN1; (+) strand; PAM type: YTN; PAM sequence: TTT
catggagtgctaggctagca

SEQ ID NO: 279074 - DNA, 20 bp, Artificial Sequence
  Description of Artificial Sequence: Synthetic oligonucleotide
  Target: ATXN1; (+) strand; PAM type: YTN; PAM sequence: TTC
atggagtgctaggctagcat

SEQ ID NO: 279075 - DNA, 20 bp, Artificial Sequence
  Description of Artificial Sequence: Synthetic oligonucleotide
  Target: ATXN1; (+) strand; PAM type: YTN; PAM sequence: CTA
ggctagcatattttaaagaa

SEQ ID NO: 279076 - DNA, 20 bp, Artificial Sequence
  Description of Artificial Sequence: Synthetic oligonucleotide
  Target: ATXN1; (+) strand; PAM type: YTN; PAM sequence: CTA
gcatattttaaagaagaaga

SEQ ID NO: 279077 - DNA, 20 bp, Artificial Sequence
  Description of Artificial Sequence: Synthetic oligonucleotide
  Target: ATXN1; (+) strand; PAM type: YTN; PAM sequence: TTT
taaagaagaagatatctttt

SEQ ID NO: 279078 - DNA, 20 bp, Artificial Sequence
  Description of Artificial Sequence: Synthetic oligonucleotide
  Target: ATXN1; (+) strand; PAM type: YTN; PAM sequence: TTT
aaagaagaagatatctttta

SEQ ID NO: 279079 - DNA, 20 bp, Artificial Sequence
  Description of Artificial Sequence: Synthetic oligonucleotide
  Target: ATXN1; (+) strand; PAM type: YTN; PAM sequence: TTA
aagaagaagatatcttttat

SEQ ID NO: 279080 - DNA, 20 bp, Artificial Sequence
  Description of Artificial Sequence: Synthetic oligonucleotide
  Target: ATXN1; (+) strand; PAM type: YTN; PAM sequence: CTT
ttatgacacagatacttgca

SEQ ID NO: 279081 - DNA, 20 bp, Artificial Sequence
  Description of Artificial Sequence: Synthetic oligonucleotide
  Target: ATXN1; (+) strand; PAM type: YTN; PAM sequence: TTT
tatgacacagatacttgcac

SEQ ID NO: 279082 - DNA, 20 bp, Artificial Sequence
  Description of Artificial Sequence: Synthetic oligonucleotide
  Target: ATXN1; (+) strand; PAM type: YTN; PAM sequence: TTT
atgacacagatacttgcacc

SEQ ID NO: 279083 - DNA, 20 bp, Artificial Sequence
  Description of Artificial Sequence: Synthetic oligonucleotide
  Target: ATXN1; (+) strand; PAM type: YTN; PAM sequence: TTA
tgacacagatacttgcacca

SEQ ID NO: 279084 - DNA, 20 bp, Artificial Sequence
  Description of Artificial Sequence: Synthetic oligonucleotide
  Target: ATXN1; (+) strand; PAM type: YTN; PAM sequence: CTT
gcaccataaattgtaagtag

SEQ ID NO: 279085 - DNA, 20 bp, Artificial Sequence
  Description of Artificial Sequence: Synthetic oligonucleotide
  Target: ATXN1; (+) strand; PAM type: YTN; PAM sequence: TTG
caccataaattgtaagtaga

SEQ ID NO: 279086 - DNA, 20 bp, Artificial Sequence
  Description of Artificial Sequence: Synthetic oligonucleotide
  Target: ATXN1; (+) strand; PAM type: YTN; PAM sequence: TTG
taagtagattaggatatgtc

SEQ ID NO: 279087 - DNA, 20 bp, Artificial Sequence
  Description of Artificial Sequence: Synthetic oligonucleotide
  Target: ATXN1; (+) strand; PAM type: YTN; PAM sequence: TTA
ggatatgtctatgccacaac

SEQ ID NO: 279088 - DNA, 20 bp, Artificial Sequence
  Description of Artificial Sequence: Synthetic oligonucleotide
  Target: ATXN1; (+) strand; PAM type: YTN; PAM sequence: CTA
tgccacaacacacaatcgtt

SEQ ID NO: 279089 - DNA, 20 bp, Artificial Sequence
  Description of Artificial Sequence: Synthetic oligonucleotide
  Target: ATXN1; (+) strand; PAM type: YTN; PAM sequence: TTT
aagatgatgtaatcgaggga

SEQ ID NO: 279090 - DNA, 20 bp, Artificial Sequence
  Description of Artificial Sequence: Synthetic oligonucleotide
  Target: ATXN1; (+) strand; PAM type: YTN; PAM sequence: TTA
agatgatgtaatcgagggac

SEQ ID NO: 279091 - DNA, 20 bp, Artificial Sequence
  Description of Artificial Sequence: Synthetic oligonucleotide
  Target: ATXN1; (+) strand; PAM type: YTN; PAM sequence: TTT
gggggctaaaatgatcaact

SEQ ID NO: 279092 - DNA, 20 bp, Artificial Sequence
  Description of Artificial Sequence: Synthetic oligonucleotide
  Target: ATXN1; (+) strand; PAM type: YTN; PAM sequence: TTG
ggggctaaaatgatcaactc

SEQ ID NO: 279093 - DNA, 20 bp, Artificial Sequence
  Description of Artificial Sequence: Synthetic oligonucleotide
  Target: ATXN1; (+) strand; PAM type: YTN; PAM sequence: CTA
aaatgatcaactccacacaa

SEQ ID NO: 279094 - DNA, 20 bp, Artificial Sequence
  Description of Artificial Sequence: Synthetic oligonucleotide
  Target: ATXN1; (+) strand; PAM type: YTN; PAM sequence: CTC
cacacaagaataatctacta

SEQ ID NO: 279095 - DNA, 20 bp, Artificial Sequence
  Description of Artificial Sequence: Synthetic oligonucleotide
  Target: ATXN1; (+) strand; PAM type: YTN; PAM sequence: CTA
ctaatggtataacaagtgat

SEQ ID NO: 279096 - DNA, 20 bp, Artificial Sequence
  Description of Artificial Sequence: Synthetic oligonucleotide
  Target: ATXN1; (+) strand; PAM type: YTN; PAM sequence: CTA
atggtataacaagtgattca

SEQ ID NO: 279097 - DNA, 20 bp, Artificial Sequence
  Description of Artificial Sequence: Synthetic oligonucleotide
  Target: ATXN1; (+) strand; PAM type: YTN; PAM sequence: TTC
atggaaaagatgatcctggc

SEQ ID NO: 279098 - DNA, 20 bp, Artificial Sequence
  Description of Artificial Sequence: Synthetic oligonucleotide
  Target: ATXN1; (+) strand; PAM type: YTN; PAM sequence: CTG
gcaaaacaataacttttgtt

SEQ ID NO: 279099 - DNA, 20 bp, Artificial Sequence
  Description of Artificial Sequence: Synthetic oligonucleotide
  Target: ATXN1; (+) strand; PAM type: YTN; PAM sequence: CTT
ttgttcaaggccatcaagag

SEQ ID NO: 279100 - DNA, 20 bp, Artificial Sequence
  Description of Artificial Sequence: Synthetic oligonucleotide
  Target: ATXN1; (+) strand; PAM type: YTN; PAM sequence: TTT
tgttcaaggccatcaagagg

SEQ ID NO: 279101 - DNA, 20 bp, Artificial Sequence
  Description of Artificial Sequence: Synthetic oligonucleotide
  Target: ATXN1; (+) strand; PAM type: YTN; PAM sequence: TTT
gttcaaggccatcaagaggt

SEQ ID NO: 279102 - DNA, 20 bp, Artificial Sequence
  Description of Artificial Sequence: Synthetic oligonucleotide
  Target: ATXN1; (+) strand; PAM type: YTN; PAM sequence: TTG
ttcaaggccatcaagaggtt

SEQ ID NO: 279103 - DNA, 20 bp, Artificial Sequence
  Description of Artificial Sequence: Synthetic oligonucleotide
  Target: ATXN1; (+) strand; PAM type: YTN; PAM sequence: TTC
aaggccatcaagaggttttc

SEQ ID NO: 279104 - DNA, 20 bp, Artificial Sequence
  Description of Artificial Sequence: Synthetic oligonucleotide
  Target: ATXN1; (+) strand; PAM type: YTN; PAM sequence: TTT
tccctaaaaatctactatgc

SEQ ID NO: 279105 - DNA, 20 bp, Artificial Sequence
  Description of Artificial Sequence: Synthetic oligonucleotide
  Target: ATXN1; (+) strand; PAM type: YTN; PAM sequence: TTT
ccctaaaaatctactatgcg

SEQ ID NO: 279106 - DNA, 20 bp, Artificial Sequence
  Description of Artificial Sequence: Synthetic oligonucleotide
  Target: ATXN1; (+) strand; PAM type: YTN; PAM sequence: TTC
cctaaaaatctactatgcgt

SEQ ID NO: 279107 - DNA, 20 bp, Artificial Sequence
  Description of Artificial Sequence: Synthetic oligonucleotide
  Target: ATXN1; (+) strand; PAM type: YTN; PAM sequence: CTA
aaaatctactatgcgtttag

SEQ ID NO: 279108 - DNA, 20 bp, Artificial Sequence
  Description of Artificial Sequence: Synthetic oligonucleotide
  Target: ATXN1; (+) strand; PAM type: YTN; PAM sequence: CTA
ctatgcgtttagccctgtgc

SEQ ID NO: 279109 - DNA, 20 bp, Artificial Sequence
  Description of Artificial Sequence: Synthetic oligonucleotide
  Target: ATXN1; (+) strand; PAM type: YTN; PAM sequence: CTA
tgcgtttagccctgtgctaa

SEQ ID NO: 279110 - DNA, 20 bp, Artificial Sequence
  Description of Artificial Sequence: Synthetic oligonucleotide
  Target: ATXN1; (+) strand; PAM type: YTN; PAM sequence: TTT
agccctgtgctaagatttgt

SEQ ID NO: 279111 - DNA, 20 bp, Artificial Sequence
  Description of Artificial Sequence: Synthetic oligonucleotide
  Target: ATXN1; (+) strand; PAM type: YTN; PAM sequence: TTA
gccctgtgctaagatttgtg

SEQ ID NO: 279112 - DNA, 20 bp, Artificial Sequence
  Description of Artificial Sequence: Synthetic oligonucleotide
  Target: ATXN1; (+) strand; PAM type: YTN; PAM sequence: CTG
tgctaagatttgtggaaaat

SEQ ID NO: 279113 - DNA, 20 bp, Artificial Sequence
  Description of Artificial Sequence: Synthetic oligonucleotide
  Target: ATXN1; (+) strand; PAM type: YTN; PAM sequence: CTA
agatttgtggaaaatatgga

SEQ ID NO: 279114 - DNA, 20 bp, Artificial Sequence
  Description of Artificial Sequence: Synthetic oligonucleotide
  Target: ATXN1; (+) strand; PAM type: YTN; PAM sequence: TTT
gtggaaaatatggaagaaat

SEQ ID NO: 279115 - DNA, 20 bp, Artificial Sequence
  Description of Artificial Sequence: Synthetic oligonucleotide
  Target: ATXN1; (+) strand; PAM type: YTN; PAM sequence: TTG
tggaaaatatggaagaaatc

SEQ ID NO: 279116 - DNA, 20 bp, Artificial Sequence
  Description of Artificial Sequence: Synthetic oligonucleotide
  Target: ATXN1; (+) strand; PAM type: YTN; PAM sequence: TTA
ccctgggccagagctcattt

SEQ ID NO: 279117 - DNA, 20 bp, Artificial Sequence
  Description of Artificial Sequence: Synthetic oligonucleotide
  Target: ATXN1; (+) strand; PAM type: YTN; PAM sequence: CTG
ggccagagctcatttcctcc

SEQ ID NO: 279118 - DNA, 20 bp, Artificial Sequence
  Description of Artificial Sequence: Synthetic oligonucleotide
  Target: ATXN1; (+) strand; PAM type: YTN; PAM sequence: CTC
atttcctccccaatctctaa

SEQ ID NO: 279119 - DNA, 20 bp, Artificial Sequence
  Description of Artificial Sequence: Synthetic oligonucleotide
  Target: ATXN1; (+) strand; PAM type: YTN; PAM sequence: TTT
cctccccaatctctaaaccc

SEQ ID NO: 279120 - DNA, 20 bp, Artificial Sequence
  Description of Artificial Sequence: Synthetic oligonucleotide
  Target: ATXN1; (+) strand; PAM type: YTN; PAM sequence: TTC
ctccccaatctctaaaccca

SEQ ID NO: 279121 - DNA, 20 bp, Artificial Sequence
  Description of Artificial Sequence: Synthetic oligonucleotide
  Target: ATXN1; (+) strand; PAM type: YTN; PAM sequence: CTC
cccaatctctaaacccaccc

SEQ ID NO: 279122 - DNA, 20 bp, Artificial Sequence
  Description of Artificial Sequence: Synthetic oligonucleotide
  Target: ATXN1; (+) strand; PAM type: YTN; PAM sequence: CTC
taaacccacccgagagacat

SEQ ID NO: 279123 - DNA, 20 bp, Artificial Sequence
  Description of Artificial Sequence: Synthetic oligonucleotide
  Target: ATXN1; (+) strand; PAM type: YTN; PAM sequence: CTA
aacccacccgagagacatta

SEQ ID NO: 279124 - DNA, 20 bp, Artificial Sequence
  Description of Artificial Sequence: Synthetic oligonucleotide
  Target: ATXN1; (+) strand; PAM type: YTN; PAM sequence: TTA
ctgtcacatttccaaaatgc

SEQ ID NO: 279125 - DNA, 20 bp, Artificial Sequence
  Description of Artificial Sequence: Synthetic oligonucleotide
  Target: ATXN1; (+) strand; PAM type: YTN; PAM sequence: CTG
tcacatttccaaaatgcaaa

SEQ ID NO: 279126 - DNA, 20 bp, Artificial Sequence
  Description of Artificial Sequence: Synthetic oligonucleotide
  Target: ATXN1; (+) strand; PAM type: YTN; PAM sequence: TTT
ccaaaatgcaaatgaaatgc

SEQ ID NO: 279127 - DNA, 20 bp, Artificial Sequence
  Description of Artificial Sequence: Synthetic oligonucleotide
  Target: ATXN1; (+) strand; PAM type: YTN; PAM sequence: TTC
caaaatgcaaatgaaatgct

SEQ ID NO: 279128 - DNA, 20 bp, Artificial Sequence
  Description of Artificial Sequence: Synthetic oligonucleotide
  Target: ATXN1; (+) strand; PAM type: YTN; PAM sequence: CTG
tccctcatgtctacagcttt

SEQ ID NO: 279129 - DNA, 20 bp, Artificial Sequence
  Description of Artificial Sequence: Synthetic oligonucleotide
  Target: ATXN1; (+) strand; PAM type: YTN; PAM sequence: CTC
atgtctacagcttttttatt

SEQ ID NO: 279130 - DNA, 20 bp, Artificial Sequence
  Description of Artificial Sequence: Synthetic oligonucleotide
  Target: ATXN1; (+) strand; PAM type: YTN; PAM sequence: CTA
cagcttttttattttttgag

SEQ ID NO: 279131 - DNA, 20 bp, Artificial Sequence
  Description of Artificial Sequence: Synthetic oligonucleotide
  Target: ATXN1; (+) strand; PAM type: YTN; PAM sequence: CTT
ttttattttttgagatggag

SEQ ID NO: 279132 - DNA, 20 bp, Artificial Sequence
  Description of Artificial Sequence: Synthetic oligonucleotide
  Target: ATXN1; (+) strand; PAM type: YTN; PAM sequence: TTT
tttattttttgagatggagt

SEQ ID NO: 279133 - DNA, 20 bp, Artificial Sequence
  Description of Artificial Sequence: Synthetic oligonucleotide
  Target: ATXN1; (+) strand; PAM type: YTN; PAM sequence: TTT
ttattttttgagatggagtt

SEQ ID NO: 279134 - DNA, 20 bp, Artificial Sequence
  Description of Artificial Sequence: Synthetic oligonucleotide
  Target: ATXN1; (+) strand; PAM type: YTN; PAM sequence: TTT
tattttttgagatggagttt

SEQ ID NO: 279135 - DNA, 20 bp, Artificial Sequence
  Description of Artificial Sequence: Synthetic oligonucleotide
  Target: ATXN1; (+) strand; PAM type: YTN; PAM sequence: TTT
attttttgagatggagtttg

SEQ ID NO: 279136 - DNA, 20 bp, Artificial Sequence
  Description of Artificial Sequence: Synthetic oligonucleotide
  Target: ATXN1; (+) strand; PAM type: YTN; PAM sequence: TTA
ttttttgagatggagtttgg

SEQ ID NO: 279137 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtttggttc

SEQ ID NO: 279138 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtttggttct

SEQ ID NO: 279139 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtttggttctt

SEQ ID NO: 279140 - DNA, 20 bp, Artificial Sequence
  Description of Artificial Sequence: Synthetic oligonucleotide
  Target: ATXN1; (+) strand; PAM type: YTN; PAM sequence: TTT
gagatggagtttggttcttg

SEQ ID NO: 279141 - DNA, 20 bp, Artificial Sequence
  Description of Artificial Sequence: Synthetic oligonucleotide
  Target: ATXN1; (+) strand; PAM type: YTN; PAM sequence: TTG
agatggagtttggttcttgt

SEQ ID NO: 279142 - DNA, 20 bp, Artificial Sequence
  Description of Artificial Sequence: Synthetic oligonucleotide
  Target: ATXN1; (+) strand; PAM type: YTN; PAM sequence: TTT
ggttcttgtcgcccaggctg

SEQ ID NO: 279143 - DNA, 20 bp, Artificial Sequence
  Description of Artificial Sequence: Synthetic oligonucleotide
  Target: ATXN1; (+) strand; PAM type: YTN; PAM sequence: TTG
gttcttgtcgcccaggctgg

SEQ ID NO: 279144 - DNA, 20 bp, Artificial Sequence
  Description of Artificial Sequence: Synthetic oligonucleotide
  Target: ATXN1; (+) strand; PAM type: YTN; PAM sequence: TTC
ttgtcgcccaggctggagtg

SEQ ID NO: 279145 - DNA, 20 bp, Artificial Sequence
  Description of Artificial Sequence: Synthetic oligonucleotide
  Target: ATXN1; (+) strand; PAM type: YTN; PAM sequence: CTT
gtcgcccaggctggagtgca

SEQ ID NO: 279146 - DNA, 20 bp, Artificial Sequence
  Description of Artificial Sequence: Synthetic oligonucleotide
  Target: ATXN1; (+) strand; PAM type: YTN; PAM sequence: TTG
tcgcccaggctggagtgcaa

SEQ ID NO: 279147 - DNA, 20 bp, Artificial Sequence
  Description of Artificial Sequence: Synthetic oligonucleotide
  Target: ATXN1; (+) strand; PAM type: YTN; PAM sequence: CTG
gagtgcaatggtgcggtctt

SEQ ID NO: 279148 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaacctccagc

SEQ ID NO: 279149 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaacctccagct

SEQ ID NO: 279150 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccagctccca

SEQ ID NO: 279151 - DNA, 20 bp, Artificial Sequence
  Description of Artificial Sequence: Synthetic oligonucleotide
  Target: ATXN1; (+) strand; PAM type: YTN; PAM sequence: CTG
caacctccagctcccagatt

SEQ ID NO: 279152 - DNA, 20 bp, Artificial Sequence
  Description of Artificial Sequence: Synthetic oligonucleotide
  Target: ATXN1; (+) strand; PAM type: YTN; PAM sequence: CTC
cagctcccagattcaagcaa

SEQ ID NO: 279153 - DNA, 20 bp, Artificial Sequence
  Description of Artificial Sequence: Synthetic oligonucleotide
  Target: ATXN1; (+) strand; PAM type: YTN; PAM sequence: CTC
ccagattcaagcaattctcc

SEQ ID NO: 279154 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcctcag

SEQ ID NO: 279155 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcctgag

SEQ ID NO: 279156 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcctgagta

SEQ ID NO: 279157 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 279158 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctgaga

SEQ ID NO: 279159 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgagattacag

SEQ ID NO: 279160 - DNA, 20 bp, Artificial Sequence
  Description of Artificial Sequence: Synthetic oligonucleotide
  Target: ATXN1; (+) strand; PAM type: YTN; PAM sequence: CTG
agtagctgagattacaggcg

SEQ ID NO: 279161 - DNA, 20 bp, Artificial Sequence
  Description of Artificial Sequence: Synthetic oligonucleotide
  Target: ATXN1; (+) strand; PAM type: YTN; PAM sequence: CTG
agattacaggcgcccgccac

SEQ ID NO: 279162 - DNA, 20 bp, Artificial Sequence
  Description of Artificial Sequence: Synthetic oligonucleotide
  Target: ATXN1; (+) strand; PAM type: YTN; PAM sequence: TTA
caggcgcccgccaccacgcc

SEQ ID NO: 279163 - DNA, 20 bp, Artificial Sequence
  Description of Artificial Sequence: Synthetic oligonucleotide
  Target: ATXN1; (+) strand; PAM type: YTN; PAM sequence: CTA
atttttttgtatttttagta

SEQ ID NO: 279164 - DNA, 20 bp, Artificial Sequence
  Description of Artificial Sequence: Synthetic oligonucleotide
  Target: ATXN1; (+) strand; PAM type: YTN; PAM sequence: TTT
ttttgtatttttagtagaga

SEQ ID NO: 279165 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagat

SEQ ID NO: 279166 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 279167 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 279168 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 279169 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 279170 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 279171 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 279172 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 279173 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 279174 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctag

SEQ ID NO: 279175 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctagt

SEQ ID NO: 279176 - DNA, 20 bp, Artificial Sequence
  Description of Artificial Sequence: Synthetic oligonucleotide
  Target: ATXN1; (+) strand; PAM type: YTN; PAM sequence: TTG
gccaggctagtctcgaactc

SEQ ID NO: 279177 - DNA, 20 bp, Artificial Sequence
  Description of Artificial Sequence: Synthetic oligonucleotide
  Target: ATXN1; (+) strand; PAM type: YTN; PAM sequence: CTA
gtctcgaactcctgacctca

SEQ ID NO: 279178 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 279179 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatgcacc

SEQ ID NO: 279180 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatgcacccac

SEQ ID NO: 279181 - DNA, 20 bp, Artificial Sequence
  Description of Artificial Sequence: Synthetic oligonucleotide
  Target: ATXN1; (+) strand; PAM type: YTN; PAM sequence: CTC
aggtgatgcacccacctcag

SEQ ID NO: 279182 - DNA, 20 bp, Artificial Sequence
  Description of Artificial Sequence: Synthetic oligonucleotide
  Target: ATXN1; (+) strand; PAM type: YTN; PAM sequence: CTC
agcgtcccaaagtgctggga

SEQ ID NO: 279183 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcacatgccac

SEQ ID NO: 279184 - DNA, 20 bp, Artificial Sequence
  Description of Artificial Sequence: Synthetic oligonucleotide
  Target: ATXN1; (+) strand; PAM type: YTN; PAM sequence: TTA
caggcacatgccaccacgcc

SEQ ID NO: 279185 - DNA, 20 bp, Artificial Sequence
  Description of Artificial Sequence: Synthetic oligonucleotide
  Target: ATXN1; (+) strand; PAM type: YTN; PAM sequence: CTA
atttttttgtatttttagta

SEQ ID NO: 279186 - DNA, 20 bp, Artificial Sequence
  Description of Artificial Sequence: Synthetic oligonucleotide
  Target: ATXN1; (+) strand; PAM type: YTN; PAM sequence: TTT
ttttgtatttttagtagaga

SEQ ID NO: 279187 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagat

SEQ ID NO: 279188 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagata

SEQ ID NO: 279189 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatag

SEQ ID NO: 279190 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatagg

SEQ ID NO: 279191 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagataggg

SEQ ID NO: 279192 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatagggtttca

SEQ ID NO: 279193 - DNA, 20 bp, Artificial Sequence
  Description of Artificial Sequence: Synthetic oligonucleotide
  Target: ATXN1; (+) strand; PAM type: YTN; PAM sequence: TTT
tagtagagatagggtttcac

SEQ ID NO: 279194 - DNA, 20 bp, Artificial Sequence
  Description of Artificial Sequence: Synthetic oligonucleotide
  Target: ATXN1; (+) strand; PAM type: YTN; PAM sequence: TTT
agtagagatagggtttcacc

SEQ ID NO: 279195 - DNA, 20 bp, Artificial Sequence
  Description of Artificial Sequence: Synthetic oligonucleotide
  Target: ATXN1; (+) strand; PAM type: YTN; PAM sequence: TTA
gtagagatagggtttcacca

SEQ ID NO: 279196 - DNA, 20 bp, Artificial Sequence
  Description of Artificial Sequence: Synthetic oligonucleotide
  Target: ATXN1; (+) strand; PAM type: YTN; PAM sequence: TTT
caccatgttggctaggctgg

SEQ ID NO: 279197 - DNA, 20 bp, Artificial Sequence
  Description of Artificial Sequence: Synthetic oligonucleotide
  Target: ATXN1; (+) strand; PAM type: YTN; PAM sequence: TTC
accatgttggctaggctggt

SEQ ID NO: 279198 - DNA, 20 bp, Artificial Sequence
  Description of Artificial Sequence: Synthetic oligonucleotide
  Target: ATXN1; (+) strand; PAM type: YTN; PAM sequence: TTG
gctaggctggtctcgaactc

SEQ ID NO: 279199 - DNA, 20 bp, Artificial Sequence
  Description of Artificial Sequence: Synthetic oligonucleotide
  Target: ATXN1; (+) strand; PAM type: YTN; PAM sequence: CTA
ggctggtctcgaactcctga

SEQ ID NO: 279200 - DNA, 20 bp, Artificial Sequence
  Description of Artificial Sequence: Synthetic oligonucleotide
  Target: ATXN1; (+) strand; PAM type: YTN; PAM sequence: CTG
gtctcgaactcctgacctca

SEQ ID NO: 279201 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 279202 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatgcacc

SEQ ID NO: 279203 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatgcacccgc

SEQ ID NO: 279204 - DNA, 20 bp, Artificial Sequence
  Description of Artificial Sequence: Synthetic oligonucleotide
  Target: ATXN1; (+) strand; PAM type: YTN; PAM sequence: CTC
aggtgatgcacccgcctcag

SEQ ID NO: 279205 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgctgaga

SEQ ID NO: 279206 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgagattacaa

SEQ ID NO: 279207 - DNA, 20 bp, Artificial Sequence
  Description of Artificial Sequence: Synthetic oligonucleotide
  Target: ATXN1; (+) strand; PAM type: YTN; PAM sequence: CTG
agattacaagcatgagccac

SEQ ID NO: 279208 - DNA, 20 bp, Artificial Sequence
  Description of Artificial Sequence: Synthetic oligonucleotide
  Target: ATXN1; (+) strand; PAM type: YTN; PAM sequence: TTA
caagcatgagccactatgcc

SEQ ID NO: 279209 - DNA, 20 bp, Artificial Sequence
  Description of Artificial Sequence: Synthetic oligonucleotide
  Target: ATXN1; (+) strand; PAM type: YTN; PAM sequence: CTA
tgcctggccatgtctacagc

SEQ ID NO: 279210 - DNA, 20 bp, Artificial Sequence
  Description of Artificial Sequence: Synthetic oligonucleotide
  Target: ATXN1; (+) strand; PAM type: YTN; PAM sequence: CTG
gccatgtctacagcctttaa

SEQ ID NO: 279211 - DNA, 20 bp, Artificial Sequence
  Description of Artificial Sequence: Synthetic oligonucleotide
  Target: ATXN1; (+) strand; PAM type: YTN; PAM sequence: CTA
cagcctttaacgactctcca

SEQ ID NO: 279212 - DNA, 20 bp, Artificial Sequence
  Description of Artificial Sequence: Synthetic oligonucleotide
  Target: ATXN1; (+) strand; PAM type: YTN; PAM sequence: CTT
taacgactctccatcatcgt

SEQ ID NO: 279213 - DNA, 20 bp, Artificial Sequence
  Description of Artificial Sequence: Synthetic oligonucleotide
  Target: ATXN1; (+) strand; PAM type: YTN; PAM sequence: TTT
aacgactctccatcatcgtg

SEQ ID NO: 279214 - DNA, 20 bp, Artificial Sequence
  Description of Artificial Sequence: Synthetic oligonucleotide
  Target: ATXN1; (+) strand; PAM type: YTN; PAM sequence: TTA
acgactctccatcatcgtga

SEQ ID NO: 279215 - DNA, 20 bp, Artificial Sequence
  Description of Artificial Sequence: Synthetic oligonucleotide
  Target: ATXN1; (+) strand; PAM type: YTN; PAM sequence: CTC
tccatcatcgtgactatagt

SEQ ID NO: 279216 - DNA, 20 bp, Artificial Sequence
  Description of Artificial Sequence: Synthetic oligonucleotide
  Target: ATXN1; (+) strand; PAM type: YTN; PAM sequence: CTC
catcatcgtgactatagtct

SEQ ID NO: 279217 - DNA, 20 bp, Artificial Sequence
  Description of Artificial Sequence: Synthetic oligonucleotide
  Target: ATXN1; (+) strand; PAM type: YTN; PAM sequence: CTA
tagtctgaacaggatacacg

SEQ ID NO: 279218 - DNA, 20 bp, Artificial Sequence
  Description of Artificial Sequence: Synthetic oligonucleotide
  Target: ATXN1; (+) strand; PAM type: YTN; PAM sequence: CTG
aacaggatacacgagtcccc

SEQ ID NO: 279219 - DNA, 20 bp, Artificial Sequence
  Description of Artificial Sequence: Synthetic oligonucleotide
  Target: ATXN1; (+) strand; PAM type: YTN; PAM sequence: CTC
aatcccacgctggctcatct

SEQ ID NO: 279220 - DNA, 20 bp, Artificial Sequence
  Description of Artificial Sequence: Synthetic oligonucleotide
  Target: ATXN1; (+) strand; PAM type: YTN; PAM sequence: CTG
gctcatctgtcctgtctcaa

SEQ ID NO: 279221 - DNA, 20 bp, Artificial Sequence
  Description of Artificial Sequence: Synthetic oligonucleotide
  Target: ATXN1; (+) strand; PAM type: YTN; PAM sequence: CTC
atctgtcctgtctcaatgag

SEQ ID NO: 279222 - DNA, 20 bp, Artificial Sequence
  Description of Artificial Sequence: Synthetic oligonucleotide
  Target: ATXN1; (+) strand; PAM type: YTN; PAM sequence: CTG
tcctgtctcaatgagtgaaa

SEQ ID NO: 279223 - DNA, 20 bp, Artificial Sequence
  Description of Artificial Sequence: Synthetic oligonucleotide
  Target: ATXN1; (+) strand; PAM type: YTN; PAM sequence: CTG
tctcaatgagtgaaactccc

SEQ ID NO: 279224 - DNA, 20 bp, Artificial Sequence
  Description of Artificial Sequence: Synthetic oligonucleotide
  Target: ATXN1; (+) strand; PAM type: YTN; PAM sequence: CTC
aatgagtgaaactccccatc

SEQ ID NO: 279225 - DNA, 20 bp, Artificial Sequence
  Description of Artificial Sequence: Synthetic oligonucleotide
  Target: ATXN1; (+) strand; PAM type: YTN; PAM sequence: CTC
cccatctcataccctgggac

SEQ ID NO: 279226 - DNA, 20 bp, Artificial Sequence
  Description of Artificial Sequence: Synthetic oligonucleotide
  Target: ATXN1; (+) strand; PAM type: YTN; PAM sequence: CTC
ataccctgggactgagccat

SEQ ID NO: 279227 - DNA, 20 bp, Artificial Sequence
  Description of Artificial Sequence: Synthetic oligonucleotide
  Target: ATXN1; (+) strand; PAM type: YTN; PAM sequence: CTG
ggactgagccatgctctact

SEQ ID NO: 279228 - DNA, 20 bp, Artificial Sequence
  Description of Artificial Sequence: Synthetic oligonucleotide
  Target: ATXN1; (+) strand; PAM type: YTN; PAM sequence: CTG
agccatgctctactacagtt

SEQ ID NO: 279229 - DNA, 20 bp, Artificial Sequence
  Description of Artificial Sequence: Synthetic oligonucleotide
  Target: ATXN1; (+) strand; PAM type: YTN; PAM sequence: CTC
tactacagttccctgggttt

SEQ ID NO: 279230 - DNA, 20 bp, Artificial Sequence
  Description of Artificial Sequence: Synthetic oligonucleotide
  Target: ATXN1; (+) strand; PAM type: YTN; PAM sequence: CTA
ctacagttccctgggtttca

SEQ ID NO: 279231 - DNA, 20 bp, Artificial Sequence
  Description of Artificial Sequence: Synthetic oligonucleotide
  Target: ATXN1; (+) strand; PAM type: YTN; PAM sequence: CTA
cagttccctgggtttcaaag

SEQ ID NO: 279232 - DNA, 20 bp, Artificial Sequence
  Description of Artificial Sequence: Synthetic oligonucleotide
  Target: ATXN1; (+) strand; PAM type: YTN; PAM sequence: TTC
cctgggtttcaaagattcct

SEQ ID NO: 279233 - DNA, 20 bp, Artificial Sequence
  Description of Artificial Sequence: Synthetic oligonucleotide
  Target: ATXN1; (+) strand; PAM type: YTN; PAM sequence: CTG
ggtttcaaagattcctccac

SEQ ID NO: 279234 - DNA, 20 bp, Artificial Sequence
  Description of Artificial Sequence: Synthetic oligonucleotide
  Target: ATXN1; (+) strand; PAM type: YTN; PAM sequence: TTT
caaagattcctccacaccca

SEQ ID NO: 279235 - DNA, 20 bp, Artificial Sequence
  Description of Artificial Sequence: Synthetic oligonucleotide
  Target: ATXN1; (+) strand; PAM type: YTN; PAM sequence: TTC
aaagattcctccacacccat

SEQ ID NO: 279236 - DNA, 20 bp, Artificial Sequence
  Description of Artificial Sequence: Synthetic oligonucleotide
  Target: ATXN1; (+) strand; PAM type: YTN; PAM sequence: TTC
ctccacacccatgcctttga

SEQ ID NO: 279237 - DNA, 20 bp, Artificial Sequence
  Description of Artificial Sequence: Synthetic oligonucleotide
  Target: ATXN1; (+) strand; PAM type: YTN; PAM sequence: CTC
cacacccatgcctttgaaaa

SEQ ID NO: 279238 - DNA, 20 bp, Artificial Sequence
  Description of Artificial Sequence: Synthetic oligonucleotide
  Target: ATXN1; (+) strand; PAM type: YTN; PAM sequence: CTT
tgaaaatgctgcccttctat

SEQ ID NO: 279239 - DNA, 20 bp, Artificial Sequence
  Description of Artificial Sequence: Synthetic oligonucleotide
  Target: ATXN1; (+) strand; PAM type: YTN; PAM sequence: TTT
gaaaatgctgcccttctatg

SEQ ID NO: 279240 - DNA, 20 bp, Artificial Sequence
  Description of Artificial Sequence: Synthetic oligonucleotide
  Target: ATXN1; (+) strand; PAM type: YTN; PAM sequence: TTG
aaaatgctgcccttctatgc

SEQ ID NO: 279241 - DNA, 20 bp, Artificial Sequence
  Description of Artificial Sequence: Synthetic oligonucleotide
  Target: ATXN1; (+) strand; PAM type: YTN; PAM sequence: CTG
cccttctatgcttagaagca

SEQ ID NO: 279242 - DNA, 20 bp, Artificial Sequence
  Description of Artificial Sequence: Synthetic oligonucleotide
  Target: ATXN1; (+) strand; PAM type: YTN; PAM sequence: CTT
ctatgcttagaagcacttcc

SEQ ID NO: 279243 - DNA, 20 bp, Artificial Sequence
  Description of Artificial Sequence: Synthetic oligonucleotide
  Target: ATXN1; (+) strand; PAM type: YTN; PAM sequence: TTC
tatgcttagaagcacttccc

SEQ ID NO: 279244 - DNA, 20 bp, Artificial Sequence
  Description of Artificial Sequence: Synthetic oligonucleotide
  Target: ATXN1; (+) strand; PAM type: YTN; PAM sequence: CTA
tgcttagaagcacttcccaa

SEQ ID NO: 279245 - DNA, 20 bp, Artificial Sequence
  Description of Artificial Sequence: Synthetic oligonucleotide
  Target: ATXN1; (+) strand; PAM type: YTN; PAM sequence: CTT
agaagcacttcccaagaaca

SEQ ID NO: 279246 - DNA, 20 bp, Artificial Sequence
  Description of Artificial Sequence: Synthetic oligonucleotide
  Target: ATXN1; (+) strand; PAM type: YTN; PAM sequence: TTA
gaagcacttcccaagaacat

SEQ ID NO: 279247 - DNA, 20 bp, Artificial Sequence
  Description of Artificial Sequence: Synthetic oligonucleotide
  Target: ATXN1; (+) strand; PAM type: YTN; PAM sequence: CTT
cccaagaacatgcttcctgt

SEQ ID NO: 279248 - DNA, 20 bp, Artificial Sequence
  Description of Artificial Sequence: Synthetic oligonucleotide
  Target: ATXN1; (+) strand; PAM type: YTN; PAM sequence: TTC
ccaagaacatgcttcctgtt

SEQ ID NO: 279249 - DNA, 20 bp, Artificial Sequence
  Description of Artificial Sequence: Synthetic oligonucleotide
  Target: ATXN1; (+) strand; PAM type: YTN; PAM sequence: CTT
cctgtttattgtacataatc

SEQ ID NO: 279250 - DNA, 20 bp, Artificial Sequence
  Description of Artificial Sequence: Synthetic oligonucleotide
  Target: ATXN1; (+) strand; PAM type: YTN; PAM sequence: TTC
ctgtttattgtacataatcc

SEQ ID NO: 279251 - DNA, 20 bp, Artificial Sequence
  Description of Artificial Sequence: Synthetic oligonucleotide
  Target: ATXN1; (+) strand; PAM type: YTN; PAM sequence: CTG
tttattgtacataatccatc

SEQ ID NO: 279252 - DNA, 20 bp, Artificial Sequence
  Description of Artificial Sequence: Synthetic oligonucleotide
  Target: ATXN1; (+) strand; PAM type: YTN; PAM sequence: TTT
attgtacataatccatctca

SEQ ID NO: 279253 - DNA, 20 bp, Artificial Sequence
  Description of Artificial Sequence: Synthetic oligonucleotide
  Target: ATXN1; (+) strand; PAM type: YTN; PAM sequence: TTA
ttgtacataatccatctcaa

SEQ ID NO: 279254 - DNA, 20 bp, Artificial Sequence
  Description of Artificial Sequence: Synthetic oligonucleotide
  Target: ATXN1; (+) strand; PAM type: YTN; PAM sequence: TTG
tacataatccatctcaacca

SEQ ID NO: 279255 - DNA, 20 bp, Artificial Sequence
  Description of Artificial Sequence: Synthetic oligonucleotide
  Target: ATXN1; (+) strand; PAM type: YTN; PAM sequence: CTC
aaccatcatctcggaggtct

SEQ ID NO: 279256 - DNA, 20 bp, Artificial Sequence
  Description of Artificial Sequence: Synthetic oligonucleotide
  Target: ATXN1; (+) strand; PAM type: YTN; PAM sequence: CTC
ggaggtctttcctacaaaca

SEQ ID NO: 279257 - DNA, 20 bp, Artificial Sequence
  Description of Artificial Sequence: Synthetic oligonucleotide
  Target: ATXN1; (+) strand; PAM type: YTN; PAM sequence: CTT
tcctacaaacactccttcat

SEQ ID NO: 279258 - DNA, 20 bp, Artificial Sequence
  Description of Artificial Sequence: Synthetic oligonucleotide
  Target: ATXN1; (+) strand; PAM type: YTN; PAM sequence: TTT
cctacaaacactccttcatc

SEQ ID NO: 279259 - DNA, 20 bp, Artificial Sequence
  Description of Artificial Sequence: Synthetic oligonucleotide
  Target: ATXN1; (+) strand; PAM type: YTN; PAM sequence: TTC
ctacaaacactccttcatcc

SEQ ID NO: 279260 - DNA, 20 bp, Artificial Sequence
  Description of Artificial Sequence: Synthetic oligonucleotide
  Target: ATXN1; (+) strand; PAM type: YTN; PAM sequence: CTA
caaacactccttcatccttg

SEQ ID NO: 279261 - DNA, 20 bp, Artificial Sequence
  Description of Artificial Sequence: Synthetic oligonucleotide
  Target: ATXN1; (+) strand; PAM type: YTN; PAM sequence: CTC
cttcatccttggtcctgatg

SEQ ID NO: 279262 - DNA, 20 bp, Artificial Sequence
  Description of Artificial Sequence: Synthetic oligonucleotide
  Target: ATXN1; (+) strand; PAM type: YTN; PAM sequence: CTT
catccttggtcctgatgtga

SEQ ID NO: 279263 - DNA, 20 bp, Artificial Sequence
  Description of Artificial Sequence: Synthetic oligonucleotide
  Target: ATXN1; (+) strand; PAM type: YTN; PAM sequence: TTC
atccttggtcctgatgtgat

SEQ ID NO: 279264 - DNA, 20 bp, Artificial Sequence
  Description of Artificial Sequence: Synthetic oligonucleotide
  Target: ATXN1; (+) strand; PAM type: YTN; PAM sequence: CTT
ggtcctgatgtgatactctt

SEQ ID NO: 279265 - DNA, 20 bp, Artificial Sequence
  Description of Artificial Sequence: Synthetic oligonucleotide
  Target: ATXN1; (+) strand; PAM type: YTN; PAM sequence: TTG
gtcctgatgtgatactcttt

SEQ ID NO: 279266 - DNA, 20 bp, Artificial Sequence
  Description of Artificial Sequence: Synthetic oligonucleotide
  Target: ATXN1; (+) strand; PAM type: YTN; PAM sequence: CTG
atgtgatactctttccatcc

SEQ ID NO: 279267 - DNA, 20 bp, Artificial Sequence
  Description of Artificial Sequence: Synthetic oligonucleotide
  Target: ATXN1; (+) strand; PAM type: YTN; PAM sequence: CTC
tttccatcccttgcttcctg

SEQ ID NO: 279268 - DNA, 20 bp, Artificial Sequence
  Description of Artificial Sequence: Synthetic oligonucleotide
  Target: ATXN1; (+) strand; PAM type: YTN; PAM sequence: CTT
tccatcccttgcttcctgtg

SEQ ID NO: 279269 - DNA, 20 bp, Artificial Sequence
  Description of Artificial Sequence: Synthetic oligonucleotide
  Target: ATXN1; (+) strand; PAM type: YTN; PAM sequence: TTT
ccatcccttgcttcctgtgc

SEQ ID NO: 279270 - DNA, 20 bp, Artificial Sequence
  Description of Artificial Sequence: Synthetic oligonucleotide
  Target: ATXN1; (+) strand; PAM type: YTN; PAM sequence: TTC
catcccttgcttcctgtgct

SEQ ID NO: 279271 - DNA, 20 bp, Artificial Sequence
  Description of Artificial Sequence: Synthetic oligonucleotide
  Target: ATXN1; (+) strand; PAM type: YTN; PAM sequence: CTT
gcttcctgtgctccacttac

SEQ ID NO: 279272 - DNA, 20 bp, Artificial Sequence
  Description of Artificial Sequence: Synthetic oligonucleotide
  Target: ATXN1; (+) strand; PAM type: YTN; PAM sequence: TTG
cttcctgtgctccacttaca

SEQ ID NO: 279273 - DNA, 20 bp, Artificial Sequence
  Description of Artificial Sequence: Synthetic oligonucleotide
  Target: ATXN1; (+) strand; PAM type: YTN; PAM sequence: CTT
cctgtgctccacttacaaac

SEQ ID NO: 279274 - DNA, 20 bp, Artificial Sequence
  Description of Artificial Sequence: Synthetic oligonucleotide
  Target: ATXN1; (+) strand; PAM type: YTN; PAM sequence: TTC
ctgtgctccacttacaaaca

SEQ ID NO: 279275 - DNA, 20 bp, Artificial Sequence
  Description of Artificial Sequence: Synthetic oligonucleotide
  Target: ATXN1; (+) strand; PAM type: YTN; PAM sequence: CTG
tgctccacttacaaacactg

SEQ ID NO: 279276 - DNA, 20 bp, Artificial Sequence
  Description of Artificial Sequence: Synthetic oligonucleotide
  Target: ATXN1; (+) strand; PAM type: YTN; PAM sequence: CTC
cacttacaaacactgcctga

SEQ ID NO: 279277 - DNA, 20 bp, Artificial Sequence
  Description of Artificial Sequence: Synthetic oligonucleotide
  Target: ATXN1; (+) strand; PAM type: YTN; PAM sequence: CTT
acaaacactgcctgagcaac

SEQ ID NO: 279278 - DNA, 20 bp, Artificial Sequence
  Description of Artificial Sequence: Synthetic oligonucleotide
  Target: ATXN1; (+) strand; PAM type: YTN; PAM sequence: TTA
caaacactgcctgagcaact

SEQ ID NO: 279279 - DNA, 20 bp, Artificial Sequence
  Description of Artificial Sequence: Synthetic oligonucleotide
  Target: ATXN1; (+) strand; PAM type: YTN; PAM sequence: CTG
cctgagcaactgctctctac

SEQ ID NO: 279280 - DNA, 20 bp, Artificial Sequence
  Description of Artificial Sequence: Synthetic oligonucleotide
  Target: ATXN1; (+) strand; PAM type: YTN; PAM sequence: CTG
agcaactgctctctacaagc

SEQ ID NO: 279281 - DNA, 20 bp, Artificial Sequence
  Description of Artificial Sequence: Synthetic oligonucleotide
  Target: ATXN1; (+) strand; PAM type: YTN; PAM sequence: CTG
ctctctacaagccccatgtg

SEQ ID NO: 279282 - DNA, 20 bp, Artificial Sequence
  Description of Artificial Sequence: Synthetic oligonucleotide
  Target: ATXN1; (+) strand; PAM type: YTN; PAM sequence: CTC
tctacaagccccatgtgagg

SEQ ID NO: 279283 - DNA, 20 bp, Artificial Sequence
  Description of Artificial Sequence: Synthetic oligonucleotide
  Target: ATXN1; (+) strand; PAM type: YTN; PAM sequence: CTC
tacaagccccatgtgaggtg

SEQ ID NO: 279284 - DNA, 20 bp, Artificial Sequence
  Description of Artificial Sequence: Synthetic oligonucleotide
  Target: ATXN1; (+) strand; PAM type: YTN; PAM sequence: CTA
caagccccatgtgaggtgct

SEQ ID NO: 279285 - DNA, 20 bp, Artificial Sequence
  Description of Artificial Sequence: Synthetic oligonucleotide
  Target: ATXN1; (+) strand; PAM type: YTN; PAM sequence: CTA
gatgtacaacatctcataag

SEQ ID NO: 279286 - DNA, 20 bp, Artificial Sequence
  Description of Artificial Sequence: Synthetic oligonucleotide
  Target: ATXN1; (+) strand; PAM type: YTN; PAM sequence: CTC
ataagtacatacaaaagccg

SEQ ID NO: 279287 - DNA, 20 bp, Artificial Sequence
  Description of Artificial Sequence: Synthetic oligonucleotide
  Target: ATXN1; (+) strand; PAM type: YTN; PAM sequence: CTG
taggcattacttgcagatga

SEQ ID NO: 279288 - DNA, 20 bp, Artificial Sequence
  Description of Artificial Sequence: Synthetic oligonucleotide
  Target: ATXN1; (+) strand; PAM type: YTN; PAM sequence: TTA
cttgcagatgacaaactagg

SEQ ID NO: 279289 - DNA, 20 bp, Artificial Sequence
  Description of Artificial Sequence: Synthetic oligonucleotide
  Target: ATXN1; (+) strand; PAM type: YTN; PAM sequence: CTT
gcagatgacaaactaggctc

SEQ ID NO: 279290 - DNA, 20 bp, Artificial Sequence
  Description of Artificial Sequence: Synthetic oligonucleotide
  Target: ATXN1; (+) strand; PAM type: YTN; PAM sequence: TTG
cagatgacaaactaggctca

SEQ ID NO: 279291 - DNA, 20 bp, Artificial Sequence
  Description of Artificial Sequence: Synthetic oligonucleotide
  Target: ATXN1; (+) strand; PAM type: YTN; PAM sequence: CTA
ggctcagaaaagttcagtag

SEQ ID NO: 279292 - DNA, 20 bp, Artificial Sequence
  Description of Artificial Sequence: Synthetic oligonucleotide
  Target: ATXN1; (+) strand; PAM type: YTN; PAM sequence: CTC
agaaaagttcagtagcttgg

SEQ ID NO: 279293 - DNA, 20 bp, Artificial Sequence
  Description of Artificial Sequence: Synthetic oligonucleotide
  Target: ATXN1; (+) strand; PAM type: YTN; PAM sequence: TTC
agtagcttggtcaagttcac

SEQ ID NO: 279294 - DNA, 20 bp, Artificial Sequence
  Description of Artificial Sequence: Synthetic oligonucleotide
  Target: ATXN1; (+) strand; PAM type: YTN; PAM sequence: CTT
ggtcaagttcacacagccag

SEQ ID NO: 279295 - DNA, 20 bp, Artificial Sequence
  Description of Artificial Sequence: Synthetic oligonucleotide
  Target: ATXN1; (+) strand; PAM type: YTN; PAM sequence: TTG
gtcaagttcacacagccagt

SEQ ID NO: 279296 - DNA, 20 bp, Artificial Sequence
  Description of Artificial Sequence: Synthetic oligonucleotide
  Target: ATXN1; (+) strand; PAM type: YTN; PAM sequence: TTC
acacagccagtgagctccat

SEQ ID NO: 279297 - DNA, 20 bp, Artificial Sequence
  Description of Artificial Sequence: Synthetic oligonucleotide
  Target: ATXN1; (+) strand; PAM type: YTN; PAM sequence: CTC
catgcttttggctctgaggc

SEQ ID NO: 279298 - DNA, 20 bp, Artificial Sequence
  Description of Artificial Sequence: Synthetic oligonucleotide
  Target: ATXN1; (+) strand; PAM type: YTN; PAM sequence: CTT
ttggctctgaggccctggtt

SEQ ID NO: 279299 - DNA, 20 bp, Artificial Sequence
  Description of Artificial Sequence: Synthetic oligonucleotide
  Target: ATXN1; (+) strand; PAM type: YTN; PAM sequence: TTT
tggctctgaggccctggttg

SEQ ID NO: 279300 - DNA, 20 bp, Artificial Sequence
  Description of Artificial Sequence: Synthetic oligonucleotide
  Target: ATXN1; (+) strand; PAM type: YTN; PAM sequence: TTT
ggctctgaggccctggttgg

SEQ ID NO: 279301 - DNA, 20 bp, Artificial Sequence
  Description of Artificial Sequence: Synthetic oligonucleotide
  Target: ATXN1; (+) strand; PAM type: YTN; PAM sequence: TTG
gctctgaggccctggttggc

SEQ ID NO: 279302 - DNA, 20 bp, Artificial Sequence
  Description of Artificial Sequence: Synthetic oligonucleotide
  Target: ATXN1; (+) strand; PAM type: YTN; PAM sequence: CTC
tgaggccctggttggcttct

SEQ ID NO: 279303 - DNA, 20 bp, Artificial Sequence
  Description of Artificial Sequence: Synthetic oligonucleotide
  Target: ATXN1; (+) strand; PAM type: YTN; PAM sequence: CTG
aggccctggttggcttctcc

SEQ ID NO: 279304 - DNA, 20 bp, Artificial Sequence
  Description of Artificial Sequence: Synthetic oligonucleotide
  Target: ATXN1; (+) strand; PAM type: YTN; PAM sequence: CTG
gttggcttctcctaaacaca

SEQ ID NO: 279305 - DNA, 20 bp, Artificial Sequence
  Description of Artificial Sequence: Synthetic oligonucleotide
  Target: ATXN1; (+) strand; PAM type: YTN; PAM sequence: TTG
gcttctcctaaacacaccac

SEQ ID NO: 279306 - DNA, 20 bp, Artificial Sequence
  Description of Artificial Sequence: Synthetic oligonucleotide
  Target: ATXN1; (+) strand; PAM type: YTN; PAM sequence: CTT
ctcctaaacacaccacctaa

SEQ ID NO: 279307 - DNA, 20 bp, Artificial Sequence
  Description of Artificial Sequence: Synthetic oligonucleotide
  Target: ATXN1; (+) strand; PAM type: YTN; PAM sequence: TTC
tcctaaacacaccacctaac

SEQ ID NO: 279308 - DNA, 20 bp, Artificial Sequence
  Description of Artificial Sequence: Synthetic oligonucleotide
  Target: ATXN1; (+) strand; PAM type: YTN; PAM sequence: CTC
ctaaacacaccacctaacaa

SEQ ID NO: 279309 - DNA, 20 bp, Artificial Sequence
  Description of Artificial Sequence: Synthetic oligonucleotide
  Target: ATXN1; (+) strand; PAM type: YTN; PAM sequence: CTA
aacacaccacctaacaatgc

SEQ ID NO: 279310 - DNA, 20 bp, Artificial Sequence
  Description of Artificial Sequence: Synthetic oligonucleotide
  Target: ATXN1; (+) strand; PAM type: YTN; PAM sequence: CTA
acaatgctaccatatgtcaa

SEQ ID NO: 279311 - DNA, 20 bp, Artificial Sequence
  Description of Artificial Sequence: Synthetic oligonucleotide
  Target: ATXN1; (+) strand; PAM type: YTN; PAM sequence: CTA
ccatatgtcaaactcaacac

SEQ ID NO: 279312 - DNA, 20 bp, Artificial Sequence
  Description of Artificial Sequence: Synthetic oligonucleotide
  Target: ATXN1; (+) strand; PAM type: YTN; PAM sequence: CTC
aacactaaggcagactcgcc

SEQ ID NO: 279313 - DNA, 20 bp, Artificial Sequence
  Description of Artificial Sequence: Synthetic oligonucleotide
  Target: ATXN1; (+) strand; PAM type: YTN; PAM sequence: CTA
aggcagactcgcctaagaca

SEQ ID NO: 279314 - DNA, 20 bp, Artificial Sequence
  Description of Artificial Sequence: Synthetic oligonucleotide
  Target: ATXN1; (+) strand; PAM type: YTN; PAM sequence: CTC
gcctaagacacccacccaga

SEQ ID NO: 279315 - DNA, 20 bp, Artificial Sequence
  Description of Artificial Sequence: Synthetic oligonucleotide
  Target: ATXN1; (+) strand; PAM type: YTN; PAM sequence: CTA
agacacccacccagagccca

SEQ ID NO: 279316 - DNA, 20 bp, Artificial Sequence
  Description of Artificial Sequence: Synthetic oligonucleotide
  Target: ATXN1; (+) strand; PAM type: YTN; PAM sequence: TTC
ctacaatcggaaaatcacat

SEQ ID NO: 279317 - DNA, 20 bp, Artificial Sequence
  Description of Artificial Sequence: Synthetic oligonucleotide
  Target: ATXN1; (+) strand; PAM type: YTN; PAM sequence: CTA
caatcggaaaatcacataaa

SEQ ID NO: 279318 - DNA, 20 bp, Artificial Sequence
  Description of Artificial Sequence: Synthetic oligonucleotide
  Target: ATXN1; (+) strand; PAM type: YTN; PAM sequence: TTT
tgacatgagaccggctgtca

SEQ ID NO: 279319 - DNA, 20 bp, Artificial Sequence
  Description of Artificial Sequence: Synthetic oligonucleotide
  Target: ATXN1; (+) strand; PAM type: YTN; PAM sequence: TTT
gacatgagaccggctgtcaa

SEQ ID NO: 279320 - DNA, 20 bp, Artificial Sequence
  Description of Artificial Sequence: Synthetic oligonucleotide
  Target: ATXN1; (+) strand; PAM type: YTN; PAM sequence: TTG
acatgagaccggctgtcaaa

SEQ ID NO: 279321 - DNA, 20 bp, Artificial Sequence
  Description of Artificial Sequence: Synthetic oligonucleotide
  Target: ATXN1; (+) strand; PAM type: YTN; PAM sequence: CTG
tcaaatagacacctctgcag

SEQ ID NO: 279322 - DNA, 20 bp, Artificial Sequence
  Description of Artificial Sequence: Synthetic oligonucleotide
  Target: ATXN1; (+) strand; PAM type: YTN; PAM sequence: CTC
tgcaggccaggggtgtgtgt

SEQ ID NO: 279323 - DNA, 20 bp, Artificial Sequence
  Description of Artificial Sequence: Synthetic oligonucleotide
  Target: ATXN1; (+) strand; PAM type: YTN; PAM sequence: CTG
caggccaggggtgtgtgtgt

SEQ ID NO: 279324 - DNA, 20 bp, Artificial Sequence
  Description of Artificial Sequence: Synthetic oligonucleotide
  Target: ATXN1; (+) strand; PAM type: YTN; PAM sequence: CTA
aaaccaactgggtggccaca

SEQ ID NO: 279325 - DNA, 20 bp, Artificial Sequence
  Description of Artificial Sequence: Synthetic oligonucleotide
  Target: ATXN1; (+) strand; PAM type: YTN; PAM sequence: CTG
ggtggccacattgttctgca

SEQ ID NO: 279326 - DNA, 20 bp, Artificial Sequence
  Description of Artificial Sequence: Synthetic oligonucleotide
  Target: ATXN1; (+) strand; PAM type: YTN; PAM sequence: TTG
ttctgcagtctgtttgcctt

SEQ ID NO: 279327 - DNA, 20 bp, Artificial Sequence
  Description of Artificial Sequence: Synthetic oligonucleotide
  Target: ATXN1; (+) strand; PAM type: YTN; PAM sequence: TTC
tgcagtctgtttgccttcca

SEQ ID NO: 279328 - DNA, 20 bp, Artificial Sequence
  Description of Artificial Sequence: Synthetic oligonucleotide
  Target: ATXN1; (+) strand; PAM type: YTN; PAM sequence: CTG
cagtctgtttgccttccagt

SEQ ID NO: 279329 - DNA, 20 bp, Artificial Sequence
  Description of Artificial Sequence: Synthetic oligonucleotide
  Target: ATXN1; (+) strand; PAM type: YTN; PAM sequence: CTG
tttgccttccagtgctttct

SEQ ID NO: 279330 - DNA, 20 bp, Artificial Sequence
  Description of Artificial Sequence: Synthetic oligonucleotide
  Target: ATXN1; (+) strand; PAM type: YTN; PAM sequence: TTT
gccttccagtgctttctttc

SEQ ID NO: 279331 - DNA, 20 bp, Artificial Sequence
  Description of Artificial Sequence: Synthetic oligonucleotide
  Target: ATXN1; (+) strand; PAM type: YTN; PAM sequence: TTG
ccttccagtgctttctttcc

SEQ ID NO: 279332 - DNA, 20 bp, Artificial Sequence
  Description of Artificial Sequence: Synthetic oligonucleotide
  Target: ATXN1; (+) strand; PAM type: YTN; PAM sequence: CTT
ccagtgctttctttcctgcc

SEQ ID NO: 279333 - DNA, 20 bp, Artificial Sequence
  Description of Artificial Sequence: Synthetic oligonucleotide
  Target: ATXN1; (+) strand; PAM type: YTN; PAM sequence: TTC
cagtgctttctttcctgcct

SEQ ID NO: 279334 - DNA, 20 bp, Artificial Sequence
  Description of Artificial Sequence: Synthetic oligonucleotide
  Target: ATXN1; (+) strand; PAM type: YTN; PAM sequence: CTT
tctttcctgcctgtcatgca

SEQ ID NO: 279335 - DNA, 20 bp, Artificial Sequence
  Description of Artificial Sequence: Synthetic oligonucleotide
  Target: ATXN1; (+) strand; PAM type: YTN; PAM sequence: TTT
ctttcctgcctgtcatgcag

SEQ ID NO: 279336 - DNA, 20 bp, Artificial Sequence
  Description of Artificial Sequence: Synthetic oligonucleotide
  Target: ATXN1; (+) strand; PAM type: YTN; PAM sequence: TTC
tttcctgcctgtcatgcaga

SEQ ID NO: 279337 - DNA, 20 bp, Artificial Sequence
  Description of Artificial Sequence: Synthetic oligonucleotide
  Target: ATXN1; (+) strand; PAM type: YTN; PAM sequence: CTT
tcctgcctgtcatgcagata

SEQ ID NO: 279338 - DNA, 20 bp, Artificial Sequence
  Description of Artificial Sequence: Synthetic oligonucleotide
  Target: ATXN1; (+) strand; PAM type: YTN; PAM sequence: TTT
cctgcctgtcatgcagataa

SEQ ID NO: 279339 - DNA, 20 bp, Artificial Sequence
  Description of Artificial Sequence: Synthetic oligonucleotide
  Target: ATXN1; (+) strand; PAM type: YTN; PAM sequence: TTC
ctgcctgtcatgcagataat

SEQ ID NO: 279340 - DNA, 20 bp, Artificial Sequence
  Description of Artificial Sequence: Synthetic oligonucleotide
  Target: ATXN1; (+) strand; PAM type: YTN; PAM sequence: CTG
cctgtcatgcagataattgt

SEQ ID NO: 279341 - DNA, 20 bp, Artificial Sequence
  Description of Artificial Sequence: Synthetic oligonucleotide
  Target: ATXN1; (+) strand; PAM type: YTN; PAM sequence: CTG
tcatgcagataattgtgtag

SEQ ID NO: 279342 - DNA, 20 bp, Artificial Sequence
  Description of Artificial Sequence: Synthetic oligonucleotide
  Target: ATXN1; (+) strand; PAM type: YTN; PAM sequence: TTG
tgtagtgtgtcccaagcaac

SEQ ID NO: 279343 - DNA, 20 bp, Artificial Sequence
  Description of Artificial Sequence: Synthetic oligonucleotide
  Target: ATXN1; (+) strand; PAM type: YTN; PAM sequence: TTT
ccctaatttatggagtcagc

SEQ ID NO: 279344 - DNA, 20 bp, Artificial Sequence
  Description of Artificial Sequence: Synthetic oligonucleotide
  Target: ATXN1; (+) strand; PAM type: YTN; PAM sequence: TTC
cctaatttatggagtcagcc

SEQ ID NO: 279345 - DNA, 20 bp, Artificial Sequence
  Description of Artificial Sequence: Synthetic oligonucleotide
  Target: ATXN1; (+) strand; PAM type: YTN; PAM sequence: CTA
atttatggagtcagcctaaa

SEQ ID NO: 279346 - DNA, 20 bp, Artificial Sequence
  Description of Artificial Sequence: Synthetic oligonucleotide
  Target: ATXN1; (+) strand; PAM type: YTN; PAM sequence: TTT
atggagtcagcctaaactcc

SEQ ID NO: 279347 - DNA, 20 bp, Artificial Sequence
  Description of Artificial Sequence: Synthetic oligonucleotide
  Target: ATXN1; (+) strand; PAM type: YTN; PAM sequence: TTA
tggagtcagcctaaactcct

SEQ ID NO: 279348 - DNA, 20 bp, Artificial Sequence
  Description of Artificial Sequence: Synthetic oligonucleotide
  Target: ATXN1; (+) strand; PAM type: YTN; PAM sequence: CTA
aactccttttgtttatgacc

SEQ ID NO: 279349 - DNA, 20 bp, Artificial Sequence
  Description of Artificial Sequence: Synthetic oligonucleotide
  Target: ATXN1; (+) strand; PAM type: YTN; PAM sequence: CTC
cttttgtttatgaccacaac

SEQ ID NO: 279350 - DNA, 20 bp, Artificial Sequence
  Description of Artificial Sequence: Synthetic oligonucleotide
  Target: ATXN1; (+) strand; PAM type: YTN; PAM sequence: CTT
ttgtttatgaccacaacaca

SEQ ID NO: 279351 - DNA, 20 bp, Artificial Sequence
  Description of Artificial Sequence: Synthetic oligonucleotide
  Target: ATXN1; (+) strand; PAM type: YTN; PAM sequence: TTT
tgtttatgaccacaacacac

SEQ ID NO: 279352 - DNA, 20 bp, Artificial Sequence
  Description of Artificial Sequence: Synthetic oligonucleotide
  Target: ATXN1; (+) strand; PAM type: YTN; PAM sequence: TTT
gtttatgaccacaacacact

SEQ ID NO: 279353 - DNA, 20 bp, Artificial Sequence
  Description of Artificial Sequence: Synthetic oligonucleotide
  Target: ATXN1; (+) strand; PAM type: YTN; PAM sequence: TTG
tttatgaccacaacacacta

SEQ ID NO: 279354 - DNA, 20 bp, Artificial Sequence
  Description of Artificial Sequence: Synthetic oligonucleotide
  Target: ATXN1; (+) strand; PAM type: YTN; PAM sequence: TTT
atgaccacaacacactaact

SEQ ID NO: 279355 - DNA, 20 bp, Artificial Sequence
  Description of Artificial Sequence: Synthetic oligonucleotide
  Target: ATXN1; (+) strand; PAM type: YTN; PAM sequence: TTA
tgaccacaacacactaactc

SEQ ID NO: 279356 - DNA, 20 bp, Artificial Sequence
  Description of Artificial Sequence: Synthetic oligonucleotide
  Target: ATXN1; (+) strand; PAM type: YTN; PAM sequence: CTA
actctgtatgttagatgttt

SEQ ID NO: 279357 - DNA, 20 bp, Artificial Sequence
  Description of Artificial Sequence: Synthetic oligonucleotide
  Target: ATXN1; (+) strand; PAM type: YTN; PAM sequence: CTC
tgtatgttagatgtttccaa

SEQ ID NO: 279358 - DNA, 20 bp, Artificial Sequence
  Description of Artificial Sequence: Synthetic oligonucleotide
  Target: ATXN1; (+) strand; PAM type: YTN; PAM sequence: CTG
tatgttagatgtttccaaca

SEQ ID NO: 279359 - DNA, 20 bp, Artificial Sequence
  Description of Artificial Sequence: Synthetic oligonucleotide
  Target: ATXN1; (+) strand; PAM type: YTN; PAM sequence: TTA
gatgtttccaacaagcatca

SEQ ID NO: 279360 - DNA, 20 bp, Artificial Sequence
  Description of Artificial Sequence: Synthetic oligonucleotide
  Target: ATXN1; (+) strand; PAM type: YTN; PAM sequence: TTT
ccaacaagcatcaaagcctc

SEQ ID NO: 279361 - DNA, 20 bp, Artificial Sequence
  Description of Artificial Sequence: Synthetic oligonucleotide
  Target: ATXN1; (+) strand; PAM type: YTN; PAM sequence: TTC
caacaagcatcaaagcctca

SEQ ID NO: 279362 - DNA, 20 bp, Artificial Sequence
  Description of Artificial Sequence: Synthetic oligonucleotide
  Target: ATXN1; (+) strand; PAM type: YTN; PAM sequence: CTC
aattgttactgtcttttgtt

SEQ ID NO: 279363 - DNA, 20 bp, Artificial Sequence
  Description of Artificial Sequence: Synthetic oligonucleotide
  Target: ATXN1; (+) strand; PAM type: YTN; PAM sequence: TTG
ttactgtcttttgttttgtt

SEQ ID NO: 279364 - DNA, 20 bp, Artificial Sequence
  Description of Artificial Sequence: Synthetic oligonucleotide
  Target: ATXN1; (+) strand; PAM type: YTN; PAM sequence: TTA
ctgtcttttgttttgttttc

SEQ ID NO: 279365 - DNA, 20 bp, Artificial Sequence
  Description of Artificial Sequence: Synthetic oligonucleotide
  Target: ATXN1; (+) strand; PAM type: YTN; PAM sequence: CTG
tcttttgttttgttttccag

SEQ ID NO: 279366 - DNA, 20 bp, Artificial Sequence
  Description of Artificial Sequence: Synthetic oligonucleotide
  Target: ATXN1; (+) strand; PAM type: YTN; PAM sequence: CTT
ttgttttgttttccagttct

SEQ ID NO: 279367 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttccagttctg

SEQ ID NO: 279368 - DNA, 20 bp, Artificial Sequence
  Description of Artificial Sequence: Synthetic oligonucleotide
  Target: ATXN1; (+) strand; PAM type: YTN; PAM sequence: TTT
gttttgttttccagttctgc

SEQ ID NO: 279369 - DNA, 20 bp, Artificial Sequence
  Description of Artificial Sequence: Synthetic oligonucleotide
  Target: ATXN1; (+) strand; PAM type: YTN; PAM sequence: TTG
ttttgttttccagttctgct

SEQ ID NO: 279370 - DNA, 20 bp, Artificial Sequence
  Description of Artificial Sequence: Synthetic oligonucleotide
  Target: ATXN1; (+) strand; PAM type: YTN; PAM sequence: TTT
tgttttccagttctgctaat

SEQ ID NO: 279371 - DNA, 20 bp, Artificial Sequence
  Description of Artificial Sequence: Synthetic oligonucleotide
  Target: ATXN1; (+) strand; PAM type: YTN; PAM sequence: TTT
gttttccagttctgctaatg

SEQ ID NO: 279372 - DNA, 20 bp, Artificial Sequence
  Description of Artificial Sequence: Synthetic oligonucleotide
  Target: ATXN1; (+) strand; PAM type: YTN; PAM sequence: TTG
ttttccagttctgctaatgc

SEQ ID NO: 279373 - DNA, 20 bp, Artificial Sequence
  Description of Artificial Sequence: Synthetic oligonucleotide
  Target: ATXN1; (+) strand; PAM type: YTN; PAM sequence: TTT
tccagttctgctaatgcaag

SEQ ID NO: 279374 - DNA, 20 bp, Artificial Sequence
  Description of Artificial Sequence: Synthetic oligonucleotide
  Target: ATXN1; (+) strand; PAM type: YTN; PAM sequence: TTT
ccagttctgctaatgcaagg

SEQ ID NO: 279375 - DNA, 20 bp, Artificial Sequence
  Description of Artificial Sequence: Synthetic oligonucleotide
  Target: ATXN1; (+) strand; PAM type: YTN; PAM sequence: TTC
cagttctgctaatgcaaggg

SEQ ID NO: 279376 - DNA, 20 bp, Artificial Sequence
  Description of Artificial Sequence: Synthetic oligonucleotide
  Target: ATXN1; (+) strand; PAM type: YTN; PAM sequence: TTC
tgctaatgcaagggacagcc

SEQ ID NO: 279377 - DNA, 20 bp, Artificial Sequence
  Description of Artificial Sequence: Synthetic oligonucleotide
  Target: ATXN1; (+) strand; PAM type: YTN; PAM sequence: CTG
ctaatgcaagggacagcctg

SEQ ID NO: 279378 - DNA, 20 bp, Artificial Sequence
  Description of Artificial Sequence: Synthetic oligonucleotide
  Target: ATXN1; (+) strand; PAM type: YTN; PAM sequence: CTA
atgcaagggacagcctgtcc

SEQ ID NO: 279379 - DNA, 20 bp, Artificial Sequence
  Description of Artificial Sequence: Synthetic oligonucleotide
  Target: ATXN1; (+) strand; PAM type: YTN; PAM sequence: CTG
tcctggtatttattactaga

SEQ ID NO: 279380 - DNA, 20 bp, Artificial Sequence
  Description of Artificial Sequence: Synthetic oligonucleotide
  Target: ATXN1; (+) strand; PAM type: YTN; PAM sequence: CTG
gtatttattactagagtaat

SEQ ID NO: 279381 - DNA, 20 bp, Artificial Sequence
  Description of Artificial Sequence: Synthetic oligonucleotide
  Target: ATXN1; (+) strand; PAM type: YTN; PAM sequence: TTT
attactagagtaatgtcagg

SEQ ID NO: 279382 - DNA, 20 bp, Artificial Sequence
  Description of Artificial Sequence: Synthetic oligonucleotide
  Target: ATXN1; (+) strand; PAM type: YTN; PAM sequence: TTA
ttactagagtaatgtcaggt

SEQ ID NO: 279383 - DNA, 20 bp, Artificial Sequence
  Description of Artificial Sequence: Synthetic oligonucleotide
  Target: ATXN1; (+) strand; PAM type: YTN; PAM sequence: TTA
ctagagtaatgtcaggtttg

SEQ ID NO: 279384 - DNA, 20 bp, Artificial Sequence
  Description of Artificial Sequence: Synthetic oligonucleotide
  Target: ATXN1; (+) strand; PAM type: YTN; PAM sequence: CTA
gagtaatgtcaggtttgggg

SEQ ID NO: 279385 - DNA, 20 bp, Artificial Sequence
  Description of Artificial Sequence: Synthetic oligonucleotide
  Target: ATXN1; (+) strand; PAM type: YTN; PAM sequence: TTT
ggggttagctcataaaatac

SEQ ID NO: 279386 - DNA, 20 bp, Artificial Sequence
  Description of Artificial Sequence: Synthetic oligonucleotide
  Target: ATXN1; (+) strand; PAM type: YTN; PAM sequence: TTG
gggttagctcataaaatacc

SEQ ID NO: 279387 - DNA, 20 bp, Artificial Sequence
  Description of Artificial Sequence: Synthetic oligonucleotide
  Target: ATXN1; (+) strand; PAM type: YTN; PAM sequence: TTA
gctcataaaatacctctcta

SEQ ID NO: 279388 - DNA, 20 bp, Artificial Sequence
  Description of Artificial Sequence: Synthetic oligonucleotide
  Target: ATXN1; (+) strand; PAM type: YTN; PAM sequence: CTC
ataaaatacctctctagttt

SEQ ID NO: 279389 - DNA, 20 bp, Artificial Sequence
  Description of Artificial Sequence: Synthetic oligonucleotide
  Target: ATXN1; (+) strand; PAM type: YTN; PAM sequence: CTC
tctagtttggctttctttgc

SEQ ID NO: 279390 - DNA, 20 bp, Artificial Sequence
  Description of Artificial Sequence: Synthetic oligonucleotide
  Target: ATXN1; (+) strand; PAM type: YTN; PAM sequence: CTC
tagtttggctttctttgcaa

SEQ ID NO: 279391 - DNA, 20 bp, Artificial Sequence
  Description of Artificial Sequence: Synthetic oligonucleotide
  Target: ATXN1; (+) strand; PAM type: YTN; PAM sequence: CTA
gtttggctttctttgcaaga

SEQ ID NO: 279392 - DNA, 20 bp, Artificial Sequence
  Description of Artificial Sequence: Synthetic oligonucleotide
  Target: ATXN1; (+) strand; PAM type: YTN; PAM sequence: TTT
ggctttctttgcaagagatc

SEQ ID NO: 279393 - DNA, 20 bp, Artificial Sequence
  Description of Artificial Sequence: Synthetic oligonucleotide
  Target: ATXN1; (+) strand; PAM type: YTN; PAM sequence: TTG
gctttctttgcaagagatca

SEQ ID NO: 279394 - DNA, 20 bp, Artificial Sequence
  Description of Artificial Sequence: Synthetic oligonucleotide
  Target: ATXN1; (+) strand; PAM type: YTN; PAM sequence: CTT
tctttgcaagagatcaaaac

SEQ ID NO: 279395 - DNA, 20 bp, Artificial Sequence
  Description of Artificial Sequence: Synthetic oligonucleotide
  Target: ATXN1; (+) strand; PAM type: YTN; PAM sequence: TTT
ctttgcaagagatcaaaaca

SEQ ID NO: 279396 - DNA, 20 bp, Artificial Sequence
  Description of Artificial Sequence: Synthetic oligonucleotide
  Target: ATXN1; (+) strand; PAM type: YTN; PAM sequence: TTC
tttgcaagagatcaaaacat

SEQ ID NO: 279397 - DNA, 20 bp, Artificial Sequence
  Description of Artificial Sequence: Synthetic oligonucleotide
  Target: ATXN1; (+) strand; PAM type: YTN; PAM sequence: CTT
tgcaagagatcaaaacattc

SEQ ID NO: 279398 - DNA, 20 bp, Artificial Sequence
  Description of Artificial Sequence: Synthetic oligonucleotide
  Target: ATXN1; (+) strand; PAM type: YTN; PAM sequence: TTT
gcaagagatcaaaacattct

SEQ ID NO: 279399 - DNA, 20 bp, Artificial Sequence
  Description of Artificial Sequence: Synthetic oligonucleotide
  Target: ATXN1; (+) strand; PAM type: YTN; PAM sequence: TTG
caagagatcaaaacattctt

SEQ ID NO: 279400 - DNA, 20 bp, Artificial Sequence
  Description of Artificial Sequence: Synthetic oligonucleotide
  Target: ATXN1; (+) strand; PAM type: YTN; PAM sequence: TTC
ttttttctttaatggcacca

SEQ ID NO: 279401 - DNA, 20 bp, Artificial Sequence
  Description of Artificial Sequence: Synthetic oligonucleotide
  Target: ATXN1; (+) strand; PAM type: YTN; PAM sequence: CTT
ttttctttaatggcaccatc

SEQ ID NO: 279402 - DNA, 20 bp, Artificial Sequence
  Description of Artificial Sequence: Synthetic oligonucleotide
  Target: ATXN1; (+) strand; PAM type: YTN; PAM sequence: TTT
tttctttaatggcaccatca

SEQ ID NO: 279403 - DNA, 20 bp, Artificial Sequence
  Description of Artificial Sequence: Synthetic oligonucleotide
  Target: ATXN1; (+) strand; PAM type: YTN; PAM sequence: TTT
ttctttaatggcaccatcaa

SEQ ID NO: 279404 - DNA, 20 bp, Artificial Sequence
  Description of Artificial Sequence: Synthetic oligonucleotide
  Target: ATXN1; (+) strand; PAM type: YTN; PAM sequence: TTT
tctttaatggcaccatcaaa

SEQ ID NO: 279405 - DNA, 20 bp, Artificial Sequence
  Description of Artificial Sequence: Synthetic oligonucleotide
  Target: ATXN1; (+) strand; PAM type: YTN; PAM sequence: TTT
ctttaatggcaccatcaaaa

SEQ ID NO: 279406 - DNA, 20 bp, Artificial Sequence
  Description of Artificial Sequence: Synthetic oligonucleotide
  Target: ATXN1; (+) strand; PAM type: YTN; PAM sequence: TTC
tttaatggcaccatcaaaaa

SEQ ID NO: 279407 - DNA, 20 bp, Artificial Sequence
  Description of Artificial Sequence: Synthetic oligonucleotide
  Target: ATXN1; (+) strand; PAM type: YTN; PAM sequence: CTT
taatggcaccatcaaaaaga

SEQ ID NO: 279408 - DNA, 20 bp, Artificial Sequence
  Description of Artificial Sequence: Synthetic oligonucleotide
  Target: ATXN1; (+) strand; PAM type: YTN; PAM sequence: TTT
aatggcaccatcaaaaagaa

SEQ ID NO: 279409 - DNA, 20 bp, Artificial Sequence
  Description of Artificial Sequence: Synthetic oligonucleotide
  Target: ATXN1; (+) strand; PAM type: YTN; PAM sequence: TTA
atggcaccatcaaaaagaat

SEQ ID NO: 279410 - DNA, 20 bp, Artificial Sequence
  Description of Artificial Sequence: Synthetic oligonucleotide
  Target: ATXN1; (+) strand; PAM type: YTN; PAM sequence: TTT
caataggcattctttttcct

SEQ ID NO: 279411 - DNA, 20 bp, Artificial Sequence
  Description of Artificial Sequence: Synthetic oligonucleotide
  Target: ATXN1; (+) strand; PAM type: YTN; PAM sequence: TTC
aataggcattctttttcctc

SEQ ID NO: 279412 - DNA, 20 bp, Artificial Sequence
  Description of Artificial Sequence: Synthetic oligonucleotide
  Target: ATXN1; (+) strand; PAM type: YTN; PAM sequence: TTC
tttttcctcttgtggtttct

SEQ ID NO: 279413 - DNA, 20 bp, Artificial Sequence
  Description of Artificial Sequence: Synthetic oligonucleotide
  Target: ATXN1; (+) strand; PAM type: YTN; PAM sequence: CTT
tttcctcttgtggtttctca

SEQ ID NO: 279414 - DNA, 20 bp, Artificial Sequence
  Description of Artificial Sequence: Synthetic oligonucleotide
  Target: ATXN1; (+) strand; PAM type: YTN; PAM sequence: TTT
ttcctcttgtggtttctcag

SEQ ID NO: 279415 - DNA, 20 bp, Artificial Sequence
  Description of Artificial Sequence: Synthetic oligonucleotide
  Target: ATXN1; (+) strand; PAM type: YTN; PAM sequence: TTT
tcctcttgtggtttctcagt

SEQ ID NO: 279416 - DNA, 20 bp, Artificial Sequence
  Description of Artificial Sequence: Synthetic oligonucleotide
  Target: ATXN1; (+) strand; PAM type: YTN; PAM sequence: TTT
cctcttgtggtttctcagta

SEQ ID NO: 279417 - DNA, 20 bp, Artificial Sequence
  Description of Artificial Sequence: Synthetic oligonucleotide
  Target: ATXN1; (+) strand; PAM type: YTN; PAM sequence: TTC
ctcttgtggtttctcagtat

SEQ ID NO: 279418 - DNA, 20 bp, Artificial Sequence
  Description of Artificial Sequence: Synthetic oligonucleotide
  Target: ATXN1; (+) strand; PAM type: YTN; PAM sequence: CTC
ttgtggtttctcagtatttg

SEQ ID NO: 279419 - DNA, 20 bp, Artificial Sequence
  Description of Artificial Sequence: Synthetic oligonucleotide
  Target: ATXN1; (+) strand; PAM type: YTN; PAM sequence: CTT
gtggtttctcagtatttgga

SEQ ID NO: 279420 - DNA, 20 bp, Artificial Sequence
  Description of Artificial Sequence: Synthetic oligonucleotide
  Target: ATXN1; (+) strand; PAM type: YTN; PAM sequence: TTG
tggtttctcagtatttggaa

SEQ ID NO: 279421 - DNA, 20 bp, Artificial Sequence
  Description of Artificial Sequence: Synthetic oligonucleotide
  Target: ATXN1; (+) strand; PAM type: YTN; PAM sequence: TTT
ctcagtatttggaactctgt

SEQ ID NO: 279422 - DNA, 20 bp, Artificial Sequence
  Description of Artificial Sequence: Synthetic oligonucleotide
  Target: ATXN1; (+) strand; PAM type: YTN; PAM sequence: TTC
tcagtatttggaactctgta

SEQ ID NO: 279423 - DNA, 20 bp, Artificial Sequence
  Description of Artificial Sequence: Synthetic oligonucleotide
  Target: ATXN1; (+) strand; PAM type: YTN; PAM sequence: CTC
agtatttggaactctgtatt

SEQ ID NO: 279424 - DNA, 20 bp, Artificial Sequence
  Description of Artificial Sequence: Synthetic oligonucleotide
  Target: ATXN1; (+) strand; PAM type: YTN; PAM sequence: TTT
ggaactctgtattattatct

SEQ ID NO: 279425 - DNA, 20 bp, Artificial Sequence
  Description of Artificial Sequence: Synthetic oligonucleotide
  Target: ATXN1; (+) strand; PAM type: YTN; PAM sequence: TTG
gaactctgtattattatctt

SEQ ID NO: 279426 - DNA, 20 bp, Artificial Sequence
  Description of Artificial Sequence: Synthetic oligonucleotide
  Target: ATXN1; (+) strand; PAM type: YTN; PAM sequence: CTC
tgtattattatcttttgctt

SEQ ID NO: 279427 - DNA, 20 bp, Artificial Sequence
  Description of Artificial Sequence: Synthetic oligonucleotide
  Target: ATXN1; (+) strand; PAM type: YTN; PAM sequence: CTG
tattattatcttttgcttac

SEQ ID NO: 279428 - DNA, 20 bp, Artificial Sequence
  Description of Artificial Sequence: Synthetic oligonucleotide
  Target: ATXN1; (+) strand; PAM type: YTN; PAM sequence: TTA
ttatcttttgcttacaaatg

SEQ ID NO: 279429 - DNA, 20 bp, Artificial Sequence
  Description of Artificial Sequence: Synthetic oligonucleotide
  Target: ATXN1; (+) strand; PAM type: YTN; PAM sequence: TTA
tcttttgcttacaaatgata

SEQ ID NO: 279430 - DNA, 20 bp, Artificial Sequence
  Description of Artificial Sequence: Synthetic oligonucleotide
  Target: ATXN1; (+) strand; PAM type: YTN; PAM sequence: CTT
ttgcttacaaatgataaaat

SEQ ID NO: 279431 - DNA, 20 bp, Artificial Sequence
  Description of Artificial Sequence: Synthetic oligonucleotide
  Target: ATXN1; (+) strand; PAM type: YTN; PAM sequence: TTT
tgcttacaaatgataaaata

SEQ ID NO: 279432 - DNA, 20 bp, Artificial Sequence
  Description of Artificial Sequence: Synthetic oligonucleotide
  Target: ATXN1; (+) strand; PAM type: YTN; PAM sequence: TTT
gcttacaaatgataaaatat

SEQ ID NO: 279433 - DNA, 20 bp, Artificial Sequence
  Description of Artificial Sequence: Synthetic oligonucleotide
  Target: ATXN1; (+) strand; PAM type: YTN; PAM sequence: TTG
cttacaaatgataaaatatt

SEQ ID NO: 279434 - DNA, 20 bp, Artificial Sequence
  Description of Artificial Sequence: Synthetic oligonucleotide
  Target: ATXN1; (+) strand; PAM type: YTN; PAM sequence: CTT
acaaatgataaaatatttca

SEQ ID NO: 279435 - DNA, 20 bp, Artificial Sequence
  Description of Artificial Sequence: Synthetic oligonucleotide
  Target: ATXN1; (+) strand; PAM type: YTN; PAM sequence: TTA
caaatgataaaatatttcac

SEQ ID NO: 279436 - DNA, 20 bp, Artificial Sequence
  Description of Artificial Sequence: Synthetic oligonucleotide
  Target: ATXN1; (+) strand; PAM type: YTN; PAM sequence: TTT
cactattttcttgcaagcct

SEQ ID NO: 279437 - DNA, 20 bp, Artificial Sequence
  Description of Artificial Sequence: Synthetic oligonucleotide
  Target: ATXN1; (+) strand; PAM type: YTN; PAM sequence: TTC
actattttcttgcaagcctt

SEQ ID NO: 279438 - DNA, 20 bp, Artificial Sequence
  Description of Artificial Sequence: Synthetic oligonucleotide
  Target: ATXN1; (+) strand; PAM type: YTN; PAM sequence: CTA
ttttcttgcaagccttttcg

SEQ ID NO: 279439 - DNA, 20 bp, Artificial Sequence
  Description of Artificial Sequence: Synthetic oligonucleotide
  Target: ATXN1; (+) strand; PAM type: YTN; PAM sequence: TTT
tcttgcaagccttttcggag

SEQ ID NO: 279440 - DNA, 20 bp, Artificial Sequence
  Description of Artificial Sequence: Synthetic oligonucleotide
  Target: ATXN1; (+) strand; PAM type: YTN; PAM sequence: TTT
cttgcaagccttttcggaga

SEQ ID NO: 279441 - DNA, 20 bp, Artificial Sequence
  Description of Artificial Sequence: Synthetic oligonucleotide
  Target: ATXN1; (+) strand; PAM type: YTN; PAM sequence: TTC
ttgcaagccttttcggagac

SEQ ID NO: 279442 - DNA, 20 bp, Artificial Sequence
  Description of Artificial Sequence: Synthetic oligonucleotide
  Target: ATXN1; (+) strand; PAM type: YTN; PAM sequence: CTT
gcaagccttttcggagactc

SEQ ID NO: 279443 - DNA, 20 bp, Artificial Sequence
  Description of Artificial Sequence: Synthetic oligonucleotide
  Target: ATXN1; (+) strand; PAM type: YTN; PAM sequence: TTG
caagccttttcggagactct

SEQ ID NO: 279444 - DNA, 20 bp, Artificial Sequence
  Description of Artificial Sequence: Synthetic oligonucleotide
  Target: ATXN1; (+) strand; PAM type: YTN; PAM sequence: CTT
ttcggagactctttatcatt

SEQ ID NO: 279445 - DNA, 20 bp, Artificial Sequence
  Description of Artificial Sequence: Synthetic oligonucleotide
  Target: ATXN1; (+) strand; PAM type: YTN; PAM sequence: TTT
tcggagactctttatcattt

SEQ ID NO: 279446 - DNA, 20 bp, Artificial Sequence
  Description of Artificial Sequence: Synthetic oligonucleotide
  Target: ATXN1; (+) strand; PAM type: YTN; PAM sequence: TTT
cggagactctttatcatttt

SEQ ID NO: 279447 - DNA, 20 bp, Artificial Sequence
  Description of Artificial Sequence: Synthetic oligonucleotide
  Target: ATXN1; (+) strand; PAM type: YTN; PAM sequence: TTC
ggagactctttatcattttg

SEQ ID NO: 279448 - DNA, 20 bp, Artificial Sequence
  Description of Artificial Sequence: Synthetic oligonucleotide
  Target: ATXN1; (+) strand; PAM type: YTN; PAM sequence: CTC
tttatcattttggttgacaa

SEQ ID NO: 279449 - DNA, 20 bp, Artificial Sequence
  Description of Artificial Sequence: Synthetic oligonucleotide
  Target: ATXN1; (+) strand; PAM type: YTN; PAM sequence: CTT
tatcattttggttgacaatt

SEQ ID NO: 279450 - DNA, 20 bp, Artificial Sequence
  Description of Artificial Sequence: Synthetic oligonucleotide
  Target: ATXN1; (+) strand; PAM type: YTN; PAM sequence: TTT
atcattttggttgacaatta

SEQ ID NO: 279451 - DNA, 20 bp, Artificial Sequence
  Description of Artificial Sequence: Synthetic oligonucleotide
  Target: ATXN1; (+) strand; PAM type: YTN; PAM sequence: TTA
tcattttggttgacaattag

SEQ ID NO: 279452 - DNA, 20 bp, Artificial Sequence
  Description of Artificial Sequence: Synthetic oligonucleotide
  Target: ATXN1; (+) strand; PAM type: YTN; PAM sequence: TTT
tggttgacaattagtgtttt

SEQ ID NO: 279453 - DNA, 20 bp, Artificial Sequence
  Description of Artificial Sequence: Synthetic oligonucleotide
  Target: ATXN1; (+) strand; PAM type: YTN; PAM sequence: TTT
ggttgacaattagtgttttg

SEQ ID NO: 279454 - DNA, 20 bp, Artificial Sequence
  Description of Artificial Sequence: Synthetic oligonucleotide
  Target: ATXN1; (+) strand; PAM type: YTN; PAM sequence: TTG
gttgacaattagtgttttgt

SEQ ID NO: 279455 - DNA, 20 bp, Artificial Sequence
  Description of Artificial Sequence: Synthetic oligonucleotide
  Target: ATXN1; (+) strand; PAM type: YTN; PAM sequence: TTG
acaattagtgttttgtgtca

SEQ ID NO: 279456 - DNA, 20 bp, Artificial Sequence
  Description of Artificial Sequence: Synthetic oligonucleotide
  Target: ATXN1; (+) strand; PAM type: YTN; PAM sequence: TTA
gtgttttgtgtcattttttg

SEQ ID NO: 279457 - DNA, 20 bp, Artificial Sequence
  Description of Artificial Sequence: Synthetic oligonucleotide
  Target: ATXN1; (+) strand; PAM type: YTN; PAM sequence: TTT
tgtgtcattttttggtaata

SEQ ID NO: 279458 - DNA, 20 bp, Artificial Sequence
  Description of Artificial Sequence: Synthetic oligonucleotide
  Target: ATXN1; (+) strand; PAM type: YTN; PAM sequence: TTT
gtgtcattttttggtaataa

SEQ ID NO: 279459 - DNA, 20 bp, Artificial Sequence
  Description of Artificial Sequence: Synthetic oligonucleotide
  Target: ATXN1; (+) strand; PAM type: YTN; PAM sequence: TTG
tgtcattttttggtaataat

SEQ ID NO: 279460 - DNA, 20 bp, Artificial Sequence
  Description of Artificial Sequence: Synthetic oligonucleotide
  Target: ATXN1; (+) strand; PAM type: YTN; PAM sequence: TTT
tttggtaataatattttggg

SEQ ID NO: 279461 - DNA, 20 bp, Artificial Sequence
  Description of Artificial Sequence: Synthetic oligonucleotide
  Target: ATXN1; (+) strand; PAM type: YTN; PAM sequence: TTT
ttggtaataatattttgggg

SEQ ID NO: 279462 - DNA, 20 bp, Artificial Sequence
  Description of Artificial Sequence: Synthetic oligonucleotide
  Target: ATXN1; (+) strand; PAM type: YTN; PAM sequence: TTT
tggtaataatattttgggga

SEQ ID NO: 279463 - DNA, 20 bp, Artificial Sequence
  Description of Artificial Sequence: Synthetic oligonucleotide
  Target: ATXN1; (+) strand; PAM type: YTN; PAM sequence: TTT
ggtaataatattttggggaa

SEQ ID NO: 279464 - DNA, 20 bp, Artificial Sequence
  Description of Artificial Sequence: Synthetic oligonucleotide
  Target: ATXN1; (+) strand; PAM type: YTN; PAM sequence: TTG
gtaataatattttggggaaa

SEQ ID NO: 279465 - DNA, 20 bp, Artificial Sequence
  Description of Artificial Sequence: Synthetic oligonucleotide
  Target: ATXN1; (+) strand; PAM type: YTN; PAM sequence: TTT
tggggaaaaaaactacccta

SEQ ID NO: 279466 - DNA, 20 bp, Artificial Sequence
  Description of Artificial Sequence: Synthetic oligonucleotide
  Target: ATXN1; (+) strand; PAM type: YTN; PAM sequence: TTT
ggggaaaaaaactaccctag

SEQ ID NO: 279467 - DNA, 20 bp, Artificial Sequence
  Description of Artificial Sequence: Synthetic oligonucleotide
  Target: ATXN1; (+) strand; PAM type: YTN; PAM sequence: TTG
gggaaaaaaactaccctagt

SEQ ID NO: 279468 - DNA, 20 bp, Artificial Sequence
  Description of Artificial Sequence: Synthetic oligonucleotide
  Target: ATXN1; (+) strand; PAM type: YTN; PAM sequence: CTA
ccctagtaatatttggttta

SEQ ID NO: 279469 - DNA, 20 bp, Artificial Sequence
  Description of Artificial Sequence: Synthetic oligonucleotide
  Target: ATXN1; (+) strand; PAM type: YTN; PAM sequence: CTA
gtaatatttggtttatcagg

SEQ ID NO: 279470 - DNA, 20 bp, Artificial Sequence
  Description of Artificial Sequence: Synthetic oligonucleotide
  Target: ATXN1; (+) strand; PAM type: YTN; PAM sequence: TTT
ggtttatcaggtgacttgat

SEQ ID NO: 279471 - DNA, 20 bp, Artificial Sequence
  Description of Artificial Sequence: Synthetic oligonucleotide
  Target: ATXN1; (+) strand; PAM type: YTN; PAM sequence: TTG
gtttatcaggtgacttgatc

SEQ ID NO: 279472 - DNA, 20 bp, Artificial Sequence
  Description of Artificial Sequence: Synthetic oligonucleotide
  Target: ATXN1; (+) strand; PAM type: YTN; PAM sequence: TTT
atcaggtgacttgatctggg

SEQ ID NO: 279473 - DNA, 20 bp, Artificial Sequence
  Description of Artificial Sequence: Synthetic oligonucleotide
  Target: ATXN1; (+) strand; PAM type: YTN; PAM sequence: TTA
tcaggtgacttgatctgggg

SEQ ID NO: 279474 - DNA, 20 bp, Artificial Sequence
  Description of Artificial Sequence: Synthetic oligonucleotide
  Target: ATXN1; (+) strand; PAM type: YTN; PAM sequence: CTT
gatctggggggacgctgagg

SEQ ID NO: 279475 - DNA, 20 bp, Artificial Sequence
  Description of Artificial Sequence: Synthetic oligonucleotide
  Target: ATXN1; (+) strand; PAM type: YTN; PAM sequence: TTG
atctggggggacgctgagga

SEQ ID NO: 279476 - DNA, 20 bp, Artificial Sequence
  Description of Artificial Sequence: Synthetic oligonucleotide
  Target: ATXN1; (+) strand; PAM type: YTN; PAM sequence: CTG
gggggacgctgaggaaaatg

SEQ ID NO: 279477 - DNA, 20 bp, Artificial Sequence
  Description of Artificial Sequence: Synthetic oligonucleotide
  Target: ATXN1; (+) strand; PAM type: YTN; PAM sequence: CTG
aggaaaatgaggtatacttt

SEQ ID NO: 279478 - DNA, 20 bp, Artificial Sequence
  Description of Artificial Sequence: Synthetic oligonucleotide
  Target: ATXN1; (+) strand; PAM type: YTN; PAM sequence: CTT
ttatctcgtttcttccatcc

SEQ ID NO: 279479 - DNA, 20 bp, Artificial Sequence
  Description of Artificial Sequence: Synthetic oligonucleotide
  Target: ATXN1; (+) strand; PAM type: YTN; PAM sequence: TTT
tatctcgtttcttccatccc

SEQ ID NO: 279480 - DNA, 20 bp, Artificial Sequence
  Description of Artificial Sequence: Synthetic oligonucleotide
  Target: ATXN1; (+) strand; PAM type: YTN; PAM sequence: TTT
atctcgtttcttccatccca

SEQ ID NO: 279481 - DNA, 20 bp, Artificial Sequence
  Description of Artificial Sequence: Synthetic oligonucleotide
  Target: ATXN1; (+) strand; PAM type: YTN; PAM sequence: TTA
tctcgtttcttccatcccat

SEQ ID NO: 279482 - DNA, 20 bp, Artificial Sequence
  Description of Artificial Sequence: Synthetic oligonucleotide
  Target: ATXN1; (+) strand; PAM type: YTN; PAM sequence: CTC
gtttcttccatcccattctt

SEQ ID NO: 279483 - DNA, 20 bp, Artificial Sequence
  Description of Artificial Sequence: Synthetic oligonucleotide
  Target: ATXN1; (+) strand; PAM type: YTN; PAM sequence: TTT
cttccatcccattcttccac

SEQ ID NO: 279484 - DNA, 20 bp, Artificial Sequence
  Description of Artificial Sequence: Synthetic oligonucleotide
  Target: ATXN1; (+) strand; PAM type: YTN; PAM sequence: TTC
ttccatcccattcttccacc

SEQ ID NO: 279485 - DNA, 20 bp, Artificial Sequence
  Description of Artificial Sequence: Synthetic oligonucleotide
  Target: ATXN1; (+) strand; PAM type: YTN; PAM sequence: CTT
ccatcccattcttccacctt

SEQ ID NO: 279486 - DNA, 20 bp, Artificial Sequence
  Description of Artificial Sequence: Synthetic oligonucleotide
  Target: ATXN1; (+) strand; PAM type: YTN; PAM sequence: TTC
catcccattcttccaccttt

SEQ ID NO: 279487 - DNA, 20 bp, Artificial Sequence
  Description of Artificial Sequence: Synthetic oligonucleotide
  Target: ATXN1; (+) strand; PAM type: YTN; PAM sequence: TTC
ttccacctttcttccttttc

SEQ ID NO: 279488 - DNA, 20 bp, Artificial Sequence
  Description of Artificial Sequence: Synthetic oligonucleotide
  Target: ATXN1; (+) strand; PAM type: YTN; PAM sequence: CTT
ccacctttcttccttttctc

SEQ ID NO: 279489 - DNA, 20 bp, Artificial Sequence
  Description of Artificial Sequence: Synthetic oligonucleotide
  Target: ATXN1; (+) strand; PAM type: YTN; PAM sequence: TTC
cacctttcttccttttctct

SEQ ID NO: 279490 - DNA, 20 bp, Artificial Sequence
  Description of Artificial Sequence: Synthetic oligonucleotide
  Target: ATXN1; (+) strand; PAM type: YTN; PAM sequence: CTT
tcttccttttctctcttagc

SEQ ID NO: 279491 - DNA, 20 bp, Artificial Sequence
  Description of Artificial Sequence: Synthetic oligonucleotide
  Target: ATXN1; (+) strand; PAM type: YTN; PAM sequence: TTT
cttccttttctctcttagca

SEQ ID NO: 279492 - DNA, 20 bp, Artificial Sequence
  Description of Artificial Sequence: Synthetic oligonucleotide
  Target: ATXN1; (+) strand; PAM type: YTN; PAM sequence: TTC
ttccttttctctcttagcaa

SEQ ID NO: 279493 - DNA, 20 bp, Artificial Sequence
  Description of Artificial Sequence: Synthetic oligonucleotide
  Target: ATXN1; (+) strand; PAM type: YTN; PAM sequence: CTT
ccttttctctcttagcaaaa

SEQ ID NO: 279494 - DNA, 20 bp, Artificial Sequence
  Description of Artificial Sequence: Synthetic oligonucleotide
  Target: ATXN1; (+) strand; PAM type: YTN; PAM sequence: TTC
cttttctctcttagcaaaag

SEQ ID NO: 279495 - DNA, 20 bp, Artificial Sequence
  Description of Artificial Sequence: Synthetic oligonucleotide
  Target: ATXN1; (+) strand; PAM type: YTN; PAM sequence: CTT
ttctctcttagcaaaagcct

SEQ ID NO: 279496 - DNA, 20 bp, Artificial Sequence
  Description of Artificial Sequence: Synthetic oligonucleotide
  Target: ATXN1; (+) strand; PAM type: YTN; PAM sequence: TTT
tctctcttagcaaaagcctt

SEQ ID NO: 279497 - DNA, 20 bp, Artificial Sequence
  Description of Artificial Sequence: Synthetic oligonucleotide
  Target: ATXN1; (+) strand; PAM type: YTN; PAM sequence: TTT
ctctcttagcaaaagccttt

SEQ ID NO: 279498 - DNA, 20 bp, Artificial Sequence
  Description of Artificial Sequence: Synthetic oligonucleotide
  Target: ATXN1; (+) strand; PAM type: YTN; PAM sequence: TTC
tctcttagcaaaagccttta

SEQ ID NO: 279499 - DNA, 20 bp, Artificial Sequence
  Description of Artificial Sequence: Synthetic oligonucleotide
  Target: ATXN1; (+) strand; PAM type: YTN; PAM sequence: CTC
tcttagcaaaagcctttact

SEQ ID NO: 279500 - DNA, 20 bp, Artificial Sequence
  Description of Artificial Sequence: Synthetic oligonucleotide
  Target: ATXN1; (+) strand; PAM type: YTN; PAM sequence: CTC
ttagcaaaagcctttactac

SEQ ID NO: 279501 - DNA, 20 bp, Artificial Sequence
  Description of Artificial Sequence: Synthetic oligonucleotide
  Target: ATXN1; (+) strand; PAM type: YTN; PAM sequence: CTT
agcaaaagcctttactacat

SEQ ID NO: 279502 - DNA, 20 bp, Artificial Sequence
  Description of Artificial Sequence: Synthetic oligonucleotide
  Target: ATXN1; (+) strand; PAM type: YTN; PAM sequence: TTA
gcaaaagcctttactacata

SEQ ID NO: 279503 - DNA, 20 bp, Artificial Sequence
  Description of Artificial Sequence: Synthetic oligonucleotide
  Target: ATXN1; (+) strand; PAM type: YTN; PAM sequence: CTT
tactacatattcctatagct

SEQ ID NO: 279504 - DNA, 20 bp, Artificial Sequence
  Description of Artificial Sequence: Synthetic oligonucleotide
  Target: ATXN1; (+) strand; PAM type: YTN; PAM sequence: TTT
actacatattcctatagctt

SEQ ID NO: 279505 - DNA, 20 bp, Artificial Sequence
  Description of Artificial Sequence: Synthetic oligonucleotide
  Target: ATXN1; (+) strand; PAM type: YTN; PAM sequence: TTA
ctacatattcctatagcttc

SEQ ID NO: 279506 - DNA, 20 bp, Artificial Sequence
  Description of Artificial Sequence: Synthetic oligonucleotide
  Target: ATXN1; (+) strand; PAM type: YTN; PAM sequence: CTA
catattcctatagcttctta

SEQ ID NO: 279507 - DNA, 20 bp, Artificial Sequence
  Description of Artificial Sequence: Synthetic oligonucleotide
  Target: ATXN1; (+) strand; PAM type: YTN; PAM sequence: TTC
ctatagcttcttagtctttt

SEQ ID NO: 279508 - DNA, 20 bp, Artificial Sequence
  Description of Artificial Sequence: Synthetic oligonucleotide
  Target: ATXN1; (+) strand; PAM type: YTN; PAM sequence: CTA
tagcttcttagtctttttac

SEQ ID NO: 279509 - DNA, 20 bp, Artificial Sequence
  Description of Artificial Sequence: Synthetic oligonucleotide
  Target: ATXN1; (+) strand; PAM type: YTN; PAM sequence: CTT
cttagtctttttacttcgtt

SEQ ID NO: 279510 - DNA, 20 bp, Artificial Sequence
  Description of Artificial Sequence: Synthetic oligonucleotide
  Target: ATXN1; (+) strand; PAM type: YTN; PAM sequence: TTC
ttagtctttttacttcgttg

SEQ ID NO: 279511 - DNA, 20 bp, Artificial Sequence
  Description of Artificial Sequence: Synthetic oligonucleotide
  Target: ATXN1; (+) strand; PAM type: YTN; PAM sequence: CTT
agtctttttacttcgttggc

SEQ ID NO: 279512 - DNA, 20 bp, Artificial Sequence
  Description of Artificial Sequence: Synthetic oligonucleotide
  Target: ATXN1; (+) strand; PAM type: YTN; PAM sequence: TTA
gtctttttacttcgttggca

SEQ ID NO: 279513 - DNA, 20 bp, Artificial Sequence
  Description of Artificial Sequence: Synthetic oligonucleotide
  Target: ATXN1; (+) strand; PAM type: YTN; PAM sequence: CTT
tttacttcgttggcaaaaga

SEQ ID NO: 279514 - DNA, 20 bp, Artificial Sequence
  Description of Artificial Sequence: Synthetic oligonucleotide
  Target: ATXN1; (+) strand; PAM type: YTN; PAM sequence: TTT
ttacttcgttggcaaaagaa

SEQ ID NO: 279515 - DNA, 20 bp, Artificial Sequence
  Description of Artificial Sequence: Synthetic oligonucleotide
  Target: ATXN1; (+) strand; PAM type: YTN; PAM sequence: TTT
tacttcgttggcaaaagaaa

SEQ ID NO: 279516 - DNA, 20 bp, Artificial Sequence
  Description of Artificial Sequence: Synthetic oligonucleotide
  Target: ATXN1; (+) strand; PAM type: YTN; PAM sequence: TTT
acttcgttggcaaaagaaaa

SEQ ID NO: 279517 - DNA, 20 bp, Artificial Sequence
  Description of Artificial Sequence: Synthetic oligonucleotide
  Target: ATXN1; (+) strand; PAM type: YTN; PAM sequence: TTA
cttcgttggcaaaagaaaaa

SEQ ID NO: 279518 - DNA, 20 bp, Artificial Sequence
  Description of Artificial Sequence: Synthetic oligonucleotide
  Target: ATXN1; (+) strand; PAM type: YTN; PAM sequence: CTT
cgttggcaaaagaaaaatag

SEQ ID NO: 279519 - DNA, 20 bp, Artificial Sequence
  Description of Artificial Sequence: Synthetic oligonucleotide
  Target: ATXN1; (+) strand; PAM type: YTN; PAM sequence: TTC
gttggcaaaagaaaaatagc

SEQ ID NO: 279520 - DNA, 20 bp, Artificial Sequence
  Description of Artificial Sequence: Synthetic oligonucleotide
  Target: ATXN1; (+) strand; PAM type: YTN; PAM sequence: TTG
gcaaaagaaaaatagcatga

SEQ ID NO: 279521 - DNA, 20 bp, Artificial Sequence
  Description of Artificial Sequence: Synthetic oligonucleotide
  Target: ATXN1; (+) strand; PAM type: YTN; PAM sequence: TTA
aaatacaattgctgccttct

SEQ ID NO: 279522 - DNA, 20 bp, Artificial Sequence
  Description of Artificial Sequence: Synthetic oligonucleotide
  Target: ATXN1; (+) strand; PAM type: YTN; PAM sequence: TTG
ctgccttcttcctttatagc

SEQ ID NO: 279523 - DNA, 20 bp, Artificial Sequence
  Description of Artificial Sequence: Synthetic oligonucleotide
  Target: ATXN1; (+) strand; PAM type: YTN; PAM sequence: CTG
ccttcttcctttatagcaca

SEQ ID NO: 279524 - DNA, 20 bp, Artificial Sequence
  Description of Artificial Sequence: Synthetic oligonucleotide
  Target: ATXN1; (+) strand; PAM type: YTN; PAM sequence: CTT
cttcctttatagcacagact

SEQ ID NO: 279525 - DNA, 20 bp, Artificial Sequence
  Description of Artificial Sequence: Synthetic oligonucleotide
  Target: ATXN1; (+) strand; PAM type: YTN; PAM sequence: TTC
ttcctttatagcacagactt

SEQ ID NO: 279526 - DNA, 20 bp, Artificial Sequence
  Description of Artificial Sequence: Synthetic oligonucleotide
  Target: ATXN1; (+) strand; PAM type: YTN; PAM sequence: CTT
cctttatagcacagacttcc

SEQ ID NO: 279527 - DNA, 20 bp, Artificial Sequence
  Description of Artificial Sequence: Synthetic oligonucleotide
  Target: ATXN1; (+) strand; PAM type: YTN; PAM sequence: TTC
ctttatagcacagacttccc

SEQ ID NO: 279528 - DNA, 20 bp, Artificial Sequence
  Description of Artificial Sequence: Synthetic oligonucleotide
  Target: ATXN1; (+) strand; PAM type: YTN; PAM sequence: CTT
tatagcacagacttcccact

SEQ ID NO: 279529 - DNA, 20 bp, Artificial Sequence
  Description of Artificial Sequence: Synthetic oligonucleotide
  Target: ATXN1; (+) strand; PAM type: YTN; PAM sequence: TTT
atagcacagacttcccactc

SEQ ID NO: 279530 - DNA, 20 bp, Artificial Sequence
  Description of Artificial Sequence: Synthetic oligonucleotide
  Target: ATXN1; (+) strand; PAM type: YTN; PAM sequence: TTA
tagcacagacttcccactca

SEQ ID NO: 279531 - DNA, 20 bp, Artificial Sequence
  Description of Artificial Sequence: Synthetic oligonucleotide
  Target: ATXN1; (+) strand; PAM type: YTN; PAM sequence: CTT
cccactcataaactcctgtc

SEQ ID NO: 279532 - DNA, 20 bp, Artificial Sequence
  Description of Artificial Sequence: Synthetic oligonucleotide
  Target: ATXN1; (+) strand; PAM type: YTN; PAM sequence: TTC
ccactcataaactcctgtca

SEQ ID NO: 279533 - DNA, 20 bp, Artificial Sequence
  Description of Artificial Sequence: Synthetic oligonucleotide
  Target: ATXN1; (+) strand; PAM type: YTN; PAM sequence: CTC
ataaactcctgtcaatgctg

SEQ ID NO: 279534 - DNA, 20 bp, Artificial Sequence
  Description of Artificial Sequence: Synthetic oligonucleotide
  Target: ATXN1; (+) strand; PAM type: YTN; PAM sequence: CTC
ctgtcaatgctggtaagaaa

SEQ ID NO: 279535 - DNA, 20 bp, Artificial Sequence
  Description of Artificial Sequence: Synthetic oligonucleotide
  Target: ATXN1; (+) strand; PAM type: YTN; PAM sequence: CTG
tcaatgctggtaagaaaaat

SEQ ID NO: 279536 - DNA, 20 bp, Artificial Sequence
  Description of Artificial Sequence: Synthetic oligonucleotide
  Target: ATXN1; (+) strand; PAM type: YTN; PAM sequence: CTG
gtaagaaaaatcagactact

SEQ ID NO: 279537 - DNA, 20 bp, Artificial Sequence
  Description of Artificial Sequence: Synthetic oligonucleotide
  Target: ATXN1; (+) strand; PAM type: YTN; PAM sequence: CTA
ctattttatcactgcgggag

SEQ ID NO: 279538 - DNA, 20 bp, Artificial Sequence
  Description of Artificial Sequence: Synthetic oligonucleotide
  Target: ATXN1; (+) strand; PAM type: YTN; PAM sequence: CTA
ttttatcactgcgggagaac

SEQ ID NO: 279539 - DNA, 20 bp, Artificial Sequence
  Description of Artificial Sequence: Synthetic oligonucleotide
  Target: ATXN1; (+) strand; PAM type: YTN; PAM sequence: TTT
tatcactgcgggagaactaa

SEQ ID NO: 279540 - DNA, 20 bp, Artificial Sequence
  Description of Artificial Sequence: Synthetic oligonucleotide
  Target: ATXN1; (+) strand; PAM type: YTN; PAM sequence: TTT
atcactgcgggagaactaac

SEQ ID NO: 279541 - DNA, 20 bp, Artificial Sequence
  Description of Artificial Sequence: Synthetic oligonucleotide
  Target: ATXN1; (+) strand; PAM type: YTN; PAM sequence: TTA
tcactgcgggagaactaaca

SEQ ID NO: 279542 - DNA, 20 bp, Artificial Sequence
  Description of Artificial Sequence: Synthetic oligonucleotide
  Target: ATXN1; (+) strand; PAM type: YTN; PAM sequence: CTG
cgggagaactaacacagcat

SEQ ID NO: 279543 - DNA, 20 bp, Artificial Sequence
  Description of Artificial Sequence: Synthetic oligonucleotide
  Target: ATXN1; (+) strand; PAM type: YTN; PAM sequence: CTA
acacagcatactttaccttt

SEQ ID NO: 279544 - DNA, 20 bp, Artificial Sequence
  Description of Artificial Sequence: Synthetic oligonucleotide
  Target: ATXN1; (+) strand; PAM type: YTN; PAM sequence: CTT
tacctttctgcaaataattc

SEQ ID NO: 279545 - DNA, 20 bp, Artificial Sequence
  Description of Artificial Sequence: Synthetic oligonucleotide
  Target: ATXN1; (+) strand; PAM type: YTN; PAM sequence: TTT
acctttctgcaaataattcc

SEQ ID NO: 279546 - DNA, 20 bp, Artificial Sequence
  Description of Artificial Sequence: Synthetic oligonucleotide
  Target: ATXN1; (+) strand; PAM type: YTN; PAM sequence: TTA
cctttctgcaaataattccg

SEQ ID NO: 279547 - DNA, 20 bp, Artificial Sequence
  Description of Artificial Sequence: Synthetic oligonucleotide
  Target: ATXN1; (+) strand; PAM type: YTN; PAM sequence: CTT
tctgcaaataattccgtcag

SEQ ID NO: 279548 - DNA, 20 bp, Artificial Sequence
  Description of Artificial Sequence: Synthetic oligonucleotide
  Target: ATXN1; (+) strand; PAM type: YTN; PAM sequence: TTT
ctgcaaataattccgtcaga

SEQ ID NO: 279549 - DNA, 20 bp, Artificial Sequence
  Description of Artificial Sequence: Synthetic oligonucleotide
  Target: ATXN1; (+) strand; PAM type: YTN; PAM sequence: TTC
tgcaaataattccgtcagat

SEQ ID NO: 279550 - DNA, 20 bp, Artificial Sequence
  Description of Artificial Sequence: Synthetic oligonucleotide
  Target: ATXN1; (+) strand; PAM type: YTN; PAM sequence: CTG
caaataattccgtcagattc

SEQ ID NO: 279551 - DNA, 20 bp, Artificial Sequence
  Description of Artificial Sequence: Synthetic oligonucleotide
  Target: ATXN1; (+) strand; PAM type: YTN; PAM sequence: TTC
cgtcagattcagcatttcca

SEQ ID NO: 279552 - DNA, 20 bp, Artificial Sequence
  Description of Artificial Sequence: Synthetic oligonucleotide
  Target: ATXN1; (+) strand; PAM type: YTN; PAM sequence: TTC
agcatttccaaaacgttttc

SEQ ID NO: 279553 - DNA, 20 bp, Artificial Sequence
  Description of Artificial Sequence: Synthetic oligonucleotide
  Target: ATXN1; (+) strand; PAM type: YTN; PAM sequence: TTT
ccaaaacgttttctactcat

SEQ ID NO: 279554 - DNA, 20 bp, Artificial Sequence
  Description of Artificial Sequence: Synthetic oligonucleotide
  Target: ATXN1; (+) strand; PAM type: YTN; PAM sequence: TTC
caaaacgttttctactcatt

SEQ ID NO: 279555 - DNA, 20 bp, Artificial Sequence
  Description of Artificial Sequence: Synthetic oligonucleotide
  Target: ATXN1; (+) strand; PAM type: YTN; PAM sequence: TTT
tctactcattataaaagccc

SEQ ID NO: 279556 - DNA, 20 bp, Artificial Sequence
  Description of Artificial Sequence: Synthetic oligonucleotide
  Target: ATXN1; (+) strand; PAM type: YTN; PAM sequence: TTT
ctactcattataaaagccct

SEQ ID NO: 279557 - DNA, 20 bp, Artificial Sequence
  Description of Artificial Sequence: Synthetic oligonucleotide
  Target: ATXN1; (+) strand; PAM type: YTN; PAM sequence: TTC
tactcattataaaagcccta

SEQ ID NO: 279558 - DNA, 20 bp, Artificial Sequence
  Description of Artificial Sequence: Synthetic oligonucleotide
  Target: ATXN1; (+) strand; PAM type: YTN; PAM sequence: CTA
ctcattataaaagccctaca

SEQ ID NO: 279559 - DNA, 20 bp, Artificial Sequence
  Description of Artificial Sequence: Synthetic oligonucleotide
  Target: ATXN1; (+) strand; PAM type: YTN; PAM sequence: CTC
attataaaagccctacaaac

SEQ ID NO: 279560 - DNA, 20 bp, Artificial Sequence
  Description of Artificial Sequence: Synthetic oligonucleotide
  Target: ATXN1; (+) strand; PAM type: YTN; PAM sequence: TTA
taaaagccctacaaacgcca

SEQ ID NO: 279561 - DNA, 20 bp, Artificial Sequence
  Description of Artificial Sequence: Synthetic oligonucleotide
  Target: ATXN1; (+) strand; PAM type: YTN; PAM sequence: CTA
caaacgccaaatggacaata

SEQ ID NO: 279562 - DNA, 20 bp, Artificial Sequence
  Description of Artificial Sequence: Synthetic oligonucleotide
  Target: ATXN1; (+) strand; PAM type: YTN; PAM sequence: CTC
caccccaaaggcaggctcac

SEQ ID NO: 279563 - DNA, 20 bp, Artificial Sequence
  Description of Artificial Sequence: Synthetic oligonucleotide
  Target: ATXN1; (+) strand; PAM type: YTN; PAM sequence: CTC
actgttaatgggggaacatg

SEQ ID NO: 279564 - DNA, 20 bp, Artificial Sequence
  Description of Artificial Sequence: Synthetic oligonucleotide
  Target: ATXN1; (+) strand; PAM type: YTN; PAM sequence: CTG
ttaatgggggaacatgagaa

SEQ ID NO: 279565 - DNA, 20 bp, Artificial Sequence
  Description of Artificial Sequence: Synthetic oligonucleotide
  Target: ATXN1; (+) strand; PAM type: YTN; PAM sequence: TTA
atgggggaacatgagaagca

SEQ ID NO: 279566 - DNA, 20 bp, Artificial Sequence
  Description of Artificial Sequence: Synthetic oligonucleotide
  Target: ATXN1; (+) strand; PAM type: YTN; PAM sequence: TTA
aaaataggaacaacatgagg

SEQ ID NO: 279567 - DNA, 20 bp, Artificial Sequence
  Description of Artificial Sequence: Synthetic oligonucleotide
  Target: ATXN1; (+) strand; PAM type: YTN; PAM sequence: CTA
ccatcatctctgttatttaa

SEQ ID NO: 279568 - DNA, 20 bp, Artificial Sequence
  Description of Artificial Sequence: Synthetic oligonucleotide
  Target: ATXN1; (+) strand; PAM type: YTN; PAM sequence: CTC
tgttatttaacactgatctg

SEQ ID NO: 279569 - DNA, 20 bp, Artificial Sequence
  Description of Artificial Sequence: Synthetic oligonucleotide
  Target: ATXN1; (+) strand; PAM type: YTN; PAM sequence: CTG
ttatttaacactgatctgtt

SEQ ID NO: 279570 - DNA, 20 bp, Artificial Sequence
  Description of Artificial Sequence: Synthetic oligonucleotide
  Target: ATXN1; (+) strand; PAM type: YTN; PAM sequence: TTA
tttaacactgatctgttaaa

SEQ ID NO: 279571 - DNA, 20 bp, Artificial Sequence
  Description of Artificial Sequence: Synthetic oligonucleotide
  Target: ATXN1; (+) strand; PAM type: YTN; PAM sequence: TTT
aacactgatctgttaaactt

SEQ ID NO: 279572 - DNA, 20 bp, Artificial Sequence
  Description of Artificial Sequence: Synthetic oligonucleotide
  Target: ATXN1; (+) strand; PAM type: YTN; PAM sequence: TTA
acactgatctgttaaactta

SEQ ID NO: 279573 - DNA, 20 bp, Artificial Sequence
  Description of Artificial Sequence: Synthetic oligonucleotide
  Target: ATXN1; (+) strand; PAM type: YTN; PAM sequence: CTG
atctgttaaacttagccaat

SEQ ID NO: 279574 - DNA, 20 bp, Artificial Sequence
  Description of Artificial Sequence: Synthetic oligonucleotide
  Target: ATXN1; (+) strand; PAM type: YTN; PAM sequence: CTG
ttaaacttagccaatttaac

SEQ ID NO: 279575 - DNA, 20 bp, Artificial Sequence
  Description of Artificial Sequence: Synthetic oligonucleotide
  Target: ATXN1; (+) strand; PAM type: YTN; PAM sequence: TTA
aacttagccaatttaactgc

SEQ ID NO: 279576 - DNA, 20 bp, Artificial Sequence
  Description of Artificial Sequence: Synthetic oligonucleotide
  Target: ATXN1; (+) strand; PAM type: YTN; PAM sequence: CTT
agccaatttaactgcataag

SEQ ID NO: 279577 - DNA, 20 bp, Artificial Sequence
  Description of Artificial Sequence: Synthetic oligonucleotide
  Target: ATXN1; (+) strand; PAM type: YTN; PAM sequence: TTA
gccaatttaactgcataaga

SEQ ID NO: 279578 - DNA, 20 bp, Artificial Sequence
  Description of Artificial Sequence: Synthetic oligonucleotide
  Target: ATXN1; (+) strand; PAM type: YTN; PAM sequence: TTT
aactgcataagagaaataaa

SEQ ID NO: 279579 - DNA, 20 bp, Artificial Sequence
  Description of Artificial Sequence: Synthetic oligonucleotide
  Target: ATXN1; (+) strand; PAM type: YTN; PAM sequence: TTA
actgcataagagaaataaat

SEQ ID NO: 279580 - DNA, 20 bp, Artificial Sequence
  Description of Artificial Sequence: Synthetic oligonucleotide
  Target: ATXN1; (+) strand; PAM type: YTN; PAM sequence: CTG
cataagagaaataaataagg

SEQ ID NO: 279581 - DNA, 20 bp, Artificial Sequence
  Description of Artificial Sequence: Synthetic oligonucleotide
  Target: ATXN1; (+) strand; PAM type: YTN; PAM sequence: TTA
taacaggcagaaaaattatt

SEQ ID NO: 279582 - DNA, 20 bp, Artificial Sequence
  Description of Artificial Sequence: Synthetic oligonucleotide
  Target: ATXN1; (+) strand; PAM type: YTN; PAM sequence: TTA
ttatttataaatgctatgat

SEQ ID NO: 279583 - DNA, 20 bp, Artificial Sequence
  Description of Artificial Sequence: Synthetic oligonucleotide
  Target: ATXN1; (+) strand; PAM type: YTN; PAM sequence: TTA
tttataaatgctatgatctg

SEQ ID NO: 279584 - DNA, 20 bp, Artificial Sequence
  Description of Artificial Sequence: Synthetic oligonucleotide
  Target: ATXN1; (+) strand; PAM type: YTN; PAM sequence: TTT
ataaatgctatgatctgagc

SEQ ID NO: 279585 - DNA, 20 bp, Artificial Sequence
  Description of Artificial Sequence: Synthetic oligonucleotide
  Target: ATXN1; (+) strand; PAM type: YTN; PAM sequence: TTA
taaatgctatgatctgagca

SEQ ID NO: 279586 - DNA, 20 bp, Artificial Sequence
  Description of Artificial Sequence: Synthetic oligonucleotide
  Target: ATXN1; (+) strand; PAM type: YTN; PAM sequence: CTA
tgatctgagcaagtcaattg

SEQ ID NO: 279587 - DNA, 20 bp, Artificial Sequence
  Description of Artificial Sequence: Synthetic oligonucleotide
  Target: ATXN1; (+) strand; PAM type: YTN; PAM sequence: CTG
agcaagtcaattgaacaact

SEQ ID NO: 279588 - DNA, 20 bp, Artificial Sequence
  Description of Artificial Sequence: Synthetic oligonucleotide
  Target: ATXN1; (+) strand; PAM type: YTN; PAM sequence: TTG
aacaacttattaattagaga

SEQ ID NO: 279589 - DNA, 20 bp, Artificial Sequence
  Description of Artificial Sequence: Synthetic oligonucleotide
  Target: ATXN1; (+) strand; PAM type: YTN; PAM sequence: CTT
attaattagagaattctgta

SEQ ID NO: 279590 - DNA, 20 bp, Artificial Sequence
  Description of Artificial Sequence: Synthetic oligonucleotide
  Target: ATXN1; (+) strand; PAM type: YTN; PAM sequence: TTA
ttaattagagaattctgtag

SEQ ID NO: 279591 - DNA, 20 bp, Artificial Sequence
  Description of Artificial Sequence: Synthetic oligonucleotide
  Target: ATXN1; (+) strand; PAM type: YTN; PAM sequence: TTA
attagagaattctgtagggt

SEQ ID NO: 279592 - DNA, 20 bp, Artificial Sequence
  Description of Artificial Sequence: Synthetic oligonucleotide
  Target: ATXN1; (+) strand; PAM type: YTN; PAM sequence: TTA
gagaattctgtagggtaact

SEQ ID NO: 279593 - DNA, 20 bp, Artificial Sequence
  Description of Artificial Sequence: Synthetic oligonucleotide
  Target: ATXN1; (+) strand; PAM type: YTN; PAM sequence: TTC
tgtagggtaactgaaacaaa

SEQ ID NO: 279594 - DNA, 20 bp, Artificial Sequence
  Description of Artificial Sequence: Synthetic oligonucleotide
  Target: ATXN1; (+) strand; PAM type: YTN; PAM sequence: CTG
tagggtaactgaaacaaaag

SEQ ID NO: 279595 - DNA, 20 bp, Artificial Sequence
  Description of Artificial Sequence: Synthetic oligonucleotide
  Target: ATXN1; (+) strand; PAM type: YTN; PAM sequence: CTG
aaacaaaagaatatacaaaa

SEQ ID NO: 279596 - DNA, 20 bp, Artificial Sequence
  Description of Artificial Sequence: Synthetic oligonucleotide
  Target: ATXN1; (+) strand; PAM type: YTN; PAM sequence: CTT
tctaaaggacaaccagtaaa

SEQ ID NO: 279597 - DNA, 20 bp, Artificial Sequence
  Description of Artificial Sequence: Synthetic oligonucleotide
  Target: ATXN1; (+) strand; PAM type: YTN; PAM sequence: TTT
ctaaaggacaaccagtaaaa

SEQ ID NO: 279598 - DNA, 20 bp, Artificial Sequence
  Description of Artificial Sequence: Synthetic oligonucleotide
  Target: ATXN1; (+) strand; PAM type: YTN; PAM sequence: TTC
taaaggacaaccagtaaaaa

SEQ ID NO: 279599 - DNA, 20 bp, Artificial Sequence
  Description of Artificial Sequence: Synthetic oligonucleotide
  Target: ATXN1; (+) strand; PAM type: YTN; PAM sequence: CTA
aaggacaaccagtaaaaagg

SEQ ID NO: 279600 - DNA, 20 bp, Artificial Sequence
  Description of Artificial Sequence: Synthetic oligonucleotide
  Target: ATXN1; (+) strand; PAM type: YTN; PAM sequence: TTT
aaataacaacaaaaatataa

SEQ ID NO: 279601 - DNA, 20 bp, Artificial Sequence
  Description of Artificial Sequence: Synthetic oligonucleotide
  Target: ATXN1; (+) strand; PAM type: YTN; PAM sequence: TTA
aataacaacaaaaatataaa

SEQ ID NO: 279602 - DNA, 20 bp, Artificial Sequence
  Description of Artificial Sequence: Synthetic oligonucleotide
  Target: ATXN1; (+) strand; PAM type: YTN; PAM sequence: CTA
gggataaactgaaggaggac

SEQ ID NO: 279603 - DNA, 20 bp, Artificial Sequence
  Description of Artificial Sequence: Synthetic oligonucleotide
  Target: ATXN1; (+) strand; PAM type: YTN; PAM sequence: CTG
aaggaggactatatgcaaga

SEQ ID NO: 279604 - DNA, 20 bp, Artificial Sequence
  Description of Artificial Sequence: Synthetic oligonucleotide
  Target: ATXN1; (+) strand; PAM type: YTN; PAM sequence: CTA
tatgcaagatctacataaag

SEQ ID NO: 279605 - DNA, 20 bp, Artificial Sequence
  Description of Artificial Sequence: Synthetic oligonucleotide
  Target: ATXN1; (+) strand; PAM type: YTN; PAM sequence: CTA
cataaagagggctgggtgca

SEQ ID NO: 279606 - DNA, 20 bp, Artificial Sequence
  Description of Artificial Sequence: Synthetic oligonucleotide
  Target: ATXN1; (+) strand; PAM type: YTN; PAM sequence: CTG
ggtgcagtggctcaggccta

SEQ ID NO: 279607 - DNA, 20 bp, Artificial Sequence
  Description of Artificial Sequence: Synthetic oligonucleotide
  Target: ATXN1; (+) strand; PAM type: YTN; PAM sequence: CTC
aggcctattattccagcact

SEQ ID NO: 279608 - DNA, 20 bp, Artificial Sequence
  Description of Artificial Sequence: Synthetic oligonucleotide
  Target: ATXN1; (+) strand; PAM type: YTN; PAM sequence: CTA
ttattccagcactttgggag

SEQ ID NO: 279609 - DNA, 20 bp, Artificial Sequence
  Description of Artificial Sequence: Synthetic oligonucleotide
  Target: ATXN1; (+) strand; PAM type: YTN; PAM sequence: TTA
ttccagcactttgggagggc

SEQ ID NO: 279610 - DNA, 20 bp, Artificial Sequence
  Description of Artificial Sequence: Synthetic oligonucleotide
  Target: ATXN1; (+) strand; PAM type: YTN; PAM sequence: TTC
cagcactttgggagggcgag

SEQ ID NO: 279611 - DNA, 20 bp, Artificial Sequence
  Description of Artificial Sequence: Synthetic oligonucleotide
  Target: ATXN1; (+) strand; PAM type: YTN; PAM sequence: CTT
tgggagggcgaggtgggcag

SEQ ID NO: 279612 - DNA, 20 bp, Artificial Sequence
  Description of Artificial Sequence: Synthetic oligonucleotide
  Target: ATXN1; (+) strand; PAM type: YTN; PAM sequence: TTT
gggagggcgaggtgggcaga

SEQ ID NO: 279613 - DNA, 20 bp, Artificial Sequence
  Description of Artificial Sequence: Synthetic oligonucleotide
  Target: ATXN1; (+) strand; PAM type: YTN; PAM sequence: TTG
ggagggcgaggtgggcagat

SEQ ID NO: 279614 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcgagacc

SEQ ID NO: 279615 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcgagacca

SEQ ID NO: 279616 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctaaccaaaca

SEQ ID NO: 279617 - DNA, 20 bp, Artificial Sequence
  Description of Artificial Sequence: Synthetic oligonucleotide
  Target: ATXN1; (+) strand; PAM type: YTN; PAM sequence: CTA
accaaacatggtaaaacgcc

SEQ ID NO: 279618 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaaat

SEQ ID NO: 279619 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaaatta

SEQ ID NO: 279620 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaaattagcc

SEQ ID NO: 279621 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtggtggcagaca

SEQ ID NO: 279622 - DNA, 20 bp, Artificial Sequence
  Description of Artificial Sequence: Synthetic oligonucleotide
  Target: ATXN1; (+) strand; PAM type: YTN; PAM sequence: CTG
tagtcccagttactggggag

SEQ ID NO: 279623 - DNA, 20 bp, Artificial Sequence
  Description of Artificial Sequence: Synthetic oligonucleotide
  Target: ATXN1; (+) strand; PAM type: YTN; PAM sequence: TTA
ctggggaggctaaggcacaa

SEQ ID NO: 279624 - DNA, 20 bp, Artificial Sequence
  Description of Artificial Sequence: Synthetic oligonucleotide
  Target: ATXN1; (+) strand; PAM type: YTN; PAM sequence: CTG
gggaggctaaggcacaagaa

SEQ ID NO: 279625 - DNA, 20 bp, Artificial Sequence
  Description of Artificial Sequence: Synthetic oligonucleotide
  Target: ATXN1; (+) strand; PAM type: YTN; PAM sequence: CTA
aggcacaagaatcgcttgaa

SEQ ID NO: 279626 - DNA, 20 bp, Artificial Sequence
  Description of Artificial Sequence: Synthetic oligonucleotide
  Target: ATXN1; (+) strand; PAM type: YTN; PAM sequence: CTT
gaacctgggagccagaggtt

SEQ ID NO: 279627 - DNA, 20 bp, Artificial Sequence
  Description of Artificial Sequence: Synthetic oligonucleotide
  Target: ATXN1; (+) strand; PAM type: YTN; PAM sequence: TTG
aacctgggagccagaggttt

SEQ ID NO: 279628 - DNA, 20 bp, Artificial Sequence
  Description of Artificial Sequence: Synthetic oligonucleotide
  Target: ATXN1; (+) strand; PAM type: YTN; PAM sequence: CTG
ggagccagaggtttcagtga

SEQ ID NO: 279629 - DNA, 20 bp, Artificial Sequence
  Description of Artificial Sequence: Synthetic oligonucleotide
  Target: ATXN1; (+) strand; PAM type: YTN; PAM sequence: TTT
cagtgagccaagattgtgcc

SEQ ID NO: 279630 - DNA, 20 bp, Artificial Sequence
  Description of Artificial Sequence: Synthetic oligonucleotide
  Target: ATXN1; (+) strand; PAM type: YTN; PAM sequence: TTC
agtgagccaagattgtgcca

SEQ ID NO: 279631 - DNA, 20 bp, Artificial Sequence
  Description of Artificial Sequence: Synthetic oligonucleotide
  Target: ATXN1; (+) strand; PAM type: YTN; PAM sequence: TTG
tgccactgcactttagcctg

SEQ ID NO: 279632 - DNA, 20 bp, Artificial Sequence
  Description of Artificial Sequence: Synthetic oligonucleotide
  Target: ATXN1; (+) strand; PAM type: YTN; PAM sequence: CTG
cactttagcctgggaaacag

SEQ ID NO: 279633 - DNA, 20 bp, Artificial Sequence
  Description of Artificial Sequence: Synthetic oligonucleotide
  Target: ATXN1; (+) strand; PAM type: YTN; PAM sequence: CTT
tagcctgggaaacagagtga

SEQ ID NO: 279634 - DNA, 20 bp, Artificial Sequence
  Description of Artificial Sequence: Synthetic oligonucleotide
  Target: ATXN1; (+) strand; PAM type: YTN; PAM sequence: TTT
agcctgggaaacagagtgaa

SEQ ID NO: 279635 - DNA, 20 bp, Artificial Sequence
  Description of Artificial Sequence: Synthetic oligonucleotide
  Target: ATXN1; (+) strand; PAM type: YTN; PAM sequence: TTA
gcctgggaaacagagtgaaa

SEQ ID NO: 279636 - DNA, 20 bp, Artificial Sequence
  Description of Artificial Sequence: Synthetic oligonucleotide
  Target: ATXN1; (+) strand; PAM type: YTN; PAM sequence: CTG
ggaaacagagtgaaacccca

SEQ ID NO: 279637 - DNA, 20 bp, Artificial Sequence
  Description of Artificial Sequence: Synthetic oligonucleotide
  Target: ATXN1; (+) strand; PAM type: YTN; PAM sequence: TTT
caaaaaaaaaaaaaaaaaaa

SEQ ID NO: 279638 - DNA, 20 bp, Artificial Sequence
  Description of Artificial Sequence: Synthetic oligonucleotide
  Target: ATXN1; (+) strand; PAM type: YTN; PAM sequence: TTC
aaaaaaaaaaaaaaaaaaaa

SEQ ID NO: 279639 - DNA, 20 bp, Artificial Sequence
  Description of Artificial Sequence: Synthetic oligonucleotide
  Target: ATXN1; (+) strand; PAM type: YTN; PAM sequence: CTA
cataaagaagaatgttaaat

SEQ ID NO: 279640 - DNA, 20 bp, Artificial Sequence
  Description of Artificial Sequence: Synthetic oligonucleotide
  Target: ATXN1; (+) strand; PAM type: YTN; PAM sequence: TTA
aatactactgagggacagag

SEQ ID NO: 279641 - DNA, 20 bp, Artificial Sequence
  Description of Artificial Sequence: Synthetic oligonucleotide
  Target: ATXN1; (+) strand; PAM type: YTN; PAM sequence: CTA
ctgagggacagaggaggaga

SEQ ID NO: 279642 - DNA, 20 bp, Artificial Sequence
  Description of Artificial Sequence: Synthetic oligonucleotide
  Target: ATXN1; (+) strand; PAM type: YTN; PAM sequence: CTG
agggacagaggaggagatag

SEQ ID NO: 279643 - DNA, 20 bp, Artificial Sequence
  Description of Artificial Sequence: Synthetic oligonucleotide
  Target: ATXN1; (+) strand; PAM type: YTN; PAM sequence: CTG
caaaggtctatcttcttctt

SEQ ID NO: 279644 - DNA, 20 bp, Artificial Sequence
  Description of Artificial Sequence: Synthetic oligonucleotide
  Target: ATXN1; (+) strand; PAM type: YTN; PAM sequence: CTA
tcttcttcttgaatagaaag

SEQ ID NO: 279645 - DNA, 20 bp, Artificial Sequence
  Description of Artificial Sequence: Synthetic oligonucleotide
  Target: ATXN1; (+) strand; PAM type: YTN; PAM sequence: CTT
cttcttgaatagaaagtcaa

SEQ ID NO: 279646 - DNA, 20 bp, Artificial Sequence
  Description of Artificial Sequence: Synthetic oligonucleotide
  Target: ATXN1; (+) strand; PAM type: YTN; PAM sequence: TTC
ttcttgaatagaaagtcaat

SEQ ID NO: 279647 - DNA, 20 bp, Artificial Sequence
  Description of Artificial Sequence: Synthetic oligonucleotide
  Target: ATXN1; (+) strand; PAM type: YTN; PAM sequence: CTT
cttgaatagaaagtcaatat

SEQ ID NO: 279648 - DNA, 20 bp, Artificial Sequence
  Description of Artificial Sequence: Synthetic oligonucleotide
  Target: ATXN1; (+) strand; PAM type: YTN; PAM sequence: TTC
ttgaatagaaagtcaatatc

SEQ ID NO: 279649 - DNA, 20 bp, Artificial Sequence
  Description of Artificial Sequence: Synthetic oligonucleotide
  Target: ATXN1; (+) strand; PAM type: YTN; PAM sequence: CTT
gaatagaaagtcaatatcaa

SEQ ID NO: 279650 - DNA, 20 bp, Artificial Sequence
  Description of Artificial Sequence: Synthetic oligonucleotide
  Target: ATXN1; (+) strand; PAM type: YTN; PAM sequence: TTG
aatagaaagtcaatatcaag

SEQ ID NO: 279651 - DNA, 20 bp, Artificial Sequence
  Description of Artificial Sequence: Synthetic oligonucleotide
  Target: ATXN1; (+) strand; PAM type: YTN; PAM sequence: TTC
tttctatatttatctataaa

SEQ ID NO: 279652 - DNA, 20 bp, Artificial Sequence
  Description of Artificial Sequence: Synthetic oligonucleotide
  Target: ATXN1; (+) strand; PAM type: YTN; PAM sequence: CTT
tctatatttatctataaact

SEQ ID NO: 279653 - DNA, 20 bp, Artificial Sequence
  Description of Artificial Sequence: Synthetic oligonucleotide
  Target: ATXN1; (+) strand; PAM type: YTN; PAM sequence: TTT
ctatatttatctataaactt

SEQ ID NO: 279654 - DNA, 20 bp, Artificial Sequence
  Description of Artificial Sequence: Synthetic oligonucleotide
  Target: ATXN1; (+) strand; PAM type: YTN; PAM sequence: TTC
tatatttatctataaactta

SEQ ID NO: 279655 - DNA, 20 bp, Artificial Sequence
  Description of Artificial Sequence: Synthetic oligonucleotide
  Target: ATXN1; (+) strand; PAM type: YTN; PAM sequence: CTA
tatttatctataaacttata

SEQ ID NO: 279656 - DNA, 20 bp, Artificial Sequence
  Description of Artificial Sequence: Synthetic oligonucleotide
  Target: ATXN1; (+) strand; PAM type: YTN; PAM sequence: TTT
atctataaacttatatgatg

SEQ ID NO: 279657 - DNA, 20 bp, Artificial Sequence
  Description of Artificial Sequence: Synthetic oligonucleotide
  Target: ATXN1; (+) strand; PAM type: YTN; PAM sequence: TTA
tctataaacttatatgatgt

SEQ ID NO: 279658 - DNA, 20 bp, Artificial Sequence
  Description of Artificial Sequence: Synthetic oligonucleotide
  Target: ATXN1; (+) strand; PAM type: YTN; PAM sequence: CTA
taaacttatatgatgtcaaa

SEQ ID NO: 279659 - DNA, 20 bp, Artificial Sequence
  Description of Artificial Sequence: Synthetic oligonucleotide
  Target: ATXN1; (+) strand; PAM type: YTN; PAM sequence: CTT
atatgatgtcaaaaatacaa

SEQ ID NO: 279660 - DNA, 20 bp, Artificial Sequence
  Description of Artificial Sequence: Synthetic oligonucleotide
  Target: ATXN1; (+) strand; PAM type: YTN; PAM sequence: TTA
tatgatgtcaaaaatacaaa

SEQ ID NO: 279661 - DNA, 20 bp, Artificial Sequence
  Description of Artificial Sequence: Synthetic oligonucleotide
  Target: ATXN1; (+) strand; PAM type: YTN; PAM sequence: TTA
gaaagctaattctgaagttc

SEQ ID NO: 279662 - DNA, 20 bp, Artificial Sequence
  Description of Artificial Sequence: Synthetic oligonucleotide
  Target: ATXN1; (+) strand; PAM type: YTN; PAM sequence: CTA
attctgaagttcctatggaa

SEQ ID NO: 279663 - DNA, 20 bp, Artificial Sequence
  Description of Artificial Sequence: Synthetic oligonucleotide
  Target: ATXN1; (+) strand; PAM type: YTN; PAM sequence: TTC
tgaagttcctatggaaaaat

SEQ ID NO: 279664 - DNA, 20 bp, Artificial Sequence
  Description of Artificial Sequence: Synthetic oligonucleotide
  Target: ATXN1; (+) strand; PAM type: YTN; PAM sequence: CTG
aagttcctatggaaaaataa

SEQ ID NO: 279665 - DNA, 20 bp, Artificial Sequence
  Description of Artificial Sequence: Synthetic oligonucleotide
  Target: ATXN1; (+) strand; PAM type: YTN; PAM sequence: TTC
ctatggaaaaataaacagga

SEQ ID NO: 279666 - DNA, 20 bp, Artificial Sequence
  Description of Artificial Sequence: Synthetic oligonucleotide
  Target: ATXN1; (+) strand; PAM type: YTN; PAM sequence: CTA
tggaaaaataaacaggaaag

SEQ ID NO: 279667 - DNA, 20 bp, Artificial Sequence
  Description of Artificial Sequence: Synthetic oligonucleotide
  Target: ATXN1; (+) strand; PAM type: YTN; PAM sequence: TTA
aaaatattataaagccttag

SEQ ID NO: 279668 - DNA, 20 bp, Artificial Sequence
  Description of Artificial Sequence: Synthetic oligonucleotide
  Target: ATXN1; (+) strand; PAM type: YTN; PAM sequence: TTA
taaagccttagaaagtaaaa

SEQ ID NO: 279669 - DNA, 20 bp, Artificial Sequence
  Description of Artificial Sequence: Synthetic oligonucleotide
  Target: ATXN1; (+) strand; PAM type: YTN; PAM sequence: CTT
agaaagtaaaacagtgtgca

SEQ ID NO: 279670 - DNA, 20 bp, Artificial Sequence
  Description of Artificial Sequence: Synthetic oligonucleotide
  Target: ATXN1; (+) strand; PAM type: YTN; PAM sequence: TTA
gaaagtaaaacagtgtgcat

SEQ ID NO: 279671 - DNA, 20 bp, Artificial Sequence
  Description of Artificial Sequence: Synthetic oligonucleotide
  Target: ATXN1; (+) strand; PAM type: YTN; PAM sequence: CTT
agcaaggtcaacagaaaaga

SEQ ID NO: 279672 - DNA, 20 bp, Artificial Sequence
  Description of Artificial Sequence: Synthetic oligonucleotide
  Target: ATXN1; (+) strand; PAM type: YTN; PAM sequence: TTA
gcaaggtcaacagaaaagag

SEQ ID NO: 279673 - DNA, 20 bp, Artificial Sequence
  Description of Artificial Sequence: Synthetic oligonucleotide
  Target: ATXN1; (+) strand; PAM type: YTN; PAM sequence: CTG
gacttcagtgaatgatatgg

SEQ ID NO: 279674 - DNA, 20 bp, Artificial Sequence
  Description of Artificial Sequence: Synthetic oligonucleotide
  Target: ATXN1; (+) strand; PAM type: YTN; PAM sequence: CTT
cagtgaatgatatgggtgtc

SEQ ID NO: 279675 - DNA, 20 bp, Artificial Sequence
  Description of Artificial Sequence: Synthetic oligonucleotide
  Target: ATXN1; (+) strand; PAM type: YTN; PAM sequence: TTC
agtgaatgatatgggtgtca

SEQ ID NO: 279676 - DNA, 20 bp, Artificial Sequence
  Description of Artificial Sequence: Synthetic oligonucleotide
  Target: ATXN1; (+) strand; PAM type: YTN; PAM sequence: CTG
cactttagtgggaggaagga

SEQ ID NO: 279677 - DNA, 20 bp, Artificial Sequence
  Description of Artificial Sequence: Synthetic oligonucleotide
  Target: ATXN1; (+) strand; PAM type: YTN; PAM sequence: CTT
tagtgggaggaaggacttcc

SEQ ID NO: 279678 - DNA, 20 bp, Artificial Sequence
  Description of Artificial Sequence: Synthetic oligonucleotide
  Target: ATXN1; (+) strand; PAM type: YTN; PAM sequence: TTT
agtgggaggaaggacttcca

SEQ ID NO: 279679 - DNA, 20 bp, Artificial Sequence
  Description of Artificial Sequence: Synthetic oligonucleotide
  Target: ATXN1; (+) strand; PAM type: YTN; PAM sequence: TTA
gtgggaggaaggacttccaa

SEQ ID NO: 279680 - DNA, 20 bp, Artificial Sequence
  Description of Artificial Sequence: Synthetic oligonucleotide
  Target: ATXN1; (+) strand; PAM type: YTN; PAM sequence: CTT
ccaataattggacggccacc

SEQ ID NO: 279681 - DNA, 20 bp, Artificial Sequence
  Description of Artificial Sequence: Synthetic oligonucleotide
  Target: ATXN1; (+) strand; PAM type: YTN; PAM sequence: TTC
caataattggacggccacct

SEQ ID NO: 279682 - DNA, 20 bp, Artificial Sequence
  Description of Artificial Sequence: Synthetic oligonucleotide
  Target: ATXN1; (+) strand; PAM type: YTN; PAM sequence: TTG
gacggccacctaaaaaaata

SEQ ID NO: 279683 - DNA, 20 bp, Artificial Sequence
  Description of Artificial Sequence: Synthetic oligonucleotide
  Target: ATXN1; (+) strand; PAM type: YTN; PAM sequence: CTA
aaaaaatatagatccctaat

SEQ ID NO: 279684 - DNA, 20 bp, Artificial Sequence
  Description of Artificial Sequence: Synthetic oligonucleotide
  Target: ATXN1; (+) strand; PAM type: YTN; PAM sequence: CTA
attcacatcctgcactaaaa

SEQ ID NO: 279685 - DNA, 20 bp, Artificial Sequence
  Description of Artificial Sequence: Synthetic oligonucleotide
  Target: ATXN1; (+) strand; PAM type: YTN; PAM sequence: TTC
acatcctgcactaaaataaa

SEQ ID NO: 279686 - DNA, 20 bp, Artificial Sequence
  Description of Artificial Sequence: Synthetic oligonucleotide
  Target: ATXN1; (+) strand; PAM type: YTN; PAM sequence: CTG
cactaaaataaatcccaagg

SEQ ID NO: 279687 - DNA, 20 bp, Artificial Sequence
  Description of Artificial Sequence: Synthetic oligonucleotide
  Target: ATXN1; (+) strand; PAM type: YTN; PAM sequence: CTA
aaataaatcccaaggtgacc

SEQ ID NO: 279688 - DNA, 20 bp, Artificial Sequence
  Description of Artificial Sequence: Synthetic oligonucleotide
  Target: ATXN1; (+) strand; PAM type: YTN; PAM sequence: TTT
gaacgtaaaaaatgaaagca

SEQ ID NO: 279689 - DNA, 20 bp, Artificial Sequence
  Description of Artificial Sequence: Synthetic oligonucleotide
  Target: ATXN1; (+) strand; PAM type: YTN; PAM sequence: TTG
aacgtaaaaaatgaaagcat

SEQ ID NO: 279690 - DNA, 20 bp, Artificial Sequence
  Description of Artificial Sequence: Synthetic oligonucleotide
  Target: ATXN1; (+) strand; PAM type: YTN; PAM sequence: CTT
gaaaacattacgctaagtgg

SEQ ID NO: 279691 - DNA, 20 bp, Artificial Sequence
  Description of Artificial Sequence: Synthetic oligonucleotide
  Target: ATXN1; (+) strand; PAM type: YTN; PAM sequence: TTG
aaaacattacgctaagtgga

SEQ ID NO: 279692 - DNA, 20 bp, Artificial Sequence
  Description of Artificial Sequence: Synthetic oligonucleotide
  Target: ATXN1; (+) strand; PAM type: YTN; PAM sequence: TTA
cgctaagtggaaaagtcagt

SEQ ID NO: 279693 - DNA, 20 bp, Artificial Sequence
  Description of Artificial Sequence: Synthetic oligonucleotide
  Target: ATXN1; (+) strand; PAM type: YTN; PAM sequence: CTA
agtggaaaagtcagttgtgt

SEQ ID NO: 279694 - DNA, 20 bp, Artificial Sequence
  Description of Artificial Sequence: Synthetic oligonucleotide
  Target: ATXN1; (+) strand; PAM type: YTN; PAM sequence: TTG
tgtaaggccacacattatat

SEQ ID NO: 279695 - DNA, 20 bp, Artificial Sequence
  Description of Artificial Sequence: Synthetic oligonucleotide
  Target: ATXN1; (+) strand; PAM type: YTN; PAM sequence: TTA
tatggttccatttatatgag

SEQ ID NO: 279696 - DNA, 20 bp, Artificial Sequence
  Description of Artificial Sequence: Synthetic oligonucleotide
  Target: ATXN1; (+) strand; PAM type: YTN; PAM sequence: TTC
catttatatgagatgtctag

SEQ ID NO: 279697 - DNA, 20 bp, Artificial Sequence
  Description of Artificial Sequence: Synthetic oligonucleotide
  Target: ATXN1; (+) strand; PAM type: YTN; PAM sequence: TTT
atatgagatgtctaggacag

SEQ ID NO: 279698 - DNA, 20 bp, Artificial Sequence
  Description of Artificial Sequence: Synthetic oligonucleotide
  Target: ATXN1; (+) strand; PAM type: YTN; PAM sequence: TTA
tatgagatgtctaggacagg

SEQ ID NO: 279699 - DNA, 20 bp, Artificial Sequence
  Description of Artificial Sequence: Synthetic oligonucleotide
  Target: ATXN1; (+) strand; PAM type: YTN; PAM sequence: CTA
ggacaggcaaatccatagag

SEQ ID NO: 279700 - DNA, 20 bp, Artificial Sequence
  Description of Artificial Sequence: Synthetic oligonucleotide
  Target: ATXN1; (+) strand; PAM type: YTN; PAM sequence: TTA
agtggataccaggggccaga

SEQ ID NO: 279701 - DNA, 20 bp, Artificial Sequence
  Description of Artificial Sequence: Synthetic oligonucleotide
  Target: ATXN1; (+) strand; PAM type: YTN; PAM sequence: CTT
aatgggtaaaggttttcttt

SEQ ID NO: 279702 - DNA, 20 bp, Artificial Sequence
  Description of Artificial Sequence: Synthetic oligonucleotide
  Target: ATXN1; (+) strand; PAM type: YTN; PAM sequence: TTA
atgggtaaaggttttctttt

SEQ ID NO: 279703 - DNA, 20 bp, Artificial Sequence
  Description of Artificial Sequence: Synthetic oligonucleotide
  Target: ATXN1; (+) strand; PAM type: YTN; PAM sequence: TTT
tctttttggagtaatgaaaa

SEQ ID NO: 279704 - DNA, 20 bp, Artificial Sequence
  Description of Artificial Sequence: Synthetic oligonucleotide
  Target: ATXN1; (+) strand; PAM type: YTN; PAM sequence: TTT
ctttttggagtaatgaaaat

SEQ ID NO: 279705 - DNA, 20 bp, Artificial Sequence
  Description of Artificial Sequence: Synthetic oligonucleotide
  Target: ATXN1; (+) strand; PAM type: YTN; PAM sequence: TTC
tttttggagtaatgaaaatg

SEQ ID NO: 279706 - DNA, 20 bp, Artificial Sequence
  Description of Artificial Sequence: Synthetic oligonucleotide
  Target: ATXN1; (+) strand; PAM type: YTN; PAM sequence: CTT
tttggagtaatgaaaatgta

SEQ ID NO: 279707 - DNA, 20 bp, Artificial Sequence
  Description of Artificial Sequence: Synthetic oligonucleotide
  Target: ATXN1; (+) strand; PAM type: YTN; PAM sequence: TTT
ttggagtaatgaaaatgtaa

SEQ ID NO: 279708 - DNA, 20 bp, Artificial Sequence
  Description of Artificial Sequence: Synthetic oligonucleotide
  Target: ATXN1; (+) strand; PAM type: YTN; PAM sequence: TTT
tggagtaatgaaaatgtaaa

SEQ ID NO: 279709 - DNA, 20 bp, Artificial Sequence
  Description of Artificial Sequence: Synthetic oligonucleotide
  Target: ATXN1; (+) strand; PAM type: YTN; PAM sequence: TTT
ggagtaatgaaaatgtaaaa

SEQ ID NO: 279710 - DNA, 20 bp, Artificial Sequence
  Description of Artificial Sequence: Synthetic oligonucleotide
  Target: ATXN1; (+) strand; PAM type: YTN; PAM sequence: TTG
gagtaatgaaaatgtaaaat

SEQ ID NO: 279711 - DNA, 20 bp, Artificial Sequence
  Description of Artificial Sequence: Synthetic oligonucleotide
  Target: ATXN1; (+) strand; PAM type: YTN; PAM sequence: TTA
ggttttgatgatgattgtat

SEQ ID NO: 279712 - DNA, 20 bp, Artificial Sequence
  Description of Artificial Sequence: Synthetic oligonucleotide
  Target: ATXN1; (+) strand; PAM type: YTN; PAM sequence: TTT
tgatgatgattgtataattc

SEQ ID NO: 279713 - DNA, 20 bp, Artificial Sequence
  Description of Artificial Sequence: Synthetic oligonucleotide
  Target: ATXN1; (+) strand; PAM type: YTN; PAM sequence: TTT
gatgatgattgtataattct

SEQ ID NO: 279714 - DNA, 20 bp, Artificial Sequence
  Description of Artificial Sequence: Synthetic oligonucleotide
  Target: ATXN1; (+) strand; PAM type: YTN; PAM sequence: TTG
atgatgattgtataattcta

SEQ ID NO: 279715 - DNA, 20 bp, Artificial Sequence
  Description of Artificial Sequence: Synthetic oligonucleotide
  Target: ATXN1; (+) strand; PAM type: YTN; PAM sequence: TTG
tataattctatgaatagatt

SEQ ID NO: 279716 - DNA, 20 bp, Artificial Sequence
  Description of Artificial Sequence: Synthetic oligonucleotide
  Target: ATXN1; (+) strand; PAM type: YTN; PAM sequence: TTC
tatgaatagattaaaaaccc

SEQ ID NO: 279717 - DNA, 20 bp, Artificial Sequence
  Description of Artificial Sequence: Synthetic oligonucleotide
  Target: ATXN1; (+) strand; PAM type: YTN; PAM sequence: CTA
tgaatagattaaaaacccat

SEQ ID NO: 279718 - DNA, 20 bp, Artificial Sequence
  Description of Artificial Sequence: Synthetic oligonucleotide
  Target: ATXN1; (+) strand; PAM type: YTN; PAM sequence: TTA
aaaacccatttattaaaaga

SEQ ID NO: 279719 - DNA, 20 bp, Artificial Sequence
  Description of Artificial Sequence: Synthetic oligonucleotide
  Target: ATXN1; (+) strand; PAM type: YTN; PAM sequence: TTT
attaaaagactgcattgtgg

SEQ ID NO: 279720 - DNA, 20 bp, Artificial Sequence
  Description of Artificial Sequence: Synthetic oligonucleotide
  Target: ATXN1; (+) strand; PAM type: YTN; PAM sequence: TTA
ttaaaagactgcattgtggc

SEQ ID NO: 279721 - DNA, 20 bp, Artificial Sequence
  Description of Artificial Sequence: Synthetic oligonucleotide
  Target: ATXN1; (+) strand; PAM type: YTN; PAM sequence: TTA
aaagactgcattgtggctgg

SEQ ID NO: 279722 - DNA, 20 bp, Artificial Sequence
  Description of Artificial Sequence: Synthetic oligonucleotide
  Target: ATXN1; (+) strand; PAM type: YTN; PAM sequence: CTG
cattgtggctgggcacagtg

SEQ ID NO: 279723 - DNA, 20 bp, Artificial Sequence
  Description of Artificial Sequence: Synthetic oligonucleotide
  Target: ATXN1; (+) strand; PAM type: YTN; PAM sequence: TTG
tggctgggcacagtggctca

SEQ ID NO: 279724 - DNA, 20 bp, Artificial Sequence
  Description of Artificial Sequence: Synthetic oligonucleotide
  Target: ATXN1; (+) strand; PAM type: YTN; PAM sequence: CTG
ggcacagtggctcacacctg

SEQ ID NO: 279725 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcctagcact

SEQ ID NO: 279726 - DNA, 20 bp, Artificial Sequence
  Description of Artificial Sequence: Synthetic oligonucleotide
  Target: ATXN1; (+) strand; PAM type: YTN; PAM sequence: CTG
taatcctagcactttagaag

SEQ ID NO: 279727 - DNA, 20 bp, Artificial Sequence
  Description of Artificial Sequence: Synthetic oligonucleotide
  Target: ATXN1; (+) strand; PAM type: YTN; PAM sequence: CTA
gcactttagaaggctaaggc

SEQ ID NO: 279728 - DNA, 20 bp, Artificial Sequence
  Description of Artificial Sequence: Synthetic oligonucleotide
  Target: ATXN1; (+) strand; PAM type: YTN; PAM sequence: CTT
tagaaggctaaggcaggagg

SEQ ID NO: 279729 - DNA, 20 bp, Artificial Sequence
  Description of Artificial Sequence: Synthetic oligonucleotide
  Target: ATXN1; (+) strand; PAM type: YTN; PAM sequence: TTT
agaaggctaaggcaggaggc

SEQ ID NO: 279730 - DNA, 20 bp, Artificial Sequence
  Description of Artificial Sequence: Synthetic oligonucleotide
  Target: ATXN1; (+) strand; PAM type: YTN; PAM sequence: TTA
gaaggctaaggcaggaggct

SEQ ID NO: 279731 - DNA, 20 bp, Artificial Sequence
  Description of Artificial Sequence: Synthetic oligonucleotide
  Target: ATXN1; (+) strand; PAM type: YTN; PAM sequence: CTA
aggcaggaggctgcttgagc

SEQ ID NO: 279732 - DNA, 20 bp, Artificial Sequence
  Description of Artificial Sequence: Synthetic oligonucleotide
  Target: ATXN1; (+) strand; PAM type: YTN; PAM sequence: CTG
cttgagcccaggagttccag

SEQ ID NO: 279733 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagttccaggtt

SEQ ID NO: 279734 - DNA, 20 bp, Artificial Sequence
  Description of Artificial Sequence: Synthetic oligonucleotide
  Target: ATXN1; (+) strand; PAM type: YTN; PAM sequence: TTG
agcccaggagttccaggttg

SEQ ID NO: 279735 - DNA, 20 bp, Artificial Sequence
  Description of Artificial Sequence: Synthetic oligonucleotide
  Target: ATXN1; (+) strand; PAM type: YTN; PAM sequence: TTC
caggttgcagtaagctgtga

SEQ ID NO: 279736 - DNA, 20 bp, Artificial Sequence
  Description of Artificial Sequence: Synthetic oligonucleotide
  Target: ATXN1; (+) strand; PAM type: YTN; PAM sequence: TTG
cagtaagctgtgactgcacc

SEQ ID NO: 279737 - DNA, 20 bp, Artificial Sequence
  Description of Artificial Sequence: Synthetic oligonucleotide
  Target: ATXN1; (+) strand; PAM type: YTN; PAM sequence: CTG
tgactgcaccactgcactcc

SEQ ID NO: 279738 - DNA, 20 bp, Artificial Sequence
  Description of Artificial Sequence: Synthetic oligonucleotide
  Target: ATXN1; (+) strand; PAM type: YTN; PAM sequence: CTG
caccactgcactccagcctg

SEQ ID NO: 279739 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 279740 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagcga

SEQ ID NO: 279741 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcgagatcctg

SEQ ID NO: 279742 - DNA, 20 bp, Artificial Sequence
  Description of Artificial Sequence: Synthetic oligonucleotide
  Target: ATXN1; (+) strand; PAM type: YTN; PAM sequence: CTG
tgtcaaaaaaaaaaaaaaaa

SEQ ID NO: 279743 - DNA, 20 bp, Artificial Sequence
  Description of Artificial Sequence: Synthetic oligonucleotide
  Target: ATXN1; (+) strand; PAM type: YTN; PAM sequence: TTT
tacgatatatgaatcatatc

SEQ ID NO: 279744 - DNA, 20 bp, Artificial Sequence
  Description of Artificial Sequence: Synthetic oligonucleotide
  Target: ATXN1; (+) strand; PAM type: YTN; PAM sequence: TTT
acgatatatgaatcatatct

SEQ ID NO: 279745 - DNA, 20 bp, Artificial Sequence
  Description of Artificial Sequence: Synthetic oligonucleotide
  Target: ATXN1; (+) strand; PAM type: YTN; PAM sequence: TTA
cgatatatgaatcatatctc

SEQ ID NO: 279746 - DNA, 20 bp, Artificial Sequence
  Description of Artificial Sequence: Synthetic oligonucleotide
  Target: ATXN1; (+) strand; PAM type: YTN; PAM sequence: CTC
aataaaacctttttaatttt

SEQ ID NO: 279747 - DNA, 20 bp, Artificial Sequence
  Description of Artificial Sequence: Synthetic oligonucleotide
  Target: ATXN1; (+) strand; PAM type: YTN; PAM sequence: CTT
tttaatttttattttctttt

SEQ ID NO: 279748 - DNA, 20 bp, Artificial Sequence
  Description of Artificial Sequence: Synthetic oligonucleotide
  Target: ATXN1; (+) strand; PAM type: YTN; PAM sequence: TTT
ttaatttttattttctttta

SEQ ID NO: 279749 - DNA, 20 bp, Artificial Sequence
  Description of Artificial Sequence: Synthetic oligonucleotide
  Target: ATXN1; (+) strand; PAM type: YTN; PAM sequence: TTT
taatttttattttcttttag

SEQ ID NO: 279750 - DNA, 20 bp, Artificial Sequence
  Description of Artificial Sequence: Synthetic oligonucleotide
  Target: ATXN1; (+) strand; PAM type: YTN; PAM sequence: TTT
aatttttattttcttttaga

SEQ ID NO: 279751 - DNA, 20 bp, Artificial Sequence
  Description of Artificial Sequence: Synthetic oligonucleotide
  Target: ATXN1; (+) strand; PAM type: YTN; PAM sequence: TTA
atttttattttcttttagag

SEQ ID NO: 279752 - DNA, 20 bp, Artificial Sequence
  Description of Artificial Sequence: Synthetic oligonucleotide
  Target: ATXN1; (+) strand; PAM type: YTN; PAM sequence: TTT
ttattttcttttagagacag

SEQ ID NO: 279753 - DNA, 20 bp, Artificial Sequence
  Description of Artificial Sequence: Synthetic oligonucleotide
  Target: ATXN1; (+) strand; PAM type: YTN; PAM sequence: TTT
tattttcttttagagacagg

SEQ ID NO: 279754 - DNA, 20 bp, Artificial Sequence
  Description of Artificial Sequence: Synthetic oligonucleotide
  Target: ATXN1; (+) strand; PAM type: YTN; PAM sequence: TTT
attttcttttagagacaggg

SEQ ID NO: 279755 - DNA, 20 bp, Artificial Sequence
  Description of Artificial Sequence: Synthetic oligonucleotide
  Target: ATXN1; (+) strand; PAM type: YTN; PAM sequence: TTA
ttttcttttagagacagggt

SEQ ID NO: 279756 - DNA, 20 bp, Artificial Sequence
  Description of Artificial Sequence: Synthetic oligonucleotide
  Target: ATXN1; (+) strand; PAM type: YTN; PAM sequence: TTT
tcttttagagacagggtctc

SEQ ID NO: 279757 - DNA, 20 bp, Artificial Sequence
  Description of Artificial Sequence: Synthetic oligonucleotide
  Target: ATXN1; (+) strand; PAM type: YTN; PAM sequence: TTT
cttttagagacagggtctca

SEQ ID NO: 279758 - DNA, 20 bp, Artificial Sequence
  Description of Artificial Sequence: Synthetic oligonucleotide
  Target: ATXN1; (+) strand; PAM type: YTN; PAM sequence: TTC
ttttagagacagggtctcac

SEQ ID NO: 279759 - DNA, 20 bp, Artificial Sequence
  Description of Artificial Sequence: Synthetic oligonucleotide
  Target: ATXN1; (+) strand; PAM type: YTN; PAM sequence: CTT
ttagagacagggtctcactc

SEQ ID NO: 279760 - DNA, 20 bp, Artificial Sequence
  Description of Artificial Sequence: Synthetic oligonucleotide
  Target: ATXN1; (+) strand; PAM type: YTN; PAM sequence: TTT
tagagacagggtctcactct

SEQ ID NO: 279761 - DNA, 20 bp, Artificial Sequence
  Description of Artificial Sequence: Synthetic oligonucleotide
  Target: ATXN1; (+) strand; PAM type: YTN; PAM sequence: TTT
agagacagggtctcactctg

SEQ ID NO: 279762 - DNA, 20 bp, Artificial Sequence
  Description of Artificial Sequence: Synthetic oligonucleotide
  Target: ATXN1; (+) strand; PAM type: YTN; PAM sequence: TTA
gagacagggtctcactctgt

SEQ ID NO: 279763 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 279764 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgt

SEQ ID NO: 279765 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgtag

SEQ ID NO: 279766 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtagcacgaccat

SEQ ID NO: 279767 - DNA, 20 bp, Artificial Sequence
  Description of Artificial Sequence: Synthetic oligonucleotide
  Target: ATXN1; (+) strand; PAM type: YTN; PAM sequence: CTC
actgcagtctcaaactcctg

SEQ ID NO: 279768 - DNA, 20 bp, Artificial Sequence
  Description of Artificial Sequence: Synthetic oligonucleotide
  Target: ATXN1; (+) strand; PAM type: YTN; PAM sequence: CTG
cagtctcaaactcctgggct

SEQ ID NO: 279769 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggctcaaacaa

SEQ ID NO: 279770 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaaacaatccttc

SEQ ID NO: 279771 - DNA, 20 bp, Artificial Sequence
  Description of Artificial Sequence: Synthetic oligonucleotide
  Target: ATXN1; (+) strand; PAM type: YTN; PAM sequence: CTG
ggctcaaacaatccttccac

SEQ ID NO: 279772 - DNA, 20 bp, Artificial Sequence
  Description of Artificial Sequence: Synthetic oligonucleotide
  Target: ATXN1; (+) strand; PAM type: YTN; PAM sequence: CTC
aaacaatccttccacctcag

SEQ ID NO: 279773 - DNA, 20 bp, Artificial Sequence
  Description of Artificial Sequence: Synthetic oligonucleotide
  Target: ATXN1; (+) strand; PAM type: YTN; PAM sequence: CTT
ccacctcagcctcccgagta

SEQ ID NO: 279774 - DNA, 20 bp, Artificial Sequence
  Description of Artificial Sequence: Synthetic oligonucleotide
  Target: ATXN1; (+) strand; PAM type: YTN; PAM sequence: TTC
cacctcagcctcccgagtac

SEQ ID NO: 279775 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtacaaacag

SEQ ID NO: 279776 - DNA, 20 bp, Artificial Sequence
  Description of Artificial Sequence: Synthetic oligonucleotide
  Target: ATXN1; (+) strand; PAM type: YTN; PAM sequence: CTC
ccgagtacaaacaggcgtgc

SEQ ID NO: 279777 - DNA, 20 bp, Artificial Sequence
  Description of Artificial Sequence: Synthetic oligonucleotide
  Target: ATXN1; (+) strand; PAM type: YTN; PAM sequence: TTT
ggctatttattattattatt

SEQ ID NO: 279778 - DNA, 20 bp, Artificial Sequence
  Description of Artificial Sequence: Synthetic oligonucleotide
  Target: ATXN1; (+) strand; PAM type: YTN; PAM sequence: TTG
gctatttattattattatta

SEQ ID NO: 279779 - DNA, 20 bp, Artificial Sequence
  Description of Artificial Sequence: Synthetic oligonucleotide
  Target: ATXN1; (+) strand; PAM type: YTN; PAM sequence: CTA
tttattattattattatgta

SEQ ID NO: 279780 - DNA, 20 bp, Artificial Sequence
  Description of Artificial Sequence: Synthetic oligonucleotide
  Target: ATXN1; (+) strand; PAM type: YTN; PAM sequence: TTT
attattattattatgtaaaa

SEQ ID NO: 279781 - DNA, 20 bp, Artificial Sequence
  Description of Artificial Sequence: Synthetic oligonucleotide
  Target: ATXN1; (+) strand; PAM type: YTN; PAM sequence: TTA
ttattattattatgtaaaaa

SEQ ID NO: 279782 - DNA, 20 bp, Artificial Sequence
  Description of Artificial Sequence: Synthetic oligonucleotide
  Target: ATXN1; (+) strand; PAM type: YTN; PAM sequence: TTA
ttattattatgtaaaaacag

SEQ ID NO: 279783 - DNA, 20 bp, Artificial Sequence
  Description of Artificial Sequence: Synthetic oligonucleotide
  Target: ATXN1; (+) strand; PAM type: YTN; PAM sequence: TTA
ttattatgtaaaaacagggt

SEQ ID NO: 279784 - DNA, 20 bp, Artificial Sequence
  Description of Artificial Sequence: Synthetic oligonucleotide
  Target: ATXN1; (+) strand; PAM type: YTN; PAM sequence: TTA
ttatgtaaaaacagggtctc

SEQ ID NO: 279785 - DNA, 20 bp, Artificial Sequence
  Description of Artificial Sequence: Synthetic oligonucleotide
  Target: ATXN1; (+) strand; PAM type: YTN; PAM sequence: TTA
tgtaaaaacagggtctccct

SEQ ID NO: 279786 - DNA, 20 bp, Artificial Sequence
  Description of Artificial Sequence: Synthetic oligonucleotide
  Target: ATXN1; (+) strand; PAM type: YTN; PAM sequence: CTC
cctgtgttgtccagactggt

SEQ ID NO: 279787 - DNA, 20 bp, Artificial Sequence
  Description of Artificial Sequence: Synthetic oligonucleotide
  Target: ATXN1; (+) strand; PAM type: YTN; PAM sequence: CTG
tgttgtccagactggtctct

SEQ ID NO: 279788 - DNA, 20 bp, Artificial Sequence
  Description of Artificial Sequence: Synthetic oligonucleotide
  Target: ATXN1; (+) strand; PAM type: YTN; PAM sequence: TTG
tccagactggtctctaactc

SEQ ID NO: 279789 - DNA, 20 bp, Artificial Sequence
  Description of Artificial Sequence: Synthetic oligonucleotide
  Target: ATXN1; (+) strand; PAM type: YTN; PAM sequence: CTG
gtctctaactcctggcctca

SEQ ID NO: 279790 - DNA, 20 bp, Artificial Sequence
  Description of Artificial Sequence: Synthetic oligonucleotide
  Target: ATXN1; (+) strand; PAM type: YTN; PAM sequence: CTC
taactcctggcctcaagtga

SEQ ID NO: 279791 - DNA, 20 bp, Artificial Sequence
  Description of Artificial Sequence: Synthetic oligonucleotide
  Target: ATXN1; (+) strand; PAM type: YTN; PAM sequence: CTA
actcctggcctcaagtgatg

SEQ ID NO: 279792 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagtgatgctct

SEQ ID NO: 279793 - DNA, 20 bp, Artificial Sequence
  Description of Artificial Sequence: Synthetic oligonucleotide
  Target: ATXN1; (+) strand; PAM type: YTN; PAM sequence: CTG
gcctcaagtgatgctctcgc

SEQ ID NO: 279794 - DNA, 20 bp, Artificial Sequence
  Description of Artificial Sequence: Synthetic oligonucleotide
  Target: ATXN1; (+) strand; PAM type: YTN; PAM sequence: CTC
aagtgatgctctcgccttgg

SEQ ID NO: 279795 - DNA, 20 bp, Artificial Sequence
  Description of Artificial Sequence: Synthetic oligonucleotide
  Target: ATXN1; (+) strand; PAM type: YTN; PAM sequence: CTC
tcgccttggcctcccaaagt

SEQ ID NO: 279796 - DNA, 20 bp, Artificial Sequence
  Description of Artificial Sequence: Synthetic oligonucleotide
  Target: ATXN1; (+) strand; PAM type: YTN; PAM sequence: CTC
gccttggcctcccaaagtgc

SEQ ID NO: 279797 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagtgctggga

SEQ ID NO: 279798 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctgggat

SEQ ID NO: 279799 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 279800 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgaaccat

SEQ ID NO: 279801 - DNA, 20 bp, Artificial Sequence
  Description of Artificial Sequence: Synthetic oligonucleotide
  Target: ATXN1; (+) strand; PAM type: YTN; PAM sequence: TTA
caggcatgaaccattgtgcc

SEQ ID NO: 279802 - DNA, 20 bp, Artificial Sequence
  Description of Artificial Sequence: Synthetic oligonucleotide
  Target: ATXN1; (+) strand; PAM type: YTN; PAM sequence: TTG
tgcctggccaaaactattat

SEQ ID NO: 279803 - DNA, 20 bp, Artificial Sequence
  Description of Artificial Sequence: Synthetic oligonucleotide
  Target: ATXN1; (+) strand; PAM type: YTN; PAM sequence: CTG
gccaaaactattatttttaa

SEQ ID NO: 279804 - DNA, 20 bp, Artificial Sequence
  Description of Artificial Sequence: Synthetic oligonucleotide
  Target: ATXN1; (+) strand; PAM type: YTN; PAM sequence: CTA
ttatttttaaaatactaata

SEQ ID NO: 279805 - DNA, 20 bp, Artificial Sequence
  Description of Artificial Sequence: Synthetic oligonucleotide
  Target: ATXN1; (+) strand; PAM type: YTN; PAM sequence: TTA
tttttaaaatactaataaaa

SEQ ID NO: 279806 - DNA, 20 bp, Artificial Sequence
  Description of Artificial Sequence: Synthetic oligonucleotide
  Target: ATXN1; (+) strand; PAM type: YTN; PAM sequence: TTT
ttaaaatactaataaaaaat

SEQ ID NO: 279807 - DNA, 20 bp, Artificial Sequence
  Description of Artificial Sequence: Synthetic oligonucleotide
  Target: ATXN1; (+) strand; PAM type: YTN; PAM sequence: TTT
taaaatactaataaaaaata

SEQ ID NO: 279808 - DNA, 20 bp, Artificial Sequence
  Description of Artificial Sequence: Synthetic oligonucleotide
  Target: ATXN1; (+) strand; PAM type: YTN; PAM sequence: TTT
aaaatactaataaaaaatac

SEQ ID NO: 279809 - DNA, 20 bp, Artificial Sequence
  Description of Artificial Sequence: Synthetic oligonucleotide
  Target: ATXN1; (+) strand; PAM type: YTN; PAM sequence: TTA
aaatactaataaaaaatacg

SEQ ID NO: 279810 - DNA, 20 bp, Artificial Sequence
  Description of Artificial Sequence: Synthetic oligonucleotide
  Target: ATXN1; (+) strand; PAM type: YTN; PAM sequence: CTA
ataaaaaatacgagacaatt

SEQ ID NO: 279811 - DNA, 20 bp, Artificial Sequence
  Description of Artificial Sequence: Synthetic oligonucleotide
  Target: ATXN1; (+) strand; PAM type: YTN; PAM sequence: TTT
aaaaattataattactgcgt

SEQ ID NO: 279812 - DNA, 20 bp, Artificial Sequence
  Description of Artificial Sequence: Synthetic oligonucleotide
  Target: ATXN1; (+) strand; PAM type: YTN; PAM sequence: TTA
aaaattataattactgcgta

SEQ ID NO: 279813 - DNA, 20 bp, Artificial Sequence
  Description of Artificial Sequence: Synthetic oligonucleotide
  Target: ATXN1; (+) strand; PAM type: YTN; PAM sequence: TTA
taattactgcgtagaagaga

SEQ ID NO: 279814 - DNA, 20 bp, Artificial Sequence
  Description of Artificial Sequence: Synthetic oligonucleotide
  Target: ATXN1; (+) strand; PAM type: YTN; PAM sequence: TTA
ctgcgtagaagagacctaag

SEQ ID NO: 279815 - DNA, 20 bp, Artificial Sequence
  Description of Artificial Sequence: Synthetic oligonucleotide
  Target: ATXN1; (+) strand; PAM type: YTN; PAM sequence: CTG
cgtagaagagacctaagtat

SEQ ID NO: 279816 - DNA, 20 bp, Artificial Sequence
  Description of Artificial Sequence: Synthetic oligonucleotide
  Target: ATXN1; (+) strand; PAM type: YTN; PAM sequence: CTA
agtatgtaaaaaaattaaaa

SEQ ID NO: 279817 - DNA, 20 bp, Artificial Sequence
  Description of Artificial Sequence: Synthetic oligonucleotide
  Target: ATXN1; (+) strand; PAM type: YTN; PAM sequence: TTA
aaagccaaaaaataaaaatc

SEQ ID NO: 279818 - DNA, 20 bp, Artificial Sequence
  Description of Artificial Sequence: Synthetic oligonucleotide
  Target: ATXN1; (+) strand; PAM type: YTN; PAM sequence: CTG
ataaataagatgactttaat

SEQ ID NO: 279819 - DNA, 20 bp, Artificial Sequence
  Description of Artificial Sequence: Synthetic oligonucleotide
  Target: ATXN1; (+) strand; PAM type: YTN; PAM sequence: CTT
taattttttaaaaccctgca

SEQ ID NO: 279820 - DNA, 20 bp, Artificial Sequence
  Description of Artificial Sequence: Synthetic oligonucleotide
  Target: ATXN1; (+) strand; PAM type: YTN; PAM sequence: TTT
aattttttaaaaccctgcat

SEQ ID NO: 279821 - DNA, 20 bp, Artificial Sequence
  Description of Artificial Sequence: Synthetic oligonucleotide
  Target: ATXN1; (+) strand; PAM type: YTN; PAM sequence: TTA
attttttaaaaccctgcatg

SEQ ID NO: 279822 - DNA, 20 bp, Artificial Sequence
  Description of Artificial Sequence: Synthetic oligonucleotide
  Target: ATXN1; (+) strand; PAM type: YTN; PAM sequence: TTT
tttaaaaccctgcatgaaga

SEQ ID NO: 279823 - DNA, 20 bp, Artificial Sequence
  Description of Artificial Sequence: Synthetic oligonucleotide
  Target: ATXN1; (+) strand; PAM type: YTN; PAM sequence: TTT
ttaaaaccctgcatgaagaa

SEQ ID NO: 279824 - DNA, 20 bp, Artificial Sequence
  Description of Artificial Sequence: Synthetic oligonucleotide
  Target: ATXN1; (+) strand; PAM type: YTN; PAM sequence: TTT
taaaaccctgcatgaagaaa

SEQ ID NO: 279825 - DNA, 20 bp, Artificial Sequence
  Description of Artificial Sequence: Synthetic oligonucleotide
  Target: ATXN1; (+) strand; PAM type: YTN; PAM sequence: TTT
aaaaccctgcatgaagaaaa

SEQ ID NO: 279826 - DNA, 20 bp, Artificial Sequence
  Description of Artificial Sequence: Synthetic oligonucleotide
  Target: ATXN1; (+) strand; PAM type: YTN; PAM sequence: TTA
aaaccctgcatgaagaaaac

SEQ ID NO: 279827 - DNA, 20 bp, Artificial Sequence
  Description of Artificial Sequence: Synthetic oligonucleotide
  Target: ATXN1; (+) strand; PAM type: YTN; PAM sequence: CTG
catgaagaaaacataaagtc

SEQ ID NO: 279828 - DNA, 20 bp, Artificial Sequence
  Description of Artificial Sequence: Synthetic oligonucleotide
  Target: ATXN1; (+) strand; PAM type: YTN; PAM sequence: TTT
aaactaaaatagcataagac

SEQ ID NO: 279829 - DNA, 20 bp, Artificial Sequence
  Description of Artificial Sequence: Synthetic oligonucleotide
  Target: ATXN1; (+) strand; PAM type: YTN; PAM sequence: TTA
aactaaaatagcataagaca

SEQ ID NO: 279830 - DNA, 20 bp, Artificial Sequence
  Description of Artificial Sequence: Synthetic oligonucleotide
  Target: ATXN1; (+) strand; PAM type: YTN; PAM sequence: CTA
aaatagcataagacaaaagg

SEQ ID NO: 279831 - DNA, 20 bp, Artificial Sequence
  Description of Artificial Sequence: Synthetic oligonucleotide
  Target: ATXN1; (+) strand; PAM type: YTN; PAM sequence: CTA
atctttttagctgttacatg

SEQ ID NO: 279832 - DNA, 20 bp, Artificial Sequence
  Description of Artificial Sequence: Synthetic oligonucleotide
  Target: ATXN1; (+) strand; PAM type: YTN; PAM sequence: CTT
tttagctgttacatgctcct

SEQ ID NO: 279833 - DNA, 20 bp, Artificial Sequence
  Description of Artificial Sequence: Synthetic oligonucleotide
  Target: ATXN1; (+) strand; PAM type: YTN; PAM sequence: TTT
ttagctgttacatgctccta

SEQ ID NO: 279834 - DNA, 20 bp, Artificial Sequence
  Description of Artificial Sequence: Synthetic oligonucleotide
  Target: ATXN1; (+) strand; PAM type: YTN; PAM sequence: TTT
tagctgttacatgctcctaa

SEQ ID NO: 279835 - DNA, 20 bp, Artificial Sequence
  Description of Artificial Sequence: Synthetic oligonucleotide
  Target: ATXN1; (+) strand; PAM type: YTN; PAM sequence: TTT
agctgttacatgctcctaaa

SEQ ID NO: 279836 - DNA, 20 bp, Artificial Sequence
  Description of Artificial Sequence: Synthetic oligonucleotide
  Target: ATXN1; (+) strand; PAM type: YTN; PAM sequence: TTA
gctgttacatgctcctaaaa

SEQ ID NO: 279837 - DNA, 20 bp, Artificial Sequence
  Description of Artificial Sequence: Synthetic oligonucleotide
  Target: ATXN1; (+) strand; PAM type: YTN; PAM sequence: CTG
ttacatgctcctaaaaaaaa

SEQ ID NO: 279838 - DNA, 20 bp, Artificial Sequence
  Description of Artificial Sequence: Synthetic oligonucleotide
  Target: ATXN1; (+) strand; PAM type: YTN; PAM sequence: TTA
catgctcctaaaaaaaaaag

SEQ ID NO: 279839 - DNA, 20 bp, Artificial Sequence
  Description of Artificial Sequence: Synthetic oligonucleotide
  Target: ATXN1; (+) strand; PAM type: YTN; PAM sequence: CTC
ctaaaaaaaaaagtcaattc

SEQ ID NO: 279840 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaagtcaattcaca

SEQ ID NO: 279841 - DNA, 20 bp, Artificial Sequence
  Description of Artificial Sequence: Synthetic oligonucleotide
  Target: ATXN1; (+) strand; PAM type: YTN; PAM sequence: TTC
acaggataaaccaaaaacgt

SEQ ID NO: 279842 - DNA, 20 bp, Artificial Sequence
  Description of Artificial Sequence: Synthetic oligonucleotide
  Target: ATXN1; (+) strand; PAM type: YTN; PAM sequence: TTT
cccagaaaagaaaataggaa

SEQ ID NO: 279843 - DNA, 20 bp, Artificial Sequence
  Description of Artificial Sequence: Synthetic oligonucleotide
  Target: ATXN1; (+) strand; PAM type: YTN; PAM sequence: TTC
ccagaaaagaaaataggaac

SEQ ID NO: 279844 - DNA, 20 bp, Artificial Sequence
  Description of Artificial Sequence: Synthetic oligonucleotide
  Target: ATXN1; (+) strand; PAM type: YTN; PAM sequence: CTT
ttaaacatatgaaagtatat

SEQ ID NO: 279845 - DNA, 20 bp, Artificial Sequence
  Description of Artificial Sequence: Synthetic oligonucleotide
  Target: ATXN1; (+) strand; PAM type: YTN; PAM sequence: TTT
taaacatatgaaagtatatt

SEQ ID NO: 279846 - DNA, 20 bp, Artificial Sequence
  Description of Artificial Sequence: Synthetic oligonucleotide
  Target: ATXN1; (+) strand; PAM type: YTN; PAM sequence: TTT
aaacatatgaaagtatattc

SEQ ID NO: 279847 - DNA, 20 bp, Artificial Sequence
  Description of Artificial Sequence: Synthetic oligonucleotide
  Target: ATXN1; (+) strand; PAM type: YTN; PAM sequence: TTA
aacatatgaaagtatattca

SEQ ID NO: 279848 - DNA, 20 bp, Artificial Sequence
  Description of Artificial Sequence: Synthetic oligonucleotide
  Target: ATXN1; (+) strand; PAM type: YTN; PAM sequence: TTC
aaccaccactataataacag

SEQ ID NO: 279849 - DNA, 20 bp, Artificial Sequence
  Description of Artificial Sequence: Synthetic oligonucleotide
  Target: ATXN1; (+) strand; PAM type: YTN; PAM sequence: CTA
taataacagaaacccatatt

SEQ ID NO: 279850 - DNA, 20 bp, Artificial Sequence
  Description of Artificial Sequence: Synthetic oligonucleotide
  Target: ATXN1; (+) strand; PAM type: YTN; PAM sequence: TTA
aagctactagaatatagtag

SEQ ID NO: 279851 - DNA, 20 bp, Artificial Sequence
  Description of Artificial Sequence: Synthetic oligonucleotide
  Target: ATXN1; (+) strand; PAM type: YTN; PAM sequence: CTA
ctagaatatagtagttttca

SEQ ID NO: 279852 - DNA, 20 bp, Artificial Sequence
  Description of Artificial Sequence: Synthetic oligonucleotide
  Target: ATXN1; (+) strand; PAM type: YTN; PAM sequence: CTA
gaatatagtagttttcacct

SEQ ID NO: 279853 - DNA, 20 bp, Artificial Sequence
  Description of Artificial Sequence: Synthetic oligonucleotide
  Target: ATXN1; (+) strand; PAM type: YTN; PAM sequence: TTT
tcacctctcagattggcaaa

SEQ ID NO: 279854 - DNA, 20 bp, Artificial Sequence
  Description of Artificial Sequence: Synthetic oligonucleotide
  Target: ATXN1; (+) strand; PAM type: YTN; PAM sequence: TTT
cacctctcagattggcaaag

SEQ ID NO: 279855 - DNA, 20 bp, Artificial Sequence
  Description of Artificial Sequence: Synthetic oligonucleotide
  Target: ATXN1; (+) strand; PAM type: YTN; PAM sequence: TTC
acctctcagattggcaaaga

SEQ ID NO: 279856 - DNA, 20 bp, Artificial Sequence
  Description of Artificial Sequence: Synthetic oligonucleotide
  Target: ATXN1; (+) strand; PAM type: YTN; PAM sequence: CTC
tcagattggcaaagatcgtg

SEQ ID NO: 279857 - DNA, 20 bp, Artificial Sequence
  Description of Artificial Sequence: Synthetic oligonucleotide
  Target: ATXN1; (+) strand; PAM type: YTN; PAM sequence: CTC
agattggcaaagatcgtgaa

SEQ ID NO: 279858 - DNA, 20 bp, Artificial Sequence
  Description of Artificial Sequence: Synthetic oligonucleotide
  Target: ATXN1; (+) strand; PAM type: YTN; PAM sequence: TTG
gcaaagatcgtgaagtttaa

SEQ ID NO: 279859 - DNA, 20 bp, Artificial Sequence
  Description of Artificial Sequence: Synthetic oligonucleotide
  Target: ATXN1; (+) strand; PAM type: YTN; PAM sequence: TTT
aaaaacatcgtctgtggaga

SEQ ID NO: 279860 - DNA, 20 bp, Artificial Sequence
  Description of Artificial Sequence: Synthetic oligonucleotide
  Target: ATXN1; (+) strand; PAM type: YTN; PAM sequence: TTA
aaaacatcgtctgtggagaa

SEQ ID NO: 279861 - DNA, 20 bp, Artificial Sequence
  Description of Artificial Sequence: Synthetic oligonucleotide
  Target: ATXN1; (+) strand; PAM type: YTN; PAM sequence: CTG
tggagaaaagcacactcaaa

SEQ ID NO: 279862 - DNA, 20 bp, Artificial Sequence
  Description of Artificial Sequence: Synthetic oligonucleotide
  Target: ATXN1; (+) strand; PAM type: YTN; PAM sequence: CTC
aaacagtgctagcaggaaca

SEQ ID NO: 279863 - DNA, 20 bp, Artificial Sequence
  Description of Artificial Sequence: Synthetic oligonucleotide
  Target: ATXN1; (+) strand; PAM type: YTN; PAM sequence: CTA
gcaggaacatacaataggac

SEQ ID NO: 279864 - DNA, 20 bp, Artificial Sequence
  Description of Artificial Sequence: Synthetic oligonucleotide
  Target: ATXN1; (+) strand; PAM type: YTN; PAM sequence: TTG
gagggcaatttggcaaggtt

SEQ ID NO: 279865 - DNA, 20 bp, Artificial Sequence
  Description of Artificial Sequence: Synthetic oligonucleotide
  Target: ATXN1; (+) strand; PAM type: YTN; PAM sequence: TTT
ggcaaggtttaccaaaatta

SEQ ID NO: 279866 - DNA, 20 bp, Artificial Sequence
  Description of Artificial Sequence: Synthetic oligonucleotide
  Target: ATXN1; (+) strand; PAM type: YTN; PAM sequence: TTG
gcaaggtttaccaaaattaa

SEQ ID NO: 279867 - DNA, 20 bp, Artificial Sequence
  Description of Artificial Sequence: Synthetic oligonucleotide
  Target: ATXN1; (+) strand; PAM type: YTN; PAM sequence: TTT
accaaaattaaaactgcata

SEQ ID NO: 279868 - DNA, 20 bp, Artificial Sequence
  Description of Artificial Sequence: Synthetic oligonucleotide
  Target: ATXN1; (+) strand; PAM type: YTN; PAM sequence: TTA
ccaaaattaaaactgcatat

SEQ ID NO: 279869 - DNA, 20 bp, Artificial Sequence
  Description of Artificial Sequence: Synthetic oligonucleotide
  Target: ATXN1; (+) strand; PAM type: YTN; PAM sequence: TTA
aaactgcatattccttttga

SEQ ID NO: 279870 - DNA, 20 bp, Artificial Sequence
  Description of Artificial Sequence: Synthetic oligonucleotide
  Target: ATXN1; (+) strand; PAM type: YTN; PAM sequence: CTG
catattccttttgatccaac

SEQ ID NO: 279871 - DNA, 20 bp, Artificial Sequence
  Description of Artificial Sequence: Synthetic oligonucleotide
  Target: ATXN1; (+) strand; PAM type: YTN; PAM sequence: TTC
cttttgatccaacaattccc

SEQ ID NO: 279872 - DNA, 20 bp, Artificial Sequence
  Description of Artificial Sequence: Synthetic oligonucleotide
  Target: ATXN1; (+) strand; PAM type: YTN; PAM sequence: CTT
ttgatccaacaattcccctt

SEQ ID NO: 279873 - DNA, 20 bp, Artificial Sequence
  Description of Artificial Sequence: Synthetic oligonucleotide
  Target: ATXN1; (+) strand; PAM type: YTN; PAM sequence: TTT
tgatccaacaattccccttt

SEQ ID NO: 279874 - DNA, 20 bp, Artificial Sequence
  Description of Artificial Sequence: Synthetic oligonucleotide
  Target: ATXN1; (+) strand; PAM type: YTN; PAM sequence: TTT
gatccaacaattccccttta

SEQ ID NO: 279875 - DNA, 20 bp, Artificial Sequence
  Description of Artificial Sequence: Synthetic oligonucleotide
  Target: ATXN1; (+) strand; PAM type: YTN; PAM sequence: TTG
atccaacaattcccctttag

SEQ ID NO: 279876 - DNA, 20 bp, Artificial Sequence
  Description of Artificial Sequence: Synthetic oligonucleotide
  Target: ATXN1; (+) strand; PAM type: YTN; PAM sequence: TTC
ccctttagtaatttctcctc

SEQ ID NO: 279877 - DNA, 20 bp, Artificial Sequence
  Description of Artificial Sequence: Synthetic oligonucleotide
  Target: ATXN1; (+) strand; PAM type: YTN; PAM sequence: CTT
tagtaatttctcctccagag

SEQ ID NO: 279878 - DNA, 20 bp, Artificial Sequence
  Description of Artificial Sequence: Synthetic oligonucleotide
  Target: ATXN1; (+) strand; PAM type: YTN; PAM sequence: TTT
agtaatttctcctccagaga

SEQ ID NO: 279879 - DNA, 20 bp, Artificial Sequence
  Description of Artificial Sequence: Synthetic oligonucleotide
  Target: ATXN1; (+) strand; PAM type: YTN; PAM sequence: TTA
gtaatttctcctccagagat

SEQ ID NO: 279880 - DNA, 20 bp, Artificial Sequence
  Description of Artificial Sequence: Synthetic oligonucleotide
  Target: ATXN1; (+) strand; PAM type: YTN; PAM sequence: TTT
ctcctccagagatccttgct

SEQ ID NO: 279881 - DNA, 20 bp, Artificial Sequence
  Description of Artificial Sequence: Synthetic oligonucleotide
  Target: ATXN1; (+) strand; PAM type: YTN; PAM sequence: TTC
tcctccagagatccttgctg

SEQ ID NO: 279882 - DNA, 20 bp, Artificial Sequence
  Description of Artificial Sequence: Synthetic oligonucleotide
  Target: ATXN1; (+) strand; PAM type: YTN; PAM sequence: CTC
ctccagagatccttgctgac

SEQ ID NO: 279883 - DNA, 20 bp, Artificial Sequence
  Description of Artificial Sequence: Synthetic oligonucleotide
  Target: ATXN1; (+) strand; PAM type: YTN; PAM sequence: CTC
cagagatccttgctgacata

SEQ ID NO: 279884 - DNA, 20 bp, Artificial Sequence
  Description of Artificial Sequence: Synthetic oligonucleotide
  Target: ATXN1; (+) strand; PAM type: YTN; PAM sequence: CTT
gctgacatacaacatgctat

SEQ ID NO: 279885 - DNA, 20 bp, Artificial Sequence
  Description of Artificial Sequence: Synthetic oligonucleotide
  Target: ATXN1; (+) strand; PAM type: YTN; PAM sequence: TTG
ctgacatacaacatgctatt

SEQ ID NO: 279886 - DNA, 20 bp, Artificial Sequence
  Description of Artificial Sequence: Synthetic oligonucleotide
  Target: ATXN1; (+) strand; PAM type: YTN; PAM sequence: CTG
acatacaacatgctatttat

SEQ ID NO: 279887 - DNA, 20 bp, Artificial Sequence
  Description of Artificial Sequence: Synthetic oligonucleotide
  Target: ATXN1; (+) strand; PAM type: YTN; PAM sequence: CTA
tttatagagagttgttcact

SEQ ID NO: 279888 - DNA, 20 bp, Artificial Sequence
  Description of Artificial Sequence: Synthetic oligonucleotide
  Target: ATXN1; (+) strand; PAM type: YTN; PAM sequence: TTT
atagagagttgttcactgaa

SEQ ID NO: 279889 - DNA, 20 bp, Artificial Sequence
  Description of Artificial Sequence: Synthetic oligonucleotide
  Target: ATXN1; (+) strand; PAM type: YTN; PAM sequence: TTA
tagagagttgttcactgaag

SEQ ID NO: 279890 - DNA, 20 bp, Artificial Sequence
  Description of Artificial Sequence: Synthetic oligonucleotide
  Target: ATXN1; (+) strand; PAM type: YTN; PAM sequence: TTG
ttcactgaagcattgttcat

SEQ ID NO: 279891 - DNA, 20 bp, Artificial Sequence
  Description of Artificial Sequence: Synthetic oligonucleotide
  Target: ATXN1; (+) strand; PAM type: YTN; PAM sequence: TTC
actgaagcattgttcatagt

SEQ ID NO: 279892 - DNA, 20 bp, Artificial Sequence
  Description of Artificial Sequence: Synthetic oligonucleotide
  Target: ATXN1; (+) strand; PAM type: YTN; PAM sequence: CTG
aagcattgttcatagtagca

SEQ ID NO: 279893 - DNA, 20 bp, Artificial Sequence
  Description of Artificial Sequence: Synthetic oligonucleotide
  Target: ATXN1; (+) strand; PAM type: YTN; PAM sequence: TTG
ttcatagtagcaagtgactg

SEQ ID NO: 279894 - DNA, 20 bp, Artificial Sequence
  Description of Artificial Sequence: Synthetic oligonucleotide
  Target: ATXN1; (+) strand; PAM type: YTN; PAM sequence: TTC
atagtagcaagtgactggaa

SEQ ID NO: 279895 - DNA, 20 bp, Artificial Sequence
  Description of Artificial Sequence: Synthetic oligonucleotide
  Target: ATXN1; (+) strand; PAM type: YTN; PAM sequence: CTG
gaaacaaccaaaaaaaaaaa

SEQ ID NO: 279896 - DNA, 20 bp, Artificial Sequence
  Description of Artificial Sequence: Synthetic oligonucleotide
  Target: ATXN1; (+) strand; PAM type: YTN; PAM sequence: CTG
aatactttatggcaaaatca

SEQ ID NO: 279897 - DNA, 20 bp, Artificial Sequence
  Description of Artificial Sequence: Synthetic oligonucleotide
  Target: ATXN1; (+) strand; PAM type: YTN; PAM sequence: CTT
tatggcaaaatcatacaatc

SEQ ID NO: 279898 - DNA, 20 bp, Artificial Sequence
  Description of Artificial Sequence: Synthetic oligonucleotide
  Target: ATXN1; (+) strand; PAM type: YTN; PAM sequence: TTT
atggcaaaatcatacaatcg

SEQ ID NO: 279899 - DNA, 20 bp, Artificial Sequence
  Description of Artificial Sequence: Synthetic oligonucleotide
  Target: ATXN1; (+) strand; PAM type: YTN; PAM sequence: TTA
tggcaaaatcatacaatcga

SEQ ID NO: 279900 - DNA, 20 bp, Artificial Sequence
  Description of Artificial Sequence: Synthetic oligonucleotide
  Target: ATXN1; (+) strand; PAM type: YTN; PAM sequence: CTA
tttagatactaaaaaagaat

SEQ ID NO: 279901 - DNA, 20 bp, Artificial Sequence
  Description of Artificial Sequence: Synthetic oligonucleotide
  Target: ATXN1; (+) strand; PAM type: YTN; PAM sequence: TTT
agatactaaaaaagaataag

SEQ ID NO: 279902 - DNA, 20 bp, Artificial Sequence
  Description of Artificial Sequence: Synthetic oligonucleotide
  Target: ATXN1; (+) strand; PAM type: YTN; PAM sequence: TTA
gatactaaaaaagaataagg

SEQ ID NO: 279903 - DNA, 20 bp, Artificial Sequence
  Description of Artificial Sequence: Synthetic oligonucleotide
  Target: ATXN1; (+) strand; PAM type: YTN; PAM sequence: CTA
aaaaagaataaggctgttct

SEQ ID NO: 279904 - DNA, 20 bp, Artificial Sequence
  Description of Artificial Sequence: Synthetic oligonucleotide
  Target: ATXN1; (+) strand; PAM type: YTN; PAM sequence: CTG
ttctatgttccgataagaaa

SEQ ID NO: 279905 - DNA, 20 bp, Artificial Sequence
  Description of Artificial Sequence: Synthetic oligonucleotide
  Target: ATXN1; (+) strand; PAM type: YTN; PAM sequence: TTC
tatgttccgataagaaaggt

SEQ ID NO: 279906 - DNA, 20 bp, Artificial Sequence
  Description of Artificial Sequence: Synthetic oligonucleotide
  Target: ATXN1; (+) strand; PAM type: YTN; PAM sequence: CTA
tgttccgataagaaaggttt

SEQ ID NO: 279907 - DNA, 20 bp, Artificial Sequence
  Description of Artificial Sequence: Synthetic oligonucleotide
  Target: ATXN1; (+) strand; PAM type: YTN; PAM sequence: TTC
cgataagaaaggttttccag

SEQ ID NO: 279908 - DNA, 20 bp, Artificial Sequence
  Description of Artificial Sequence: Synthetic oligonucleotide
  Target: ATXN1; (+) strand; PAM type: YTN; PAM sequence: TTT
tccaggacacactgttaggt

SEQ ID NO: 279909 - DNA, 20 bp, Artificial Sequence
  Description of Artificial Sequence: Synthetic oligonucleotide
  Target: ATXN1; (+) strand; PAM type: YTN; PAM sequence: TTT
ccaggacacactgttaggtg

SEQ ID NO: 279910 - DNA, 20 bp, Artificial Sequence
  Description of Artificial Sequence: Synthetic oligonucleotide
  Target: ATXN1; (+) strand; PAM type: YTN; PAM sequence: TTC
caggacacactgttaggtga

SEQ ID NO: 279911 - DNA, 20 bp, Artificial Sequence
  Description of Artificial Sequence: Synthetic oligonucleotide
  Target: ATXN1; (+) strand; PAM type: YTN; PAM sequence: CTG
ttaggtgaaaagaggtaaag

SEQ ID NO: 279912 - DNA, 20 bp, Artificial Sequence
  Description of Artificial Sequence: Synthetic oligonucleotide
  Target: ATXN1; (+) strand; PAM type: YTN; PAM sequence: TTA
ggtgaaaagaggtaaagggc

SEQ ID NO: 279913 - DNA, 20 bp, Artificial Sequence
  Description of Artificial Sequence: Synthetic oligonucleotide
  Target: ATXN1; (+) strand; PAM type: YTN; PAM sequence: TTG
ttttaaaaaacctatatttt

SEQ ID NO: 279914 - DNA, 20 bp, Artificial Sequence
  Description of Artificial Sequence: Synthetic oligonucleotide
  Target: ATXN1; (+) strand; PAM type: YTN; PAM sequence: TTT
taaaaaacctatatttttgc

SEQ ID NO: 279915 - DNA, 20 bp, Artificial Sequence
  Description of Artificial Sequence: Synthetic oligonucleotide
  Target: ATXN1; (+) strand; PAM type: YTN; PAM sequence: TTT
aaaaaacctatatttttgct

SEQ ID NO: 279916 - DNA, 20 bp, Artificial Sequence
  Description of Artificial Sequence: Synthetic oligonucleotide
  Target: ATXN1; (+) strand; PAM type: YTN; PAM sequence: TTA
aaaaacctatatttttgctt

SEQ ID NO: 279917 - DNA, 20 bp, Artificial Sequence
  Description of Artificial Sequence: Synthetic oligonucleotide
  Target: ATXN1; (+) strand; PAM type: YTN; PAM sequence: CTA
tatttttgcttatataatca

SEQ ID NO: 279918 - DNA, 20 bp, Artificial Sequence
  Description of Artificial Sequence: Synthetic oligonucleotide
  Target: ATXN1; (+) strand; PAM type: YTN; PAM sequence: TTT
ttgcttatataatcataaaa

SEQ ID NO: 279919 - DNA, 20 bp, Artificial Sequence
  Description of Artificial Sequence: Synthetic oligonucleotide
  Target: ATXN1; (+) strand; PAM type: YTN; PAM sequence: TTT
tgcttatataatcataaaat

SEQ ID NO: 279920 - DNA, 20 bp, Artificial Sequence
  Description of Artificial Sequence: Synthetic oligonucleotide
  Target: ATXN1; (+) strand; PAM type: YTN; PAM sequence: TTT
gcttatataatcataaaata

SEQ ID NO: 279921 - DNA, 20 bp, Artificial Sequence
  Description of Artificial Sequence: Synthetic oligonucleotide
  Target: ATXN1; (+) strand; PAM type: YTN; PAM sequence: TTG
cttatataatcataaaatat

SEQ ID NO: 279922 - DNA, 20 bp, Artificial Sequence
  Description of Artificial Sequence: Synthetic oligonucleotide
  Target: ATXN1; (+) strand; PAM type: YTN; PAM sequence: CTT
atataatcataaaatatcct

SEQ ID NO: 279923 - DNA, 20 bp, Artificial Sequence
  Description of Artificial Sequence: Synthetic oligonucleotide
  Target: ATXN1; (+) strand; PAM type: YTN; PAM sequence: TTA
tataatcataaaatatcctt

SEQ ID NO: 279924 - DNA, 20 bp, Artificial Sequence
  Description of Artificial Sequence: Synthetic oligonucleotide
  Target: ATXN1; (+) strand; PAM type: YTN; PAM sequence: CTT
aaaaggactcacaagaaaat

SEQ ID NO: 279925 - DNA, 20 bp, Artificial Sequence
  Description of Artificial Sequence: Synthetic oligonucleotide
  Target: ATXN1; (+) strand; PAM type: YTN; PAM sequence: TTA
aaaggactcacaagaaaatg

SEQ ID NO: 279926 - DNA, 20 bp, Artificial Sequence
  Description of Artificial Sequence: Synthetic oligonucleotide
  Target: ATXN1; (+) strand; PAM type: YTN; PAM sequence: CTC
acaagaaaatgataatggta

SEQ ID NO: 279927 - DNA, 20 bp, Artificial Sequence
  Description of Artificial Sequence: Synthetic oligonucleotide
  Target: ATXN1; (+) strand; PAM type: YTN; PAM sequence: CTT
gcttctaggtgagaattcaa

SEQ ID NO: 279928 - DNA, 20 bp, Artificial Sequence
  Description of Artificial Sequence: Synthetic oligonucleotide
  Target: ATXN1; (+) strand; PAM type: YTN; PAM sequence: TTG
cttctaggtgagaattcaag

SEQ ID NO: 279929 - DNA, 20 bp, Artificial Sequence
  Description of Artificial Sequence: Synthetic oligonucleotide
  Target: ATXN1; (+) strand; PAM type: YTN; PAM sequence: CTT
ctaggtgagaattcaagtga

SEQ ID NO: 279930 - DNA, 20 bp, Artificial Sequence
  Description of Artificial Sequence: Synthetic oligonucleotide
  Target: ATXN1; (+) strand; PAM type: YTN; PAM sequence: TTC
taggtgagaattcaagtgac

SEQ ID NO: 279931 - DNA, 20 bp, Artificial Sequence
  Description of Artificial Sequence: Synthetic oligonucleotide
  Target: ATXN1; (+) strand; PAM type: YTN; PAM sequence: CTA
ggtgagaattcaagtgactt

SEQ ID NO: 279932 - DNA, 20 bp, Artificial Sequence
  Description of Artificial Sequence: Synthetic oligonucleotide
  Target: ATXN1; (+) strand; PAM type: YTN; PAM sequence: TTC
aagtgacttagacacagaaa

SEQ ID NO: 279933 - DNA, 20 bp, Artificial Sequence
  Description of Artificial Sequence: Synthetic oligonucleotide
  Target: ATXN1; (+) strand; PAM type: YTN; PAM sequence: CTT
agacacagaaataagagaga

SEQ ID NO: 279934 - DNA, 20 bp, Artificial Sequence
  Description of Artificial Sequence: Synthetic oligonucleotide
  Target: ATXN1; (+) strand; PAM type: YTN; PAM sequence: TTA
gacacagaaataagagagat

SEQ ID NO: 279935 - DNA, 20 bp, Artificial Sequence
  Description of Artificial Sequence: Synthetic oligonucleotide
  Target: ATXN1; (+) strand; PAM type: YTN; PAM sequence: CTT
atttttccttgtacatctat

SEQ ID NO: 279936 - DNA, 20 bp, Artificial Sequence
  Description of Artificial Sequence: Synthetic oligonucleotide
  Target: ATXN1; (+) strand; PAM type: YTN; PAM sequence: TTA
tttttccttgtacatctatc

SEQ ID NO: 279937 - DNA, 20 bp, Artificial Sequence
  Description of Artificial Sequence: Synthetic oligonucleotide
  Target: ATXN1; (+) strand; PAM type: YTN; PAM sequence: TTT
ttccttgtacatctatcgta

SEQ ID NO: 279938 - DNA, 20 bp, Artificial Sequence
  Description of Artificial Sequence: Synthetic oligonucleotide
  Target: ATXN1; (+) strand; PAM type: YTN; PAM sequence: TTT
tccttgtacatctatcgtac

SEQ ID NO: 279939 - DNA, 20 bp, Artificial Sequence
  Description of Artificial Sequence: Synthetic oligonucleotide
  Target: ATXN1; (+) strand; PAM type: YTN; PAM sequence: TTT
ccttgtacatctatcgtacc

SEQ ID NO: 279940 - DNA, 20 bp, Artificial Sequence
  Description of Artificial Sequence: Synthetic oligonucleotide
  Target: ATXN1; (+) strand; PAM type: YTN; PAM sequence: TTC
cttgtacatctatcgtacct

SEQ ID NO: 279941 - DNA, 20 bp, Artificial Sequence
  Description of Artificial Sequence: Synthetic oligonucleotide
  Target: ATXN1; (+) strand; PAM type: YTN; PAM sequence: CTT
gtacatctatcgtaccttct

SEQ ID NO: 279942 - DNA, 20 bp, Artificial Sequence
  Description of Artificial Sequence: Synthetic oligonucleotide
  Target: ATXN1; (+) strand; PAM type: YTN; PAM sequence: TTG
tacatctatcgtaccttctg

SEQ ID NO: 279943 - DNA, 20 bp, Artificial Sequence
  Description of Artificial Sequence: Synthetic oligonucleotide
  Target: ATXN1; (+) strand; PAM type: YTN; PAM sequence: CTA
tcgtaccttctgtatatcta

SEQ ID NO: 279944 - DNA, 20 bp, Artificial Sequence
  Description of Artificial Sequence: Synthetic oligonucleotide
  Target: ATXN1; (+) strand; PAM type: YTN; PAM sequence: CTT
ctgtatatctagcaattcaa

SEQ ID NO: 279945 - DNA, 20 bp, Artificial Sequence
  Description of Artificial Sequence: Synthetic oligonucleotide
  Target: ATXN1; (+) strand; PAM type: YTN; PAM sequence: TTC
tgtatatctagcaattcaaa

SEQ ID NO: 279946 - DNA, 20 bp, Artificial Sequence
  Description of Artificial Sequence: Synthetic oligonucleotide
  Target: ATXN1; (+) strand; PAM type: YTN; PAM sequence: CTG
tatatctagcaattcaaaac

SEQ ID NO: 279947 - DNA, 20 bp, Artificial Sequence
  Description of Artificial Sequence: Synthetic oligonucleotide
  Target: ATXN1; (+) strand; PAM type: YTN; PAM sequence: CTA
gcaattcaaaacaatattaa

SEQ ID NO: 279948 - DNA, 20 bp, Artificial Sequence
  Description of Artificial Sequence: Synthetic oligonucleotide
  Target: ATXN1; (+) strand; PAM type: YTN; PAM sequence: TTC
aaaacaatattaatgcttca

SEQ ID NO: 279949 - DNA, 20 bp, Artificial Sequence
  Description of Artificial Sequence: Synthetic oligonucleotide
  Target: ATXN1; (+) strand; PAM type: YTN; PAM sequence: TTA
atgcttcaaaaagaaagaaa

SEQ ID NO: 279950 - DNA, 20 bp, Artificial Sequence
  Description of Artificial Sequence: Synthetic oligonucleotide
  Target: ATXN1; (+) strand; PAM type: YTN; PAM sequence: CTT
caaaaagaaagaaaagaaac

SEQ ID NO: 279951 - DNA, 20 bp, Artificial Sequence
  Description of Artificial Sequence: Synthetic oligonucleotide
  Target: ATXN1; (+) strand; PAM type: YTN; PAM sequence: TTC
aaaaagaaagaaaagaaacc

SEQ ID NO: 279952 - DNA, 20 bp, Artificial Sequence
  Description of Artificial Sequence: Synthetic oligonucleotide
  Target: ATXN1; (+) strand; PAM type: YTN; PAM sequence: CTG
aaatataaaaggagcaaagt

SEQ ID NO: 279953 - DNA, 20 bp, Artificial Sequence
  Description of Artificial Sequence: Synthetic oligonucleotide
  Target: ATXN1; (+) strand; PAM type: YTN; PAM sequence: CTA
attttggatagctttgttat

SEQ ID NO: 279954 - DNA, 20 bp, Artificial Sequence
  Description of Artificial Sequence: Synthetic oligonucleotide
  Target: ATXN1; (+) strand; PAM type: YTN; PAM sequence: TTT
tggatagctttgttattttt

SEQ ID NO: 279955 - DNA, 20 bp, Artificial Sequence
  Description of Artificial Sequence: Synthetic oligonucleotide
  Target: ATXN1; (+) strand; PAM type: YTN; PAM sequence: TTT
ggatagctttgttattttta

SEQ ID NO: 279956 - DNA, 20 bp, Artificial Sequence
  Description of Artificial Sequence: Synthetic oligonucleotide
  Target: ATXN1; (+) strand; PAM type: YTN; PAM sequence: TTG
gatagctttgttatttttag

SEQ ID NO: 279957 - DNA, 20 bp, Artificial Sequence
  Description of Artificial Sequence: Synthetic oligonucleotide
  Target: ATXN1; (+) strand; PAM type: YTN; PAM sequence: CTT
tgttatttttagtatgttta

SEQ ID NO: 279958 - DNA, 20 bp, Artificial Sequence
  Description of Artificial Sequence: Synthetic oligonucleotide
  Target: ATXN1; (+) strand; PAM type: YTN; PAM sequence: TTT
gttatttttagtatgtttaa

SEQ ID NO: 279959 - DNA, 20 bp, Artificial Sequence
  Description of Artificial Sequence: Synthetic oligonucleotide
  Target: ATXN1; (+) strand; PAM type: YTN; PAM sequence: TTG
ttatttttagtatgtttaat

SEQ ID NO: 279960 - DNA, 20 bp, Artificial Sequence
  Description of Artificial Sequence: Synthetic oligonucleotide
  Target: ATXN1; (+) strand; PAM type: YTN; PAM sequence: TTA
tttttagtatgtttaataaa

SEQ ID NO: 279961 - DNA, 20 bp, Artificial Sequence
  Description of Artificial Sequence: Synthetic oligonucleotide
  Target: ATXN1; (+) strand; PAM type: YTN; PAM sequence: TTT
ttagtatgtttaataaaaaa

SEQ ID NO: 279962 - DNA, 20 bp, Artificial Sequence
  Description of Artificial Sequence: Synthetic oligonucleotide
  Target: ATXN1; (+) strand; PAM type: YTN; PAM sequence: TTT
tagtatgtttaataaaaaaa

SEQ ID NO: 279963 - DNA, 20 bp, Artificial Sequence
  Description of Artificial Sequence: Synthetic oligonucleotide
  Target: ATXN1; (+) strand; PAM type: YTN; PAM sequence: TTT
agtatgtttaataaaaaaaa

SEQ ID NO: 279964 - DNA, 20 bp, Artificial Sequence
  Description of Artificial Sequence: Synthetic oligonucleotide
  Target: ATXN1; (+) strand; PAM type: YTN; PAM sequence: TTA
gtatgtttaataaaaaaaaa

SEQ ID NO: 279965 - DNA, 20 bp, Artificial Sequence
  Description of Artificial Sequence: Synthetic oligonucleotide
  Target: ATXN1; (+) strand; PAM type: YTN; PAM sequence: TTT
aataaaaaaaaaataaagtt

SEQ ID NO: 279966 - DNA, 20 bp, Artificial Sequence
  Description of Artificial Sequence: Synthetic oligonucleotide
  Target: ATXN1; (+) strand; PAM type: YTN; PAM sequence: TTA
ataaaaaaaaaataaagttt

SEQ ID NO: 279967 - DNA, 20 bp, Artificial Sequence
  Description of Artificial Sequence: Synthetic oligonucleotide
  Target: ATXN1; (+) strand; PAM type: YTN; PAM sequence: TTT
tttaaaccctcaaaattgac

SEQ ID NO: 279968 - DNA, 20 bp, Artificial Sequence
  Description of Artificial Sequence: Synthetic oligonucleotide
  Target: ATXN1; (+) strand; PAM type: YTN; PAM sequence: TTT
ttaaaccctcaaaattgact

SEQ ID NO: 279969 - DNA, 20 bp, Artificial Sequence
  Description of Artificial Sequence: Synthetic oligonucleotide
  Target: ATXN1; (+) strand; PAM type: YTN; PAM sequence: TTT
taaaccctcaaaattgactg

SEQ ID NO: 279970 - DNA, 20 bp, Artificial Sequence
  Description of Artificial Sequence: Synthetic oligonucleotide
  Target: ATXN1; (+) strand; PAM type: YTN; PAM sequence: TTT
aaaccctcaaaattgactgc

SEQ ID NO: 279971 - DNA, 20 bp, Artificial Sequence
  Description of Artificial Sequence: Synthetic oligonucleotide
  Target: ATXN1; (+) strand; PAM type: YTN; PAM sequence: TTA
aaccctcaaaattgactgcc

SEQ ID NO: 279972 - DNA, 20 bp, Artificial Sequence
  Description of Artificial Sequence: Synthetic oligonucleotide
  Target: ATXN1; (+) strand; PAM type: YTN; PAM sequence: CTC
aaaattgactgcccaggaaa

SEQ ID NO: 279973 - DNA, 20 bp, Artificial Sequence
  Description of Artificial Sequence: Synthetic oligonucleotide
  Target: ATXN1; (+) strand; PAM type: YTN; PAM sequence: TTG
actgcccaggaaactgattt

SEQ ID NO: 279974 - DNA, 20 bp, Artificial Sequence
  Description of Artificial Sequence: Synthetic oligonucleotide
  Target: ATXN1; (+) strand; PAM type: YTN; PAM sequence: CTG
cccaggaaactgatttcaac

SEQ ID NO: 279975 - DNA, 20 bp, Artificial Sequence
  Description of Artificial Sequence: Synthetic oligonucleotide
  Target: ATXN1; (+) strand; PAM type: YTN; PAM sequence: CTG
atttcaacttttcccaaata

SEQ ID NO: 279976 - DNA, 20 bp, Artificial Sequence
  Description of Artificial Sequence: Synthetic oligonucleotide
  Target: ATXN1; (+) strand; PAM type: YTN; PAM sequence: TTT
caacttttcccaaatagagg

SEQ ID NO: 279977 - DNA, 20 bp, Artificial Sequence
  Description of Artificial Sequence: Synthetic oligonucleotide
  Target: ATXN1; (+) strand; PAM type: YTN; PAM sequence: TTC
aacttttcccaaatagaggc

SEQ ID NO: 279978 - DNA, 20 bp, Artificial Sequence
  Description of Artificial Sequence: Synthetic oligonucleotide
  Target: ATXN1; (+) strand; PAM type: YTN; PAM sequence: CTT
ttcccaaatagaggcatttg

SEQ ID NO: 279979 - DNA, 20 bp, Artificial Sequence
  Description of Artificial Sequence: Synthetic oligonucleotide
  Target: ATXN1; (+) strand; PAM type: YTN; PAM sequence: TTT
tcccaaatagaggcatttgg

SEQ ID NO: 279980 - DNA, 20 bp, Artificial Sequence
  Description of Artificial Sequence: Synthetic oligonucleotide
  Target: ATXN1; (+) strand; PAM type: YTN; PAM sequence: TTT
cccaaatagaggcatttggc

SEQ ID NO: 279981 - DNA, 20 bp, Artificial Sequence
  Description of Artificial Sequence: Synthetic oligonucleotide
  Target: ATXN1; (+) strand; PAM type: YTN; PAM sequence: TTC
ccaaatagaggcatttggct

SEQ ID NO: 279982 - DNA, 20 bp, Artificial Sequence
  Description of Artificial Sequence: Synthetic oligonucleotide
  Target: ATXN1; (+) strand; PAM type: YTN; PAM sequence: TTT
ggctaagcttcctgtacaca

SEQ ID NO: 279983 - DNA, 20 bp, Artificial Sequence
  Description of Artificial Sequence: Synthetic oligonucleotide
  Target: ATXN1; (+) strand; PAM type: YTN; PAM sequence: TTG
gctaagcttcctgtacacat

SEQ ID NO: 279984 - DNA, 20 bp, Artificial Sequence
  Description of Artificial Sequence: Synthetic oligonucleotide
  Target: ATXN1; (+) strand; PAM type: YTN; PAM sequence: CTA
agcttcctgtacacatgtct

SEQ ID NO: 279985 - DNA, 20 bp, Artificial Sequence
  Description of Artificial Sequence: Synthetic oligonucleotide
  Target: ATXN1; (+) strand; PAM type: YTN; PAM sequence: CTT
cctgtacacatgtctgcacc

SEQ ID NO: 279986 - DNA, 20 bp, Artificial Sequence
  Description of Artificial Sequence: Synthetic oligonucleotide
  Target: ATXN1; (+) strand; PAM type: YTN; PAM sequence: TTC
ctgtacacatgtctgcaccg

SEQ ID NO: 279987 - DNA, 20 bp, Artificial Sequence
  Description of Artificial Sequence: Synthetic oligonucleotide
  Target: ATXN1; (+) strand; PAM type: YTN; PAM sequence: CTG
tacacatgtctgcaccgcct

SEQ ID NO: 279988 - DNA, 20 bp, Artificial Sequence
  Description of Artificial Sequence: Synthetic oligonucleotide
  Target: ATXN1; (+) strand; PAM type: YTN; PAM sequence: CTG
caccgcctccccaccccacc

SEQ ID NO: 279989 - DNA, 20 bp, Artificial Sequence
  Description of Artificial Sequence: Synthetic oligonucleotide
  Target: ATXN1; (+) strand; PAM type: YTN; PAM sequence: CTC
cccaccccaccatcacagga

SEQ ID NO: 279990 - DNA, 20 bp, Artificial Sequence
  Description of Artificial Sequence: Synthetic oligonucleotide
  Target: ATXN1; (+) strand; PAM type: YTN; PAM sequence: CTC
caagaccaagtggataattc

SEQ ID NO: 279991 - DNA, 20 bp, Artificial Sequence
  Description of Artificial Sequence: Synthetic oligonucleotide
  Target: ATXN1; (+) strand; PAM type: YTN; PAM sequence: TTC
aatcttcataatccattcaa

SEQ ID NO: 279992 - DNA, 20 bp, Artificial Sequence
  Description of Artificial Sequence: Synthetic oligonucleotide
  Target: ATXN1; (+) strand; PAM type: YTN; PAM sequence: CTT
cataatccattcaaatttgc

SEQ ID NO: 279993 - DNA, 20 bp, Artificial Sequence
  Description of Artificial Sequence: Synthetic oligonucleotide
  Target: ATXN1; (+) strand; PAM type: YTN; PAM sequence: TTC
ataatccattcaaatttgcc

SEQ ID NO: 279994 - DNA, 20 bp, Artificial Sequence
  Description of Artificial Sequence: Synthetic oligonucleotide
  Target: ATXN1; (+) strand; PAM type: YTN; PAM sequence: TTC
aaatttgccctctgttgtag

SEQ ID NO: 279995 - DNA, 20 bp, Artificial Sequence
  Description of Artificial Sequence: Synthetic oligonucleotide
  Target: ATXN1; (+) strand; PAM type: YTN; PAM sequence: TTT
gccctctgttgtagctggag

SEQ ID NO: 279996 - DNA, 20 bp, Artificial Sequence
  Description of Artificial Sequence: Synthetic oligonucleotide
  Target: ATXN1; (+) strand; PAM type: YTN; PAM sequence: TTG
ccctctgttgtagctggaga

SEQ ID NO: 279997 - DNA, 20 bp, Artificial Sequence
  Description of Artificial Sequence: Synthetic oligonucleotide
  Target: ATXN1; (+) strand; PAM type: YTN; PAM sequence: CTC
tgttgtagctggagatatgc

SEQ ID NO: 279998 - DNA, 20 bp, Artificial Sequence
  Description of Artificial Sequence: Synthetic oligonucleotide
  Target: ATXN1; (+) strand; PAM type: YTN; PAM sequence: CTG
ttgtagctggagatatgcca

SEQ ID NO: 279999 - DNA, 20 bp, Artificial Sequence
  Description of Artificial Sequence: Synthetic oligonucleotide
  Target: ATXN1; (+) strand; PAM type: YTN; PAM sequence: TTG
tagctggagatatgccaacg

SEQ ID NO: 280000 - DNA, 20 bp, Artificial Sequence
  Description of Artificial Sequence: Synthetic oligonucleotide
  Target: ATXN1; (+) strand; PAM type: YTN; PAM sequence: CTG
gagatatgccaacgagaggg

SEQ ID NO: 280001 - DNA, 20 bp, Artificial Sequence
  Description of Artificial Sequence: Synthetic oligonucleotide
  Target: ATXN1; (+) strand; PAM type: YTN; PAM sequence: TTT
gtttagatttatcctcagga

SEQ ID NO: 280002 - DNA, 20 bp, Artificial Sequence
  Description of Artificial Sequence: Synthetic oligonucleotide
  Target: ATXN1; (+) strand; PAM type: YTN; PAM sequence: TTG
tttagatttatcctcaggat

SEQ ID NO: 280003 - DNA, 20 bp, Artificial Sequence
  Description of Artificial Sequence: Synthetic oligonucleotide
  Target: ATXN1; (+) strand; PAM type: YTN; PAM sequence: TTT
agatttatcctcaggatgca

SEQ ID NO: 280004 - DNA, 20 bp, Artificial Sequence
  Description of Artificial Sequence: Synthetic oligonucleotide
  Target: ATXN1; (+) strand; PAM type: YTN; PAM sequence: TTA
gatttatcctcaggatgcaa

SEQ ID NO: 280005 - DNA, 20 bp, Artificial Sequence
  Description of Artificial Sequence: Synthetic oligonucleotide
  Target: ATXN1; (+) strand; PAM type: YTN; PAM sequence: TTT
atcctcaggatgcaaagaaa

SEQ ID NO: 280006 - DNA, 20 bp, Artificial Sequence
  Description of Artificial Sequence: Synthetic oligonucleotide
  Target: ATXN1; (+) strand; PAM type: YTN; PAM sequence: TTA
tcctcaggatgcaaagaaaa

SEQ ID NO: 280007 - DNA, 20 bp, Artificial Sequence
  Description of Artificial Sequence: Synthetic oligonucleotide
  Target: ATXN1; (+) strand; PAM type: YTN; PAM sequence: CTC
aggatgcaaagaaaaagacc

SEQ ID NO: 280008 - DNA, 20 bp, Artificial Sequence
  Description of Artificial Sequence: Synthetic oligonucleotide
  Target: ATXN1; (+) strand; PAM type: YTN; PAM sequence: TTT
tacttattctgcgtagctga

SEQ ID NO: 280009 - DNA, 20 bp, Artificial Sequence
  Description of Artificial Sequence: Synthetic oligonucleotide
  Target: ATXN1; (+) strand; PAM type: YTN; PAM sequence: TTT
acttattctgcgtagctgaa

SEQ ID NO: 280010 - DNA, 20 bp, Artificial Sequence
  Description of Artificial Sequence: Synthetic oligonucleotide
  Target: ATXN1; (+) strand; PAM type: YTN; PAM sequence: TTA
cttattctgcgtagctgaat

SEQ ID NO: 280011 - DNA, 20 bp, Artificial Sequence
  Description of Artificial Sequence: Synthetic oligonucleotide
  Target: ATXN1; (+) strand; PAM type: YTN; PAM sequence: CTT
attctgcgtagctgaatttt

SEQ ID NO: 280012 - DNA, 20 bp, Artificial Sequence
  Description of Artificial Sequence: Synthetic oligonucleotide
  Target: ATXN1; (+) strand; PAM type: YTN; PAM sequence: TTA
ttctgcgtagctgaattttt

SEQ ID NO: 280013 - DNA, 20 bp, Artificial Sequence
  Description of Artificial Sequence: Synthetic oligonucleotide
  Target: ATXN1; (+) strand; PAM type: YTN; PAM sequence: TTC
tgcgtagctgaatttttagg

SEQ ID NO: 280014 - DNA, 20 bp, Artificial Sequence
  Description of Artificial Sequence: Synthetic oligonucleotide
  Target: ATXN1; (+) strand; PAM type: YTN; PAM sequence: CTG
cgtagctgaatttttaggtc

SEQ ID NO: 280015 - DNA, 20 bp, Artificial Sequence
  Description of Artificial Sequence: Synthetic oligonucleotide
  Target: ATXN1; (+) strand; PAM type: YTN; PAM sequence: CTG
aatttttaggtcttccaatg

SEQ ID NO: 280016 - DNA, 20 bp, Artificial Sequence
  Description of Artificial Sequence: Synthetic oligonucleotide
  Target: ATXN1; (+) strand; PAM type: YTN; PAM sequence: TTT
ttaggtcttccaatggtcat

SEQ ID NO: 280017 - DNA, 20 bp, Artificial Sequence
  Description of Artificial Sequence: Synthetic oligonucleotide
  Target: ATXN1; (+) strand; PAM type: YTN; PAM sequence: TTT
taggtcttccaatggtcatc

SEQ ID NO: 280018 - DNA, 20 bp, Artificial Sequence
  Description of Artificial Sequence: Synthetic oligonucleotide
  Target: ATXN1; (+) strand; PAM type: YTN; PAM sequence: TTT
aggtcttccaatggtcatca

SEQ ID NO: 280019 - DNA, 20 bp, Artificial Sequence
  Description of Artificial Sequence: Synthetic oligonucleotide
  Target: ATXN1; (+) strand; PAM type: YTN; PAM sequence: TTA
ggtcttccaatggtcatcag

SEQ ID NO: 280020 - DNA, 20 bp, Artificial Sequence
  Description of Artificial Sequence: Synthetic oligonucleotide
  Target: ATXN1; (+) strand; PAM type: YTN; PAM sequence: CTT
ccaatggtcatcagttaggg

SEQ ID NO: 280021 - DNA, 20 bp, Artificial Sequence
  Description of Artificial Sequence: Synthetic oligonucleotide
  Target: ATXN1; (+) strand; PAM type: YTN; PAM sequence: TTC
caatggtcatcagttagggt

SEQ ID NO: 280022 - DNA, 20 bp, Artificial Sequence
  Description of Artificial Sequence: Synthetic oligonucleotide
  Target: ATXN1; (+) strand; PAM type: YTN; PAM sequence: TTA
gggttagaacgaaaacagct

SEQ ID NO: 280023 - DNA, 20 bp, Artificial Sequence
  Description of Artificial Sequence: Synthetic oligonucleotide
  Target: ATXN1; (+) strand; PAM type: YTN; PAM sequence: TTA
gaacgaaaacagctgtaaaa

SEQ ID NO: 280024 - DNA, 20 bp, Artificial Sequence
  Description of Artificial Sequence: Synthetic oligonucleotide
  Target: ATXN1; (+) strand; PAM type: YTN; PAM sequence: CTG
taaaaatgtcctgacaggag

SEQ ID NO: 280025 - DNA, 20 bp, Artificial Sequence
  Description of Artificial Sequence: Synthetic oligonucleotide
  Target: ATXN1; (+) strand; PAM type: YTN; PAM sequence: CTG
acaggagctggagaccagcc

SEQ ID NO: 280026 - DNA, 20 bp, Artificial Sequence
  Description of Artificial Sequence: Synthetic oligonucleotide
  Target: ATXN1; (+) strand; PAM type: YTN; PAM sequence: CTG
gagaccagcctggccaacat

SEQ ID NO: 280027 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccccg

SEQ ID NO: 280028 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaattt

SEQ ID NO: 280029 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaatttgc

SEQ ID NO: 280030 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaatttgctgg

SEQ ID NO: 280031 - DNA, 20 bp, Artificial Sequence
  Description of Artificial Sequence: Synthetic oligonucleotide
  Target: ATXN1; (+) strand; PAM type: YTN; PAM sequence: TTT
gctgggcatggtggcaggtg

SEQ ID NO: 280032 - DNA, 20 bp, Artificial Sequence
  Description of Artificial Sequence: Synthetic oligonucleotide
  Target: ATXN1; (+) strand; PAM type: YTN; PAM sequence: TTG
ctgggcatggtggcaggtgc

SEQ ID NO: 280033 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcaggtgcttg

SEQ ID NO: 280034 - DNA, 20 bp, Artificial Sequence
  Description of Artificial Sequence: Synthetic oligonucleotide
  Target: ATXN1; (+) strand; PAM type: YTN; PAM sequence: CTT
gtaatcccagctactcggga

SEQ ID NO: 280035 - DNA, 20 bp, Artificial Sequence
  Description of Artificial Sequence: Synthetic oligonucleotide
  Target: ATXN1; (+) strand; PAM type: YTN; PAM sequence: TTG
taatcccagctactcgggag

SEQ ID NO: 280036 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 280037 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 280038 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgtttaaa

SEQ ID NO: 280039 - DNA, 20 bp, Artificial Sequence
  Description of Artificial Sequence: Synthetic oligonucleotide
  Target: ATXN1; (+) strand; PAM type: YTN; PAM sequence: TTT
aaacggggaggcggaggttg

SEQ ID NO: 280040 - DNA, 20 bp, Artificial Sequence
  Description of Artificial Sequence: Synthetic oligonucleotide
  Target: ATXN1; (+) strand; PAM type: YTN; PAM sequence: TTA
aacggggaggcggaggttgc

SEQ ID NO: 280041 - DNA, 20 bp, Artificial Sequence
  Description of Artificial Sequence: Synthetic oligonucleotide
  Target: ATXN1; (+) strand; PAM type: YTN; PAM sequence: TTG
cagtgcaccgagatcacacc

SEQ ID NO: 280042 - DNA, 20 bp, Artificial Sequence
  Description of Artificial Sequence: Synthetic oligonucleotide
  Target: ATXN1; (+) strand; PAM type: YTN; PAM sequence: TTG
cactccagtttggatagcaa

SEQ ID NO: 280043 - DNA, 20 bp, Artificial Sequence
  Description of Artificial Sequence: Synthetic oligonucleotide
  Target: ATXN1; (+) strand; PAM type: YTN; PAM sequence: CTC
cagtttggatagcaagagcg

SEQ ID NO: 280044 - DNA, 20 bp, Artificial Sequence
  Description of Artificial Sequence: Synthetic oligonucleotide
  Target: ATXN1; (+) strand; PAM type: YTN; PAM sequence: TTT
ggatagcaagagcgaaactc

SEQ ID NO: 280045 - DNA, 20 bp, Artificial Sequence
  Description of Artificial Sequence: Synthetic oligonucleotide
  Target: ATXN1; (+) strand; PAM type: YTN; PAM sequence: TTG
gatagcaagagcgaaactcc

SEQ ID NO: 280046 - DNA, 20 bp, Artificial Sequence
  Description of Artificial Sequence: Synthetic oligonucleotide
  Target: ATXN1; (+) strand; PAM type: YTN; PAM sequence: CTC
cacctcaaaaataaaaataa

SEQ ID NO: 280047 - DNA, 20 bp, Artificial Sequence
  Description of Artificial Sequence: Synthetic oligonucleotide
  Target: ATXN1; (+) strand; PAM type: YTN; PAM sequence: CTC
aaaaataaaaataaaaaaat

SEQ ID NO: 280048 - DNA, 20 bp, Artificial Sequence
  Description of Artificial Sequence: Synthetic oligonucleotide
  Target: ATXN1; (+) strand; PAM type: YTN; PAM sequence: CTG
acaaagactatagtgagctc

SEQ ID NO: 280049 - DNA, 20 bp, Artificial Sequence
  Description of Artificial Sequence: Synthetic oligonucleotide
  Target: ATXN1; (+) strand; PAM type: YTN; PAM sequence: CTA
tagtgagctcatcagacatt

SEQ ID NO: 280050 - DNA, 20 bp, Artificial Sequence
  Description of Artificial Sequence: Synthetic oligonucleotide
  Target: ATXN1; (+) strand; PAM type: YTN; PAM sequence: CTC
atcagacattcctttaatat

SEQ ID NO: 280051 - DNA, 20 bp, Artificial Sequence
  Description of Artificial Sequence: Synthetic oligonucleotide
  Target: ATXN1; (+) strand; PAM type: YTN; PAM sequence: TTC
ctttaatatgcttgttctaa

SEQ ID NO: 280052 - DNA, 20 bp, Artificial Sequence
  Description of Artificial Sequence: Synthetic oligonucleotide
  Target: ATXN1; (+) strand; PAM type: YTN; PAM sequence: CTT
taatatgcttgttctaaagg

SEQ ID NO: 280053 - DNA, 20 bp, Artificial Sequence
  Description of Artificial Sequence: Synthetic oligonucleotide
  Target: ATXN1; (+) strand; PAM type: YTN; PAM sequence: TTT
aatatgcttgttctaaaggg

SEQ ID NO: 280054 - DNA, 20 bp, Artificial Sequence
  Description of Artificial Sequence: Synthetic oligonucleotide
  Target: ATXN1; (+) strand; PAM type: YTN; PAM sequence: TTA
atatgcttgttctaaagggg

SEQ ID NO: 280055 - DNA, 20 bp, Artificial Sequence
  Description of Artificial Sequence: Synthetic oligonucleotide
  Target: ATXN1; (+) strand; PAM type: YTN; PAM sequence: CTT
gttctaaagggggcaggggt

SEQ ID NO: 280056 - DNA, 20 bp, Artificial Sequence
  Description of Artificial Sequence: Synthetic oligonucleotide
  Target: ATXN1; (+) strand; PAM type: YTN; PAM sequence: TTG
ttctaaagggggcaggggtg

SEQ ID NO: 280057 - DNA, 20 bp, Artificial Sequence
  Description of Artificial Sequence: Synthetic oligonucleotide
  Target: ATXN1; (+) strand; PAM type: YTN; PAM sequence: TTC
taaagggggcaggggtggag

SEQ ID NO: 280058 - DNA, 20 bp, Artificial Sequence
  Description of Artificial Sequence: Synthetic oligonucleotide
  Target: ATXN1; (+) strand; PAM type: YTN; PAM sequence: CTA
aagggggcaggggtggagag

SEQ ID NO: 280059 - DNA, 20 bp, Artificial Sequence
  Description of Artificial Sequence: Synthetic oligonucleotide
  Target: ATXN1; (+) strand; PAM type: YTN; PAM sequence: CTA
gaattggtctgcagggccca

SEQ ID NO: 280060 - DNA, 20 bp, Artificial Sequence
  Description of Artificial Sequence: Synthetic oligonucleotide
  Target: ATXN1; (+) strand; PAM type: YTN; PAM sequence: TTG
gtctgcagggcccagctcct

SEQ ID NO: 280061 - DNA, 20 bp, Artificial Sequence
  Description of Artificial Sequence: Synthetic oligonucleotide
  Target: ATXN1; (+) strand; PAM type: YTN; PAM sequence: CTG
cagggcccagctcctctcag

SEQ ID NO: 280062 - DNA, 20 bp, Artificial Sequence
  Description of Artificial Sequence: Synthetic oligonucleotide
  Target: ATXN1; (+) strand; PAM type: YTN; PAM sequence: CTC
ctctcagacacccgtcttgg

SEQ ID NO: 280063 - DNA, 20 bp, Artificial Sequence
  Description of Artificial Sequence: Synthetic oligonucleotide
  Target: ATXN1; (+) strand; PAM type: YTN; PAM sequence: CTC
tcagacacccgtcttggagg

SEQ ID NO: 280064 - DNA, 20 bp, Artificial Sequence
  Description of Artificial Sequence: Synthetic oligonucleotide
  Target: ATXN1; (+) strand; PAM type: YTN; PAM sequence: CTC
agacacccgtcttggaggag

SEQ ID NO: 280065 - DNA, 20 bp, Artificial Sequence
  Description of Artificial Sequence: Synthetic oligonucleotide
  Target: ATXN1; (+) strand; PAM type: YTN; PAM sequence: CTT
ggaggaggttagaagagtgt

SEQ ID NO: 280066 - DNA, 20 bp, Artificial Sequence
  Description of Artificial Sequence: Synthetic oligonucleotide
  Target: ATXN1; (+) strand; PAM type: YTN; PAM sequence: TTG
gaggaggttagaagagtgtt

SEQ ID NO: 280067 - DNA, 20 bp, Artificial Sequence
  Description of Artificial Sequence: Synthetic oligonucleotide
  Target: ATXN1; (+) strand; PAM type: YTN; PAM sequence: TTA
gaagagtgttcagggtaatg

SEQ ID NO: 280068 - DNA, 20 bp, Artificial Sequence
  Description of Artificial Sequence: Synthetic oligonucleotide
  Target: ATXN1; (+) strand; PAM type: YTN; PAM sequence: TTC
agggtaatgggccagcaaca

SEQ ID NO: 280069 - DNA, 20 bp, Artificial Sequence
  Description of Artificial Sequence: Synthetic oligonucleotide
  Target: ATXN1; (+) strand; PAM type: YTN; PAM sequence: CTA
aaatgtcccagactccaatg

SEQ ID NO: 280070 - DNA, 20 bp, Artificial Sequence
  Description of Artificial Sequence: Synthetic oligonucleotide
  Target: ATXN1; (+) strand; PAM type: YTN; PAM sequence: CTC
caatgaagcttctcattcta

SEQ ID NO: 280071 - DNA, 20 bp, Artificial Sequence
  Description of Artificial Sequence: Synthetic oligonucleotide
  Target: ATXN1; (+) strand; PAM type: YTN; PAM sequence: CTT
ctcattctaccactcctgca

SEQ ID NO: 280072 - DNA, 20 bp, Artificial Sequence
  Description of Artificial Sequence: Synthetic oligonucleotide
  Target: ATXN1; (+) strand; PAM type: YTN; PAM sequence: TTC
tcattctaccactcctgcag

SEQ ID NO: 280073 - DNA, 20 bp, Artificial Sequence
  Description of Artificial Sequence: Synthetic oligonucleotide
  Target: ATXN1; (+) strand; PAM type: YTN; PAM sequence: CTC
attctaccactcctgcagag

SEQ ID NO: 280074 - DNA, 20 bp, Artificial Sequence
  Description of Artificial Sequence: Synthetic oligonucleotide
  Target: ATXN1; (+) strand; PAM type: YTN; PAM sequence: TTC
taccactcctgcagagattc

SEQ ID NO: 280075 - DNA, 20 bp, Artificial Sequence
  Description of Artificial Sequence: Synthetic oligonucleotide
  Target: ATXN1; (+) strand; PAM type: YTN; PAM sequence: CTA
ccactcctgcagagattctt

SEQ ID NO: 280076 - DNA, 20 bp, Artificial Sequence
  Description of Artificial Sequence: Synthetic oligonucleotide
  Target: ATXN1; (+) strand; PAM type: YTN; PAM sequence: CTC
ctgcagagattcttgtagca

SEQ ID NO: 280077 - DNA, 20 bp, Artificial Sequence
  Description of Artificial Sequence: Synthetic oligonucleotide
  Target: ATXN1; (+) strand; PAM type: YTN; PAM sequence: CTG
cagagattcttgtagcaaat

SEQ ID NO: 280078 - DNA, 20 bp, Artificial Sequence
  Description of Artificial Sequence: Synthetic oligonucleotide
  Target: ATXN1; (+) strand; PAM type: YTN; PAM sequence: TTC
ttgtagcaaatccctgggtt

SEQ ID NO: 280079 - DNA, 20 bp, Artificial Sequence
  Description of Artificial Sequence: Synthetic oligonucleotide
  Target: ATXN1; (+) strand; PAM type: YTN; PAM sequence: CTT
gtagcaaatccctgggtttt

SEQ ID NO: 280080 - DNA, 20 bp, Artificial Sequence
  Description of Artificial Sequence: Synthetic oligonucleotide
  Target: ATXN1; (+) strand; PAM type: YTN; PAM sequence: TTG
tagcaaatccctgggttttt

SEQ ID NO: 280081 - DNA, 20 bp, Artificial Sequence
  Description of Artificial Sequence: Synthetic oligonucleotide
  Target: ATXN1; (+) strand; PAM type: YTN; PAM sequence: CTG
ggtttttcaccttgcctgtc

SEQ ID NO: 280082 - DNA, 20 bp, Artificial Sequence
  Description of Artificial Sequence: Synthetic oligonucleotide
  Target: ATXN1; (+) strand; PAM type: YTN; PAM sequence: TTT
ttcaccttgcctgtcaagca

SEQ ID NO: 280083 - DNA, 20 bp, Artificial Sequence
  Description of Artificial Sequence: Synthetic oligonucleotide
  Target: ATXN1; (+) strand; PAM type: YTN; PAM sequence: TTT
tcaccttgcctgtcaagcac

SEQ ID NO: 280084 - DNA, 20 bp, Artificial Sequence
  Description of Artificial Sequence: Synthetic oligonucleotide
  Target: ATXN1; (+) strand; PAM type: YTN; PAM sequence: TTT
caccttgcctgtcaagcaca

SEQ ID NO: 280085 - DNA, 20 bp, Artificial Sequence
  Description of Artificial Sequence: Synthetic oligonucleotide
  Target: ATXN1; (+) strand; PAM type: YTN; PAM sequence: TTC
accttgcctgtcaagcacaa

SEQ ID NO: 280086 - DNA, 20 bp, Artificial Sequence
  Description of Artificial Sequence: Synthetic oligonucleotide
  Target: ATXN1; (+) strand; PAM type: YTN; PAM sequence: CTT
gcctgtcaagcacaactttt

SEQ ID NO: 280087 - DNA, 20 bp, Artificial Sequence
  Description of Artificial Sequence: Synthetic oligonucleotide
  Target: ATXN1; (+) strand; PAM type: YTN; PAM sequence: TTG
cctgtcaagcacaacttttt

SEQ ID NO: 280088 - DNA, 20 bp, Artificial Sequence
  Description of Artificial Sequence: Synthetic oligonucleotide
  Target: ATXN1; (+) strand; PAM type: YTN; PAM sequence: CTG
tcaagcacaacttttttgat

SEQ ID NO: 280089 - DNA, 20 bp, Artificial Sequence
  Description of Artificial Sequence: Synthetic oligonucleotide
  Target: ATXN1; (+) strand; PAM type: YTN; PAM sequence: CTT
ttttgattcccttgaagaca

SEQ ID NO: 280090 - DNA, 20 bp, Artificial Sequence
  Description of Artificial Sequence: Synthetic oligonucleotide
  Target: ATXN1; (+) strand; PAM type: YTN; PAM sequence: TTT
tttgattcccttgaagacac

SEQ ID NO: 280091 - DNA, 20 bp, Artificial Sequence
  Description of Artificial Sequence: Synthetic oligonucleotide
  Target: ATXN1; (+) strand; PAM type: YTN; PAM sequence: TTT
ttgattcccttgaagacaca

SEQ ID NO: 280092 - DNA, 20 bp, Artificial Sequence
  Description of Artificial Sequence: Synthetic oligonucleotide
  Target: ATXN1; (+) strand; PAM type: YTN; PAM sequence: TTT
tgattcccttgaagacacat

SEQ ID NO: 280093 - DNA, 20 bp, Artificial Sequence
  Description of Artificial Sequence: Synthetic oligonucleotide
  Target: ATXN1; (+) strand; PAM type: YTN; PAM sequence: TTT
gattcccttgaagacacatt

SEQ ID NO: 280094 - DNA, 20 bp, Artificial Sequence
  Description of Artificial Sequence: Synthetic oligonucleotide
  Target: ATXN1; (+) strand; PAM type: YTN; PAM sequence: TTG
attcccttgaagacacattc

SEQ ID NO: 280095 - DNA, 20 bp, Artificial Sequence
  Description of Artificial Sequence: Synthetic oligonucleotide
  Target: ATXN1; (+) strand; PAM type: YTN; PAM sequence: TTC
ccttgaagacacattcagca

SEQ ID NO: 280096 - DNA, 20 bp, Artificial Sequence
  Description of Artificial Sequence: Synthetic oligonucleotide
  Target: ATXN1; (+) strand; PAM type: YTN; PAM sequence: CTT
gaagacacattcagcatcac

SEQ ID NO: 280097 - DNA, 20 bp, Artificial Sequence
  Description of Artificial Sequence: Synthetic oligonucleotide
  Target: ATXN1; (+) strand; PAM type: YTN; PAM sequence: TTG
aagacacattcagcatcaca

SEQ ID NO: 280098 - DNA, 20 bp, Artificial Sequence
  Description of Artificial Sequence: Synthetic oligonucleotide
  Target: ATXN1; (+) strand; PAM type: YTN; PAM sequence: TTC
agcatcacaaaagaggtggt

SEQ ID NO: 280099 - DNA, 20 bp, Artificial Sequence
  Description of Artificial Sequence: Synthetic oligonucleotide
  Target: ATXN1; (+) strand; PAM type: YTN; PAM sequence: CTT
actttcccccaattatgacc

SEQ ID NO: 280100 - DNA, 20 bp, Artificial Sequence
  Description of Artificial Sequence: Synthetic oligonucleotide
  Target: ATXN1; (+) strand; PAM type: YTN; PAM sequence: TTA
ctttcccccaattatgacca

SEQ ID NO: 280101 - DNA, 20 bp, Artificial Sequence
  Description of Artificial Sequence: Synthetic oligonucleotide
  Target: ATXN1; (+) strand; PAM type: YTN; PAM sequence: CTT
tcccccaattatgaccattt

SEQ ID NO: 280102 - DNA, 20 bp, Artificial Sequence
  Description of Artificial Sequence: Synthetic oligonucleotide
  Target: ATXN1; (+) strand; PAM type: YTN; PAM sequence: TTT
cccccaattatgaccatttt

SEQ ID NO: 280103 - DNA, 20 bp, Artificial Sequence
  Description of Artificial Sequence: Synthetic oligonucleotide
  Target: ATXN1; (+) strand; PAM type: YTN; PAM sequence: TTC
ccccaattatgaccattttt

SEQ ID NO: 280104 - DNA, 20 bp, Artificial Sequence
  Description of Artificial Sequence: Synthetic oligonucleotide
  Target: ATXN1; (+) strand; PAM type: YTN; PAM sequence: TTA
tgaccatttttagcatcaca

SEQ ID NO: 280105 - DNA, 20 bp, Artificial Sequence
  Description of Artificial Sequence: Synthetic oligonucleotide
  Target: ATXN1; (+) strand; PAM type: YTN; PAM sequence: TTT
ttagcatcacagtcaatttt

SEQ ID NO: 280106 - DNA, 20 bp, Artificial Sequence
  Description of Artificial Sequence: Synthetic oligonucleotide
  Target: ATXN1; (+) strand; PAM type: YTN; PAM sequence: TTT
tagcatcacagtcaattttc

SEQ ID NO: 280107 - DNA, 20 bp, Artificial Sequence
  Description of Artificial Sequence: Synthetic oligonucleotide
  Target: ATXN1; (+) strand; PAM type: YTN; PAM sequence: TTT
agcatcacagtcaattttcc

SEQ ID NO: 280108 - DNA, 20 bp, Artificial Sequence
  Description of Artificial Sequence: Synthetic oligonucleotide
  Target: ATXN1; (+) strand; PAM type: YTN; PAM sequence: TTA
gcatcacagtcaattttcca

SEQ ID NO: 280109 - DNA, 20 bp, Artificial Sequence
  Description of Artificial Sequence: Synthetic oligonucleotide
  Target: ATXN1; (+) strand; PAM type: YTN; PAM sequence: TTT
tccactgtccacctgatgga

SEQ ID NO: 280110 - DNA, 20 bp, Artificial Sequence
  Description of Artificial Sequence: Synthetic oligonucleotide
  Target: ATXN1; (+) strand; PAM type: YTN; PAM sequence: TTT
ccactgtccacctgatggac

SEQ ID NO: 280111 - DNA, 20 bp, Artificial Sequence
  Description of Artificial Sequence: Synthetic oligonucleotide
  Target: ATXN1; (+) strand; PAM type: YTN; PAM sequence: TTC
cactgtccacctgatggacc

SEQ ID NO: 280112 - DNA, 20 bp, Artificial Sequence
  Description of Artificial Sequence: Synthetic oligonucleotide
  Target: ATXN1; (+) strand; PAM type: YTN; PAM sequence: CTG
tccacctgatggaccggagg

SEQ ID NO: 280113 - DNA, 20 bp, Artificial Sequence
  Description of Artificial Sequence: Synthetic oligonucleotide
  Target: ATXN1; (+) strand; PAM type: YTN; PAM sequence: CTG
atggaccggagggcaaagct

SEQ ID NO: 280114 - DNA, 20 bp, Artificial Sequence
  Description of Artificial Sequence: Synthetic oligonucleotide
  Target: ATXN1; (+) strand; PAM type: YTN; PAM sequence: CTG
gctgaaattcacaggtaatc

SEQ ID NO: 280115 - DNA, 20 bp, Artificial Sequence
  Description of Artificial Sequence: Synthetic oligonucleotide
  Target: ATXN1; (+) strand; PAM type: YTN; PAM sequence: CTG
aaattcacaggtaatcccaa

SEQ ID NO: 280116 - DNA, 20 bp, Artificial Sequence
  Description of Artificial Sequence: Synthetic oligonucleotide
  Target: ATXN1; (+) strand; PAM type: YTN; PAM sequence: TTC
acaggtaatcccaactttat

SEQ ID NO: 280117 - DNA, 20 bp, Artificial Sequence
  Description of Artificial Sequence: Synthetic oligonucleotide
  Target: ATXN1; (+) strand; PAM type: YTN; PAM sequence: CTT
tattttagtcaaacatatca

SEQ ID NO: 280118 - DNA, 20 bp, Artificial Sequence
  Description of Artificial Sequence: Synthetic oligonucleotide
  Target: ATXN1; (+) strand; PAM type: YTN; PAM sequence: TTT
attttagtcaaacatatcaa

SEQ ID NO: 280119 - DNA, 20 bp, Artificial Sequence
  Description of Artificial Sequence: Synthetic oligonucleotide
  Target: ATXN1; (+) strand; PAM type: YTN; PAM sequence: TTA
ttttagtcaaacatatcaac

SEQ ID NO: 280120 - DNA, 20 bp, Artificial Sequence
  Description of Artificial Sequence: Synthetic oligonucleotide
  Target: ATXN1; (+) strand; PAM type: YTN; PAM sequence: TTT
tagtcaaacatatcaacctt

SEQ ID NO: 280121 - DNA, 20 bp, Artificial Sequence
  Description of Artificial Sequence: Synthetic oligonucleotide
  Target: ATXN1; (+) strand; PAM type: YTN; PAM sequence: TTT
agtcaaacatatcaaccttg

SEQ ID NO: 280122 - DNA, 20 bp, Artificial Sequence
  Description of Artificial Sequence: Synthetic oligonucleotide
  Target: ATXN1; (+) strand; PAM type: YTN; PAM sequence: TTA
gtcaaacatatcaaccttgc

SEQ ID NO: 280123 - DNA, 20 bp, Artificial Sequence
  Description of Artificial Sequence: Synthetic oligonucleotide
  Target: ATXN1; (+) strand; PAM type: YTN; PAM sequence: CTT
gcctcttcaaaatgaaaaaa

SEQ ID NO: 280124 - DNA, 20 bp, Artificial Sequence
  Description of Artificial Sequence: Synthetic oligonucleotide
  Target: ATXN1; (+) strand; PAM type: YTN; PAM sequence: TTG
cctcttcaaaatgaaaaaac

SEQ ID NO: 280125 - DNA, 20 bp, Artificial Sequence
  Description of Artificial Sequence: Synthetic oligonucleotide
  Target: ATXN1; (+) strand; PAM type: YTN; PAM sequence: CTC
ttcaaaatgaaaaaacaacc

SEQ ID NO: 280126 - DNA, 20 bp, Artificial Sequence
  Description of Artificial Sequence: Synthetic oligonucleotide
  Target: ATXN1; (+) strand; PAM type: YTN; PAM sequence: CTT
caaaatgaaaaaacaacctc

SEQ ID NO: 280127 - DNA, 20 bp, Artificial Sequence
  Description of Artificial Sequence: Synthetic oligonucleotide
  Target: ATXN1; (+) strand; PAM type: YTN; PAM sequence: TTC
aaaatgaaaaaacaacctct

SEQ ID NO: 280128 - DNA, 20 bp, Artificial Sequence
  Description of Artificial Sequence: Synthetic oligonucleotide
  Target: ATXN1; (+) strand; PAM type: YTN; PAM sequence: CTC
ttgttcctttcttctttgtt

SEQ ID NO: 280129 - DNA, 20 bp, Artificial Sequence
  Description of Artificial Sequence: Synthetic oligonucleotide
  Target: ATXN1; (+) strand; PAM type: YTN; PAM sequence: CTT
gttcctttcttctttgttca

SEQ ID NO: 280130 - DNA, 20 bp, Artificial Sequence
  Description of Artificial Sequence: Synthetic oligonucleotide
  Target: ATXN1; (+) strand; PAM type: YTN; PAM sequence: TTG
ttcctttcttctttgttcat

SEQ ID NO: 280131 - DNA, 20 bp, Artificial Sequence
  Description of Artificial Sequence: Synthetic oligonucleotide
  Target: ATXN1; (+) strand; PAM type: YTN; PAM sequence: TTC
ctttcttctttgttcatagg

SEQ ID NO: 280132 - DNA, 20 bp, Artificial Sequence
  Description of Artificial Sequence: Synthetic oligonucleotide
  Target: ATXN1; (+) strand; PAM type: YTN; PAM sequence: CTT
tcttctttgttcataggaga

SEQ ID NO: 280133 - DNA, 20 bp, Artificial Sequence
  Description of Artificial Sequence: Synthetic oligonucleotide
  Target: ATXN1; (+) strand; PAM type: YTN; PAM sequence: TTT
cttctttgttcataggagaa

SEQ ID NO: 280134 - DNA, 20 bp, Artificial Sequence
  Description of Artificial Sequence: Synthetic oligonucleotide
  Target: ATXN1; (+) strand; PAM type: YTN; PAM sequence: TTC
ttctttgttcataggagaac

SEQ ID NO: 280135 - DNA, 20 bp, Artificial Sequence
  Description of Artificial Sequence: Synthetic oligonucleotide
  Target: ATXN1; (+) strand; PAM type: YTN; PAM sequence: CTT
ctttgttcataggagaacaa

SEQ ID NO: 280136 - DNA, 20 bp, Artificial Sequence
  Description of Artificial Sequence: Synthetic oligonucleotide
  Target: ATXN1; (+) strand; PAM type: YTN; PAM sequence: TTC
tttgttcataggagaacaaa

SEQ ID NO: 280137 - DNA, 20 bp, Artificial Sequence
  Description of Artificial Sequence: Synthetic oligonucleotide
  Target: ATXN1; (+) strand; PAM type: YTN; PAM sequence: CTT
tgttcataggagaacaaaat

SEQ ID NO: 280138 - DNA, 20 bp, Artificial Sequence
  Description of Artificial Sequence: Synthetic oligonucleotide
  Target: ATXN1; (+) strand; PAM type: YTN; PAM sequence: TTT
gttcataggagaacaaaatg

SEQ ID NO: 280139 - DNA, 20 bp, Artificial Sequence
  Description of Artificial Sequence: Synthetic oligonucleotide
  Target: ATXN1; (+) strand; PAM type: YTN; PAM sequence: TTG
ttcataggagaacaaaatgg

SEQ ID NO: 280140 - DNA, 20 bp, Artificial Sequence
  Description of Artificial Sequence: Synthetic oligonucleotide
  Target: ATXN1; (+) strand; PAM type: YTN; PAM sequence: TTC
ataggagaacaaaatgggag

SEQ ID NO: 280141 - DNA, 20 bp, Artificial Sequence
  Description of Artificial Sequence: Synthetic oligonucleotide
  Target: ATXN1; (+) strand; PAM type: YTN; PAM sequence: TTA
gtggagacaatgggagtgag

SEQ ID NO: 280142 - DNA, 20 bp, Artificial Sequence
  Description of Artificial Sequence: Synthetic oligonucleotide
  Target: ATXN1; (+) strand; PAM type: YTN; PAM sequence: TTA
gtgtgctttgtatacaatgt

SEQ ID NO: 280143 - DNA, 20 bp, Artificial Sequence
  Description of Artificial Sequence: Synthetic oligonucleotide
  Target: ATXN1; (+) strand; PAM type: YTN; PAM sequence: CTT
tgtatacaatgtagagaaac

SEQ ID NO: 280144 - DNA, 20 bp, Artificial Sequence
  Description of Artificial Sequence: Synthetic oligonucleotide
  Target: ATXN1; (+) strand; PAM type: YTN; PAM sequence: TTT
gtatacaatgtagagaaact

SEQ ID NO: 280145 - DNA, 20 bp, Artificial Sequence
  Description of Artificial Sequence: Synthetic oligonucleotide
  Target: ATXN1; (+) strand; PAM type: YTN; PAM sequence: TTG
tatacaatgtagagaaacta

SEQ ID NO: 280146 - DNA, 20 bp, Artificial Sequence
  Description of Artificial Sequence: Synthetic oligonucleotide
  Target: ATXN1; (+) strand; PAM type: YTN; PAM sequence: CTA
ttgaaaaataaaataaaaag

SEQ ID NO: 280147 - DNA, 20 bp, Artificial Sequence
  Description of Artificial Sequence: Synthetic oligonucleotide
  Target: ATXN1; (+) strand; PAM type: YTN; PAM sequence: TTG
aaaaataaaataaaaagaat

SEQ ID NO: 280148 - DNA, 20 bp, Artificial Sequence
  Description of Artificial Sequence: Synthetic oligonucleotide
  Target: ATXN1; (+) strand; PAM type: YTN; PAM sequence: TTT
tatgaaatattctataaaag

SEQ ID NO: 280149 - DNA, 20 bp, Artificial Sequence
  Description of Artificial Sequence: Synthetic oligonucleotide
  Target: ATXN1; (+) strand; PAM type: YTN; PAM sequence: TTT
atgaaatattctataaaagt

SEQ ID NO: 280150 - DNA, 20 bp, Artificial Sequence
  Description of Artificial Sequence: Synthetic oligonucleotide
  Target: ATXN1; (+) strand; PAM type: YTN; PAM sequence: TTA
tgaaatattctataaaagtc

SEQ ID NO: 280151 - DNA, 20 bp, Artificial Sequence
  Description of Artificial Sequence: Synthetic oligonucleotide
  Target: ATXN1; (+) strand; PAM type: YTN; PAM sequence: TTC
tataaaagtcaggcttccta

SEQ ID NO: 280152 - DNA, 20 bp, Artificial Sequence
  Description of Artificial Sequence: Synthetic oligonucleotide
  Target: ATXN1; (+) strand; PAM type: YTN; PAM sequence: CTA
taaaagtcaggcttcctacc

SEQ ID NO: 280153 - DNA, 20 bp, Artificial Sequence
  Description of Artificial Sequence: Synthetic oligonucleotide
  Target: ATXN1; (+) strand; PAM type: YTN; PAM sequence: CTT
cctacccagatgaccttcgg

SEQ ID NO: 280154 - DNA, 20 bp, Artificial Sequence
  Description of Artificial Sequence: Synthetic oligonucleotide
  Target: ATXN1; (+) strand; PAM type: YTN; PAM sequence: TTC
ctacccagatgaccttcgga

SEQ ID NO: 280155 - DNA, 20 bp, Artificial Sequence
  Description of Artificial Sequence: Synthetic oligonucleotide
  Target: ATXN1; (+) strand; PAM type: YTN; PAM sequence: CTA
cccagatgaccttcggaaaa

SEQ ID NO: 280156 - DNA, 20 bp, Artificial Sequence
  Description of Artificial Sequence: Synthetic oligonucleotide
  Target: ATXN1; (+) strand; PAM type: YTN; PAM sequence: CTT
cggaaaaatttctctgaatc

SEQ ID NO: 280157 - DNA, 20 bp, Artificial Sequence
  Description of Artificial Sequence: Synthetic oligonucleotide
  Target: ATXN1; (+) strand; PAM type: YTN; PAM sequence: TTC
ggaaaaatttctctgaatcc

SEQ ID NO: 280158 - DNA, 20 bp, Artificial Sequence
  Description of Artificial Sequence: Synthetic oligonucleotide
  Target: ATXN1; (+) strand; PAM type: YTN; PAM sequence: TTT
ctctgaatccctgatgcctt

SEQ ID NO: 280159 - DNA, 20 bp, Artificial Sequence
  Description of Artificial Sequence: Synthetic oligonucleotide
  Target: ATXN1; (+) strand; PAM type: YTN; PAM sequence: TTC
tctgaatccctgatgccttg

SEQ ID NO: 280160 - DNA, 20 bp, Artificial Sequence
  Description of Artificial Sequence: Synthetic oligonucleotide
  Target: ATXN1; (+) strand; PAM type: YTN; PAM sequence: CTC
tgaatccctgatgccttggg

SEQ ID NO: 280161 - DNA, 20 bp, Artificial Sequence
  Description of Artificial Sequence: Synthetic oligonucleotide
  Target: ATXN1; (+) strand; PAM type: YTN; PAM sequence: CTG
aatccctgatgccttgggta

SEQ ID NO: 280162 - DNA, 20 bp, Artificial Sequence
  Description of Artificial Sequence: Synthetic oligonucleotide
  Target: ATXN1; (+) strand; PAM type: YTN; PAM sequence: CTG
atgccttgggtatccagtat

SEQ ID NO: 280163 - DNA, 20 bp, Artificial Sequence
  Description of Artificial Sequence: Synthetic oligonucleotide
  Target: ATXN1; (+) strand; PAM type: YTN; PAM sequence: CTT
gggtatccagtatgcagtat

SEQ ID NO: 280164 - DNA, 20 bp, Artificial Sequence
  Description of Artificial Sequence: Synthetic oligonucleotide
  Target: ATXN1; (+) strand; PAM type: YTN; PAM sequence: TTG
ggtatccagtatgcagtata

SEQ ID NO: 280165 - DNA, 20 bp, Artificial Sequence
  Description of Artificial Sequence: Synthetic oligonucleotide
  Target: ATXN1; (+) strand; PAM type: YTN; PAM sequence: CTG
atacaagagattggaggatc

SEQ ID NO: 280166 - DNA, 20 bp, Artificial Sequence
  Description of Artificial Sequence: Synthetic oligonucleotide
  Target: ATXN1; (+) strand; PAM type: YTN; PAM sequence: TTG
gaggatccatgagttcattc

SEQ ID NO: 280167 - DNA, 20 bp, Artificial Sequence
  Description of Artificial Sequence: Synthetic oligonucleotide
  Target: ATXN1; (+) strand; PAM type: YTN; PAM sequence: TTC
attctgggctgtatagtgat

SEQ ID NO: 280168 - DNA, 20 bp, Artificial Sequence
  Description of Artificial Sequence: Synthetic oligonucleotide
  Target: ATXN1; (+) strand; PAM type: YTN; PAM sequence: TTC
tgggctgtatagtgatgcca

SEQ ID NO: 280169 - DNA, 20 bp, Artificial Sequence
  Description of Artificial Sequence: Synthetic oligonucleotide
  Target: ATXN1; (+) strand; PAM type: YTN; PAM sequence: CTG
ggctgtatagtgatgccata

SEQ ID NO: 280170 - DNA, 20 bp, Artificial Sequence
  Description of Artificial Sequence: Synthetic oligonucleotide
  Target: ATXN1; (+) strand; PAM type: YTN; PAM sequence: CTG
tatagtgatgccataacact

SEQ ID NO: 280171 - DNA, 20 bp, Artificial Sequence
  Description of Artificial Sequence: Synthetic oligonucleotide
  Target: ATXN1; (+) strand; PAM type: YTN; PAM sequence: CTC
attgctattttccaagcttg

SEQ ID NO: 280172 - DNA, 20 bp, Artificial Sequence
  Description of Artificial Sequence: Synthetic oligonucleotide
  Target: ATXN1; (+) strand; PAM type: YTN; PAM sequence: TTG
ctattttccaagcttgagaa

SEQ ID NO: 280173 - DNA, 20 bp, Artificial Sequence
  Description of Artificial Sequence: Synthetic oligonucleotide
  Target: ATXN1; (+) strand; PAM type: YTN; PAM sequence: CTA
ttttccaagcttgagaatca

SEQ ID NO: 280174 - DNA, 20 bp, Artificial Sequence
  Description of Artificial Sequence: Synthetic oligonucleotide
  Target: ATXN1; (+) strand; PAM type: YTN; PAM sequence: TTT
tccaagcttgagaatcattt

SEQ ID NO: 280175 - DNA, 20 bp, Artificial Sequence
  Description of Artificial Sequence: Synthetic oligonucleotide
  Target: ATXN1; (+) strand; PAM type: YTN; PAM sequence: TTT
ccaagcttgagaatcattta

SEQ ID NO: 280176 - DNA, 20 bp, Artificial Sequence
  Description of Artificial Sequence: Synthetic oligonucleotide
  Target: ATXN1; (+) strand; PAM type: YTN; PAM sequence: TTC
caagcttgagaatcatttaa

SEQ ID NO: 280177 - DNA, 20 bp, Artificial Sequence
  Description of Artificial Sequence: Synthetic oligonucleotide
  Target: ATXN1; (+) strand; PAM type: YTN; PAM sequence: CTT
gagaatcatttaatatttcc

SEQ ID NO: 280178 - DNA, 20 bp, Artificial Sequence
  Description of Artificial Sequence: Synthetic oligonucleotide
  Target: ATXN1; (+) strand; PAM type: YTN; PAM sequence: TTG
agaatcatttaatatttccc

SEQ ID NO: 280179 - DNA, 20 bp, Artificial Sequence
  Description of Artificial Sequence: Synthetic oligonucleotide
  Target: ATXN1; (+) strand; PAM type: YTN; PAM sequence: TTT
aatatttccctaaaactatc

SEQ ID NO: 280180 - DNA, 20 bp, Artificial Sequence
  Description of Artificial Sequence: Synthetic oligonucleotide
  Target: ATXN1; (+) strand; PAM type: YTN; PAM sequence: TTA
atatttccctaaaactatct

SEQ ID NO: 280181 - DNA, 20 bp, Artificial Sequence
  Description of Artificial Sequence: Synthetic oligonucleotide
  Target: ATXN1; (+) strand; PAM type: YTN; PAM sequence: TTT
ccctaaaactatctgattaa

SEQ ID NO: 280182 - DNA, 20 bp, Artificial Sequence
  Description of Artificial Sequence: Synthetic oligonucleotide
  Target: ATXN1; (+) strand; PAM type: YTN; PAM sequence: TTC
cctaaaactatctgattaac

SEQ ID NO: 280183 - DNA, 20 bp, Artificial Sequence
  Description of Artificial Sequence: Synthetic oligonucleotide
  Target: ATXN1; (+) strand; PAM type: YTN; PAM sequence: CTA
aaactatctgattaactgca

SEQ ID NO: 280184 - DNA, 20 bp, Artificial Sequence
  Description of Artificial Sequence: Synthetic oligonucleotide
  Target: ATXN1; (+) strand; PAM type: YTN; PAM sequence: CTA
tctgattaactgcaaaatgg

SEQ ID NO: 280185 - DNA, 20 bp, Artificial Sequence
  Description of Artificial Sequence: Synthetic oligonucleotide
  Target: ATXN1; (+) strand; PAM type: YTN; PAM sequence: CTG
attaactgcaaaatggtgca

SEQ ID NO: 280186 - DNA, 20 bp, Artificial Sequence
  Description of Artificial Sequence: Synthetic oligonucleotide
  Target: ATXN1; (+) strand; PAM type: YTN; PAM sequence: TTA
actgcaaaatggtgcactga

SEQ ID NO: 280187 - DNA, 20 bp, Artificial Sequence
  Description of Artificial Sequence: Synthetic oligonucleotide
  Target: ATXN1; (+) strand; PAM type: YTN; PAM sequence: CTG
caaaatggtgcactgagcaa

SEQ ID NO: 280188 - DNA, 20 bp, Artificial Sequence
  Description of Artificial Sequence: Synthetic oligonucleotide
  Target: ATXN1; (+) strand; PAM type: YTN; PAM sequence: CTG
agcaatgataatatttttgc

SEQ ID NO: 280189 - DNA, 20 bp, Artificial Sequence
  Description of Artificial Sequence: Synthetic oligonucleotide
  Target: ATXN1; (+) strand; PAM type: YTN; PAM sequence: TTT
ttgcaattacaggagttaat

SEQ ID NO: 280190 - DNA, 20 bp, Artificial Sequence
  Description of Artificial Sequence: Synthetic oligonucleotide
  Target: ATXN1; (+) strand; PAM type: YTN; PAM sequence: TTT
tgcaattacaggagttaatt

SEQ ID NO: 280191 - DNA, 20 bp, Artificial Sequence
  Description of Artificial Sequence: Synthetic oligonucleotide
  Target: ATXN1; (+) strand; PAM type: YTN; PAM sequence: TTT
gcaattacaggagttaatta

SEQ ID NO: 280192 - DNA, 20 bp, Artificial Sequence
  Description of Artificial Sequence: Synthetic oligonucleotide
  Target: ATXN1; (+) strand; PAM type: YTN; PAM sequence: TTG
caattacaggagttaattat

SEQ ID NO: 280193 - DNA, 20 bp, Artificial Sequence
  Description of Artificial Sequence: Synthetic oligonucleotide
  Target: ATXN1; (+) strand; PAM type: YTN; PAM sequence: TTA
caggagttaattattttggt

SEQ ID NO: 280194 - DNA, 20 bp, Artificial Sequence
  Description of Artificial Sequence: Synthetic oligonucleotide
  Target: ATXN1; (+) strand; PAM type: YTN; PAM sequence: TTA
attattttggttcagactat

SEQ ID NO: 280195 - DNA, 20 bp, Artificial Sequence
  Description of Artificial Sequence: Synthetic oligonucleotide
  Target: ATXN1; (+) strand; PAM type: YTN; PAM sequence: TTA
ttttggttcagactatacaa

SEQ ID NO: 280196 - DNA, 20 bp, Artificial Sequence
  Description of Artificial Sequence: Synthetic oligonucleotide
  Target: ATXN1; (+) strand; PAM type: YTN; PAM sequence: TTT
tggttcagactatacaacaa

SEQ ID NO: 280197 - DNA, 20 bp, Artificial Sequence
  Description of Artificial Sequence: Synthetic oligonucleotide
  Target: ATXN1; (+) strand; PAM type: YTN; PAM sequence: TTT
ggttcagactatacaacaac

SEQ ID NO: 280198 - DNA, 20 bp, Artificial Sequence
  Description of Artificial Sequence: Synthetic oligonucleotide
  Target: ATXN1; (+) strand; PAM type: YTN; PAM sequence: TTG
gttcagactatacaacaacc

SEQ ID NO: 280199 - DNA, 20 bp, Artificial Sequence
  Description of Artificial Sequence: Synthetic oligonucleotide
  Target: ATXN1; (+) strand; PAM type: YTN; PAM sequence: TTC
agactatacaacaaccctct

SEQ ID NO: 280200 - DNA, 20 bp, Artificial Sequence
  Description of Artificial Sequence: Synthetic oligonucleotide
  Target: ATXN1; (+) strand; PAM type: YTN; PAM sequence: CTA
tacaacaaccctctcccacc

SEQ ID NO: 280201 - DNA, 20 bp, Artificial Sequence
  Description of Artificial Sequence: Synthetic oligonucleotide
  Target: ATXN1; (+) strand; PAM type: YTN; PAM sequence: CTC
tcccacccacctctccacag

SEQ ID NO: 280202 - DNA, 20 bp, Artificial Sequence
  Description of Artificial Sequence: Synthetic oligonucleotide
  Target: ATXN1; (+) strand; PAM type: YTN; PAM sequence: CTC
ccacccacctctccacagat

SEQ ID NO: 280203 - DNA, 20 bp, Artificial Sequence
  Description of Artificial Sequence: Synthetic oligonucleotide
  Target: ATXN1; (+) strand; PAM type: YTN; PAM sequence: CTC
tccacagatacattttgcta

SEQ ID NO: 280204 - DNA, 20 bp, Artificial Sequence
  Description of Artificial Sequence: Synthetic oligonucleotide
  Target: ATXN1; (+) strand; PAM type: YTN; PAM sequence: CTC
cacagatacattttgctaag

SEQ ID NO: 280205 - DNA, 20 bp, Artificial Sequence
  Description of Artificial Sequence: Synthetic oligonucleotide
  Target: ATXN1; (+) strand; PAM type: YTN; PAM sequence: TTT
tgctaagttttgcttttctt

SEQ ID NO: 280206 - DNA, 20 bp, Artificial Sequence
  Description of Artificial Sequence: Synthetic oligonucleotide
  Target: ATXN1; (+) strand; PAM type: YTN; PAM sequence: TTT
gctaagttttgcttttcttc

SEQ ID NO: 280207 - DNA, 20 bp, Artificial Sequence
  Description of Artificial Sequence: Synthetic oligonucleotide
  Target: ATXN1; (+) strand; PAM type: YTN; PAM sequence: TTG
ctaagttttgcttttcttca

SEQ ID NO: 280208 - DNA, 20 bp, Artificial Sequence
  Description of Artificial Sequence: Synthetic oligonucleotide
  Target: ATXN1; (+) strand; PAM type: YTN; PAM sequence: CTA
agttttgcttttcttcattg

SEQ ID NO: 280209 - DNA, 20 bp, Artificial Sequence
  Description of Artificial Sequence: Synthetic oligonucleotide
  Target: ATXN1; (+) strand; PAM type: YTN; PAM sequence: TTT
tgcttttcttcattggtaaa

SEQ ID NO: 280210 - DNA, 20 bp, Artificial Sequence
  Description of Artificial Sequence: Synthetic oligonucleotide
  Target: ATXN1; (+) strand; PAM type: YTN; PAM sequence: TTT
gcttttcttcattggtaaat

SEQ ID NO: 280211 - DNA, 20 bp, Artificial Sequence
  Description of Artificial Sequence: Synthetic oligonucleotide
  Target: ATXN1; (+) strand; PAM type: YTN; PAM sequence: TTG
cttttcttcattggtaaata

SEQ ID NO: 280212 - DNA, 20 bp, Artificial Sequence
  Description of Artificial Sequence: Synthetic oligonucleotide
  Target: ATXN1; (+) strand; PAM type: YTN; PAM sequence: CTT
ttcttcattggtaaataaaa

SEQ ID NO: 280213 - DNA, 20 bp, Artificial Sequence
  Description of Artificial Sequence: Synthetic oligonucleotide
  Target: ATXN1; (+) strand; PAM type: YTN; PAM sequence: TTT
tcttcattggtaaataaaaa

SEQ ID NO: 280214 - DNA, 20 bp, Artificial Sequence
  Description of Artificial Sequence: Synthetic oligonucleotide
  Target: ATXN1; (+) strand; PAM type: YTN; PAM sequence: TTT
cttcattggtaaataaaaat

SEQ ID NO: 280215 - DNA, 20 bp, Artificial Sequence
  Description of Artificial Sequence: Synthetic oligonucleotide
  Target: ATXN1; (+) strand; PAM type: YTN; PAM sequence: TTC
ttcattggtaaataaaaatg

SEQ ID NO: 280216 - DNA, 20 bp, Artificial Sequence
  Description of Artificial Sequence: Synthetic oligonucleotide
  Target: ATXN1; (+) strand; PAM type: YTN; PAM sequence: CTT
cattggtaaataaaaatggg

SEQ ID NO: 280217 - DNA, 20 bp, Artificial Sequence
  Description of Artificial Sequence: Synthetic oligonucleotide
  Target: ATXN1; (+) strand; PAM type: YTN; PAM sequence: TTC
attggtaaataaaaatggga

SEQ ID NO: 280218 - DNA, 20 bp, Artificial Sequence
  Description of Artificial Sequence: Synthetic oligonucleotide
  Target: ATXN1; (+) strand; PAM type: YTN; PAM sequence: TTG
gtaaataaaaatgggacatt

SEQ ID NO: 280219 - DNA, 20 bp, Artificial Sequence
  Description of Artificial Sequence: Synthetic oligonucleotide
  Target: ATXN1; (+) strand; PAM type: YTN; PAM sequence: TTC
accaacaagttcccatagag

SEQ ID NO: 280220 - DNA, 20 bp, Artificial Sequence
  Description of Artificial Sequence: Synthetic oligonucleotide
  Target: ATXN1; (+) strand; PAM type: YTN; PAM sequence: TTC
ccatagagccatacttttca

SEQ ID NO: 280221 - DNA, 20 bp, Artificial Sequence
  Description of Artificial Sequence: Synthetic oligonucleotide
  Target: ATXN1; (+) strand; PAM type: YTN; PAM sequence: CTT
ttcactcctttcatttagca

SEQ ID NO: 280222 - DNA, 20 bp, Artificial Sequence
  Description of Artificial Sequence: Synthetic oligonucleotide
  Target: ATXN1; (+) strand; PAM type: YTN; PAM sequence: TTT
tcactcctttcatttagcaa

SEQ ID NO: 280223 - DNA, 20 bp, Artificial Sequence
  Description of Artificial Sequence: Synthetic oligonucleotide
  Target: ATXN1; (+) strand; PAM type: YTN; PAM sequence: TTT
cactcctttcatttagcaaa

SEQ ID NO: 280224 - DNA, 20 bp, Artificial Sequence
  Description of Artificial Sequence: Synthetic oligonucleotide
  Target: ATXN1; (+) strand; PAM type: YTN; PAM sequence: TTC
actcctttcatttagcaaac

SEQ ID NO: 280225 - DNA, 20 bp, Artificial Sequence
  Description of Artificial Sequence: Synthetic oligonucleotide
  Target: ATXN1; (+) strand; PAM type: YTN; PAM sequence: CTC
ctttcatttagcaaacattg

SEQ ID NO: 280226 - DNA, 20 bp, Artificial Sequence
  Description of Artificial Sequence: Synthetic oligonucleotide
  Target: ATXN1; (+) strand; PAM type: YTN; PAM sequence: CTT
tcatttagcaaacattgaca

SEQ ID NO: 280227 - DNA, 20 bp, Artificial Sequence
  Description of Artificial Sequence: Synthetic oligonucleotide
  Target: ATXN1; (+) strand; PAM type: YTN; PAM sequence: TTT
catttagcaaacattgacac

SEQ ID NO: 280228 - DNA, 20 bp, Artificial Sequence
  Description of Artificial Sequence: Synthetic oligonucleotide
  Target: ATXN1; (+) strand; PAM type: YTN; PAM sequence: TTC
atttagcaaacattgacaca

SEQ ID NO: 280229 - DNA, 20 bp, Artificial Sequence
  Description of Artificial Sequence: Synthetic oligonucleotide
  Target: ATXN1; (+) strand; PAM type: YTN; PAM sequence: TTT
agcaaacattgacacaatat

SEQ ID NO: 280230 - DNA, 20 bp, Artificial Sequence
  Description of Artificial Sequence: Synthetic oligonucleotide
  Target: ATXN1; (+) strand; PAM type: YTN; PAM sequence: TTA
gcaaacattgacacaatatt

SEQ ID NO: 280231 - DNA, 20 bp, Artificial Sequence
  Description of Artificial Sequence: Synthetic oligonucleotide
  Target: ATXN1; (+) strand; PAM type: YTN; PAM sequence: TTG
acacaatatttactgtgttt

SEQ ID NO: 280232 - DNA, 20 bp, Artificial Sequence
  Description of Artificial Sequence: Synthetic oligonucleotide
  Target: ATXN1; (+) strand; PAM type: YTN; PAM sequence: TTT
actgtgtttaaggacagggg

SEQ ID NO: 280233 - DNA, 20 bp, Artificial Sequence
  Description of Artificial Sequence: Synthetic oligonucleotide
  Target: ATXN1; (+) strand; PAM type: YTN; PAM sequence: TTA
ctgtgtttaaggacaggggt

SEQ ID NO: 280234 - DNA, 20 bp, Artificial Sequence
  Description of Artificial Sequence: Synthetic oligonucleotide
  Target: ATXN1; (+) strand; PAM type: YTN; PAM sequence: CTG
tgtttaaggacaggggttaa

SEQ ID NO: 280235 - DNA, 20 bp, Artificial Sequence
  Description of Artificial Sequence: Synthetic oligonucleotide
  Target: ATXN1; (+) strand; PAM type: YTN; PAM sequence: TTT
aaggacaggggttaaattct

SEQ ID NO: 280236 - DNA, 20 bp, Artificial Sequence
  Description of Artificial Sequence: Synthetic oligonucleotide
  Target: ATXN1; (+) strand; PAM type: YTN; PAM sequence: TTA
aggacaggggttaaattctc

SEQ ID NO: 280237 - DNA, 20 bp, Artificial Sequence
  Description of Artificial Sequence: Synthetic oligonucleotide
  Target: ATXN1; (+) strand; PAM type: YTN; PAM sequence: TTA
aattctcaatatactgtctc

SEQ ID NO: 280238 - DNA, 20 bp, Artificial Sequence
  Description of Artificial Sequence: Synthetic oligonucleotide
  Target: ATXN1; (+) strand; PAM type: YTN; PAM sequence: TTC
tcaatatactgtctcatgag

SEQ ID NO: 280239 - DNA, 20 bp, Artificial Sequence
  Description of Artificial Sequence: Synthetic oligonucleotide
  Target: ATXN1; (+) strand; PAM type: YTN; PAM sequence: CTC
aatatactgtctcatgagta

SEQ ID NO: 280240 - DNA, 20 bp, Artificial Sequence
  Description of Artificial Sequence: Synthetic oligonucleotide
  Target: ATXN1; (+) strand; PAM type: YTN; PAM sequence: CTG
tctcatgagtacatagttta

SEQ ID NO: 280241 - DNA, 20 bp, Artificial Sequence
  Description of Artificial Sequence: Synthetic oligonucleotide
  Target: ATXN1; (+) strand; PAM type: YTN; PAM sequence: CTC
atgagtacatagtttaaaag

SEQ ID NO: 280242 - DNA, 20 bp, Artificial Sequence
  Description of Artificial Sequence: Synthetic oligonucleotide
  Target: ATXN1; (+) strand; PAM type: YTN; PAM sequence: TTT
aaaagaaatgtgtttcaaca

SEQ ID NO: 280243 - DNA, 20 bp, Artificial Sequence
  Description of Artificial Sequence: Synthetic oligonucleotide
  Target: ATXN1; (+) strand; PAM type: YTN; PAM sequence: TTA
aaagaaatgtgtttcaacaa

SEQ ID NO: 280244 - DNA, 20 bp, Artificial Sequence
  Description of Artificial Sequence: Synthetic oligonucleotide
  Target: ATXN1; (+) strand; PAM type: YTN; PAM sequence: TTT
caacaaataatttgaaaacc

SEQ ID NO: 280245 - DNA, 20 bp, Artificial Sequence
  Description of Artificial Sequence: Synthetic oligonucleotide
  Target: ATXN1; (+) strand; PAM type: YTN; PAM sequence: TTC
aacaaataatttgaaaacca

SEQ ID NO: 280246 - DNA, 20 bp, Artificial Sequence
  Description of Artificial Sequence: Synthetic oligonucleotide
  Target: ATXN1; (+) strand; PAM type: YTN; PAM sequence: TTT
gaaaaccaagtaaaagtaag

SEQ ID NO: 280247 - DNA, 20 bp, Artificial Sequence
  Description of Artificial Sequence: Synthetic oligonucleotide
  Target: ATXN1; (+) strand; PAM type: YTN; PAM sequence: TTG
aaaaccaagtaaaagtaaga

SEQ ID NO: 280248 - DNA, 20 bp, Artificial Sequence
  Description of Artificial Sequence: Synthetic oligonucleotide
  Target: ATXN1; (+) strand; PAM type: YTN; PAM sequence: TTA
aaaatgtggaccaaaaaaaa

SEQ ID NO: 280249 - DNA, 20 bp, Artificial Sequence
  Description of Artificial Sequence: Synthetic oligonucleotide
  Target: ATXN1; (+) strand; PAM type: YTN; PAM sequence: CTT
cctggggtcatttgagatta

SEQ ID NO: 280250 - DNA, 20 bp, Artificial Sequence
  Description of Artificial Sequence: Synthetic oligonucleotide
  Target: ATXN1; (+) strand; PAM type: YTN; PAM sequence: TTC
ctggggtcatttgagattat

SEQ ID NO: 280251 - DNA, 20 bp, Artificial Sequence
  Description of Artificial Sequence: Synthetic oligonucleotide
  Target: ATXN1; (+) strand; PAM type: YTN; PAM sequence: CTG
gggtcatttgagattatgtc

SEQ ID NO: 280252 - DNA, 20 bp, Artificial Sequence
  Description of Artificial Sequence: Synthetic oligonucleotide
  Target: ATXN1; (+) strand; PAM type: YTN; PAM sequence: TTT
gagattatgtcataaggaga

SEQ ID NO: 280253 - DNA, 20 bp, Artificial Sequence
  Description of Artificial Sequence: Synthetic oligonucleotide
  Target: ATXN1; (+) strand; PAM type: YTN; PAM sequence: TTG
agattatgtcataaggagaa

SEQ ID NO: 280254 - DNA, 20 bp, Artificial Sequence
  Description of Artificial Sequence: Synthetic oligonucleotide
  Target: ATXN1; (+) strand; PAM type: YTN; PAM sequence: TTA
tgtcataaggagaacacaga

SEQ ID NO: 280255 - DNA, 20 bp, Artificial Sequence
  Description of Artificial Sequence: Synthetic oligonucleotide
  Target: ATXN1; (+) strand; PAM type: YTN; PAM sequence: TTT
gatgtggtcctggaaaagaa

SEQ ID NO: 280256 - DNA, 20 bp, Artificial Sequence
  Description of Artificial Sequence: Synthetic oligonucleotide
  Target: ATXN1; (+) strand; PAM type: YTN; PAM sequence: TTG
atgtggtcctggaaaagaat

SEQ ID NO: 280257 - DNA, 20 bp, Artificial Sequence
  Description of Artificial Sequence: Synthetic oligonucleotide
  Target: ATXN1; (+) strand; PAM type: YTN; PAM sequence: CTG
gaaaagaatatatagaaatg

SEQ ID NO: 280258 - DNA, 20 bp, Artificial Sequence
  Description of Artificial Sequence: Synthetic oligonucleotide
  Target: ATXN1; (+) strand; PAM type: YTN; PAM sequence: CTA
ggtgaaagaaaccagagatg

SEQ ID NO: 280259 - DNA, 20 bp, Artificial Sequence
  Description of Artificial Sequence: Synthetic oligonucleotide
  Target: ATXN1; (+) strand; PAM type: YTN; PAM sequence: CTT
gaggtgtgagaggaacatgt

SEQ ID NO: 280260 - DNA, 20 bp, Artificial Sequence
  Description of Artificial Sequence: Synthetic oligonucleotide
  Target: ATXN1; (+) strand; PAM type: YTN; PAM sequence: TTG
aggtgtgagaggaacatgta

SEQ ID NO: 280261 - DNA, 20 bp, Artificial Sequence
  Description of Artificial Sequence: Synthetic oligonucleotide
  Target: ATXN1; (+) strand; PAM type: YTN; PAM sequence: TTA
tggggaagcctgggctgcaa

SEQ ID NO: 280262 - DNA, 20 bp, Artificial Sequence
  Description of Artificial Sequence: Synthetic oligonucleotide
  Target: ATXN1; (+) strand; PAM type: YTN; PAM sequence: CTG
ggctgcaatgagtaaggtta

SEQ ID NO: 280263 - DNA, 20 bp, Artificial Sequence
  Description of Artificial Sequence: Synthetic oligonucleotide
  Target: ATXN1; (+) strand; PAM type: YTN; PAM sequence: CTG
caatgagtaaggttaggaag

SEQ ID NO: 280264 - DNA, 20 bp, Artificial Sequence
  Description of Artificial Sequence: Synthetic oligonucleotide
  Target: ATXN1; (+) strand; PAM type: YTN; PAM sequence: TTA
ggaaggtaggctgtaaccaa

SEQ ID NO: 280265 - DNA, 20 bp, Artificial Sequence
  Description of Artificial Sequence: Synthetic oligonucleotide
  Target: ATXN1; (+) strand; PAM type: YTN; PAM sequence: CTG
taaccaagtcacaacactcc

SEQ ID NO: 280266 - DNA, 20 bp, Artificial Sequence
  Description of Artificial Sequence: Synthetic oligonucleotide
  Target: ATXN1; (+) strand; PAM type: YTN; PAM sequence: CTC
cctcaggacctggaagatgt

SEQ ID NO: 280267 - DNA, 20 bp, Artificial Sequence
  Description of Artificial Sequence: Synthetic oligonucleotide
  Target: ATXN1; (+) strand; PAM type: YTN; PAM sequence: CTC
aggacctggaagatgtaaac

SEQ ID NO: 280268 - DNA, 20 bp, Artificial Sequence
  Description of Artificial Sequence: Synthetic oligonucleotide
  Target: ATXN1; (+) strand; PAM type: YTN; PAM sequence: CTG
gaagatgtaaacaaggaaga

SEQ ID NO: 280269 - DNA, 20 bp, Artificial Sequence
  Description of Artificial Sequence: Synthetic oligonucleotide
  Target: ATXN1; (+) strand; PAM type: YTN; PAM sequence: TTA
tacacacttaggcagaatct

SEQ ID NO: 280270 - DNA, 20 bp, Artificial Sequence
  Description of Artificial Sequence: Synthetic oligonucleotide
  Target: ATXN1; (+) strand; PAM type: YTN; PAM sequence: CTT
aggcagaatctacttttaag

SEQ ID NO: 280271 - DNA, 20 bp, Artificial Sequence
  Description of Artificial Sequence: Synthetic oligonucleotide
  Target: ATXN1; (+) strand; PAM type: YTN; PAM sequence: TTA
ggcagaatctacttttaaga

SEQ ID NO: 280272 - DNA, 20 bp, Artificial Sequence
  Description of Artificial Sequence: Synthetic oligonucleotide
  Target: ATXN1; (+) strand; PAM type: YTN; PAM sequence: CTA
cttttaagaataagtacgaa

SEQ ID NO: 280273 - DNA, 20 bp, Artificial Sequence
  Description of Artificial Sequence: Synthetic oligonucleotide
  Target: ATXN1; (+) strand; PAM type: YTN; PAM sequence: CTT
ttaagaataagtacgaaaag

SEQ ID NO: 280274 - DNA, 20 bp, Artificial Sequence
  Description of Artificial Sequence: Synthetic oligonucleotide
  Target: ATXN1; (+) strand; PAM type: YTN; PAM sequence: TTT
taagaataagtacgaaaagg

SEQ ID NO: 280275 - DNA, 20 bp, Artificial Sequence
  Description of Artificial Sequence: Synthetic oligonucleotide
  Target: ATXN1; (+) strand; PAM type: YTN; PAM sequence: TTT
aagaataagtacgaaaaggg

SEQ ID NO: 280276 - DNA, 20 bp, Artificial Sequence
  Description of Artificial Sequence: Synthetic oligonucleotide
  Target: ATXN1; (+) strand; PAM type: YTN; PAM sequence: TTA
agaataagtacgaaaaggga

SEQ ID NO: 280277 - DNA, 20 bp, Artificial Sequence
  Description of Artificial Sequence: Synthetic oligonucleotide
  Target: ATXN1; (+) strand; PAM type: YTN; PAM sequence: TTT
tcagaaacaaataggctgat

SEQ ID NO: 280278 - DNA, 20 bp, Artificial Sequence
  Description of Artificial Sequence: Synthetic oligonucleotide
  Target: ATXN1; (+) strand; PAM type: YTN; PAM sequence: TTT
cagaaacaaataggctgatg

SEQ ID NO: 280279 - DNA, 20 bp, Artificial Sequence
  Description of Artificial Sequence: Synthetic oligonucleotide
  Target: ATXN1; (+) strand; PAM type: YTN; PAM sequence: TTC
agaaacaaataggctgatgc

SEQ ID NO: 280280 - DNA, 20 bp, Artificial Sequence
  Description of Artificial Sequence: Synthetic oligonucleotide
  Target: ATXN1; (+) strand; PAM type: YTN; PAM sequence: CTG
atgcagtggctcacacctgt

SEQ ID NO: 280281 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccagcact

SEQ ID NO: 280282 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 280283 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcaggcgg

SEQ ID NO: 280284 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaggcgga

SEQ ID NO: 280285 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaggcggat

SEQ ID NO: 280286 - DNA, 20 bp, Artificial Sequence
  Description of Artificial Sequence: Synthetic oligonucleotide
  Target: ATXN1; (+) strand; PAM type: YTN; PAM sequence: TTG
cttgagctcagagttggaga

SEQ ID NO: 280287 - DNA, 20 bp, Artificial Sequence
  Description of Artificial Sequence: Synthetic oligonucleotide
  Target: ATXN1; (+) strand; PAM type: YTN; PAM sequence: CTT
gagctcagagttggagacca

SEQ ID NO: 280288 - DNA, 20 bp, Artificial Sequence
  Description of Artificial Sequence: Synthetic oligonucleotide
  Target: ATXN1; (+) strand; PAM type: YTN; PAM sequence: TTG
agctcagagttggagaccag

SEQ ID NO: 280289 - DNA, 20 bp, Artificial Sequence
  Description of Artificial Sequence: Synthetic oligonucleotide
  Target: ATXN1; (+) strand; PAM type: YTN; PAM sequence: CTC
agagttggagaccagcctgg

SEQ ID NO: 280290 - DNA, 20 bp, Artificial Sequence
  Description of Artificial Sequence: Synthetic oligonucleotide
  Target: ATXN1; (+) strand; PAM type: YTN; PAM sequence: TTG
gagaccagcctgggcaacac

SEQ ID NO: 280291 - DNA, 20 bp, Artificial Sequence
  Description of Artificial Sequence: Synthetic oligonucleotide
  Target: ATXN1; (+) strand; PAM type: YTN; PAM sequence: CTG
ggcaacacagcaaaaccctg

SEQ ID NO: 280292 - DNA, 20 bp, Artificial Sequence
  Description of Artificial Sequence: Synthetic oligonucleotide
  Target: ATXN1; (+) strand; PAM type: YTN; PAM sequence: CTG
cctctacaaaaaatacaaaa

SEQ ID NO: 280293 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaatacaaaaatta

SEQ ID NO: 280294 - DNA, 20 bp, Artificial Sequence
  Description of Artificial Sequence: Synthetic oligonucleotide
  Target: ATXN1; (+) strand; PAM type: YTN; PAM sequence: CTA
caaaaaatacaaaaattagc

SEQ ID NO: 280295 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtggtggcctgca

SEQ ID NO: 280296 - DNA, 20 bp, Artificial Sequence
  Description of Artificial Sequence: Synthetic oligonucleotide
  Target: ATXN1; (+) strand; PAM type: YTN; PAM sequence: CTG
cacctgtagtcccagctatt

SEQ ID NO: 280297 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctatttgggag

SEQ ID NO: 280298 - DNA, 20 bp, Artificial Sequence
  Description of Artificial Sequence: Synthetic oligonucleotide
  Target: ATXN1; (+) strand; PAM type: YTN; PAM sequence: CTA
tttgggaggctgagatggga

SEQ ID NO: 280299 - DNA, 20 bp, Artificial Sequence
  Description of Artificial Sequence: Synthetic oligonucleotide
  Target: ATXN1; (+) strand; PAM type: YTN; PAM sequence: TTT
gggaggctgagatgggaaga

SEQ ID NO: 280300 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagatgggaagat

SEQ ID NO: 280301 - DNA, 20 bp, Artificial Sequence
  Description of Artificial Sequence: Synthetic oligonucleotide
  Target: ATXN1; (+) strand; PAM type: YTN; PAM sequence: CTG
agatgggaagatcacttgag

SEQ ID NO: 280302 - DNA, 20 bp, Artificial Sequence
  Description of Artificial Sequence: Synthetic oligonucleotide
  Target: ATXN1; (+) strand; PAM type: YTN; PAM sequence: CTT
gagcccgggaggcagaggtt

SEQ ID NO: 280303 - DNA, 20 bp, Artificial Sequence
  Description of Artificial Sequence: Synthetic oligonucleotide
  Target: ATXN1; (+) strand; PAM type: YTN; PAM sequence: TTG
agcccgggaggcagaggttg

SEQ ID NO: 280304 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcacccc

SEQ ID NO: 280305 - DNA, 20 bp, Artificial Sequence
  Description of Artificial Sequence: Synthetic oligonucleotide
  Target: ATXN1; (+) strand; PAM type: YTN; PAM sequence: CTG
tactccagcctgggcaacag

SEQ ID NO: 280306 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacagagcta

SEQ ID NO: 280307 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagctagatcttg

SEQ ID NO: 280308 - DNA, 20 bp, Artificial Sequence
  Description of Artificial Sequence: Synthetic oligonucleotide
  Target: ATXN1; (+) strand; PAM type: YTN; PAM sequence: CTA
gatcttgtctcaaaaaaaaa

SEQ ID NO: 280309 - DNA, 20 bp, Artificial Sequence
  Description of Artificial Sequence: Synthetic oligonucleotide
  Target: ATXN1; (+) strand; PAM type: YTN; PAM sequence: CTT
gtctcaaaaaaaaaaaaaaa

SEQ ID NO: 280310 - DNA, 20 bp, Artificial Sequence
  Description of Artificial Sequence: Synthetic oligonucleotide
  Target: ATXN1; (+) strand; PAM type: YTN; PAM sequence: TTG
tctcaaaaaaaaaaaaaaag

SEQ ID NO: 280311 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaagaaga

SEQ ID NO: 280312 - DNA, 20 bp, Artificial Sequence
  Description of Artificial Sequence: Synthetic oligonucleotide
  Target: ATXN1; (+) strand; PAM type: YTN; PAM sequence: CTG
gcagcagccaccgtaggaaa

SEQ ID NO: 280313 - DNA, 20 bp, Artificial Sequence
  Description of Artificial Sequence: Synthetic oligonucleotide
  Target: ATXN1; (+) strand; PAM type: YTN; PAM sequence: CTA
ggagtaaccactgaataaaa

SEQ ID NO: 280314 - DNA, 20 bp, Artificial Sequence
  Description of Artificial Sequence: Synthetic oligonucleotide
  Target: ATXN1; (+) strand; PAM type: YTN; PAM sequence: CTG
aataaaagcttactagtttg

SEQ ID NO: 280315 - DNA, 20 bp, Artificial Sequence
  Description of Artificial Sequence: Synthetic oligonucleotide
  Target: ATXN1; (+) strand; PAM type: YTN; PAM sequence: CTT
actagtttgagtccatctta

SEQ ID NO: 280316 - DNA, 20 bp, Artificial Sequence
  Description of Artificial Sequence: Synthetic oligonucleotide
  Target: ATXN1; (+) strand; PAM type: YTN; PAM sequence: TTA
ctagtttgagtccatcttag

SEQ ID NO: 280317 - DNA, 20 bp, Artificial Sequence
  Description of Artificial Sequence: Synthetic oligonucleotide
  Target: ATXN1; (+) strand; PAM type: YTN; PAM sequence: CTA
gtttgagtccatcttaggcc

SEQ ID NO: 280318 - DNA, 20 bp, Artificial Sequence
  Description of Artificial Sequence: Synthetic oligonucleotide
  Target: ATXN1; (+) strand; PAM type: YTN; PAM sequence: TTT
gagtccatcttaggccagtg

SEQ ID NO: 280319 - DNA, 20 bp, Artificial Sequence
  Description of Artificial Sequence: Synthetic oligonucleotide
  Target: ATXN1; (+) strand; PAM type: YTN; PAM sequence: TTG
agtccatcttaggccagtga

SEQ ID NO: 280320 - DNA, 20 bp, Artificial Sequence
  Description of Artificial Sequence: Synthetic oligonucleotide
  Target: ATXN1; (+) strand; PAM type: YTN; PAM sequence: CTT
aggccagtgaagacattggg

SEQ ID NO: 280321 - DNA, 20 bp, Artificial Sequence
  Description of Artificial Sequence: Synthetic oligonucleotide
  Target: ATXN1; (+) strand; PAM type: YTN; PAM sequence: TTA
ggccagtgaagacattgggc

SEQ ID NO: 280322 - DNA, 20 bp, Artificial Sequence
  Description of Artificial Sequence: Synthetic oligonucleotide
  Target: ATXN1; (+) strand; PAM type: YTN; PAM sequence: TTG
ggccgagaagtttccagtgc

SEQ ID NO: 280323 - DNA, 20 bp, Artificial Sequence
  Description of Artificial Sequence: Synthetic oligonucleotide
  Target: ATXN1; (+) strand; PAM type: YTN; PAM sequence: TTT
ccagtgcttggatgacagag

SEQ ID NO: 280324 - DNA, 20 bp, Artificial Sequence
  Description of Artificial Sequence: Synthetic oligonucleotide
  Target: ATXN1; (+) strand; PAM type: YTN; PAM sequence: TTC
cagtgcttggatgacagaga

SEQ ID NO: 280325 - DNA, 20 bp, Artificial Sequence
  Description of Artificial Sequence: Synthetic oligonucleotide
  Target: ATXN1; (+) strand; PAM type: YTN; PAM sequence: CTT
ggatgacagagaagaactgg

SEQ ID NO: 280326 - DNA, 20 bp, Artificial Sequence
  Description of Artificial Sequence: Synthetic oligonucleotide
  Target: ATXN1; (+) strand; PAM type: YTN; PAM sequence: TTG
gatgacagagaagaactggt

SEQ ID NO: 280327 - DNA, 20 bp, Artificial Sequence
  Description of Artificial Sequence: Synthetic oligonucleotide
  Target: ATXN1; (+) strand; PAM type: YTN; PAM sequence: CTG
gtgactaagacttcagtggg

SEQ ID NO: 280328 - DNA, 20 bp, Artificial Sequence
  Description of Artificial Sequence: Synthetic oligonucleotide
  Target: ATXN1; (+) strand; PAM type: YTN; PAM sequence: CTA
agacttcagtgggtggtaat

SEQ ID NO: 280329 - DNA, 20 bp, Artificial Sequence
  Description of Artificial Sequence: Synthetic oligonucleotide
  Target: ATXN1; (+) strand; PAM type: YTN; PAM sequence: CTT
cagtgggtggtaataatctg

SEQ ID NO: 280330 - DNA, 20 bp, Artificial Sequence
  Description of Artificial Sequence: Synthetic oligonucleotide
  Target: ATXN1; (+) strand; PAM type: YTN; PAM sequence: TTC
agtgggtggtaataatctgg

SEQ ID NO: 280331 - DNA, 20 bp, Artificial Sequence
  Description of Artificial Sequence: Synthetic oligonucleotide
  Target: ATXN1; (+) strand; PAM type: YTN; PAM sequence: CTG
gatgaatagaacacagacta

SEQ ID NO: 280332 - DNA, 20 bp, Artificial Sequence
  Description of Artificial Sequence: Synthetic oligonucleotide
  Target: ATXN1; (+) strand; PAM type: YTN; PAM sequence: CTA
tgttttcaaaacatgttgag

SEQ ID NO: 280333 - DNA, 20 bp, Artificial Sequence
  Description of Artificial Sequence: Synthetic oligonucleotide
  Target: ATXN1; (+) strand; PAM type: YTN; PAM sequence: TTT
tcaaaacatgttgaggttaa

SEQ ID NO: 280334 - DNA, 20 bp, Artificial Sequence
  Description of Artificial Sequence: Synthetic oligonucleotide
  Target: ATXN1; (+) strand; PAM type: YTN; PAM sequence: TTT
caaaacatgttgaggttaaa

SEQ ID NO: 280335 - DNA, 20 bp, Artificial Sequence
  Description of Artificial Sequence: Synthetic oligonucleotide
  Target: ATXN1; (+) strand; PAM type: YTN; PAM sequence: TTC
aaaacatgttgaggttaaag

SEQ ID NO: 280336 - DNA, 20 bp, Artificial Sequence
  Description of Artificial Sequence: Synthetic oligonucleotide
  Target: ATXN1; (+) strand; PAM type: YTN; PAM sequence: TTG
aggttaaagaaagaatagag

SEQ ID NO: 280337 - DNA, 20 bp, Artificial Sequence
  Description of Artificial Sequence: Synthetic oligonucleotide
  Target: ATXN1; (+) strand; PAM type: YTN; PAM sequence: TTA
aagaaagaatagagaaatgg

SEQ ID NO: 280338 - DNA, 20 bp, Artificial Sequence
  Description of Artificial Sequence: Synthetic oligonucleotide
  Target: ATXN1; (+) strand; PAM type: YTN; PAM sequence: TTG
cctgaggagaacaaggtcaa

SEQ ID NO: 280339 - DNA, 20 bp, Artificial Sequence
  Description of Artificial Sequence: Synthetic oligonucleotide
  Target: ATXN1; (+) strand; PAM type: YTN; PAM sequence: CTG
aggagaacaaggtcaaaata

SEQ ID NO: 280340 - DNA, 20 bp, Artificial Sequence
  Description of Artificial Sequence: Synthetic oligonucleotide
  Target: ATXN1; (+) strand; PAM type: YTN; PAM sequence: CTC
ctttagtttttaaaagacag

SEQ ID NO: 280341 - DNA, 20 bp, Artificial Sequence
  Description of Artificial Sequence: Synthetic oligonucleotide
  Target: ATXN1; (+) strand; PAM type: YTN; PAM sequence: CTT
tagtttttaaaagacaggcc

SEQ ID NO: 280342 - DNA, 20 bp, Artificial Sequence
  Description of Artificial Sequence: Synthetic oligonucleotide
  Target: ATXN1; (+) strand; PAM type: YTN; PAM sequence: TTT
agtttttaaaagacaggcca

SEQ ID NO: 280343 - DNA, 20 bp, Artificial Sequence
  Description of Artificial Sequence: Synthetic oligonucleotide
  Target: ATXN1; (+) strand; PAM type: YTN; PAM sequence: TTA
gtttttaaaagacaggccac

SEQ ID NO: 280344 - DNA, 20 bp, Artificial Sequence
  Description of Artificial Sequence: Synthetic oligonucleotide
  Target: ATXN1; (+) strand; PAM type: YTN; PAM sequence: TTT
ttaaaagacaggccacacca

SEQ ID NO: 280345 - DNA, 20 bp, Artificial Sequence
  Description of Artificial Sequence: Synthetic oligonucleotide
  Target: ATXN1; (+) strand; PAM type: YTN; PAM sequence: TTT
taaaagacaggccacaccac

SEQ ID NO: 280346 - DNA, 20 bp, Artificial Sequence
  Description of Artificial Sequence: Synthetic oligonucleotide
  Target: ATXN1; (+) strand; PAM type: YTN; PAM sequence: TTT
aaaagacaggccacaccact

SEQ ID NO: 280347 - DNA, 20 bp, Artificial Sequence
  Description of Artificial Sequence: Synthetic oligonucleotide
  Target: ATXN1; (+) strand; PAM type: YTN; PAM sequence: TTA
aaagacaggccacaccacta

SEQ ID NO: 280348 - DNA, 20 bp, Artificial Sequence
  Description of Artificial Sequence: Synthetic oligonucleotide
  Target: ATXN1; (+) strand; PAM type: YTN; PAM sequence: CTA
ggcacattcatagactgaag

SEQ ID NO: 280349 - DNA, 20 bp, Artificial Sequence
  Description of Artificial Sequence: Synthetic oligonucleotide
  Target: ATXN1; (+) strand; PAM type: YTN; PAM sequence: TTC
atagactgaagagaaggttt

SEQ ID NO: 280350 - DNA, 20 bp, Artificial Sequence
  Description of Artificial Sequence: Synthetic oligonucleotide
  Target: ATXN1; (+) strand; PAM type: YTN; PAM sequence: CTG
aagagaaggttttggttaag

SEQ ID NO: 280351 - DNA, 20 bp, Artificial Sequence
  Description of Artificial Sequence: Synthetic oligonucleotide
  Target: ATXN1; (+) strand; PAM type: YTN; PAM sequence: TTT
tggttaagatgaagataatg

SEQ ID NO: 280352 - DNA, 20 bp, Artificial Sequence
  Description of Artificial Sequence: Synthetic oligonucleotide
  Target: ATXN1; (+) strand; PAM type: YTN; PAM sequence: TTT
ggttaagatgaagataatga

SEQ ID NO: 280353 - DNA, 20 bp, Artificial Sequence
  Description of Artificial Sequence: Synthetic oligonucleotide
  Target: ATXN1; (+) strand; PAM type: YTN; PAM sequence: TTG
gttaagatgaagataatgaa

SEQ ID NO: 280354 - DNA, 20 bp, Artificial Sequence
  Description of Artificial Sequence: Synthetic oligonucleotide
  Target: ATXN1; (+) strand; PAM type: YTN; PAM sequence: TTA
agatgaagataatgaaagat

SEQ ID NO: 280355 - DNA, 20 bp, Artificial Sequence
  Description of Artificial Sequence: Synthetic oligonucleotide
  Target: ATXN1; (+) strand; PAM type: YTN; PAM sequence: CTA
ggtgacaaagcctcagagaa

SEQ ID NO: 280356 - DNA, 20 bp, Artificial Sequence
  Description of Artificial Sequence: Synthetic oligonucleotide
  Target: ATXN1; (+) strand; PAM type: YTN; PAM sequence: CTC
agagaagtcagggtagagag

SEQ ID NO: 280357 - DNA, 20 bp, Artificial Sequence
  Description of Artificial Sequence: Synthetic oligonucleotide
  Target: ATXN1; (+) strand; PAM type: YTN; PAM sequence: CTT
ggagccttgcggagtgggag

SEQ ID NO: 280358 - DNA, 20 bp, Artificial Sequence
  Description of Artificial Sequence: Synthetic oligonucleotide
  Target: ATXN1; (+) strand; PAM type: YTN; PAM sequence: TTG
gagccttgcggagtgggagg

SEQ ID NO: 280359 - DNA, 20 bp, Artificial Sequence
  Description of Artificial Sequence: Synthetic oligonucleotide
  Target: ATXN1; (+) strand; PAM type: YTN; PAM sequence: CTT
gcggagtgggaggtcttctt

SEQ ID NO: 280360 - DNA, 20 bp, Artificial Sequence
  Description of Artificial Sequence: Synthetic oligonucleotide
  Target: ATXN1; (+) strand; PAM type: YTN; PAM sequence: TTG
cggagtgggaggtcttcttg

SEQ ID NO: 280361 - DNA, 20 bp, Artificial Sequence
  Description of Artificial Sequence: Synthetic oligonucleotide
  Target: ATXN1; (+) strand; PAM type: YTN; PAM sequence: CTT
cttgctcctctgggatgcgt

SEQ ID NO: 280362 - DNA, 20 bp, Artificial Sequence
  Description of Artificial Sequence: Synthetic oligonucleotide
  Target: ATXN1; (+) strand; PAM type: YTN; PAM sequence: TTC
ttgctcctctgggatgcgtg

SEQ ID NO: 280363 - DNA, 20 bp, Artificial Sequence
  Description of Artificial Sequence: Synthetic oligonucleotide
  Target: ATXN1; (+) strand; PAM type: YTN; PAM sequence: CTT
gctcctctgggatgcgtgag

SEQ ID NO: 280364 - DNA, 20 bp, Artificial Sequence
  Description of Artificial Sequence: Synthetic oligonucleotide
  Target: ATXN1; (+) strand; PAM type: YTN; PAM sequence: TTG
ctcctctgggatgcgtgagc

SEQ ID NO: 280365 - DNA, 20 bp, Artificial Sequence
  Description of Artificial Sequence: Synthetic oligonucleotide
  Target: ATXN1; (+) strand; PAM type: YTN; PAM sequence: CTC
ctctgggatgcgtgagcaca

SEQ ID NO: 280366 - DNA, 20 bp, Artificial Sequence
  Description of Artificial Sequence: Synthetic oligonucleotide
  Target: ATXN1; (+) strand; PAM type: YTN; PAM sequence: CTC
tgggatgcgtgagcacagca

SEQ ID NO: 280367 - DNA, 20 bp, Artificial Sequence
  Description of Artificial Sequence: Synthetic oligonucleotide
  Target: ATXN1; (+) strand; PAM type: YTN; PAM sequence: CTG
ggatgcgtgagcacagcatg

SEQ ID NO: 280368 - DNA, 20 bp, Artificial Sequence
  Description of Artificial Sequence: Synthetic oligonucleotide
  Target: ATXN1; (+) strand; PAM type: YTN; PAM sequence: CTT
gtctgcaactgtgagacagg

SEQ ID NO: 280369 - DNA, 20 bp, Artificial Sequence
  Description of Artificial Sequence: Synthetic oligonucleotide
  Target: ATXN1; (+) strand; PAM type: YTN; PAM sequence: TTG
tctgcaactgtgagacagga

SEQ ID NO: 280370 - DNA, 20 bp, Artificial Sequence
  Description of Artificial Sequence: Synthetic oligonucleotide
  Target: ATXN1; (+) strand; PAM type: YTN; PAM sequence: CTG
caactgtgagacaggagcaa

SEQ ID NO: 280371 - DNA, 20 bp, Artificial Sequence
  Description of Artificial Sequence: Synthetic oligonucleotide
  Target: ATXN1; (+) strand; PAM type: YTN; PAM sequence: CTG
tgagacaggagcaacggaca

SEQ ID NO: 280372 - DNA, 20 bp, Artificial Sequence
  Description of Artificial Sequence: Synthetic oligonucleotide
  Target: ATXN1; (+) strand; PAM type: YTN; PAM sequence: TTA
aagggaaaaagagagtagaa

SEQ ID NO: 280373 - DNA, 20 bp, Artificial Sequence
  Description of Artificial Sequence: Synthetic oligonucleotide
  Target: ATXN1; (+) strand; PAM type: YTN; PAM sequence: TTC
atgcctggattcttcaagat

SEQ ID NO: 280374 - DNA, 20 bp, Artificial Sequence
  Description of Artificial Sequence: Synthetic oligonucleotide
  Target: ATXN1; (+) strand; PAM type: YTN; PAM sequence: CTG
gattcttcaagattttaaaa

SEQ ID NO: 280375 - DNA, 20 bp, Artificial Sequence
  Description of Artificial Sequence: Synthetic oligonucleotide
  Target: ATXN1; (+) strand; PAM type: YTN; PAM sequence: TTC
ttcaagattttaaaaaagca

SEQ ID NO: 280376 - DNA, 20 bp, Artificial Sequence
  Description of Artificial Sequence: Synthetic oligonucleotide
  Target: ATXN1; (+) strand; PAM type: YTN; PAM sequence: CTT
caagattttaaaaaagcaag

SEQ ID NO: 280377 - DNA, 20 bp, Artificial Sequence
  Description of Artificial Sequence: Synthetic oligonucleotide
  Target: ATXN1; (+) strand; PAM type: YTN; PAM sequence: TTC
aagattttaaaaaagcaaga

SEQ ID NO: 280378 - DNA, 20 bp, Artificial Sequence
  Description of Artificial Sequence: Synthetic oligonucleotide
  Target: ATXN1; (+) strand; PAM type: YTN; PAM sequence: TTT
taaaaaagcaagatgaataa

SEQ ID NO: 280379 - DNA, 20 bp, Artificial Sequence
  Description of Artificial Sequence: Synthetic oligonucleotide
  Target: ATXN1; (+) strand; PAM type: YTN; PAM sequence: TTT
aaaaaagcaagatgaataaa

SEQ ID NO: 280380 - DNA, 20 bp, Artificial Sequence
  Description of Artificial Sequence: Synthetic oligonucleotide
  Target: ATXN1; (+) strand; PAM type: YTN; PAM sequence: TTA
aaaaagcaagatgaataaat

SEQ ID NO: 280381 - DNA, 20 bp, Artificial Sequence
  Description of Artificial Sequence: Synthetic oligonucleotide
  Target: ATXN1; (+) strand; PAM type: YTN; PAM sequence: CTC
taccaaagtgagggtgaggg

SEQ ID NO: 280382 - DNA, 20 bp, Artificial Sequence
  Description of Artificial Sequence: Synthetic oligonucleotide
  Target: ATXN1; (+) strand; PAM type: YTN; PAM sequence: CTA
ccaaagtgagggtgagggta

SEQ ID NO: 280383 - DNA, 20 bp, Artificial Sequence
  Description of Artificial Sequence: Synthetic oligonucleotide
  Target: ATXN1; (+) strand; PAM type: YTN; PAM sequence: TTT
tgaagagactggaaaagttt

SEQ ID NO: 280384 - DNA, 20 bp, Artificial Sequence
  Description of Artificial Sequence: Synthetic oligonucleotide
  Target: ATXN1; (+) strand; PAM type: YTN; PAM sequence: TTT
gaagagactggaaaagtttg

SEQ ID NO: 280385 - DNA, 20 bp, Artificial Sequence
  Description of Artificial Sequence: Synthetic oligonucleotide
  Target: ATXN1; (+) strand; PAM type: YTN; PAM sequence: TTG
aagagactggaaaagtttgg

SEQ ID NO: 280386 - DNA, 20 bp, Artificial Sequence
  Description of Artificial Sequence: Synthetic oligonucleotide
  Target: ATXN1; (+) strand; PAM type: YTN; PAM sequence: CTG
gaaaagtttggaatagatcc

SEQ ID NO: 280387 - DNA, 20 bp, Artificial Sequence
  Description of Artificial Sequence: Synthetic oligonucleotide
  Target: ATXN1; (+) strand; PAM type: YTN; PAM sequence: TTT
ggaatagatcccataagaaa

SEQ ID NO: 280388 - DNA, 20 bp, Artificial Sequence
  Description of Artificial Sequence: Synthetic oligonucleotide
  Target: ATXN1; (+) strand; PAM type: YTN; PAM sequence: TTG
gaatagatcccataagaaat

SEQ ID NO: 280389 - DNA, 20 bp, Artificial Sequence
  Description of Artificial Sequence: Synthetic oligonucleotide
  Target: ATXN1; (+) strand; PAM type: YTN; PAM sequence: CTA
tgagcccactagaaaagcaa

SEQ ID NO: 280390 - DNA, 20 bp, Artificial Sequence
  Description of Artificial Sequence: Synthetic oligonucleotide
  Target: ATXN1; (+) strand; PAM type: YTN; PAM sequence: CTA
gaaaagcaatgatgactctc

SEQ ID NO: 280391 - DNA, 20 bp, Artificial Sequence
  Description of Artificial Sequence: Synthetic oligonucleotide
  Target: ATXN1; (+) strand; PAM type: YTN; PAM sequence: CTC
tcctcagattaacagtaaga

SEQ ID NO: 280392 - DNA, 20 bp, Artificial Sequence
  Description of Artificial Sequence: Synthetic oligonucleotide
  Target: ATXN1; (+) strand; PAM type: YTN; PAM sequence: CTC
ctcagattaacagtaagaat

SEQ ID NO: 280393 - DNA, 20 bp, Artificial Sequence
  Description of Artificial Sequence: Synthetic oligonucleotide
  Target: ATXN1; (+) strand; PAM type: YTN; PAM sequence: CTC
agattaacagtaagaattta

SEQ ID NO: 280394 - DNA, 20 bp, Artificial Sequence
  Description of Artificial Sequence: Synthetic oligonucleotide
  Target: ATXN1; (+) strand; PAM type: YTN; PAM sequence: TTA
acagtaagaatttacatcag

SEQ ID NO: 280395 - DNA, 20 bp, Artificial Sequence
  Description of Artificial Sequence: Synthetic oligonucleotide
  Target: ATXN1; (+) strand; PAM type: YTN; PAM sequence: TTT
acatcaggacccatcagttg

SEQ ID NO: 280396 - DNA, 20 bp, Artificial Sequence
  Description of Artificial Sequence: Synthetic oligonucleotide
  Target: ATXN1; (+) strand; PAM type: YTN; PAM sequence: TTA
catcaggacccatcagttgg

SEQ ID NO: 280397 - DNA, 20 bp, Artificial Sequence
  Description of Artificial Sequence: Synthetic oligonucleotide
  Target: ATXN1; (+) strand; PAM type: YTN; PAM sequence: TTG
ggtttgggggcctctaagca

SEQ ID NO: 280398 - DNA, 20 bp, Artificial Sequence
  Description of Artificial Sequence: Synthetic oligonucleotide
  Target: ATXN1; (+) strand; PAM type: YTN; PAM sequence: TTT
gggggcctctaagcagctgt

SEQ ID NO: 280399 - DNA, 20 bp, Artificial Sequence
  Description of Artificial Sequence: Synthetic oligonucleotide
  Target: ATXN1; (+) strand; PAM type: YTN; PAM sequence: TTG
ggggcctctaagcagctgtg

SEQ ID NO: 280400 - DNA, 20 bp, Artificial Sequence
  Description of Artificial Sequence: Synthetic oligonucleotide
  Target: ATXN1; (+) strand; PAM type: YTN; PAM sequence: CTC
taagcagctgtgcaggtgat

SEQ ID NO: 280401 - DNA, 20 bp, Artificial Sequence
  Description of Artificial Sequence: Synthetic oligonucleotide
  Target: ATXN1; (+) strand; PAM type: YTN; PAM sequence: CTA
agcagctgtgcaggtgatgg

SEQ ID NO: 280402 - DNA, 20 bp, Artificial Sequence
  Description of Artificial Sequence: Synthetic oligonucleotide
  Target: ATXN1; (+) strand; PAM type: YTN; PAM sequence: CTG
tgcaggtgatggggatcatg

SEQ ID NO: 280403 - DNA, 20 bp, Artificial Sequence
  Description of Artificial Sequence: Synthetic oligonucleotide
  Target: ATXN1; (+) strand; PAM type: YTN; PAM sequence: TTG
gtgcctggaaaggaatgcat

SEQ ID NO: 280404 - DNA, 20 bp, Artificial Sequence
  Description of Artificial Sequence: Synthetic oligonucleotide
  Target: ATXN1; (+) strand; PAM type: YTN; PAM sequence: CTG
gaaaggaatgcatggcacta

SEQ ID NO: 280405 - DNA, 20 bp, Artificial Sequence
  Description of Artificial Sequence: Synthetic oligonucleotide
  Target: ATXN1; (+) strand; PAM type: YTN; PAM sequence: CTA
agctattgggcatgcacagt

SEQ ID NO: 280406 - DNA, 20 bp, Artificial Sequence
  Description of Artificial Sequence: Synthetic oligonucleotide
  Target: ATXN1; (+) strand; PAM type: YTN; PAM sequence: CTA
ttgggcatgcacagttaaac

SEQ ID NO: 280407 - DNA, 20 bp, Artificial Sequence
  Description of Artificial Sequence: Synthetic oligonucleotide
  Target: ATXN1; (+) strand; PAM type: YTN; PAM sequence: TTG
ggcatgcacagttaaacttt

SEQ ID NO: 280408 - DNA, 20 bp, Artificial Sequence
  Description of Artificial Sequence: Synthetic oligonucleotide
  Target: ATXN1; (+) strand; PAM type: YTN; PAM sequence: TTA
aactttcaagccatgaggtc

SEQ ID NO: 280409 - DNA, 20 bp, Artificial Sequence
  Description of Artificial Sequence: Synthetic oligonucleotide
  Target: ATXN1; (+) strand; PAM type: YTN; PAM sequence: CTT
tcaagccatgaggtctaggc

SEQ ID NO: 280410 - DNA, 20 bp, Artificial Sequence
  Description of Artificial Sequence: Synthetic oligonucleotide
  Target: ATXN1; (+) strand; PAM type: YTN; PAM sequence: TTT
caagccatgaggtctaggct

SEQ ID NO: 280411 - DNA, 20 bp, Artificial Sequence
  Description of Artificial Sequence: Synthetic oligonucleotide
  Target: ATXN1; (+) strand; PAM type: YTN; PAM sequence: TTC
aagccatgaggtctaggctg

SEQ ID NO: 280412 - DNA, 20 bp, Artificial Sequence
  Description of Artificial Sequence: Synthetic oligonucleotide
  Target: ATXN1; (+) strand; PAM type: YTN; PAM sequence: CTA
ggctggttagggggcaggaa

SEQ ID NO: 280413 - DNA, 20 bp, Artificial Sequence
  Description of Artificial Sequence: Synthetic oligonucleotide
  Target: ATXN1; (+) strand; PAM type: YTN; PAM sequence: CTG
gttagggggcaggaatacgg

SEQ ID NO: 280414 - DNA, 20 bp, Artificial Sequence
  Description of Artificial Sequence: Synthetic oligonucleotide
  Target: ATXN1; (+) strand; PAM type: YTN; PAM sequence: TTA
gggggcaggaatacggagcc

SEQ ID NO: 280415 - DNA, 20 bp, Artificial Sequence
  Description of Artificial Sequence: Synthetic oligonucleotide
  Target: ATXN1; (+) strand; PAM type: YTN; PAM sequence: CTG
aagaaagtggctatagtgac

SEQ ID NO: 280416 - DNA, 20 bp, Artificial Sequence
  Description of Artificial Sequence: Synthetic oligonucleotide
  Target: ATXN1; (+) strand; PAM type: YTN; PAM sequence: CTA
tagtgaccaagagtggggga

SEQ ID NO: 280417 - DNA, 20 bp, Artificial Sequence
  Description of Artificial Sequence: Synthetic oligonucleotide
  Target: ATXN1; (+) strand; PAM type: YTN; PAM sequence: CTC
acaataaggagacaactgag

SEQ ID NO: 280418 - DNA, 20 bp, Artificial Sequence
  Description of Artificial Sequence: Synthetic oligonucleotide
  Target: ATXN1; (+) strand; PAM type: YTN; PAM sequence: CTG
agttctgaggaagagaggga

SEQ ID NO: 280419 - DNA, 20 bp, Artificial Sequence
  Description of Artificial Sequence: Synthetic oligonucleotide
  Target: ATXN1; (+) strand; PAM type: YTN; PAM sequence: TTC
tgaggaagagagggaaagca

SEQ ID NO: 280420 - DNA, 20 bp, Artificial Sequence
  Description of Artificial Sequence: Synthetic oligonucleotide
  Target: ATXN1; (+) strand; PAM type: YTN; PAM sequence: CTG
aggaagagagggaaagcaag

SEQ ID NO: 280421 - DNA, 20 bp, Artificial Sequence
  Description of Artificial Sequence: Synthetic oligonucleotide
  Target: ATXN1; (+) strand; PAM type: YTN; PAM sequence: CTA
tgcccagagagaactacaga

SEQ ID NO: 280422 - DNA, 20 bp, Artificial Sequence
  Description of Artificial Sequence: Synthetic oligonucleotide
  Target: ATXN1; (+) strand; PAM type: YTN; PAM sequence: CTA
cagagtctgagattttaaga

SEQ ID NO: 280423 - DNA, 20 bp, Artificial Sequence
  Description of Artificial Sequence: Synthetic oligonucleotide
  Target: ATXN1; (+) strand; PAM type: YTN; PAM sequence: CTG
agattttaagatttagaaag

SEQ ID NO: 280424 - DNA, 20 bp, Artificial Sequence
  Description of Artificial Sequence: Synthetic oligonucleotide
  Target: ATXN1; (+) strand; PAM type: YTN; PAM sequence: TTT
taagatttagaaaggtccaa

SEQ ID NO: 280425 - DNA, 20 bp, Artificial Sequence
  Description of Artificial Sequence: Synthetic oligonucleotide
  Target: ATXN1; (+) strand; PAM type: YTN; PAM sequence: TTT
aagatttagaaaggtccaag

SEQ ID NO: 280426 - DNA, 20 bp, Artificial Sequence
  Description of Artificial Sequence: Synthetic oligonucleotide
  Target: ATXN1; (+) strand; PAM type: YTN; PAM sequence: TTA
agatttagaaaggtccaagt

SEQ ID NO: 280427 - DNA, 20 bp, Artificial Sequence
  Description of Artificial Sequence: Synthetic oligonucleotide
  Target: ATXN1; (+) strand; PAM type: YTN; PAM sequence: TTT
agaaaggtccaagttggggg

SEQ ID NO: 280428 - DNA, 20 bp, Artificial Sequence
  Description of Artificial Sequence: Synthetic oligonucleotide
  Target: ATXN1; (+) strand; PAM type: YTN; PAM sequence: TTA
gaaaggtccaagttgggggg

SEQ ID NO: 280429 - DNA, 20 bp, Artificial Sequence
  Description of Artificial Sequence: Synthetic oligonucleotide
  Target: ATXN1; (+) strand; PAM type: YTN; PAM sequence: TTG
gggggtgtgagggttcaagt

SEQ ID NO: 280430 - DNA, 20 bp, Artificial Sequence
  Description of Artificial Sequence: Synthetic oligonucleotide
  Target: ATXN1; (+) strand; PAM type: YTN; PAM sequence: TTC
aagttgatacacaggtccgg

SEQ ID NO: 280431 - DNA, 20 bp, Artificial Sequence
  Description of Artificial Sequence: Synthetic oligonucleotide
  Target: ATXN1; (+) strand; PAM type: YTN; PAM sequence: TTG
atacacaggtccggggtgtg

SEQ ID NO: 280432 - DNA, 20 bp, Artificial Sequence
  Description of Artificial Sequence: Synthetic oligonucleotide
  Target: ATXN1; (+) strand; PAM type: YTN; PAM sequence: CTC
tgggaagctgaaatgaagga

SEQ ID NO: 280433 - DNA, 20 bp, Artificial Sequence
  Description of Artificial Sequence: Synthetic oligonucleotide
  Target: ATXN1; (+) strand; PAM type: YTN; PAM sequence: CTG
ggaagctgaaatgaaggaaa

SEQ ID NO: 280434 - DNA, 20 bp, Artificial Sequence
  Description of Artificial Sequence: Synthetic oligonucleotide
  Target: ATXN1; (+) strand; PAM type: YTN; PAM sequence: CTG
aaatgaaggaaaggtgaagt

SEQ ID NO: 280435 - DNA, 20 bp, Artificial Sequence
  Description of Artificial Sequence: Synthetic oligonucleotide
  Target: ATXN1; (+) strand; PAM type: YTN; PAM sequence: CTT
aaggtgaggagatgaagcaa

SEQ ID NO: 280436 - DNA, 20 bp, Artificial Sequence
  Description of Artificial Sequence: Synthetic oligonucleotide
  Target: ATXN1; (+) strand; PAM type: YTN; PAM sequence: TTA
aggtgaggagatgaagcaac

SEQ ID NO: 280437 - DNA, 20 bp, Artificial Sequence
  Description of Artificial Sequence: Synthetic oligonucleotide
  Target: ATXN1; (+) strand; PAM type: YTN; PAM sequence: CTG
cagggcagagagaagggtca

SEQ ID NO: 280438 - DNA, 20 bp, Artificial Sequence
  Description of Artificial Sequence: Synthetic oligonucleotide
  Target: ATXN1; (+) strand; PAM type: YTN; PAM sequence: TTA
aacttaacaccggtccatga

SEQ ID NO: 280439 - DNA, 20 bp, Artificial Sequence
  Description of Artificial Sequence: Synthetic oligonucleotide
  Target: ATXN1; (+) strand; PAM type: YTN; PAM sequence: CTT
aacaccggtccatgacgccg

SEQ ID NO: 280440 - DNA, 20 bp, Artificial Sequence
  Description of Artificial Sequence: Synthetic oligonucleotide
  Target: ATXN1; (+) strand; PAM type: YTN; PAM sequence: TTA
acaccggtccatgacgccgc

SEQ ID NO: 280441 - DNA, 20 bp, Artificial Sequence
  Description of Artificial Sequence: Synthetic oligonucleotide
  Target: ATXN1; (+) strand; PAM type: YTN; PAM sequence: CTG
cactcagacacagaggaagt

SEQ ID NO: 280442 - DNA, 20 bp, Artificial Sequence
  Description of Artificial Sequence: Synthetic oligonucleotide
  Target: ATXN1; (+) strand; PAM type: YTN; PAM sequence: CTC
agacacagaggaagtatttc

SEQ ID NO: 280443 - DNA, 20 bp, Artificial Sequence
  Description of Artificial Sequence: Synthetic oligonucleotide
  Target: ATXN1; (+) strand; PAM type: YTN; PAM sequence: TTT
catcatctttttgtcaacgg

SEQ ID NO: 280444 - DNA, 20 bp, Artificial Sequence
  Description of Artificial Sequence: Synthetic oligonucleotide
  Target: ATXN1; (+) strand; PAM type: YTN; PAM sequence: TTC
atcatctttttgtcaacggg

SEQ ID NO: 280445 - DNA, 20 bp, Artificial Sequence
  Description of Artificial Sequence: Synthetic oligonucleotide
  Target: ATXN1; (+) strand; PAM type: YTN; PAM sequence: CTT
tttgtcaacggggaacacaa

SEQ ID NO: 280446 - DNA, 20 bp, Artificial Sequence
  Description of Artificial Sequence: Synthetic oligonucleotide
  Target: ATXN1; (+) strand; PAM type: YTN; PAM sequence: TTT
ttgtcaacggggaacacaaa

SEQ ID NO: 280447 - DNA, 20 bp, Artificial Sequence
  Description of Artificial Sequence: Synthetic oligonucleotide
  Target: ATXN1; (+) strand; PAM type: YTN; PAM sequence: TTT
tgtcaacggggaacacaaat

SEQ ID NO: 280448 - DNA, 20 bp, Artificial Sequence
  Description of Artificial Sequence: Synthetic oligonucleotide
  Target: ATXN1; (+) strand; PAM type: YTN; PAM sequence: TTT
gtcaacggggaacacaaatg

SEQ ID NO: 280449 - DNA, 20 bp, Artificial Sequence
  Description of Artificial Sequence: Synthetic oligonucleotide
  Target: ATXN1; (+) strand; PAM type: YTN; PAM sequence: TTG
tcaacggggaacacaaatgc

SEQ ID NO: 280450 - DNA, 20 bp, Artificial Sequence
  Description of Artificial Sequence: Synthetic oligonucleotide
  Target: ATXN1; (+) strand; PAM type: YTN; PAM sequence: CTC
caggtccaagggcttaggac

SEQ ID NO: 280451 - DNA, 20 bp, Artificial Sequence
  Description of Artificial Sequence: Synthetic oligonucleotide
  Target: ATXN1; (+) strand; PAM type: YTN; PAM sequence: CTT
aggacggagcatctgattta

SEQ ID NO: 280452 - DNA, 20 bp, Artificial Sequence
  Description of Artificial Sequence: Synthetic oligonucleotide
  Target: ATXN1; (+) strand; PAM type: YTN; PAM sequence: TTA
ggacggagcatctgatttat

SEQ ID NO: 280453 - DNA, 20 bp, Artificial Sequence
  Description of Artificial Sequence: Synthetic oligonucleotide
  Target: ATXN1; (+) strand; PAM type: YTN; PAM sequence: CTG
atttatattccttacttttt

SEQ ID NO: 280454 - DNA, 20 bp, Artificial Sequence
  Description of Artificial Sequence: Synthetic oligonucleotide
  Target: ATXN1; (+) strand; PAM type: YTN; PAM sequence: TTT
atattccttactttttagga

SEQ ID NO: 280455 - DNA, 20 bp, Artificial Sequence
  Description of Artificial Sequence: Synthetic oligonucleotide
  Target: ATXN1; (+) strand; PAM type: YTN; PAM sequence: TTA
tattccttactttttaggat

SEQ ID NO: 280456 - DNA, 20 bp, Artificial Sequence
  Description of Artificial Sequence: Synthetic oligonucleotide
  Target: ATXN1; (+) strand; PAM type: YTN; PAM sequence: TTC
cttactttttaggatacaat

SEQ ID NO: 280457 - DNA, 20 bp, Artificial Sequence
  Description of Artificial Sequence: Synthetic oligonucleotide
  Target: ATXN1; (+) strand; PAM type: YTN; PAM sequence: CTT
actttttaggatacaattgg

SEQ ID NO: 280458 - DNA, 20 bp, Artificial Sequence
  Description of Artificial Sequence: Synthetic oligonucleotide
  Target: ATXN1; (+) strand; PAM type: YTN; PAM sequence: TTA
ctttttaggatacaattggg

SEQ ID NO: 280459 - DNA, 20 bp, Artificial Sequence
  Description of Artificial Sequence: Synthetic oligonucleotide
  Target: ATXN1; (+) strand; PAM type: YTN; PAM sequence: CTT
tttaggatacaattgggaga

SEQ ID NO: 280460 - DNA, 20 bp, Artificial Sequence
  Description of Artificial Sequence: Synthetic oligonucleotide
  Target: ATXN1; (+) strand; PAM type: YTN; PAM sequence: TTT
ttaggatacaattgggagaa

SEQ ID NO: 280461 - DNA, 20 bp, Artificial Sequence
  Description of Artificial Sequence: Synthetic oligonucleotide
  Target: ATXN1; (+) strand; PAM type: YTN; PAM sequence: TTT
taggatacaattgggagaag

SEQ ID NO: 280462 - DNA, 20 bp, Artificial Sequence
  Description of Artificial Sequence: Synthetic oligonucleotide
  Target: ATXN1; (+) strand; PAM type: YTN; PAM sequence: TTT
aggatacaattgggagaagc

SEQ ID NO: 280463 - DNA, 20 bp, Artificial Sequence
  Description of Artificial Sequence: Synthetic oligonucleotide
  Target: ATXN1; (+) strand; PAM type: YTN; PAM sequence: TTA
ggatacaattgggagaagct

SEQ ID NO: 280464 - DNA, 20 bp, Artificial Sequence
  Description of Artificial Sequence: Synthetic oligonucleotide
  Target: ATXN1; (+) strand; PAM type: YTN; PAM sequence: TTG
ggagaagctcacgaatagaa

SEQ ID NO: 280465 - DNA, 20 bp, Artificial Sequence
  Description of Artificial Sequence: Synthetic oligonucleotide
  Target: ATXN1; (+) strand; PAM type: YTN; PAM sequence: CTC
acgaatagaaagagaattct

SEQ ID NO: 280466 - DNA, 20 bp, Artificial Sequence
  Description of Artificial Sequence: Synthetic oligonucleotide
  Target: ATXN1; (+) strand; PAM type: YTN; PAM sequence: TTC
tctaagatttcaacaggtgt

SEQ ID NO: 280467 - DNA, 20 bp, Artificial Sequence
  Description of Artificial Sequence: Synthetic oligonucleotide
  Target: ATXN1; (+) strand; PAM type: YTN; PAM sequence: CTC
taagatttcaacaggtgtat

SEQ ID NO: 280468 - DNA, 20 bp, Artificial Sequence
  Description of Artificial Sequence: Synthetic oligonucleotide
  Target: ATXN1; (+) strand; PAM type: YTN; PAM sequence: CTA
agatttcaacaggtgtatga

SEQ ID NO: 280469 - DNA, 20 bp, Artificial Sequence
  Description of Artificial Sequence: Synthetic oligonucleotide
  Target: ATXN1; (+) strand; PAM type: YTN; PAM sequence: TTT
caacaggtgtatgatctggg

SEQ ID NO: 280470 - DNA, 20 bp, Artificial Sequence
  Description of Artificial Sequence: Synthetic oligonucleotide
  Target: ATXN1; (+) strand; PAM type: YTN; PAM sequence: TTC
aacaggtgtatgatctggga

SEQ ID NO: 280471 - DNA, 20 bp, Artificial Sequence
  Description of Artificial Sequence: Synthetic oligonucleotide
  Target: ATXN1; (+) strand; PAM type: YTN; PAM sequence: CTG
ggatcatatcatgagggagt

SEQ ID NO: 280472 - DNA, 20 bp, Artificial Sequence
  Description of Artificial Sequence: Synthetic oligonucleotide
  Target: ATXN1; (+) strand; PAM type: YTN; PAM sequence: CTT
gctgagtaaacaggatgtgg

SEQ ID NO: 280473 - DNA, 20 bp, Artificial Sequence
  Description of Artificial Sequence: Synthetic oligonucleotide
  Target: ATXN1; (+) strand; PAM type: YTN; PAM sequence: TTG
ctgagtaaacaggatgtggg

SEQ ID NO: 280474 - DNA, 20 bp, Artificial Sequence
  Description of Artificial Sequence: Synthetic oligonucleotide
  Target: ATXN1; (+) strand; PAM type: YTN; PAM sequence: CTG
agtaaacaggatgtgggtcc

SEQ ID NO: 280475 - DNA, 20 bp, Artificial Sequence
  Description of Artificial Sequence: Synthetic oligonucleotide
  Target: ATXN1; (+) strand; PAM type: YTN; PAM sequence: CTC
ttctaccttttcagctgaat

SEQ ID NO: 280476 - DNA, 20 bp, Artificial Sequence
  Description of Artificial Sequence: Synthetic oligonucleotide
  Target: ATXN1; (+) strand; PAM type: YTN; PAM sequence: CTT
ctaccttttcagctgaatga

SEQ ID NO: 280477 - DNA, 20 bp, Artificial Sequence
  Description of Artificial Sequence: Synthetic oligonucleotide
  Target: ATXN1; (+) strand; PAM type: YTN; PAM sequence: TTC
taccttttcagctgaatgac

SEQ ID NO: 280478 - DNA, 20 bp, Artificial Sequence
  Description of Artificial Sequence: Synthetic oligonucleotide
  Target: ATXN1; (+) strand; PAM type: YTN; PAM sequence: CTA
ccttttcagctgaatgacct

SEQ ID NO: 280479 - DNA, 20 bp, Artificial Sequence
  Description of Artificial Sequence: Synthetic oligonucleotide
  Target: ATXN1; (+) strand; PAM type: YTN; PAM sequence: CTT
ttcagctgaatgacctccag

SEQ ID NO: 280480 - DNA, 20 bp, Artificial Sequence
  Description of Artificial Sequence: Synthetic oligonucleotide
  Target: ATXN1; (+) strand; PAM type: YTN; PAM sequence: TTT
tcagctgaatgacctccagg

SEQ ID NO: 280481 - DNA, 20 bp, Artificial Sequence
  Description of Artificial Sequence: Synthetic oligonucleotide
  Target: ATXN1; (+) strand; PAM type: YTN; PAM sequence: TTT
cagctgaatgacctccaggc

SEQ ID NO: 280482 - DNA, 20 bp, Artificial Sequence
  Description of Artificial Sequence: Synthetic oligonucleotide
  Target: ATXN1; (+) strand; PAM type: YTN; PAM sequence: TTC
agctgaatgacctccaggct

SEQ ID NO: 280483 - DNA, 20 bp, Artificial Sequence
  Description of Artificial Sequence: Synthetic oligonucleotide
  Target: ATXN1; (+) strand; PAM type: YTN; PAM sequence: CTG
aatgacctccaggcttagca

SEQ ID NO: 280484 - DNA, 20 bp, Artificial Sequence
  Description of Artificial Sequence: Synthetic oligonucleotide
  Target: ATXN1; (+) strand; PAM type: YTN; PAM sequence: CTC
caggcttagcagcctctcta

SEQ ID NO: 280485 - DNA, 20 bp, Artificial Sequence
  Description of Artificial Sequence: Synthetic oligonucleotide
  Target: ATXN1; (+) strand; PAM type: YTN; PAM sequence: CTT
agcagcctctctaaacctca

SEQ ID NO: 280486 - DNA, 20 bp, Artificial Sequence
  Description of Artificial Sequence: Synthetic oligonucleotide
  Target: ATXN1; (+) strand; PAM type: YTN; PAM sequence: TTA
gcagcctctctaaacctcag

SEQ ID NO: 280487 - DNA, 20 bp, Artificial Sequence
  Description of Artificial Sequence: Synthetic oligonucleotide
  Target: ATXN1; (+) strand; PAM type: YTN; PAM sequence: CTC
tctaaacctcagcccccgtc

SEQ ID NO: 280488 - DNA, 20 bp, Artificial Sequence
  Description of Artificial Sequence: Synthetic oligonucleotide
  Target: ATXN1; (+) strand; PAM type: YTN; PAM sequence: CTC
taaacctcagcccccgtcta

SEQ ID NO: 280489 - DNA, 20 bp, Artificial Sequence
  Description of Artificial Sequence: Synthetic oligonucleotide
  Target: ATXN1; (+) strand; PAM type: YTN; PAM sequence: CTA
aacctcagcccccgtctata

SEQ ID NO: 280490 - DNA, 20 bp, Artificial Sequence
  Description of Artificial Sequence: Synthetic oligonucleotide
  Target: ATXN1; (+) strand; PAM type: YTN; PAM sequence: CTC
agcccccgtctataaagtga

SEQ ID NO: 280491 - DNA, 20 bp, Artificial Sequence
  Description of Artificial Sequence: Synthetic oligonucleotide
  Target: ATXN1; (+) strand; PAM type: YTN; PAM sequence: CTA
taaagtgagaaacattgtaa

SEQ ID NO: 280492 - DNA, 20 bp, Artificial Sequence
  Description of Artificial Sequence: Synthetic oligonucleotide
  Target: ATXN1; (+) strand; PAM type: YTN; PAM sequence: TTG
taacacatacatgatgctta

SEQ ID NO: 280493 - DNA, 20 bp, Artificial Sequence
  Description of Artificial Sequence: Synthetic oligonucleotide
  Target: ATXN1; (+) strand; PAM type: YTN; PAM sequence: CTT
agcagagcgcctgggcattc

SEQ ID NO: 280494 - DNA, 20 bp, Artificial Sequence
  Description of Artificial Sequence: Synthetic oligonucleotide
  Target: ATXN1; (+) strand; PAM type: YTN; PAM sequence: TTA
gcagagcgcctgggcattca

SEQ ID NO: 280495 - DNA, 20 bp, Artificial Sequence
  Description of Artificial Sequence: Synthetic oligonucleotide
  Target: ATXN1; (+) strand; PAM type: YTN; PAM sequence: CTG
ggcattcatacttagcaaaa

SEQ ID NO: 280496 - DNA, 20 bp, Artificial Sequence
  Description of Artificial Sequence: Synthetic oligonucleotide
  Target: ATXN1; (+) strand; PAM type: YTN; PAM sequence: TTC
atacttagcaaaagttggtt

SEQ ID NO: 280497 - DNA, 20 bp, Artificial Sequence
  Description of Artificial Sequence: Synthetic oligonucleotide
  Target: ATXN1; (+) strand; PAM type: YTN; PAM sequence: CTT
agcaaaagttggttgatatt

SEQ ID NO: 280498 - DNA, 20 bp, Artificial Sequence
  Description of Artificial Sequence: Synthetic oligonucleotide
  Target: ATXN1; (+) strand; PAM type: YTN; PAM sequence: TTA
gcaaaagttggttgatattc

SEQ ID NO: 280499 - DNA, 20 bp, Artificial Sequence
  Description of Artificial Sequence: Synthetic oligonucleotide
  Target: ATXN1; (+) strand; PAM type: YTN; PAM sequence: TTG
gttgatattcttacccttct

SEQ ID NO: 280500 - DNA, 20 bp, Artificial Sequence
  Description of Artificial Sequence: Synthetic oligonucleotide
  Target: ATXN1; (+) strand; PAM type: YTN; PAM sequence: TTG
atattcttacccttctacaa

SEQ ID NO: 280501 - DNA, 20 bp, Artificial Sequence
  Description of Artificial Sequence: Synthetic oligonucleotide
  Target: ATXN1; (+) strand; PAM type: YTN; PAM sequence: TTC
ttacccttctacaactatgt

SEQ ID NO: 280502 - DNA, 20 bp, Artificial Sequence
  Description of Artificial Sequence: Synthetic oligonucleotide
  Target: ATXN1; (+) strand; PAM type: YTN; PAM sequence: CTT
acccttctacaactatgttc

SEQ ID NO: 280503 - DNA, 20 bp, Artificial Sequence
  Description of Artificial Sequence: Synthetic oligonucleotide
  Target: ATXN1; (+) strand; PAM type: YTN; PAM sequence: TTA
cccttctacaactatgttct

SEQ ID NO: 280504 - DNA, 20 bp, Artificial Sequence
  Description of Artificial Sequence: Synthetic oligonucleotide
  Target: ATXN1; (+) strand; PAM type: YTN; PAM sequence: CTT
ctacaactatgttctcaaga

SEQ ID NO: 280505 - DNA, 20 bp, Artificial Sequence
  Description of Artificial Sequence: Synthetic oligonucleotide
  Target: ATXN1; (+) strand; PAM type: YTN; PAM sequence: TTC
tacaactatgttctcaagaa

SEQ ID NO: 280506 - DNA, 20 bp, Artificial Sequence
  Description of Artificial Sequence: Synthetic oligonucleotide
  Target: ATXN1; (+) strand; PAM type: YTN; PAM sequence: CTA
caactatgttctcaagaaaa

SEQ ID NO: 280507 - DNA, 20 bp, Artificial Sequence
  Description of Artificial Sequence: Synthetic oligonucleotide
  Target: ATXN1; (+) strand; PAM type: YTN; PAM sequence: CTA
tgttctcaagaaaaatcatt

SEQ ID NO: 280508 - DNA, 20 bp, Artificial Sequence
  Description of Artificial Sequence: Synthetic oligonucleotide
  Target: ATXN1; (+) strand; PAM type: YTN; PAM sequence: TTC
tcaagaaaaatcatttttgg

SEQ ID NO: 280509 - DNA, 20 bp, Artificial Sequence
  Description of Artificial Sequence: Synthetic oligonucleotide
  Target: ATXN1; (+) strand; PAM type: YTN; PAM sequence: CTC
aagaaaaatcatttttggga

SEQ ID NO: 280510 - DNA, 20 bp, Artificial Sequence
  Description of Artificial Sequence: Synthetic oligonucleotide
  Target: ATXN1; (+) strand; PAM type: YTN; PAM sequence: TTT
ttgggagagtgagataggta

SEQ ID NO: 280511 - DNA, 20 bp, Artificial Sequence
  Description of Artificial Sequence: Synthetic oligonucleotide
  Target: ATXN1; (+) strand; PAM type: YTN; PAM sequence: TTT
tgggagagtgagataggtaa

SEQ ID NO: 280512 - DNA, 20 bp, Artificial Sequence
  Description of Artificial Sequence: Synthetic oligonucleotide
  Target: ATXN1; (+) strand; PAM type: YTN; PAM sequence: TTT
gggagagtgagataggtaag

SEQ ID NO: 280513 - DNA, 20 bp, Artificial Sequence
  Description of Artificial Sequence: Synthetic oligonucleotide
  Target: ATXN1; (+) strand; PAM type: YTN; PAM sequence: TTG
ggagagtgagataggtaaga

SEQ ID NO: 280514 - DNA, 20 bp, Artificial Sequence
  Description of Artificial Sequence: Synthetic oligonucleotide
  Target: ATXN1; (+) strand; PAM type: YTN; PAM sequence: CTT
acaatcttaatttgtaacta

SEQ ID NO: 280515 - DNA, 20 bp, Artificial Sequence
  Description of Artificial Sequence: Synthetic oligonucleotide
  Target: ATXN1; (+) strand; PAM type: YTN; PAM sequence: TTA
caatcttaatttgtaactac

SEQ ID NO: 280516 - DNA, 20 bp, Artificial Sequence
  Description of Artificial Sequence: Synthetic oligonucleotide
  Target: ATXN1; (+) strand; PAM type: YTN; PAM sequence: CTT
aatttgtaactacctaaaag

SEQ ID NO: 280517 - DNA, 20 bp, Artificial Sequence
  Description of Artificial Sequence: Synthetic oligonucleotide
  Target: ATXN1; (+) strand; PAM type: YTN; PAM sequence: TTA
atttgtaactacctaaaagt

SEQ ID NO: 280518 - DNA, 20 bp, Artificial Sequence
  Description of Artificial Sequence: Synthetic oligonucleotide
  Target: ATXN1; (+) strand; PAM type: YTN; PAM sequence: TTT
gtaactacctaaaagtaggc

SEQ ID NO: 280519 - DNA, 20 bp, Artificial Sequence
  Description of Artificial Sequence: Synthetic oligonucleotide
  Target: ATXN1; (+) strand; PAM type: YTN; PAM sequence: TTG
taactacctaaaagtaggct

SEQ ID NO: 280520 - DNA, 20 bp, Artificial Sequence
  Description of Artificial Sequence: Synthetic oligonucleotide
  Target: ATXN1; (+) strand; PAM type: YTN; PAM sequence: CTA
cctaaaagtaggctgcacag

SEQ ID NO: 280521 - DNA, 20 bp, Artificial Sequence
  Description of Artificial Sequence: Synthetic oligonucleotide
  Target: ATXN1; (+) strand; PAM type: YTN; PAM sequence: CTA
aaagtaggctgcacagagaa

SEQ ID NO: 280522 - DNA, 20 bp, Artificial Sequence
  Description of Artificial Sequence: Synthetic oligonucleotide
  Target: ATXN1; (+) strand; PAM type: YTN; PAM sequence: CTG
cacagagaaatgaaactatg

SEQ ID NO: 280523 - DNA, 20 bp, Artificial Sequence
  Description of Artificial Sequence: Synthetic oligonucleotide
  Target: ATXN1; (+) strand; PAM type: YTN; PAM sequence: CTA
tgtctacacaaaaacttgga

SEQ ID NO: 280524 - DNA, 20 bp, Artificial Sequence
  Description of Artificial Sequence: Synthetic oligonucleotide
  Target: ATXN1; (+) strand; PAM type: YTN; PAM sequence: CTA
cacaaaaacttggaaaggaa

SEQ ID NO: 280525 - DNA, 20 bp, Artificial Sequence
  Description of Artificial Sequence: Synthetic oligonucleotide
  Target: ATXN1; (+) strand; PAM type: YTN; PAM sequence: CTT
ggaaaggaatgttcatagca

SEQ ID NO: 280526 - DNA, 20 bp, Artificial Sequence
  Description of Artificial Sequence: Synthetic oligonucleotide
  Target: ATXN1; (+) strand; PAM type: YTN; PAM sequence: TTG
gaaaggaatgttcatagcag

SEQ ID NO: 280527 - DNA, 20 bp, Artificial Sequence
  Description of Artificial Sequence: Synthetic oligonucleotide
  Target: ATXN1; (+) strand; PAM type: YTN; PAM sequence: TTC
atagcagcactgttcataat

SEQ ID NO: 280528 - DNA, 20 bp, Artificial Sequence
  Description of Artificial Sequence: Synthetic oligonucleotide
  Target: ATXN1; (+) strand; PAM type: YTN; PAM sequence: CTG
ttcataatagtgaaagagtg

SEQ ID NO: 280529 - DNA, 20 bp, Artificial Sequence
  Description of Artificial Sequence: Synthetic oligonucleotide
  Target: ATXN1; (+) strand; PAM type: YTN; PAM sequence: TTC
ataatagtgaaagagtggag

SEQ ID NO: 280530 - DNA, 20 bp, Artificial Sequence
  Description of Artificial Sequence: Synthetic oligonucleotide
  Target: ATXN1; (+) strand; PAM type: YTN; PAM sequence: CTG
ataaatgaataaacaaaata

SEQ ID NO: 280531 - DNA, 20 bp, Artificial Sequence
  Description of Artificial Sequence: Synthetic oligonucleotide
  Target: ATXN1; (+) strand; PAM type: YTN; PAM sequence: TTA
cattattccatcataacaag

SEQ ID NO: 280532 - DNA, 20 bp, Artificial Sequence
  Description of Artificial Sequence: Synthetic oligonucleotide
  Target: ATXN1; (+) strand; PAM type: YTN; PAM sequence: TTA
ttccatcataacaagaaatg

SEQ ID NO: 280533 - DNA, 20 bp, Artificial Sequence
  Description of Artificial Sequence: Synthetic oligonucleotide
  Target: ATXN1; (+) strand; PAM type: YTN; PAM sequence: TTC
catcataacaagaaatgaat

SEQ ID NO: 280534 - DNA, 20 bp, Artificial Sequence
  Description of Artificial Sequence: Synthetic oligonucleotide
  Target: ATXN1; (+) strand; PAM type: YTN; PAM sequence: CTG
atgtatgctgaaatgtggat

SEQ ID NO: 280535 - DNA, 20 bp, Artificial Sequence
  Description of Artificial Sequence: Synthetic oligonucleotide
  Target: ATXN1; (+) strand; PAM type: YTN; PAM sequence: CTG
aaatgtggatgatccttgaa

SEQ ID NO: 280536 - DNA, 20 bp, Artificial Sequence
  Description of Artificial Sequence: Synthetic oligonucleotide
  Target: ATXN1; (+) strand; PAM type: YTN; PAM sequence: CTT
gaaagcattatgctaagtga

SEQ ID NO: 280537 - DNA, 20 bp, Artificial Sequence
  Description of Artificial Sequence: Synthetic oligonucleotide
  Target: ATXN1; (+) strand; PAM type: YTN; PAM sequence: TTG
aaagcattatgctaagtgaa

SEQ ID NO: 280538 - DNA, 20 bp, Artificial Sequence
  Description of Artificial Sequence: Synthetic oligonucleotide
  Target: ATXN1; (+) strand; PAM type: YTN; PAM sequence: TTA
tgctaagtgaaagaagtcag

SEQ ID NO: 280539 - DNA, 20 bp, Artificial Sequence
  Description of Artificial Sequence: Synthetic oligonucleotide
  Target: ATXN1; (+) strand; PAM type: YTN; PAM sequence: CTA
agtgaaagaagtcagtcaca

SEQ ID NO: 280540 - DNA, 20 bp, Artificial Sequence
  Description of Artificial Sequence: Synthetic oligonucleotide
  Target: ATXN1; (+) strand; PAM type: YTN; PAM sequence: TTG
catgattctatttatatgga

SEQ ID NO: 280541 - DNA, 20 bp, Artificial Sequence
  Description of Artificial Sequence: Synthetic oligonucleotide
  Target: ATXN1; (+) strand; PAM type: YTN; PAM sequence: TTC
tatttatatggaatgtctag

SEQ ID NO: 280542 - DNA, 20 bp, Artificial Sequence
  Description of Artificial Sequence: Synthetic oligonucleotide
  Target: ATXN1; (+) strand; PAM type: YTN; PAM sequence: CTA
tttatatggaatgtctagaa

SEQ ID NO: 280543 - DNA, 20 bp, Artificial Sequence
  Description of Artificial Sequence: Synthetic oligonucleotide
  Target: ATXN1; (+) strand; PAM type: YTN; PAM sequence: TTT
atatggaatgtctagaacaa

SEQ ID NO: 280544 - DNA, 20 bp, Artificial Sequence
  Description of Artificial Sequence: Synthetic oligonucleotide
  Target: ATXN1; (+) strand; PAM type: YTN; PAM sequence: TTA
tatggaatgtctagaacaag

SEQ ID NO: 280545 - DNA, 20 bp, Artificial Sequence
  Description of Artificial Sequence: Synthetic oligonucleotide
  Target: ATXN1; (+) strand; PAM type: YTN; PAM sequence: CTA
gaacaagcaaatctatatat

SEQ ID NO: 280546 - DNA, 20 bp, Artificial Sequence
  Description of Artificial Sequence: Synthetic oligonucleotide
  Target: ATXN1; (+) strand; PAM type: YTN; PAM sequence: CTA
tatatagagaaacagcttcg

SEQ ID NO: 280547 - DNA, 20 bp, Artificial Sequence
  Description of Artificial Sequence: Synthetic oligonucleotide
  Target: ATXN1; (+) strand; PAM type: YTN; PAM sequence: CTT
cgtggttgccaggagctgag

SEQ ID NO: 280548 - DNA, 20 bp, Artificial Sequence
  Description of Artificial Sequence: Synthetic oligonucleotide
  Target: ATXN1; (+) strand; PAM type: YTN; PAM sequence: TTC
gtggttgccaggagctgagg

SEQ ID NO: 280549 - DNA, 20 bp, Artificial Sequence
  Description of Artificial Sequence: Synthetic oligonucleotide
  Target: ATXN1; (+) strand; PAM type: YTN; PAM sequence: TTG
ccaggagctgagggtagagg

SEQ ID NO: 280550 - DNA, 20 bp, Artificial Sequence
  Description of Artificial Sequence: Synthetic oligonucleotide
  Target: ATXN1; (+) strand; PAM type: YTN; PAM sequence: CTG
agggtagaggattgggggaa

SEQ ID NO: 280551 - DNA, 20 bp, Artificial Sequence
  Description of Artificial Sequence: Synthetic oligonucleotide
  Target: ATXN1; (+) strand; PAM type: YTN; PAM sequence: TTG
ggggaaaatgggaagtgatt

SEQ ID NO: 280552 - DNA, 20 bp, Artificial Sequence
  Description of Artificial Sequence: Synthetic oligonucleotide
  Target: ATXN1; (+) strand; PAM type: YTN; PAM sequence: TTG
ctgatgggtatgggatttcc

SEQ ID NO: 280553 - DNA, 20 bp, Artificial Sequence
  Description of Artificial Sequence: Synthetic oligonucleotide
  Target: ATXN1; (+) strand; PAM type: YTN; PAM sequence: CTG
atgggtatgggatttccttt

SEQ ID NO: 280554 - DNA, 20 bp, Artificial Sequence
  Description of Artificial Sequence: Synthetic oligonucleotide
  Target: ATXN1; (+) strand; PAM type: YTN; PAM sequence: TTT
cctttaggggtgatgaaaat

SEQ ID NO: 280555 - DNA, 20 bp, Artificial Sequence
  Description of Artificial Sequence: Synthetic oligonucleotide
  Target: ATXN1; (+) strand; PAM type: YTN; PAM sequence: TTC
ctttaggggtgatgaaaatg

SEQ ID NO: 280556 - DNA, 20 bp, Artificial Sequence
  Description of Artificial Sequence: Synthetic oligonucleotide
  Target: ATXN1; (+) strand; PAM type: YTN; PAM sequence: CTT
taggggtgatgaaaatgttc

SEQ ID NO: 280557 - DNA, 20 bp, Artificial Sequence
  Description of Artificial Sequence: Synthetic oligonucleotide
  Target: ATXN1; (+) strand; PAM type: YTN; PAM sequence: TTT
aggggtgatgaaaatgttct

SEQ ID NO: 280558 - DNA, 20 bp, Artificial Sequence
  Description of Artificial Sequence: Synthetic oligonucleotide
  Target: ATXN1; (+) strand; PAM type: YTN; PAM sequence: TTA
ggggtgatgaaaatgttcta

SEQ ID NO: 280559 - DNA, 20 bp, Artificial Sequence
  Description of Artificial Sequence: Synthetic oligonucleotide
  Target: ATXN1; (+) strand; PAM type: YTN; PAM sequence: TTC
taaaatttattgtggtgata

SEQ ID NO: 280560 - DNA, 20 bp, Artificial Sequence
  Description of Artificial Sequence: Synthetic oligonucleotide
  Target: ATXN1; (+) strand; PAM type: YTN; PAM sequence: CTA
aaatttattgtggtgatagc

SEQ ID NO: 280561 - DNA, 20 bp, Artificial Sequence
  Description of Artificial Sequence: Synthetic oligonucleotide
  Target: ATXN1; (+) strand; PAM type: YTN; PAM sequence: TTT
attgtggtgatagctgcaca

SEQ ID NO: 280562 - DNA, 20 bp, Artificial Sequence
  Description of Artificial Sequence: Synthetic oligonucleotide
  Target: ATXN1; (+) strand; PAM type: YTN; PAM sequence: TTA
ttgtggtgatagctgcacag

SEQ ID NO: 280563 - DNA, 20 bp, Artificial Sequence
  Description of Artificial Sequence: Synthetic oligonucleotide
  Target: ATXN1; (+) strand; PAM type: YTN; PAM sequence: TTG
tggtgatagctgcacagctc

SEQ ID NO: 280564 - DNA, 20 bp, Artificial Sequence
  Description of Artificial Sequence: Synthetic oligonucleotide
  Target: ATXN1; (+) strand; PAM type: YTN; PAM sequence: CTG
cacagctctgtaaatacact

SEQ ID NO: 280565 - DNA, 20 bp, Artificial Sequence
  Description of Artificial Sequence: Synthetic oligonucleotide
  Target: ATXN1; (+) strand; PAM type: YTN; PAM sequence: CTC
tgtaaatacactaaaaagca

SEQ ID NO: 280566 - DNA, 20 bp, Artificial Sequence
  Description of Artificial Sequence: Synthetic oligonucleotide
  Target: ATXN1; (+) strand; PAM type: YTN; PAM sequence: CTG
taaatacactaaaaagcaat

SEQ ID NO: 280567 - DNA, 20 bp, Artificial Sequence
  Description of Artificial Sequence: Synthetic oligonucleotide
  Target: ATXN1; (+) strand; PAM type: YTN; PAM sequence: CTA
aaaagcaattcattgcactt

SEQ ID NO: 280568 - DNA, 20 bp, Artificial Sequence
  Description of Artificial Sequence: Synthetic oligonucleotide
  Target: ATXN1; (+) strand; PAM type: YTN; PAM sequence: TTC
attgcacttttttttttaat

SEQ ID NO: 280569 - DNA, 20 bp, Artificial Sequence
  Description of Artificial Sequence: Synthetic oligonucleotide
  Target: ATXN1; (+) strand; PAM type: YTN; PAM sequence: TTG
cacttttttttttaatttaa

SEQ ID NO: 280570 - DNA, 20 bp, Artificial Sequence
  Description of Artificial Sequence: Synthetic oligonucleotide
  Target: ATXN1; (+) strand; PAM type: YTN; PAM sequence: CTT
ttttttttaatttaaataag

SEQ ID NO: 280571 - DNA, 20 bp, Artificial Sequence
  Description of Artificial Sequence: Synthetic oligonucleotide
  Target: ATXN1; (+) strand; PAM type: YTN; PAM sequence: TTT
tttttttaatttaaataagc

SEQ ID NO: 280572 - DNA, 20 bp, Artificial Sequence
  Description of Artificial Sequence: Synthetic oligonucleotide
  Target: ATXN1; (+) strand; PAM type: YTN; PAM sequence: TTT
ttttttaatttaaataagct

SEQ ID NO: 280573 - DNA, 20 bp, Artificial Sequence
  Description of Artificial Sequence: Synthetic oligonucleotide
  Target: ATXN1; (+) strand; PAM type: YTN; PAM sequence: TTT
tttttaatttaaataagcta

SEQ ID NO: 280574 - DNA, 20 bp, Artificial Sequence
  Description of Artificial Sequence: Synthetic oligonucleotide
  Target: ATXN1; (+) strand; PAM type: YTN; PAM sequence: TTT
ttttaatttaaataagctat

SEQ ID NO: 280575 - DNA, 20 bp, Artificial Sequence
  Description of Artificial Sequence: Synthetic oligonucleotide
  Target: ATXN1; (+) strand; PAM type: YTN; PAM sequence: TTT
tttaatttaaataagctatg

SEQ ID NO: 280576 - DNA, 20 bp, Artificial Sequence
  Description of Artificial Sequence: Synthetic oligonucleotide
  Target: ATXN1; (+) strand; PAM type: YTN; PAM sequence: TTT
ttaatttaaataagctatgc

SEQ ID NO: 280577 - DNA, 20 bp, Artificial Sequence
  Description of Artificial Sequence: Synthetic oligonucleotide
  Target: ATXN1; (+) strand; PAM type: YTN; PAM sequence: TTT
taatttaaataagctatgca

SEQ ID NO: 280578 - DNA, 20 bp, Artificial Sequence
  Description of Artificial Sequence: Synthetic oligonucleotide
  Target: ATXN1; (+) strand; PAM type: YTN; PAM sequence: TTT
aatttaaataagctatgcag

SEQ ID NO: 280579 - DNA, 20 bp, Artificial Sequence
  Description of Artificial Sequence: Synthetic oligonucleotide
  Target: ATXN1; (+) strand; PAM type: YTN; PAM sequence: TTA
atttaaataagctatgcagt

SEQ ID NO: 280580 - DNA, 20 bp, Artificial Sequence
  Description of Artificial Sequence: Synthetic oligonucleotide
  Target: ATXN1; (+) strand; PAM type: YTN; PAM sequence: TTT
aaataagctatgcagtcctc

SEQ ID NO: 280581 - DNA, 20 bp, Artificial Sequence
  Description of Artificial Sequence: Synthetic oligonucleotide
  Target: ATXN1; (+) strand; PAM type: YTN; PAM sequence: TTA
aataagctatgcagtcctca

SEQ ID NO: 280582 - DNA, 20 bp, Artificial Sequence
  Description of Artificial Sequence: Synthetic oligonucleotide
  Target: ATXN1; (+) strand; PAM type: YTN; PAM sequence: CTA
tgcagtcctcaatgcctcct

SEQ ID NO: 280583 - DNA, 20 bp, Artificial Sequence
  Description of Artificial Sequence: Synthetic oligonucleotide
  Target: ATXN1; (+) strand; PAM type: YTN; PAM sequence: CTC
aatgcctcctgctccccatc

SEQ ID NO: 280584 - DNA, 20 bp, Artificial Sequence
  Description of Artificial Sequence: Synthetic oligonucleotide
  Target: ATXN1; (+) strand; PAM type: YTN; PAM sequence: CTC
ctgctccccatctcctgaat

SEQ ID NO: 280585 - DNA, 20 bp, Artificial Sequence
  Description of Artificial Sequence: Synthetic oligonucleotide
  Target: ATXN1; (+) strand; PAM type: YTN; PAM sequence: CTG
ctccccatctcctgaataaa

SEQ ID NO: 280586 - DNA, 20 bp, Artificial Sequence
  Description of Artificial Sequence: Synthetic oligonucleotide
  Target: ATXN1; (+) strand; PAM type: YTN; PAM sequence: CTC
cccatctcctgaataaacaa

SEQ ID NO: 280587 - DNA, 20 bp, Artificial Sequence
  Description of Artificial Sequence: Synthetic oligonucleotide
  Target: ATXN1; (+) strand; PAM type: YTN; PAM sequence: CTC
ctgaataaacaagactttct

SEQ ID NO: 280588 - DNA, 20 bp, Artificial Sequence
  Description of Artificial Sequence: Synthetic oligonucleotide
  Target: ATXN1; (+) strand; PAM type: YTN; PAM sequence: CTG
aataaacaagactttcttcc

SEQ ID NO: 280589 - DNA, 20 bp, Artificial Sequence
  Description of Artificial Sequence: Synthetic oligonucleotide
  Target: ATXN1; (+) strand; PAM type: YTN; PAM sequence: CTT
tcttccctgggtgagggtct

SEQ ID NO: 280590 - DNA, 20 bp, Artificial Sequence
  Description of Artificial Sequence: Synthetic oligonucleotide
  Target: ATXN1; (+) strand; PAM type: YTN; PAM sequence: TTT
cttccctgggtgagggtctt

SEQ ID NO: 280591 - DNA, 20 bp, Artificial Sequence
  Description of Artificial Sequence: Synthetic oligonucleotide
  Target: ATXN1; (+) strand; PAM type: YTN; PAM sequence: TTC
ttccctgggtgagggtcttg

SEQ ID NO: 280592 - DNA, 20 bp, Artificial Sequence
  Description of Artificial Sequence: Synthetic oligonucleotide
  Target: ATXN1; (+) strand; PAM type: YTN; PAM sequence: CTT
ccctgggtgagggtcttgat

SEQ ID NO: 280593 - DNA, 20 bp, Artificial Sequence
  Description of Artificial Sequence: Synthetic oligonucleotide
  Target: ATXN1; (+) strand; PAM type: YTN; PAM sequence: TTC
cctgggtgagggtcttgata

SEQ ID NO: 280594 - DNA, 20 bp, Artificial Sequence
  Description of Artificial Sequence: Synthetic oligonucleotide
  Target: ATXN1; (+) strand; PAM type: YTN; PAM sequence: CTG
ggtgagggtcttgataggta

SEQ ID NO: 280595 - DNA, 20 bp, Artificial Sequence
  Description of Artificial Sequence: Synthetic oligonucleotide
  Target: ATXN1; (+) strand; PAM type: YTN; PAM sequence: CTT
gataggtagaatactgtaca

SEQ ID NO: 280596 - DNA, 20 bp, Artificial Sequence
  Description of Artificial Sequence: Synthetic oligonucleotide
  Target: ATXN1; (+) strand; PAM type: YTN; PAM sequence: TTG
ataggtagaatactgtacac

SEQ ID NO: 280597 - DNA, 20 bp, Artificial Sequence
  Description of Artificial Sequence: Synthetic oligonucleotide
  Target: ATXN1; (+) strand; PAM type: YTN; PAM sequence: CTG
tacacggaatacagaattca

SEQ ID NO: 280598 - DNA, 20 bp, Artificial Sequence
  Description of Artificial Sequence: Synthetic oligonucleotide
  Target: ATXN1; (+) strand; PAM type: YTN; PAM sequence: TTC
aagcagttccttgacttatg

SEQ ID NO: 280599 - DNA, 20 bp, Artificial Sequence
  Description of Artificial Sequence: Synthetic oligonucleotide
  Target: ATXN1; (+) strand; PAM type: YTN; PAM sequence: TTC
cttgacttatgaatatcaga

SEQ ID NO: 280600 - DNA, 20 bp, Artificial Sequence
  Description of Artificial Sequence: Synthetic oligonucleotide
  Target: ATXN1; (+) strand; PAM type: YTN; PAM sequence: CTT
gacttatgaatatcagaaga

SEQ ID NO: 280601 - DNA, 20 bp, Artificial Sequence
  Description of Artificial Sequence: Synthetic oligonucleotide
  Target: ATXN1; (+) strand; PAM type: YTN; PAM sequence: TTG
acttatgaatatcagaagat

SEQ ID NO: 280602 - DNA, 20 bp, Artificial Sequence
  Description of Artificial Sequence: Synthetic oligonucleotide
  Target: ATXN1; (+) strand; PAM type: YTN; PAM sequence: CTT
atgaatatcagaagatgtcc

SEQ ID NO: 280603 - DNA, 20 bp, Artificial Sequence
  Description of Artificial Sequence: Synthetic oligonucleotide
  Target: ATXN1; (+) strand; PAM type: YTN; PAM sequence: TTA
tgaatatcagaagatgtcca

SEQ ID NO: 280604 - DNA, 20 bp, Artificial Sequence
  Description of Artificial Sequence: Synthetic oligonucleotide
  Target: ATXN1; (+) strand; PAM type: YTN; PAM sequence: CTC
tttctcaggagacatttcca

SEQ ID NO: 280605 - DNA, 20 bp, Artificial Sequence
  Description of Artificial Sequence: Synthetic oligonucleotide
  Target: ATXN1; (+) strand; PAM type: YTN; PAM sequence: CTT
tctcaggagacatttccagg

SEQ ID NO: 280606 - DNA, 20 bp, Artificial Sequence
  Description of Artificial Sequence: Synthetic oligonucleotide
  Target: ATXN1; (+) strand; PAM type: YTN; PAM sequence: TTT
ctcaggagacatttccaggt

SEQ ID NO: 280607 - DNA, 20 bp, Artificial Sequence
  Description of Artificial Sequence: Synthetic oligonucleotide
  Target: ATXN1; (+) strand; PAM type: YTN; PAM sequence: TTC
tcaggagacatttccaggtg

SEQ ID NO: 280608 - DNA, 20 bp, Artificial Sequence
  Description of Artificial Sequence: Synthetic oligonucleotide
  Target: ATXN1; (+) strand; PAM type: YTN; PAM sequence: CTC
aggagacatttccaggtgga

SEQ ID NO: 280609 - DNA, 20 bp, Artificial Sequence
  Description of Artificial Sequence: Synthetic oligonucleotide
  Target: ATXN1; (+) strand; PAM type: YTN; PAM sequence: TTT
ccaggtggatgccagaggag

SEQ ID NO: 280610 - DNA, 20 bp, Artificial Sequence
  Description of Artificial Sequence: Synthetic oligonucleotide
  Target: ATXN1; (+) strand; PAM type: YTN; PAM sequence: TTC
caggtggatgccagaggagg

SEQ ID NO: 280611 - DNA, 20 bp, Artificial Sequence
  Description of Artificial Sequence: Synthetic oligonucleotide
  Target: ATXN1; (+) strand; PAM type: YTN; PAM sequence: TTA
tttctcttcttcccatctgc

SEQ ID NO: 280612 - DNA, 20 bp, Artificial Sequence
  Description of Artificial Sequence: Synthetic oligonucleotide
  Target: ATXN1; (+) strand; PAM type: YTN; PAM sequence: TTT
ctcttcttcccatctgcttc

SEQ ID NO: 280613 - DNA, 20 bp, Artificial Sequence
  Description of Artificial Sequence: Synthetic oligonucleotide
  Target: ATXN1; (+) strand; PAM type: YTN; PAM sequence: TTC
tcttcttcccatctgcttct

SEQ ID NO: 280614 - DNA, 20 bp, Artificial Sequence
  Description of Artificial Sequence: Synthetic oligonucleotide
  Target: ATXN1; (+) strand; PAM type: YTN; PAM sequence: CTC
ttcttcccatctgcttcttt

SEQ ID NO: 280615 - DNA, 20 bp, Artificial Sequence
  Description of Artificial Sequence: Synthetic oligonucleotide
  Target: ATXN1; (+) strand; PAM type: YTN; PAM sequence: CTT
cttcccatctgcttctttaa

SEQ ID NO: 280616 - DNA, 20 bp, Artificial Sequence
  Description of Artificial Sequence: Synthetic oligonucleotide
  Target: ATXN1; (+) strand; PAM type: YTN; PAM sequence: TTC
ttcccatctgcttctttaaa

SEQ ID NO: 280617 - DNA, 20 bp, Artificial Sequence
  Description of Artificial Sequence: Synthetic oligonucleotide
  Target: ATXN1; (+) strand; PAM type: YTN; PAM sequence: CTT
cccatctgcttctttaaatc

SEQ ID NO: 280618 - DNA, 20 bp, Artificial Sequence
  Description of Artificial Sequence: Synthetic oligonucleotide
  Target: ATXN1; (+) strand; PAM type: YTN; PAM sequence: TTC
ccatctgcttctttaaatct

SEQ ID NO: 280619 - DNA, 20 bp, Artificial Sequence
  Description of Artificial Sequence: Synthetic oligonucleotide
  Target: ATXN1; (+) strand; PAM type: YTN; PAM sequence: CTG
cttctttaaatcttagctcc

SEQ ID NO: 280620 - DNA, 20 bp, Artificial Sequence
  Description of Artificial Sequence: Synthetic oligonucleotide
  Target: ATXN1; (+) strand; PAM type: YTN; PAM sequence: CTT
ctttaaatcttagctcctgc

SEQ ID NO: 280621 - DNA, 20 bp, Artificial Sequence
  Description of Artificial Sequence: Synthetic oligonucleotide
  Target: ATXN1; (+) strand; PAM type: YTN; PAM sequence: TTC
tttaaatcttagctcctgca

SEQ ID NO: 280622 - DNA, 20 bp, Artificial Sequence
  Description of Artificial Sequence: Synthetic oligonucleotide
  Target: ATXN1; (+) strand; PAM type: YTN; PAM sequence: CTT
taaatcttagctcctgcatt

SEQ ID NO: 280623 - DNA, 20 bp, Artificial Sequence
  Description of Artificial Sequence: Synthetic oligonucleotide
  Target: ATXN1; (+) strand; PAM type: YTN; PAM sequence: TTT
aaatcttagctcctgcattc

SEQ ID NO: 280624 - DNA, 20 bp, Artificial Sequence
  Description of Artificial Sequence: Synthetic oligonucleotide
  Target: ATXN1; (+) strand; PAM type: YTN; PAM sequence: TTA
aatcttagctcctgcattct

SEQ ID NO: 280625 - DNA, 20 bp, Artificial Sequence
  Description of Artificial Sequence: Synthetic oligonucleotide
  Target: ATXN1; (+) strand; PAM type: YTN; PAM sequence: CTT
agctcctgcattctgtttcc

SEQ ID NO: 280626 - DNA, 20 bp, Artificial Sequence
  Description of Artificial Sequence: Synthetic oligonucleotide
  Target: ATXN1; (+) strand; PAM type: YTN; PAM sequence: TTA
gctcctgcattctgtttccc

SEQ ID NO: 280627 - DNA, 20 bp, Artificial Sequence
  Description of Artificial Sequence: Synthetic oligonucleotide
  Target: ATXN1; (+) strand; PAM type: YTN; PAM sequence: CTC
ctgcattctgtttccccata

SEQ ID NO: 280628 - DNA, 20 bp, Artificial Sequence
  Description of Artificial Sequence: Synthetic oligonucleotide
  Target: ATXN1; (+) strand; PAM type: YTN; PAM sequence: CTG
cattctgtttccccatatga

SEQ ID NO: 280629 - DNA, 20 bp, Artificial Sequence
  Description of Artificial Sequence: Synthetic oligonucleotide
  Target: ATXN1; (+) strand; PAM type: YTN; PAM sequence: TTC
tgtttccccatatgagcata

SEQ ID NO: 280630 - DNA, 20 bp, Artificial Sequence
  Description of Artificial Sequence: Synthetic oligonucleotide
  Target: ATXN1; (+) strand; PAM type: YTN; PAM sequence: CTG
tttccccatatgagcatagt

SEQ ID NO: 280631 - DNA, 20 bp, Artificial Sequence
  Description of Artificial Sequence: Synthetic oligonucleotide
  Target: ATXN1; (+) strand; PAM type: YTN; PAM sequence: TTT
ccccatatgagcatagtggt

SEQ ID NO: 280632 - DNA, 20 bp, Artificial Sequence
  Description of Artificial Sequence: Synthetic oligonucleotide
  Target: ATXN1; (+) strand; PAM type: YTN; PAM sequence: TTC
cccatatgagcatagtggtt

SEQ ID NO: 280633 - DNA, 20 bp, Artificial Sequence
  Description of Artificial Sequence: Synthetic oligonucleotide
  Target: ATXN1; (+) strand; PAM type: YTN; PAM sequence: TTA
aaaatcaatctctgctttat

SEQ ID NO: 280634 - DNA, 20 bp, Artificial Sequence
  Description of Artificial Sequence: Synthetic oligonucleotide
  Target: ATXN1; (+) strand; PAM type: YTN; PAM sequence: CTC
tgctttatcttcacaggcga

SEQ ID NO: 280635 - DNA, 20 bp, Artificial Sequence
  Description of Artificial Sequence: Synthetic oligonucleotide
  Target: ATXN1; (+) strand; PAM type: YTN; PAM sequence: CTG
ctttatcttcacaggcgaaa

SEQ ID NO: 280636 - DNA, 20 bp, Artificial Sequence
  Description of Artificial Sequence: Synthetic oligonucleotide
  Target: ATXN1; (+) strand; PAM type: YTN; PAM sequence: CTT
tatcttcacaggcgaaagct

SEQ ID NO: 280637 - DNA, 20 bp, Artificial Sequence
  Description of Artificial Sequence: Synthetic oligonucleotide
  Target: ATXN1; (+) strand; PAM type: YTN; PAM sequence: TTT
atcttcacaggcgaaagctt

SEQ ID NO: 280638 - DNA, 20 bp, Artificial Sequence
  Description of Artificial Sequence: Synthetic oligonucleotide
  Target: ATXN1; (+) strand; PAM type: YTN; PAM sequence: TTA
tcttcacaggcgaaagcttt

SEQ ID NO: 280639 - DNA, 20 bp, Artificial Sequence
  Description of Artificial Sequence: Synthetic oligonucleotide
  Target: ATXN1; (+) strand; PAM type: YTN; PAM sequence: CTT
cacaggcgaaagctttaaag

SEQ ID NO: 280640 - DNA, 20 bp, Artificial Sequence
  Description of Artificial Sequence: Synthetic oligonucleotide
  Target: ATXN1; (+) strand; PAM type: YTN; PAM sequence: TTC
acaggcgaaagctttaaagt

SEQ ID NO: 280641 - DNA, 20 bp, Artificial Sequence
  Description of Artificial Sequence: Synthetic oligonucleotide
  Target: ATXN1; (+) strand; PAM type: YTN; PAM sequence: CTT
taaagtggacaggtctttca

SEQ ID NO: 280642 - DNA, 20 bp, Artificial Sequence
  Description of Artificial Sequence: Synthetic oligonucleotide
  Target: ATXN1; (+) strand; PAM type: YTN; PAM sequence: TTT
aaagtggacaggtctttcat

SEQ ID NO: 280643 - DNA, 20 bp, Artificial Sequence
  Description of Artificial Sequence: Synthetic oligonucleotide
  Target: ATXN1; (+) strand; PAM type: YTN; PAM sequence: TTA
aagtggacaggtctttcata

SEQ ID NO: 280644 - DNA, 20 bp, Artificial Sequence
  Description of Artificial Sequence: Synthetic oligonucleotide
  Target: ATXN1; (+) strand; PAM type: YTN; PAM sequence: CTT
tcatacctagtttgaagttt

SEQ ID NO: 280645 - DNA, 20 bp, Artificial Sequence
  Description of Artificial Sequence: Synthetic oligonucleotide
  Target: ATXN1; (+) strand; PAM type: YTN; PAM sequence: TTT
catacctagtttgaagttta

SEQ ID NO: 280646 - DNA, 20 bp, Artificial Sequence
  Description of Artificial Sequence: Synthetic oligonucleotide
  Target: ATXN1; (+) strand; PAM type: YTN; PAM sequence: TTC
atacctagtttgaagtttat

SEQ ID NO: 280647 - DNA, 20 bp, Artificial Sequence
  Description of Artificial Sequence: Synthetic oligonucleotide
  Target: ATXN1; (+) strand; PAM type: YTN; PAM sequence: CTA
gtttgaagtttatgaaaaag

SEQ ID NO: 280648 - DNA, 20 bp, Artificial Sequence
  Description of Artificial Sequence: Synthetic oligonucleotide
  Target: ATXN1; (+) strand; PAM type: YTN; PAM sequence: TTT
gaagtttatgaaaaagaata

SEQ ID NO: 280649 - DNA, 20 bp, Artificial Sequence
  Description of Artificial Sequence: Synthetic oligonucleotide
  Target: ATXN1; (+) strand; PAM type: YTN; PAM sequence: TTG
aagtttatgaaaaagaataa

SEQ ID NO: 280650 - DNA, 20 bp, Artificial Sequence
  Description of Artificial Sequence: Synthetic oligonucleotide
  Target: ATXN1; (+) strand; PAM type: YTN; PAM sequence: TTT
atgaaaaagaataagggggc

SEQ ID NO: 280651 - DNA, 20 bp, Artificial Sequence
  Description of Artificial Sequence: Synthetic oligonucleotide
  Target: ATXN1; (+) strand; PAM type: YTN; PAM sequence: TTA
tgaaaaagaataagggggct

SEQ ID NO: 280652 - DNA, 20 bp, Artificial Sequence
  Description of Artificial Sequence: Synthetic oligonucleotide
  Target: ATXN1; (+) strand; PAM type: YTN; PAM sequence: CTA
ctctggagtactgtgagttt

SEQ ID NO: 280653 - DNA, 20 bp, Artificial Sequence
  Description of Artificial Sequence: Synthetic oligonucleotide
  Target: ATXN1; (+) strand; PAM type: YTN; PAM sequence: CTC
tggagtactgtgagtttttt

SEQ ID NO: 280654 - DNA, 20 bp, Artificial Sequence
  Description of Artificial Sequence: Synthetic oligonucleotide
  Target: ATXN1; (+) strand; PAM type: YTN; PAM sequence: CTG
gagtactgtgagttttttct

SEQ ID NO: 280655 - DNA, 20 bp, Artificial Sequence
  Description of Artificial Sequence: Synthetic oligonucleotide
  Target: ATXN1; (+) strand; PAM type: YTN; PAM sequence: CTG
tgagttttttctgcttctcc

SEQ ID NO: 280656 - DNA, 20 bp, Artificial Sequence
  Description of Artificial Sequence: Synthetic oligonucleotide
  Target: ATXN1; (+) strand; PAM type: YTN; PAM sequence: TTT
tttctgcttctccacaccat

SEQ ID NO: 280657 - DNA, 20 bp, Artificial Sequence
  Description of Artificial Sequence: Synthetic oligonucleotide
  Target: ATXN1; (+) strand; PAM type: YTN; PAM sequence: TTT
ttctgcttctccacaccata

SEQ ID NO: 280658 - DNA, 20 bp, Artificial Sequence
  Description of Artificial Sequence: Synthetic oligonucleotide
  Target: ATXN1; (+) strand; PAM type: YTN; PAM sequence: TTT
tctgcttctccacaccataa

SEQ ID NO: 280659 - DNA, 20 bp, Artificial Sequence
  Description of Artificial Sequence: Synthetic oligonucleotide
  Target: ATXN1; (+) strand; PAM type: YTN; PAM sequence: TTT
ctgcttctccacaccataag

SEQ ID NO: 280660 - DNA, 20 bp, Artificial Sequence
  Description of Artificial Sequence: Synthetic oligonucleotide
  Target: ATXN1; (+) strand; PAM type: YTN; PAM sequence: TTC
tgcttctccacaccataagg

SEQ ID NO: 280661 - DNA, 20 bp, Artificial Sequence
  Description of Artificial Sequence: Synthetic oligonucleotide
  Target: ATXN1; (+) strand; PAM type: YTN; PAM sequence: CTG
cttctccacaccataaggac

SEQ ID NO: 280662 - DNA, 20 bp, Artificial Sequence
  Description of Artificial Sequence: Synthetic oligonucleotide
  Target: ATXN1; (+) strand; PAM type: YTN; PAM sequence: CTT
ctccacaccataaggacagg

SEQ ID NO: 280663 - DNA, 20 bp, Artificial Sequence
  Description of Artificial Sequence: Synthetic oligonucleotide
  Target: ATXN1; (+) strand; PAM type: YTN; PAM sequence: TTC
tccacaccataaggacaggg

SEQ ID NO: 280664 - DNA, 20 bp, Artificial Sequence
  Description of Artificial Sequence: Synthetic oligonucleotide
  Target: ATXN1; (+) strand; PAM type: YTN; PAM sequence: CTC
cacaccataaggacagggtc

SEQ ID NO: 280665 - DNA, 20 bp, Artificial Sequence
  Description of Artificial Sequence: Synthetic oligonucleotide
  Target: ATXN1; (+) strand; PAM type: YTN; PAM sequence: CTG
taagcaattgtcctccaaac

SEQ ID NO: 280666 - DNA, 20 bp, Artificial Sequence
  Description of Artificial Sequence: Synthetic oligonucleotide
  Target: ATXN1; (+) strand; PAM type: YTN; PAM sequence: TTG
tcctccaaaccaatccacct

SEQ ID NO: 280667 - DNA, 20 bp, Artificial Sequence
  Description of Artificial Sequence: Synthetic oligonucleotide
  Target: ATXN1; (+) strand; PAM type: YTN; PAM sequence: CTC
caaaccaatccacctaatag

SEQ ID NO: 280668 - DNA, 20 bp, Artificial Sequence
  Description of Artificial Sequence: Synthetic oligonucleotide
  Target: ATXN1; (+) strand; PAM type: YTN; PAM sequence: CTA
ataggccacatcattttgtt

SEQ ID NO: 280669 - DNA, 20 bp, Artificial Sequence
  Description of Artificial Sequence: Synthetic oligonucleotide
  Target: ATXN1; (+) strand; PAM type: YTN; PAM sequence: TTT
tgtttagggaagaaactgca

SEQ ID NO: 280670 - DNA, 20 bp, Artificial Sequence
  Description of Artificial Sequence: Synthetic oligonucleotide
  Target: ATXN1; (+) strand; PAM type: YTN; PAM sequence: TTT
gtttagggaagaaactgcaa

SEQ ID NO: 280671 - DNA, 20 bp, Artificial Sequence
  Description of Artificial Sequence: Synthetic oligonucleotide
  Target: ATXN1; (+) strand; PAM type: YTN; PAM sequence: TTG
tttagggaagaaactgcaaa

SEQ ID NO: 280672 - DNA, 20 bp, Artificial Sequence
  Description of Artificial Sequence: Synthetic oligonucleotide
  Target: ATXN1; (+) strand; PAM type: YTN; PAM sequence: TTT
agggaagaaactgcaaaaag

SEQ ID NO: 280673 - DNA, 20 bp, Artificial Sequence
  Description of Artificial Sequence: Synthetic oligonucleotide
  Target: ATXN1; (+) strand; PAM type: YTN; PAM sequence: TTA
gggaagaaactgcaaaaaga

SEQ ID NO: 280674 - DNA, 20 bp, Artificial Sequence
  Description of Artificial Sequence: Synthetic oligonucleotide
  Target: ATXN1; (+) strand; PAM type: YTN; PAM sequence: CTG
caaaaagagattactgaaaa

SEQ ID NO: 280675 - DNA, 20 bp, Artificial Sequence
  Description of Artificial Sequence: Synthetic oligonucleotide
  Target: ATXN1; (+) strand; PAM type: YTN; PAM sequence: TTA
ctgaaaaatcattccccata

SEQ ID NO: 280676 - DNA, 20 bp, Artificial Sequence
  Description of Artificial Sequence: Synthetic oligonucleotide
  Target: ATXN1; (+) strand; PAM type: YTN; PAM sequence: CTG
aaaaatcattccccataatc

SEQ ID NO: 280677 - DNA, 20 bp, Artificial Sequence
  Description of Artificial Sequence: Synthetic oligonucleotide
  Target: ATXN1; (+) strand; PAM type: YTN; PAM sequence: TTC
cccataatctatttatttga

SEQ ID NO: 280678 - DNA, 20 bp, Artificial Sequence
  Description of Artificial Sequence: Synthetic oligonucleotide
  Target: ATXN1; (+) strand; PAM type: YTN; PAM sequence: CTA
tttatttgatgtttgattta

SEQ ID NO: 280679 - DNA, 20 bp, Artificial Sequence
  Description of Artificial Sequence: Synthetic oligonucleotide
  Target: ATXN1; (+) strand; PAM type: YTN; PAM sequence: TTT
atttgatgtttgatttatct

SEQ ID NO: 280680 - DNA, 20 bp, Artificial Sequence
  Description of Artificial Sequence: Synthetic oligonucleotide
  Target: ATXN1; (+) strand; PAM type: YTN; PAM sequence: TTA
tttgatgtttgatttatctg

SEQ ID NO: 280681 - DNA, 20 bp, Artificial Sequence
  Description of Artificial Sequence: Synthetic oligonucleotide
  Target: ATXN1; (+) strand; PAM type: YTN; PAM sequence: TTT
gatgtttgatttatctgata

SEQ ID NO: 280682 - DNA, 20 bp, Artificial Sequence
  Description of Artificial Sequence: Synthetic oligonucleotide
  Target: ATXN1; (+) strand; PAM type: YTN; PAM sequence: TTG
atgtttgatttatctgataa

SEQ ID NO: 280683 - DNA, 20 bp, Artificial Sequence
  Description of Artificial Sequence: Synthetic oligonucleotide
  Target: ATXN1; (+) strand; PAM type: YTN; PAM sequence: TTT
gatttatctgataaacatgc

SEQ ID NO: 280684 - DNA, 20 bp, Artificial Sequence
  Description of Artificial Sequence: Synthetic oligonucleotide
  Target: ATXN1; (+) strand; PAM type: YTN; PAM sequence: TTG
atttatctgataaacatgcc

SEQ ID NO: 280685 - DNA, 20 bp, Artificial Sequence
  Description of Artificial Sequence: Synthetic oligonucleotide
  Target: ATXN1; (+) strand; PAM type: YTN; PAM sequence: TTT
atctgataaacatgccaaaa

SEQ ID NO: 280686 - DNA, 20 bp, Artificial Sequence
  Description of Artificial Sequence: Synthetic oligonucleotide
  Target: ATXN1; (+) strand; PAM type: YTN; PAM sequence: TTA
tctgataaacatgccaaaat

SEQ ID NO: 280687 - DNA, 20 bp, Artificial Sequence
  Description of Artificial Sequence: Synthetic oligonucleotide
  Target: ATXN1; (+) strand; PAM type: YTN; PAM sequence: CTG
ataaacatgccaaaatattg

SEQ ID NO: 280688 - DNA, 20 bp, Artificial Sequence
  Description of Artificial Sequence: Synthetic oligonucleotide
  Target: ATXN1; (+) strand; PAM type: YTN; PAM sequence: TTG
cctaaaaagtaatctctaac

SEQ ID NO: 280689 - DNA, 20 bp, Artificial Sequence
  Description of Artificial Sequence: Synthetic oligonucleotide
  Target: ATXN1; (+) strand; PAM type: YTN; PAM sequence: CTA
aaaagtaatctctaacatca

SEQ ID NO: 280690 - DNA, 20 bp, Artificial Sequence
  Description of Artificial Sequence: Synthetic oligonucleotide
  Target: ATXN1; (+) strand; PAM type: YTN; PAM sequence: CTC
taacatcatattattacttc

SEQ ID NO: 280691 - DNA, 20 bp, Artificial Sequence
  Description of Artificial Sequence: Synthetic oligonucleotide
  Target: ATXN1; (+) strand; PAM type: YTN; PAM sequence: CTA
acatcatattattacttcca

SEQ ID NO: 280692 - DNA, 20 bp, Artificial Sequence
  Description of Artificial Sequence: Synthetic oligonucleotide
  Target: ATXN1; (+) strand; PAM type: YTN; PAM sequence: TTA
ttacttccaggaaatcaacc

SEQ ID NO: 280693 - DNA, 20 bp, Artificial Sequence
  Description of Artificial Sequence: Synthetic oligonucleotide
  Target: ATXN1; (+) strand; PAM type: YTN; PAM sequence: TTA
cttccaggaaatcaaccttc

SEQ ID NO: 280694 - DNA, 20 bp, Artificial Sequence
  Description of Artificial Sequence: Synthetic oligonucleotide
  Target: ATXN1; (+) strand; PAM type: YTN; PAM sequence: CTT
ccaggaaatcaaccttctcc

SEQ ID NO: 280695 - DNA, 20 bp, Artificial Sequence
  Description of Artificial Sequence: Synthetic oligonucleotide
  Target: ATXN1; (+) strand; PAM type: YTN; PAM sequence: TTC
caggaaatcaaccttctcca

SEQ ID NO: 280696 - DNA, 20 bp, Artificial Sequence
  Description of Artificial Sequence: Synthetic oligonucleotide
  Target: ATXN1; (+) strand; PAM type: YTN; PAM sequence: CTT
ctccataaaaatcaacagtg

SEQ ID NO: 280697 - DNA, 20 bp, Artificial Sequence
  Description of Artificial Sequence: Synthetic oligonucleotide
  Target: ATXN1; (+) strand; PAM type: YTN; PAM sequence: TTC
tccataaaaatcaacagtgt

SEQ ID NO: 280698 - DNA, 20 bp, Artificial Sequence
  Description of Artificial Sequence: Synthetic oligonucleotide
  Target: ATXN1; (+) strand; PAM type: YTN; PAM sequence: CTC
cataaaaatcaacagtgttt

SEQ ID NO: 280699 - DNA, 20 bp, Artificial Sequence
  Description of Artificial Sequence: Synthetic oligonucleotide
  Target: ATXN1; (+) strand; PAM type: YTN; PAM sequence: TTT
ttaaaggaacgttgaggtta

SEQ ID NO: 280700 - DNA, 20 bp, Artificial Sequence
  Description of Artificial Sequence: Synthetic oligonucleotide
  Target: ATXN1; (+) strand; PAM type: YTN; PAM sequence: TTT
taaaggaacgttgaggttaa

SEQ ID NO: 280701 - DNA, 20 bp, Artificial Sequence
  Description of Artificial Sequence: Synthetic oligonucleotide
  Target: ATXN1; (+) strand; PAM type: YTN; PAM sequence: TTT
aaaggaacgttgaggttaaa

SEQ ID NO: 280702 - DNA, 20 bp, Artificial Sequence
  Description of Artificial Sequence: Synthetic oligonucleotide
  Target: ATXN1; (+) strand; PAM type: YTN; PAM sequence: TTA
aaggaacgttgaggttaaaa

SEQ ID NO: 280703 - DNA, 20 bp, Artificial Sequence
  Description of Artificial Sequence: Synthetic oligonucleotide
  Target: ATXN1; (+) strand; PAM type: YTN; PAM sequence: TTG
aggttaaaaaaatcagaatg

SEQ ID NO: 280704 - DNA, 20 bp, Artificial Sequence
  Description of Artificial Sequence: Synthetic oligonucleotide
  Target: ATXN1; (+) strand; PAM type: YTN; PAM sequence: TTA
aaaaaatcagaatgacaatt

SEQ ID NO: 280705 - DNA, 20 bp, Artificial Sequence
  Description of Artificial Sequence: Synthetic oligonucleotide
  Target: ATXN1; (+) strand; PAM type: YTN; PAM sequence: TTT
attcatttgcaaaaataaca

SEQ ID NO: 280706 - DNA, 20 bp, Artificial Sequence
  Description of Artificial Sequence: Synthetic oligonucleotide
  Target: ATXN1; (+) strand; PAM type: YTN; PAM sequence: TTA
ttcatttgcaaaaataacaa

SEQ ID NO: 280707 - DNA, 20 bp, Artificial Sequence
  Description of Artificial Sequence: Synthetic oligonucleotide
  Target: ATXN1; (+) strand; PAM type: YTN; PAM sequence: TTC
atttgcaaaaataacaataa

SEQ ID NO: 280708 - DNA, 20 bp, Artificial Sequence
  Description of Artificial Sequence: Synthetic oligonucleotide
  Target: ATXN1; (+) strand; PAM type: YTN; PAM sequence: TTT
gcaaaaataacaataatcat

SEQ ID NO: 280709 - DNA, 20 bp, Artificial Sequence
  Description of Artificial Sequence: Synthetic oligonucleotide
  Target: ATXN1; (+) strand; PAM type: YTN; PAM sequence: TTG
caaaaataacaataatcata

SEQ ID NO: 280710 - DNA, 20 bp, Artificial Sequence
  Description of Artificial Sequence: Synthetic oligonucleotide
  Target: ATXN1; (+) strand; PAM type: YTN; PAM sequence: TTT
ccacatgaaccagaaggtct

SEQ ID NO: 280711 - DNA, 20 bp, Artificial Sequence
  Description of Artificial Sequence: Synthetic oligonucleotide
  Target: ATXN1; (+) strand; PAM type: YTN; PAM sequence: TTC
cacatgaaccagaaggtctc

SEQ ID NO: 280712 - DNA, 20 bp, Artificial Sequence
  Description of Artificial Sequence: Synthetic oligonucleotide
  Target: ATXN1; (+) strand; PAM type: YTN; PAM sequence: CTC
tgggtaatgctggcttttaa

SEQ ID NO: 280713 - DNA, 20 bp, Artificial Sequence
  Description of Artificial Sequence: Synthetic oligonucleotide
  Target: ATXN1; (+) strand; PAM type: YTN; PAM sequence: CTG
ggtaatgctggcttttaacc

SEQ ID NO: 280714 - DNA, 20 bp, Artificial Sequence
  Description of Artificial Sequence: Synthetic oligonucleotide
  Target: ATXN1; (+) strand; PAM type: YTN; PAM sequence: CTG
gcttttaaccacaaacacac

SEQ ID NO: 280715 - DNA, 20 bp, Artificial Sequence
  Description of Artificial Sequence: Synthetic oligonucleotide
  Target: ATXN1; (+) strand; PAM type: YTN; PAM sequence: CTT
ttaaccacaaacacacacat

SEQ ID NO: 280716 - DNA, 20 bp, Artificial Sequence
  Description of Artificial Sequence: Synthetic oligonucleotide
  Target: ATXN1; (+) strand; PAM type: YTN; PAM sequence: TTT
taaccacaaacacacacatg

SEQ ID NO: 280717 - DNA, 20 bp, Artificial Sequence
  Description of Artificial Sequence: Synthetic oligonucleotide
  Target: ATXN1; (+) strand; PAM type: YTN; PAM sequence: TTT
aaccacaaacacacacatgc

SEQ ID NO: 280718 - DNA, 20 bp, Artificial Sequence
  Description of Artificial Sequence: Synthetic oligonucleotide
  Target: ATXN1; (+) strand; PAM type: YTN; PAM sequence: TTA
accacaaacacacacatgca

SEQ ID NO: 280719 - DNA, 20 bp, Artificial Sequence
  Description of Artificial Sequence: Synthetic oligonucleotide
  Target: ATXN1; (+) strand; PAM type: YTN; PAM sequence: CTG
cctttgctatttgaacattc

SEQ ID NO: 280720 - DNA, 20 bp, Artificial Sequence
  Description of Artificial Sequence: Synthetic oligonucleotide
  Target: ATXN1; (+) strand; PAM type: YTN; PAM sequence: CTT
tgctatttgaacattccagg

SEQ ID NO: 280721 - DNA, 20 bp, Artificial Sequence
  Description of Artificial Sequence: Synthetic oligonucleotide
  Target: ATXN1; (+) strand; PAM type: YTN; PAM sequence: TTT
gctatttgaacattccagga

SEQ ID NO: 280722 - DNA, 20 bp, Artificial Sequence
  Description of Artificial Sequence: Synthetic oligonucleotide
  Target: ATXN1; (+) strand; PAM type: YTN; PAM sequence: TTG
ctatttgaacattccaggaa

SEQ ID NO: 280723 - DNA, 20 bp, Artificial Sequence
  Description of Artificial Sequence: Synthetic oligonucleotide
  Target: ATXN1; (+) strand; PAM type: YTN; PAM sequence: CTA
tttgaacattccaggaatca

SEQ ID NO: 280724 - DNA, 20 bp, Artificial Sequence
  Description of Artificial Sequence: Synthetic oligonucleotide
  Target: ATXN1; (+) strand; PAM type: YTN; PAM sequence: TTT
gaacattccaggaatcaaat

SEQ ID NO: 280725 - DNA, 20 bp, Artificial Sequence
  Description of Artificial Sequence: Synthetic oligonucleotide
  Target: ATXN1; (+) strand; PAM type: YTN; PAM sequence: TTG
aacattccaggaatcaaatg

SEQ ID NO: 280726 - DNA, 20 bp, Artificial Sequence
  Description of Artificial Sequence: Synthetic oligonucleotide
  Target: ATXN1; (+) strand; PAM type: YTN; PAM sequence: TTC
caggaatcaaatgaaaacat

SEQ ID NO: 280727 - DNA, 20 bp, Artificial Sequence
  Description of Artificial Sequence: Synthetic oligonucleotide
  Target: ATXN1; (+) strand; PAM type: YTN; PAM sequence: TTG
ctcaaaaaatttccaggtaa

SEQ ID NO: 280728 - DNA, 20 bp, Artificial Sequence
  Description of Artificial Sequence: Synthetic oligonucleotide
  Target: ATXN1; (+) strand; PAM type: YTN; PAM sequence: CTC
aaaaaatttccaggtaaacc

SEQ ID NO: 280729 - DNA, 20 bp, Artificial Sequence
  Description of Artificial Sequence: Synthetic oligonucleotide
  Target: ATXN1; (+) strand; PAM type: YTN; PAM sequence: TTT
ccaggtaaaccatgttaata

SEQ ID NO: 280730 - DNA, 20 bp, Artificial Sequence
  Description of Artificial Sequence: Synthetic oligonucleotide
  Target: ATXN1; (+) strand; PAM type: YTN; PAM sequence: TTC
caggtaaaccatgttaatat

SEQ ID NO: 280731 - DNA, 20 bp, Artificial Sequence
  Description of Artificial Sequence: Synthetic oligonucleotide
  Target: ATXN1; (+) strand; PAM type: YTN; PAM sequence: TTA
atatctagggttaataaagt

SEQ ID NO: 280732 - DNA, 20 bp, Artificial Sequence
  Description of Artificial Sequence: Synthetic oligonucleotide
  Target: ATXN1; (+) strand; PAM type: YTN; PAM sequence: CTA
gggttaataaagtctcttta

SEQ ID NO: 280733 - DNA, 20 bp, Artificial Sequence
  Description of Artificial Sequence: Synthetic oligonucleotide
  Target: ATXN1; (+) strand; PAM type: YTN; PAM sequence: TTA
ataaagtctctttaaatgtt

SEQ ID NO: 280734 - DNA, 20 bp, Artificial Sequence
  Description of Artificial Sequence: Synthetic oligonucleotide
  Target: ATXN1; (+) strand; PAM type: YTN; PAM sequence: CTC
tttaaatgttaataaagtct

SEQ ID NO: 280735 - DNA, 20 bp, Artificial Sequence
  Description of Artificial Sequence: Synthetic oligonucleotide
  Target: ATXN1; (+) strand; PAM type: YTN; PAM sequence: CTT
taaatgttaataaagtctct

SEQ ID NO: 280736 - DNA, 20 bp, Artificial Sequence
  Description of Artificial Sequence: Synthetic oligonucleotide
  Target: ATXN1; (+) strand; PAM type: YTN; PAM sequence: TTT
aaatgttaataaagtctctc

SEQ ID NO: 280737 - DNA, 20 bp, Artificial Sequence
  Description of Artificial Sequence: Synthetic oligonucleotide
  Target: ATXN1; (+) strand; PAM type: YTN; PAM sequence: TTA
aatgttaataaagtctctcc

SEQ ID NO: 280738 - DNA, 20 bp, Artificial Sequence
  Description of Artificial Sequence: Synthetic oligonucleotide
  Target: ATXN1; (+) strand; PAM type: YTN; PAM sequence: TTA
ataaagtctctccataaaat

SEQ ID NO: 280739 - DNA, 20 bp, Artificial Sequence
  Description of Artificial Sequence: Synthetic oligonucleotide
  Target: ATXN1; (+) strand; PAM type: YTN; PAM sequence: CTC
tccataaaatgttcagccct

SEQ ID NO: 280740 - DNA, 20 bp, Artificial Sequence
  Description of Artificial Sequence: Synthetic oligonucleotide
  Target: ATXN1; (+) strand; PAM type: YTN; PAM sequence: CTC
cataaaatgttcagccctga

SEQ ID NO: 280741 - DNA, 20 bp, Artificial Sequence
  Description of Artificial Sequence: Synthetic oligonucleotide
  Target: ATXN1; (+) strand; PAM type: YTN; PAM sequence: TTC
agccctgaagacacagaaca

SEQ ID NO: 280742 - DNA, 20 bp, Artificial Sequence
  Description of Artificial Sequence: Synthetic oligonucleotide
  Target: ATXN1; (+) strand; PAM type: YTN; PAM sequence: CTG
aagacacagaacaaatgata

SEQ ID NO: 280743 - DNA, 20 bp, Artificial Sequence
  Description of Artificial Sequence: Synthetic oligonucleotide
  Target: ATXN1; (+) strand; PAM type: YTN; PAM sequence: TTT
tataacaggttactatggtc

SEQ ID NO: 280744 - DNA, 20 bp, Artificial Sequence
  Description of Artificial Sequence: Synthetic oligonucleotide
  Target: ATXN1; (+) strand; PAM type: YTN; PAM sequence: TTT
ataacaggttactatggtca

SEQ ID NO: 280745 - DNA, 20 bp, Artificial Sequence
  Description of Artificial Sequence: Synthetic oligonucleotide
  Target: ATXN1; (+) strand; PAM type: YTN; PAM sequence: TTA
taacaggttactatggtcaa

SEQ ID NO: 280746 - DNA, 20 bp, Artificial Sequence
  Description of Artificial Sequence: Synthetic oligonucleotide
  Target: ATXN1; (+) strand; PAM type: YTN; PAM sequence: TTA
ctatggtcaatggagtatca

SEQ ID NO: 280747 - DNA, 20 bp, Artificial Sequence
  Description of Artificial Sequence: Synthetic oligonucleotide
  Target: ATXN1; (+) strand; PAM type: YTN; PAM sequence: CTA
tggtcaatggagtatcagct

SEQ ID NO: 280748 - DNA, 20 bp, Artificial Sequence
  Description of Artificial Sequence: Synthetic oligonucleotide
  Target: ATXN1; (+) strand; PAM type: YTN; PAM sequence: CTA
taaaatataaacttctactg

SEQ ID NO: 280749 - DNA, 20 bp, Artificial Sequence
  Description of Artificial Sequence: Synthetic oligonucleotide
  Target: ATXN1; (+) strand; PAM type: YTN; PAM sequence: CTT
ctactgaggaaagcacatcc

SEQ ID NO: 280750 - DNA, 20 bp, Artificial Sequence
  Description of Artificial Sequence: Synthetic oligonucleotide
  Target: ATXN1; (+) strand; PAM type: YTN; PAM sequence: TTC
tactgaggaaagcacatccg

SEQ ID NO: 280751 - DNA, 20 bp, Artificial Sequence
  Description of Artificial Sequence: Synthetic oligonucleotide
  Target: ATXN1; (+) strand; PAM type: YTN; PAM sequence: CTA
ctgaggaaagcacatccggc

SEQ ID NO: 280752 - DNA, 20 bp, Artificial Sequence
  Description of Artificial Sequence: Synthetic oligonucleotide
  Target: ATXN1; (+) strand; PAM type: YTN; PAM sequence: CTG
aggaaagcacatccggcaag

SEQ ID NO: 280753 - DNA, 20 bp, Artificial Sequence
  Description of Artificial Sequence: Synthetic oligonucleotide
  Target: ATXN1; (+) strand; PAM type: YTN; PAM sequence: CTG
ggtccaatttccatgaagag

SEQ ID NO: 280754 - DNA, 20 bp, Artificial Sequence
  Description of Artificial Sequence: Synthetic oligonucleotide
  Target: ATXN1; (+) strand; PAM type: YTN; PAM sequence: TTT
ccatgaagaggtgccagctc

SEQ ID NO: 280755 - DNA, 20 bp, Artificial Sequence
  Description of Artificial Sequence: Synthetic oligonucleotide
  Target: ATXN1; (+) strand; PAM type: YTN; PAM sequence: TTC
catgaagaggtgccagctcc

SEQ ID NO: 280756 - DNA, 20 bp, Artificial Sequence
  Description of Artificial Sequence: Synthetic oligonucleotide
  Target: ATXN1; (+) strand; PAM type: YTN; PAM sequence: CTC
catttggtatgtacaatcta

SEQ ID NO: 280757 - DNA, 20 bp, Artificial Sequence
  Description of Artificial Sequence: Synthetic oligonucleotide
  Target: ATXN1; (+) strand; PAM type: YTN; PAM sequence: TTT
ggtatgtacaatctacaaat

SEQ ID NO: 280758 - DNA, 20 bp, Artificial Sequence
  Description of Artificial Sequence: Synthetic oligonucleotide
  Target: ATXN1; (+) strand; PAM type: YTN; PAM sequence: TTG
gtatgtacaatctacaaatg

SEQ ID NO: 280759 - DNA, 20 bp, Artificial Sequence
  Description of Artificial Sequence: Synthetic oligonucleotide
  Target: ATXN1; (+) strand; PAM type: YTN; PAM sequence: CTA
caaatgaatccaagcactat

SEQ ID NO: 280760 - DNA, 20 bp, Artificial Sequence
  Description of Artificial Sequence: Synthetic oligonucleotide
  Target: ATXN1; (+) strand; PAM type: YTN; PAM sequence: CTA
tcagaactgttaactgcatg

SEQ ID NO: 280761 - DNA, 20 bp, Artificial Sequence
  Description of Artificial Sequence: Synthetic oligonucleotide
  Target: ATXN1; (+) strand; PAM type: YTN; PAM sequence: CTG
ttaactgcatgactctggat

SEQ ID NO: 280762 - DNA, 20 bp, Artificial Sequence
  Description of Artificial Sequence: Synthetic oligonucleotide
  Target: ATXN1; (+) strand; PAM type: YTN; PAM sequence: TTA
actgcatgactctggatggt

SEQ ID NO: 280763 - DNA, 20 bp, Artificial Sequence
  Description of Artificial Sequence: Synthetic oligonucleotide
  Target: ATXN1; (+) strand; PAM type: YTN; PAM sequence: CTG
catgactctggatggtaggg

SEQ ID NO: 280764 - DNA, 20 bp, Artificial Sequence
  Description of Artificial Sequence: Synthetic oligonucleotide
  Target: ATXN1; (+) strand; PAM type: YTN; PAM sequence: CTC
tggatggtagggggagggaa

SEQ ID NO: 280765 - DNA, 20 bp, Artificial Sequence
  Description of Artificial Sequence: Synthetic oligonucleotide
  Target: ATXN1; (+) strand; PAM type: YTN; PAM sequence: CTG
gatggtagggggagggaagg

SEQ ID NO: 280766 - DNA, 20 bp, Artificial Sequence
  Description of Artificial Sequence: Synthetic oligonucleotide
  Target: ATXN1; (+) strand; PAM type: YTN; PAM sequence: CTC
aaaaaagagagaaaaaggat

SEQ ID NO: 280767 - DNA, 20 bp, Artificial Sequence
  Description of Artificial Sequence: Synthetic oligonucleotide
  Target: ATXN1; (+) strand; PAM type: YTN; PAM sequence: TTT
ttcaggatactggaaattga

SEQ ID NO: 280768 - DNA, 20 bp, Artificial Sequence
  Description of Artificial Sequence: Synthetic oligonucleotide
  Target: ATXN1; (+) strand; PAM type: YTN; PAM sequence: TTT
tcaggatactggaaattgag

SEQ ID NO: 280769 - DNA, 20 bp, Artificial Sequence
  Description of Artificial Sequence: Synthetic oligonucleotide
  Target: ATXN1; (+) strand; PAM type: YTN; PAM sequence: TTT
caggatactggaaattgaga

SEQ ID NO: 280770 - DNA, 20 bp, Artificial Sequence
  Description of Artificial Sequence: Synthetic oligonucleotide
  Target: ATXN1; (+) strand; PAM type: YTN; PAM sequence: TTC
aggatactggaaattgagag

SEQ ID NO: 280771 - DNA, 20 bp, Artificial Sequence
  Description of Artificial Sequence: Synthetic oligonucleotide
  Target: ATXN1; (+) strand; PAM type: YTN; PAM sequence: CTG
gaaattgagagcagattata

SEQ ID NO: 280772 - DNA, 20 bp, Artificial Sequence
  Description of Artificial Sequence: Synthetic oligonucleotide
  Target: ATXN1; (+) strand; PAM type: YTN; PAM sequence: TTG
agagcagattataaaagatt

SEQ ID NO: 280773 - DNA, 20 bp, Artificial Sequence
  Description of Artificial Sequence: Synthetic oligonucleotide
  Target: ATXN1; (+) strand; PAM type: YTN; PAM sequence: TTA
taaaagatttacgttgaata

SEQ ID NO: 280774 - DNA, 20 bp, Artificial Sequence
  Description of Artificial Sequence: Synthetic oligonucleotide
  Target: ATXN1; (+) strand; PAM type: YTN; PAM sequence: TTT
acgttgaataacaagaataa

SEQ ID NO: 280775 - DNA, 20 bp, Artificial Sequence
  Description of Artificial Sequence: Synthetic oligonucleotide
  Target: ATXN1; (+) strand; PAM type: YTN; PAM sequence: TTA
cgttgaataacaagaataaa

SEQ ID NO: 280776 - DNA, 20 bp, Artificial Sequence
  Description of Artificial Sequence: Synthetic oligonucleotide
  Target: ATXN1; (+) strand; PAM type: YTN; PAM sequence: TTG
aataacaagaataaagcttt

SEQ ID NO: 280777 - DNA, 20 bp, Artificial Sequence
  Description of Artificial Sequence: Synthetic oligonucleotide
  Target: ATXN1; (+) strand; PAM type: YTN; PAM sequence: CTT
tcatgtatctctatgtgaaa

SEQ ID NO: 280778 - DNA, 20 bp, Artificial Sequence
  Description of Artificial Sequence: Synthetic oligonucleotide
  Target: ATXN1; (+) strand; PAM type: YTN; PAM sequence: TTT
catgtatctctatgtgaaaa

SEQ ID NO: 280779 - DNA, 20 bp, Artificial Sequence
  Description of Artificial Sequence: Synthetic oligonucleotide
  Target: ATXN1; (+) strand; PAM type: YTN; PAM sequence: TTC
atgtatctctatgtgaaaaa

SEQ ID NO: 280780 - DNA, 20 bp, Artificial Sequence
  Description of Artificial Sequence: Synthetic oligonucleotide
  Target: ATXN1; (+) strand; PAM type: YTN; PAM sequence: CTC
tatgtgaaaaaaatagccta

SEQ ID NO: 280781 - DNA, 20 bp, Artificial Sequence
  Description of Artificial Sequence: Synthetic oligonucleotide
  Target: ATXN1; (+) strand; PAM type: YTN; PAM sequence: CTA
tgtgaaaaaaatagcctaga

SEQ ID NO: 280782 - DNA, 20 bp, Artificial Sequence
  Description of Artificial Sequence: Synthetic oligonucleotide
  Target: ATXN1; (+) strand; PAM type: YTN; PAM sequence: CTA
gaaatctgtaaactccaact

SEQ ID NO: 280783 - DNA, 20 bp, Artificial Sequence
  Description of Artificial Sequence: Synthetic oligonucleotide
  Target: ATXN1; (+) strand; PAM type: YTN; PAM sequence: CTG
taaactccaacttgtcataa

SEQ ID NO: 280784 - DNA, 20 bp, Artificial Sequence
  Description of Artificial Sequence: Synthetic oligonucleotide
  Target: ATXN1; (+) strand; PAM type: YTN; PAM sequence: CTC
caacttgtcataaaacataa

SEQ ID NO: 280785 - DNA, 20 bp, Artificial Sequence
  Description of Artificial Sequence: Synthetic oligonucleotide
  Target: ATXN1; (+) strand; PAM type: YTN; PAM sequence: CTT
gtcataaaacataaatccgt

SEQ ID NO: 280786 - DNA, 20 bp, Artificial Sequence
  Description of Artificial Sequence: Synthetic oligonucleotide
  Target: ATXN1; (+) strand; PAM type: YTN; PAM sequence: TTG
tcataaaacataaatccgtg

SEQ ID NO: 280787 - DNA, 20 bp, Artificial Sequence
  Description of Artificial Sequence: Synthetic oligonucleotide
  Target: ATXN1; (+) strand; PAM type: YTN; PAM sequence: CTT
aatgacttataatctacaat

SEQ ID NO: 280788 - DNA, 20 bp, Artificial Sequence
  Description of Artificial Sequence: Synthetic oligonucleotide
  Target: ATXN1; (+) strand; PAM type: YTN; PAM sequence: TTA
atgacttataatctacaatt

SEQ ID NO: 280789 - DNA, 20 bp, Artificial Sequence
  Description of Artificial Sequence: Synthetic oligonucleotide
  Target: ATXN1; (+) strand; PAM type: YTN; PAM sequence: CTT
ataatctacaattaacattt

SEQ ID NO: 280790 - DNA, 20 bp, Artificial Sequence
  Description of Artificial Sequence: Synthetic oligonucleotide
  Target: ATXN1; (+) strand; PAM type: YTN; PAM sequence: TTA
taatctacaattaacatttc

SEQ ID NO: 280791 - DNA, 20 bp, Artificial Sequence
  Description of Artificial Sequence: Synthetic oligonucleotide
  Target: ATXN1; (+) strand; PAM type: YTN; PAM sequence: CTA
caattaacatttcatgtttt

SEQ ID NO: 280792 - DNA, 20 bp, Artificial Sequence
  Description of Artificial Sequence: Synthetic oligonucleotide
  Target: ATXN1; (+) strand; PAM type: YTN; PAM sequence: TTA
acatttcatgtttttgcatc

SEQ ID NO: 280793 - DNA, 20 bp, Artificial Sequence
  Description of Artificial Sequence: Synthetic oligonucleotide
  Target: ATXN1; (+) strand; PAM type: YTN; PAM sequence: TTT
catgtttttgcatccagata

SEQ ID NO: 280794 - DNA, 20 bp, Artificial Sequence
  Description of Artificial Sequence: Synthetic oligonucleotide
  Target: ATXN1; (+) strand; PAM type: YTN; PAM sequence: TTC
atgtttttgcatccagatat

SEQ ID NO: 280795 - DNA, 20 bp, Artificial Sequence
  Description of Artificial Sequence: Synthetic oligonucleotide
  Target: ATXN1; (+) strand; PAM type: YTN; PAM sequence: TTT
ttgcatccagatataagaaa

SEQ ID NO: 280796 - DNA, 20 bp, Artificial Sequence
  Description of Artificial Sequence: Synthetic oligonucleotide
  Target: ATXN1; (+) strand; PAM type: YTN; PAM sequence: TTT
tgcatccagatataagaaat

SEQ ID NO: 280797 - DNA, 20 bp, Artificial Sequence
  Description of Artificial Sequence: Synthetic oligonucleotide
  Target: ATXN1; (+) strand; PAM type: YTN; PAM sequence: TTT
gcatccagatataagaaata

SEQ ID NO: 280798 - DNA, 20 bp, Artificial Sequence
  Description of Artificial Sequence: Synthetic oligonucleotide
  Target: ATXN1; (+) strand; PAM type: YTN; PAM sequence: TTG
catccagatataagaaatac

SEQ ID NO: 280799 - DNA, 20 bp, Artificial Sequence
  Description of Artificial Sequence: Synthetic oligonucleotide
  Target: ATXN1; (+) strand; PAM type: YTN; PAM sequence: CTA
ttctgtttttgcttgggtga

SEQ ID NO: 280800 - DNA, 20 bp, Artificial Sequence
  Description of Artificial Sequence: Synthetic oligonucleotide
  Target: ATXN1; (+) strand; PAM type: YTN; PAM sequence: TTC
tgtttttgcttgggtgaggc

SEQ ID NO: 280801 - DNA, 20 bp, Artificial Sequence
  Description of Artificial Sequence: Synthetic oligonucleotide
  Target: ATXN1; (+) strand; PAM type: YTN; PAM sequence: CTG
tttttgcttgggtgaggcta

SEQ ID NO: 280802 - DNA, 20 bp, Artificial Sequence
  Description of Artificial Sequence: Synthetic oligonucleotide
  Target: ATXN1; (+) strand; PAM type: YTN; PAM sequence: TTT
ttgcttgggtgaggctaaaa

SEQ ID NO: 280803 - DNA, 20 bp, Artificial Sequence
  Description of Artificial Sequence: Synthetic oligonucleotide
  Target: ATXN1; (+) strand; PAM type: YTN; PAM sequence: TTT
tgcttgggtgaggctaaaaa

SEQ ID NO: 280804 - DNA, 20 bp, Artificial Sequence
  Description of Artificial Sequence: Synthetic oligonucleotide
  Target: ATXN1; (+) strand; PAM type: YTN; PAM sequence: TTT
gcttgggtgaggctaaaaaa

SEQ ID NO: 280805 - DNA, 20 bp, Artificial Sequence
  Description of Artificial Sequence: Synthetic oligonucleotide
  Target: ATXN1; (+) strand; PAM type: YTN; PAM sequence: TTG
cttgggtgaggctaaaaaac

SEQ ID NO: 280806 - DNA, 20 bp, Artificial Sequence
  Description of Artificial Sequence: Synthetic oligonucleotide
  Target: ATXN1; (+) strand; PAM type: YTN; PAM sequence: CTT
gggtgaggctaaaaaactca

SEQ ID NO: 280807 - DNA, 20 bp, Artificial Sequence
  Description of Artificial Sequence: Synthetic oligonucleotide
  Target: ATXN1; (+) strand; PAM type: YTN; PAM sequence: TTG
ggtgaggctaaaaaactcag

SEQ ID NO: 280808 - DNA, 20 bp, Artificial Sequence
  Description of Artificial Sequence: Synthetic oligonucleotide
  Target: ATXN1; (+) strand; PAM type: YTN; PAM sequence: CTA
aaaaactcagtaccaccatg

SEQ ID NO: 280809 - DNA, 20 bp, Artificial Sequence
  Description of Artificial Sequence: Synthetic oligonucleotide
  Target: ATXN1; (+) strand; PAM type: YTN; PAM sequence: CTC
agtaccaccatgttttttgt

SEQ ID NO: 280810 - DNA, 20 bp, Artificial Sequence
  Description of Artificial Sequence: Synthetic oligonucleotide
  Target: ATXN1; (+) strand; PAM type: YTN; PAM sequence: TTT
tttgtagggtcaaagagacg

SEQ ID NO: 280811 - DNA, 20 bp, Artificial Sequence
  Description of Artificial Sequence: Synthetic oligonucleotide
  Target: ATXN1; (+) strand; PAM type: YTN; PAM sequence: TTT
ttgtagggtcaaagagacgg

SEQ ID NO: 280812 - DNA, 20 bp, Artificial Sequence
  Description of Artificial Sequence: Synthetic oligonucleotide
  Target: ATXN1; (+) strand; PAM type: YTN; PAM sequence: TTT
tgtagggtcaaagagacggc

SEQ ID NO: 280813 - DNA, 20 bp, Artificial Sequence
  Description of Artificial Sequence: Synthetic oligonucleotide
  Target: ATXN1; (+) strand; PAM type: YTN; PAM sequence: TTT
gtagggtcaaagagacggct

SEQ ID NO: 280814 - DNA, 20 bp, Artificial Sequence
  Description of Artificial Sequence: Synthetic oligonucleotide
  Target: ATXN1; (+) strand; PAM type: YTN; PAM sequence: TTG
tagggtcaaagagacggcta

SEQ ID NO: 280815 - DNA, 20 bp, Artificial Sequence
  Description of Artificial Sequence: Synthetic oligonucleotide
  Target: ATXN1; (+) strand; PAM type: YTN; PAM sequence: CTA
agagatccccttaattaata

SEQ ID NO: 280816 - DNA, 20 bp, Artificial Sequence
  Description of Artificial Sequence: Synthetic oligonucleotide
  Target: ATXN1; (+) strand; PAM type: YTN; PAM sequence: CTT
aattaataatttttgttggc

SEQ ID NO: 280817 - DNA, 20 bp, Artificial Sequence
  Description of Artificial Sequence: Synthetic oligonucleotide
  Target: ATXN1; (+) strand; PAM type: YTN; PAM sequence: TTA
attaataatttttgttggca

SEQ ID NO: 280818 - DNA, 20 bp, Artificial Sequence
  Description of Artificial Sequence: Synthetic oligonucleotide
  Target: ATXN1; (+) strand; PAM type: YTN; PAM sequence: TTA
ataatttttgttggcatttt

SEQ ID NO: 280819 - DNA, 20 bp, Artificial Sequence
  Description of Artificial Sequence: Synthetic oligonucleotide
  Target: ATXN1; (+) strand; PAM type: YTN; PAM sequence: TTT
ttgttggcattttacaactc

SEQ ID NO: 280820 - DNA, 20 bp, Artificial Sequence
  Description of Artificial Sequence: Synthetic oligonucleotide
  Target: ATXN1; (+) strand; PAM type: YTN; PAM sequence: TTT
tgttggcattttacaactct

SEQ ID NO: 280821 - DNA, 20 bp, Artificial Sequence
  Description of Artificial Sequence: Synthetic oligonucleotide
  Target: ATXN1; (+) strand; PAM type: YTN; PAM sequence: TTT
gttggcattttacaactctg

SEQ ID NO: 280822 - DNA, 20 bp, Artificial Sequence
  Description of Artificial Sequence: Synthetic oligonucleotide
  Target: ATXN1; (+) strand; PAM type: YTN; PAM sequence: TTG
ttggcattttacaactctgg

SEQ ID NO: 280823 - DNA, 20 bp, Artificial Sequence
  Description of Artificial Sequence: Synthetic oligonucleotide
  Target: ATXN1; (+) strand; PAM type: YTN; PAM sequence: TTG
gcattttacaactctggatt

SEQ ID NO: 280824 - DNA, 20 bp, Artificial Sequence
  Description of Artificial Sequence: Synthetic oligonucleotide
  Target: ATXN1; (+) strand; PAM type: YTN; PAM sequence: TTT
tacaactctggattccccca

SEQ ID NO: 280825 - DNA, 20 bp, Artificial Sequence
  Description of Artificial Sequence: Synthetic oligonucleotide
  Target: ATXN1; (+) strand; PAM type: YTN; PAM sequence: TTT
acaactctggattcccccaa

SEQ ID NO: 280826 - DNA, 20 bp, Artificial Sequence
  Description of Artificial Sequence: Synthetic oligonucleotide
  Target: ATXN1; (+) strand; PAM type: YTN; PAM sequence: TTA
caactctggattcccccaaa

SEQ ID NO: 280827 - DNA, 20 bp, Artificial Sequence
  Description of Artificial Sequence: Synthetic oligonucleotide
  Target: ATXN1; (+) strand; PAM type: YTN; PAM sequence: CTC
tggattcccccaaactcctg

SEQ ID NO: 280828 - DNA, 20 bp, Artificial Sequence
  Description of Artificial Sequence: Synthetic oligonucleotide
  Target: ATXN1; (+) strand; PAM type: YTN; PAM sequence: CTG
gattcccccaaactcctgca

SEQ ID NO: 280829 - DNA, 20 bp, Artificial Sequence
  Description of Artificial Sequence: Synthetic oligonucleotide
  Target: ATXN1; (+) strand; PAM type: YTN; PAM sequence: TTC
ccccaaactcctgcagcatt

SEQ ID NO: 280830 - DNA, 20 bp, Artificial Sequence
  Description of Artificial Sequence: Synthetic oligonucleotide
  Target: ATXN1; (+) strand; PAM type: YTN; PAM sequence: CTC
ctgcagcattggtgtaactt

SEQ ID NO: 280831 - DNA, 20 bp, Artificial Sequence
  Description of Artificial Sequence: Synthetic oligonucleotide
  Target: ATXN1; (+) strand; PAM type: YTN; PAM sequence: CTG
cagcattggtgtaacttcta

SEQ ID NO: 280832 - DNA, 20 bp, Artificial Sequence
  Description of Artificial Sequence: Synthetic oligonucleotide
  Target: ATXN1; (+) strand; PAM type: YTN; PAM sequence: TTG
gtgtaacttctagctactct

SEQ ID NO: 280833 - DNA, 20 bp, Artificial Sequence
  Description of Artificial Sequence: Synthetic oligonucleotide
  Target: ATXN1; (+) strand; PAM type: YTN; PAM sequence: CTT
ctagctactctcataacatt

SEQ ID NO: 280834 - DNA, 20 bp, Artificial Sequence
  Description of Artificial Sequence: Synthetic oligonucleotide
  Target: ATXN1; (+) strand; PAM type: YTN; PAM sequence: TTC
tagctactctcataacattg

SEQ ID NO: 280835 - DNA, 20 bp, Artificial Sequence
  Description of Artificial Sequence: Synthetic oligonucleotide
  Target: ATXN1; (+) strand; PAM type: YTN; PAM sequence: CTA
gctactctcataacattgct

SEQ ID NO: 280836 - DNA, 20 bp, Artificial Sequence
  Description of Artificial Sequence: Synthetic oligonucleotide
  Target: ATXN1; (+) strand; PAM type: YTN; PAM sequence: CTA
ctctcataacattgctgtaa

SEQ ID NO: 280837 - DNA, 20 bp, Artificial Sequence
  Description of Artificial Sequence: Synthetic oligonucleotide
  Target: ATXN1; (+) strand; PAM type: YTN; PAM sequence: CTC
tcataacattgctgtaatct

SEQ ID NO: 280838 - DNA, 20 bp, Artificial Sequence
  Description of Artificial Sequence: Synthetic oligonucleotide
  Target: ATXN1; (+) strand; PAM type: YTN; PAM sequence: CTC
ataacattgctgtaatctca

SEQ ID NO: 280839 - DNA, 20 bp, Artificial Sequence
  Description of Artificial Sequence: Synthetic oligonucleotide
  Target: ATXN1; (+) strand; PAM type: YTN; PAM sequence: TTG
ctgtaatctcaaactcctgg

SEQ ID NO: 280840 - DNA, 20 bp, Artificial Sequence
  Description of Artificial Sequence: Synthetic oligonucleotide
  Target: ATXN1; (+) strand; PAM type: YTN; PAM sequence: CTG
taatctcaaactcctgggct

SEQ ID NO: 280841 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggctcaagcga

SEQ ID NO: 280842 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcgatcctcc

SEQ ID NO: 280843 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcgatcctcccgc

SEQ ID NO: 280844 - DNA, 20 bp, Artificial Sequence
  Description of Artificial Sequence: Synthetic oligonucleotide
  Target: ATXN1; (+) strand; PAM type: YTN; PAM sequence: CTC
aagcgatcctcccgcctcag

SEQ ID NO: 280845 - DNA, 20 bp, Artificial Sequence
  Description of Artificial Sequence: Synthetic oligonucleotide
  Target: ATXN1; (+) strand; PAM type: YTN; PAM sequence: CTC
ccgcctcagcctccagagta

SEQ ID NO: 280846 - DNA, 20 bp, Artificial Sequence
  Description of Artificial Sequence: Synthetic oligonucleotide
  Target: ATXN1; (+) strand; PAM type: YTN; PAM sequence: CTC
agcctccagagtagctggac

SEQ ID NO: 280847 - DNA, 20 bp, Artificial Sequence
  Description of Artificial Sequence: Synthetic oligonucleotide
  Target: ATXN1; (+) strand; PAM type: YTN; PAM sequence: CTC
cagagtagctggactataag

SEQ ID NO: 280848 - DNA, 20 bp, Artificial Sequence
  Description of Artificial Sequence: Synthetic oligonucleotide
  Target: ATXN1; (+) strand; PAM type: YTN; PAM sequence: CTG
gactataagcacatctcacc

SEQ ID NO: 280849 - DNA, 20 bp, Artificial Sequence
  Description of Artificial Sequence: Synthetic oligonucleotide
  Target: ATXN1; (+) strand; PAM type: YTN; PAM sequence: CTA
taagcacatctcaccatgcc

SEQ ID NO: 280850 - DNA, 20 bp, Artificial Sequence
  Description of Artificial Sequence: Synthetic oligonucleotide
  Target: ATXN1; (+) strand; PAM type: YTN; PAM sequence: CTC
accatgcctggccaattaaa

SEQ ID NO: 280851 - DNA, 20 bp, Artificial Sequence
  Description of Artificial Sequence: Synthetic oligonucleotide
  Target: ATXN1; (+) strand; PAM type: YTN; PAM sequence: CTG
gccaattaaaaaacaaacaa

SEQ ID NO: 280852 - DNA, 20 bp, Artificial Sequence
  Description of Artificial Sequence: Synthetic oligonucleotide
  Target: ATXN1; (+) strand; PAM type: YTN; PAM sequence: TTA
aaaaacaaacaaacaaacaa

SEQ ID NO: 280853 - DNA, 20 bp, Artificial Sequence
  Description of Artificial Sequence: Synthetic oligonucleotide
  Target: ATXN1; (+) strand; PAM type: YTN; PAM sequence: CTG
ggcgcggtggctcacgactg

SEQ ID NO: 280854 - DNA, 20 bp, Artificial Sequence
  Description of Artificial Sequence: Synthetic oligonucleotide
  Target: ATXN1; (+) strand; PAM type: YTN; PAM sequence: CTC
acgactgtaatcccagcact

SEQ ID NO: 280855 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 280856 - DNA, 20 bp, Artificial Sequence
  Description of Artificial Sequence: Synthetic oligonucleotide
  Target: ATXN1; (+) strand; PAM type: YTN; PAM sequence: CTT
tgggaggccacggcgggcgg

SEQ ID NO: 280857 - DNA, 20 bp, Artificial Sequence
  Description of Artificial Sequence: Synthetic oligonucleotide
  Target: ATXN1; (+) strand; PAM type: YTN; PAM sequence: TTT
gggaggccacggcgggcgga

SEQ ID NO: 280858 - DNA, 20 bp, Artificial Sequence
  Description of Artificial Sequence: Synthetic oligonucleotide
  Target: ATXN1; (+) strand; PAM type: YTN; PAM sequence: TTG
ggaggccacggcgggcggat

SEQ ID NO: 280859 - DNA, 20 bp, Artificial Sequence
  Description of Artificial Sequence: Synthetic oligonucleotide
  Target: ATXN1; (+) strand; PAM type: YTN; PAM sequence: CTG
gcgaacactgtgaaaccccg

SEQ ID NO: 280860 - DNA, 20 bp, Artificial Sequence
  Description of Artificial Sequence: Synthetic oligonucleotide
  Target: ATXN1; (+) strand; PAM type: YTN; PAM sequence: CTG
tgaaaccccgtctctactaa

SEQ ID NO: 280861 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaaaa

SEQ ID NO: 280862 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaaaaat

SEQ ID NO: 280863 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaaaaattag

SEQ ID NO: 280864 - DNA, 20 bp, Artificial Sequence
  Description of Artificial Sequence: Synthetic oligonucleotide
  Target: ATXN1; (+) strand; PAM type: YTN; PAM sequence: TTA
gccgggcatggtggtgggtt

SEQ ID NO: 280865 - DNA, 20 bp, Artificial Sequence
  Description of Artificial Sequence: Synthetic oligonucleotide
  Target: ATXN1; (+) strand; PAM type: YTN; PAM sequence: TTC
ctgtaatctcagctactcgg

SEQ ID NO: 280866 - DNA, 20 bp, Artificial Sequence
  Description of Artificial Sequence: Synthetic oligonucleotide
  Target: ATXN1; (+) strand; PAM type: YTN; PAM sequence: CTG
taatctcagctactcgggag

SEQ ID NO: 280867 - DNA, 20 bp, Artificial Sequence
  Description of Artificial Sequence: Synthetic oligonucleotide
  Target: ATXN1; (+) strand; PAM type: YTN; PAM sequence: CTC
agctactcgggaggctgagg

SEQ ID NO: 280868 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 280869 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 280870 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 280871 - DNA, 20 bp, Artificial Sequence
  Description of Artificial Sequence: Synthetic oligonucleotide
  Target: ATXN1; (+) strand; PAM type: YTN; PAM sequence: CTT
gaatctgggaggcaaaggtt

SEQ ID NO: 280872 - DNA, 20 bp, Artificial Sequence
  Description of Artificial Sequence: Synthetic oligonucleotide
  Target: ATXN1; (+) strand; PAM type: YTN; PAM sequence: TTG
aatctgggaggcaaaggttg

SEQ ID NO: 280873 - DNA, 20 bp, Artificial Sequence
  Description of Artificial Sequence: Synthetic oligonucleotide
  Target: ATXN1; (+) strand; PAM type: YTN; PAM sequence: CTG
ggaggcaaaggttgcagtga

SEQ ID NO: 280874 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcacacc

SEQ ID NO: 280875 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacag

SEQ ID NO: 280876 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacagagtga

SEQ ID NO: 280877 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagtgagactccg

SEQ ID NO: 280878 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaacaacaacaa

SEQ ID NO: 280879 - DNA, 20 bp, Artificial Sequence
  Description of Artificial Sequence: Synthetic oligonucleotide
  Target: ATXN1; (+) strand; PAM type: YTN; PAM sequence: CTC
aaaaacaacaacaacaacaa

SEQ ID NO: 280880 - DNA, 20 bp, Artificial Sequence
  Description of Artificial Sequence: Synthetic oligonucleotide
  Target: ATXN1; (+) strand; PAM type: YTN; PAM sequence: TTT
tgtagaggtgggtcctcact

SEQ ID NO: 280881 - DNA, 20 bp, Artificial Sequence
  Description of Artificial Sequence: Synthetic oligonucleotide
  Target: ATXN1; (+) strand; PAM type: YTN; PAM sequence: TTT
gtagaggtgggtcctcactg

SEQ ID NO: 280882 - DNA, 20 bp, Artificial Sequence
  Description of Artificial Sequence: Synthetic oligonucleotide
  Target: ATXN1; (+) strand; PAM type: YTN; PAM sequence: TTG
tagaggtgggtcctcactgt

SEQ ID NO: 280883 - DNA, 20 bp, Artificial Sequence
  Description of Artificial Sequence: Synthetic oligonucleotide
  Target: ATXN1; (+) strand; PAM type: YTN; PAM sequence: CTC
actgtgttgcctaggctagt

SEQ ID NO: 280884 - DNA, 20 bp, Artificial Sequence
  Description of Artificial Sequence: Synthetic oligonucleotide
  Target: ATXN1; (+) strand; PAM type: YTN; PAM sequence: CTG
tgttgcctaggctagtctca

SEQ ID NO: 280885 - DNA, 20 bp, Artificial Sequence
  Description of Artificial Sequence: Synthetic oligonucleotide
  Target: ATXN1; (+) strand; PAM type: YTN; PAM sequence: TTG
cctaggctagtctcaaactc

SEQ ID NO: 280886 - DNA, 20 bp, Artificial Sequence
  Description of Artificial Sequence: Synthetic oligonucleotide
  Target: ATXN1; (+) strand; PAM type: YTN; PAM sequence: CTA
ggctagtctcaaactcctgg

SEQ ID NO: 280887 - DNA, 20 bp, Artificial Sequence
  Description of Artificial Sequence: Synthetic oligonucleotide
  Target: ATXN1; (+) strand; PAM type: YTN; PAM sequence: CTA
gtctcaaactcctggcatcg

SEQ ID NO: 280888 - DNA, 20 bp, Artificial Sequence
  Description of Artificial Sequence: Synthetic oligonucleotide
  Target: ATXN1; (+) strand; PAM type: YTN; PAM sequence: CTC
aaactcctggcatcgtaagt

SEQ ID NO: 280889 - DNA, 20 bp, Artificial Sequence
  Description of Artificial Sequence: Synthetic oligonucleotide
  Target: ATXN1; (+) strand; PAM type: YTN; PAM sequence: CTC
ctggcatcgtaagttgtctt

SEQ ID NO: 280890 - DNA, 20 bp, Artificial Sequence
  Description of Artificial Sequence: Synthetic oligonucleotide
  Target: ATXN1; (+) strand; PAM type: YTN; PAM sequence: CTG
gcatcgtaagttgtctttca

SEQ ID NO: 280891 - DNA, 20 bp, Artificial Sequence
  Description of Artificial Sequence: Synthetic oligonucleotide
  Target: ATXN1; (+) strand; PAM type: YTN; PAM sequence: TTG
tctttcatatgctttggcat

SEQ ID NO: 280892 - DNA, 20 bp, Artificial Sequence
  Description of Artificial Sequence: Synthetic oligonucleotide
  Target: ATXN1; (+) strand; PAM type: YTN; PAM sequence: CTT
tcatatgctttggcattcaa

SEQ ID NO: 280893 - DNA, 20 bp, Artificial Sequence
  Description of Artificial Sequence: Synthetic oligonucleotide
  Target: ATXN1; (+) strand; PAM type: YTN; PAM sequence: TTT
catatgctttggcattcaat

SEQ ID NO: 280894 - DNA, 20 bp, Artificial Sequence
  Description of Artificial Sequence: Synthetic oligonucleotide
  Target: ATXN1; (+) strand; PAM type: YTN; PAM sequence: TTC
atatgctttggcattcaatg

SEQ ID NO: 280895 - DNA, 20 bp, Artificial Sequence
  Description of Artificial Sequence: Synthetic oligonucleotide
  Target: ATXN1; (+) strand; PAM type: YTN; PAM sequence: CTT
tggcattcaatgctcagtaa

SEQ ID NO: 280896 - DNA, 20 bp, Artificial Sequence
  Description of Artificial Sequence: Synthetic oligonucleotide
  Target: ATXN1; (+) strand; PAM type: YTN; PAM sequence: TTT
ggcattcaatgctcagtaac

SEQ ID NO: 280897 - DNA, 20 bp, Artificial Sequence
  Description of Artificial Sequence: Synthetic oligonucleotide
  Target: ATXN1; (+) strand; PAM type: YTN; PAM sequence: TTG
gcattcaatgctcagtaaca

SEQ ID NO: 280898 - DNA, 20 bp, Artificial Sequence
  Description of Artificial Sequence: Synthetic oligonucleotide
  Target: ATXN1; (+) strand; PAM type: YTN; PAM sequence: TTC
aatgctcagtaacaacctga

SEQ ID NO: 280899 - DNA, 20 bp, Artificial Sequence
  Description of Artificial Sequence: Synthetic oligonucleotide
  Target: ATXN1; (+) strand; PAM type: YTN; PAM sequence: CTC
agtaacaacctgagcatatt

SEQ ID NO: 280900 - DNA, 20 bp, Artificial Sequence
  Description of Artificial Sequence: Synthetic oligonucleotide
  Target: ATXN1; (+) strand; PAM type: YTN; PAM sequence: CTG
agcatatttaattataatgc

SEQ ID NO: 280901 - DNA, 20 bp, Artificial Sequence
  Description of Artificial Sequence: Synthetic oligonucleotide
  Target: ATXN1; (+) strand; PAM type: YTN; PAM sequence: TTT
aattataatgcctcaccttt

SEQ ID NO: 280902 - DNA, 20 bp, Artificial Sequence
  Description of Artificial Sequence: Synthetic oligonucleotide
  Target: ATXN1; (+) strand; PAM type: YTN; PAM sequence: TTA
attataatgcctcaccttta

SEQ ID NO: 280903 - DNA, 20 bp, Artificial Sequence
  Description of Artificial Sequence: Synthetic oligonucleotide
  Target: ATXN1; (+) strand; PAM type: YTN; PAM sequence: TTA
taatgcctcacctttaaata

SEQ ID NO: 280904 - DNA, 20 bp, Artificial Sequence
  Description of Artificial Sequence: Synthetic oligonucleotide
  Target: ATXN1; (+) strand; PAM type: YTN; PAM sequence: CTC
acctttaaatagtactctac

SEQ ID NO: 280905 - DNA, 20 bp, Artificial Sequence
  Description of Artificial Sequence: Synthetic oligonucleotide
  Target: ATXN1; (+) strand; PAM type: YTN; PAM sequence: CTT
taaatagtactctacagttc

SEQ ID NO: 280906 - DNA, 20 bp, Artificial Sequence
  Description of Artificial Sequence: Synthetic oligonucleotide
  Target: ATXN1; (+) strand; PAM type: YTN; PAM sequence: TTT
aaatagtactctacagttca

SEQ ID NO: 280907 - DNA, 20 bp, Artificial Sequence
  Description of Artificial Sequence: Synthetic oligonucleotide
  Target: ATXN1; (+) strand; PAM type: YTN; PAM sequence: TTA
aatagtactctacagttcat

SEQ ID NO: 280908 - DNA, 20 bp, Artificial Sequence
  Description of Artificial Sequence: Synthetic oligonucleotide
  Target: ATXN1; (+) strand; PAM type: YTN; PAM sequence: CTC
tacagttcataaagtgcttt

SEQ ID NO: 280909 - DNA, 20 bp, Artificial Sequence
  Description of Artificial Sequence: Synthetic oligonucleotide
  Target: ATXN1; (+) strand; PAM type: YTN; PAM sequence: CTA
cagttcataaagtgctttct

SEQ ID NO: 280910 - DNA, 20 bp, Artificial Sequence
  Description of Artificial Sequence: Synthetic oligonucleotide
  Target: ATXN1; (+) strand; PAM type: YTN; PAM sequence: TTC
ataaagtgctttctttcaca

SEQ ID NO: 280911 - DNA, 20 bp, Artificial Sequence
  Description of Artificial Sequence: Synthetic oligonucleotide
  Target: ATXN1; (+) strand; PAM type: YTN; PAM sequence: CTT
tctttcacactgatgtagcc

SEQ ID NO: 280912 - DNA, 20 bp, Artificial Sequence
  Description of Artificial Sequence: Synthetic oligonucleotide
  Target: ATXN1; (+) strand; PAM type: YTN; PAM sequence: TTT
ctttcacactgatgtagcct

SEQ ID NO: 280913 - DNA, 20 bp, Artificial Sequence
  Description of Artificial Sequence: Synthetic oligonucleotide
  Target: ATXN1; (+) strand; PAM type: YTN; PAM sequence: TTC
tttcacactgatgtagcctt

SEQ ID NO: 280914 - DNA, 20 bp, Artificial Sequence
  Description of Artificial Sequence: Synthetic oligonucleotide
  Target: ATXN1; (+) strand; PAM type: YTN; PAM sequence: CTT
tcacactgatgtagccttcc

SEQ ID NO: 280915 - DNA, 20 bp, Artificial Sequence
  Description of Artificial Sequence: Synthetic oligonucleotide
  Target: ATXN1; (+) strand; PAM type: YTN; PAM sequence: TTT
cacactgatgtagccttcct

SEQ ID NO: 280916 - DNA, 20 bp, Artificial Sequence
  Description of Artificial Sequence: Synthetic oligonucleotide
  Target: ATXN1; (+) strand; PAM type: YTN; PAM sequence: TTC
acactgatgtagccttcctt

SEQ ID NO: 280917 - DNA, 20 bp, Artificial Sequence
  Description of Artificial Sequence: Synthetic oligonucleotide
  Target: ATXN1; (+) strand; PAM type: YTN; PAM sequence: CTG
atgtagccttccttgtatta

SEQ ID NO: 280918 - DNA, 20 bp, Artificial Sequence
  Description of Artificial Sequence: Synthetic oligonucleotide
  Target: ATXN1; (+) strand; PAM type: YTN; PAM sequence: CTT
ccttgtattaaatcacagct

SEQ ID NO: 280919 - DNA, 20 bp, Artificial Sequence
  Description of Artificial Sequence: Synthetic oligonucleotide
  Target: ATXN1; (+) strand; PAM type: YTN; PAM sequence: TTC
cttgtattaaatcacagctt

SEQ ID NO: 280920 - DNA, 20 bp, Artificial Sequence
  Description of Artificial Sequence: Synthetic oligonucleotide
  Target: ATXN1; (+) strand; PAM type: YTN; PAM sequence: CTT
gtattaaatcacagctttgc

SEQ ID NO: 280921 - DNA, 20 bp, Artificial Sequence
  Description of Artificial Sequence: Synthetic oligonucleotide
  Target: ATXN1; (+) strand; PAM type: YTN; PAM sequence: TTG
tattaaatcacagctttgca

SEQ ID NO: 280922 - DNA, 20 bp, Artificial Sequence
  Description of Artificial Sequence: Synthetic oligonucleotide
  Target: ATXN1; (+) strand; PAM type: YTN; PAM sequence: TTA
aatcacagctttgcagttca

SEQ ID NO: 280923 - DNA, 20 bp, Artificial Sequence
  Description of Artificial Sequence: Synthetic oligonucleotide
  Target: ATXN1; (+) strand; PAM type: YTN; PAM sequence: CTT
tgcagttcaatttttgcaaa

SEQ ID NO: 280924 - DNA, 20 bp, Artificial Sequence
  Description of Artificial Sequence: Synthetic oligonucleotide
  Target: ATXN1; (+) strand; PAM type: YTN; PAM sequence: TTT
gcagttcaatttttgcaaaa

SEQ ID NO: 280925 - DNA, 20 bp, Artificial Sequence
  Description of Artificial Sequence: Synthetic oligonucleotide
  Target: ATXN1; (+) strand; PAM type: YTN; PAM sequence: TTG
cagttcaatttttgcaaaac

SEQ ID NO: 280926 - DNA, 20 bp, Artificial Sequence
  Description of Artificial Sequence: Synthetic oligonucleotide
  Target: ATXN1; (+) strand; PAM type: YTN; PAM sequence: TTC
aatttttgcaaaaccctttc

SEQ ID NO: 280927 - DNA, 20 bp, Artificial Sequence
  Description of Artificial Sequence: Synthetic oligonucleotide
  Target: ATXN1; (+) strand; PAM type: YTN; PAM sequence: TTT
ttgcaaaaccctttcaaagg

SEQ ID NO: 280928 - DNA, 20 bp, Artificial Sequence
  Description of Artificial Sequence: Synthetic oligonucleotide
  Target: ATXN1; (+) strand; PAM type: YTN; PAM sequence: TTT
tgcaaaaccctttcaaaggt

SEQ ID NO: 280929 - DNA, 20 bp, Artificial Sequence
  Description of Artificial Sequence: Synthetic oligonucleotide
  Target: ATXN1; (+) strand; PAM type: YTN; PAM sequence: TTT
gcaaaaccctttcaaaggta

SEQ ID NO: 280930 - DNA, 20 bp, Artificial Sequence
  Description of Artificial Sequence: Synthetic oligonucleotide
  Target: ATXN1; (+) strand; PAM type: YTN; PAM sequence: TTG
caaaaccctttcaaaggtac

SEQ ID NO: 280931 - DNA, 20 bp, Artificial Sequence
  Description of Artificial Sequence: Synthetic oligonucleotide
  Target: ATXN1; (+) strand; PAM type: YTN; PAM sequence: CTT
tcaaaggtacttgtcaatta

SEQ ID NO: 280932 - DNA, 20 bp, Artificial Sequence
  Description of Artificial Sequence: Synthetic oligonucleotide
  Target: ATXN1; (+) strand; PAM type: YTN; PAM sequence: TTT
caaaggtacttgtcaattaa

SEQ ID NO: 280933 - DNA, 20 bp, Artificial Sequence
  Description of Artificial Sequence: Synthetic oligonucleotide
  Target: ATXN1; (+) strand; PAM type: YTN; PAM sequence: TTC
aaaggtacttgtcaattaat

SEQ ID NO: 280934 - DNA, 20 bp, Artificial Sequence
  Description of Artificial Sequence: Synthetic oligonucleotide
  Target: ATXN1; (+) strand; PAM type: YTN; PAM sequence: CTT
gtcaattaatgaagattaaa

SEQ ID NO: 280935 - DNA, 20 bp, Artificial Sequence
  Description of Artificial Sequence: Synthetic oligonucleotide
  Target: ATXN1; (+) strand; PAM type: YTN; PAM sequence: TTG
tcaattaatgaagattaaac

SEQ ID NO: 280936 - DNA, 20 bp, Artificial Sequence
  Description of Artificial Sequence: Synthetic oligonucleotide
  Target: ATXN1; (+) strand; PAM type: YTN; PAM sequence: TTA
atgaagattaaacataaagg

SEQ ID NO: 280937 - DNA, 20 bp, Artificial Sequence
  Description of Artificial Sequence: Synthetic oligonucleotide
  Target: ATXN1; (+) strand; PAM type: YTN; PAM sequence: TTA
aacataaaggtgatctggaa

SEQ ID NO: 280938 - DNA, 20 bp, Artificial Sequence
  Description of Artificial Sequence: Synthetic oligonucleotide
  Target: ATXN1; (+) strand; PAM type: YTN; PAM sequence: CTG
gaatctatgaggacaatctg

SEQ ID NO: 280939 - DNA, 20 bp, Artificial Sequence
  Description of Artificial Sequence: Synthetic oligonucleotide
  Target: ATXN1; (+) strand; PAM type: YTN; PAM sequence: CTA
tgaggacaatctggggggat

SEQ ID NO: 280940 - DNA, 20 bp, Artificial Sequence
  Description of Artificial Sequence: Synthetic oligonucleotide
  Target: ATXN1; (+) strand; PAM type: YTN; PAM sequence: CTG
gggggatatgactgccaact

SEQ ID NO: 280941 - DNA, 20 bp, Artificial Sequence
  Description of Artificial Sequence: Synthetic oligonucleotide
  Target: ATXN1; (+) strand; PAM type: YTN; PAM sequence: CTG
ccaactgaagatggcagaaa

SEQ ID NO: 280942 - DNA, 20 bp, Artificial Sequence
  Description of Artificial Sequence: Synthetic oligonucleotide
  Target: ATXN1; (+) strand; PAM type: YTN; PAM sequence: CTG
aagatggcagaaaaaacatg

SEQ ID NO: 280943 - DNA, 20 bp, Artificial Sequence
  Description of Artificial Sequence: Synthetic oligonucleotide
  Target: ATXN1; (+) strand; PAM type: YTN; PAM sequence: TTG
aaattattctcacagttttg

SEQ ID NO: 280944 - DNA, 20 bp, Artificial Sequence
  Description of Artificial Sequence: Synthetic oligonucleotide
  Target: ATXN1; (+) strand; PAM type: YTN; PAM sequence: TTA
ttctcacagttttgacagta

SEQ ID NO: 280945 - DNA, 20 bp, Artificial Sequence
  Description of Artificial Sequence: Synthetic oligonucleotide
  Target: ATXN1; (+) strand; PAM type: YTN; PAM sequence: TTC
tcacagttttgacagtagag

SEQ ID NO: 280946 - DNA, 20 bp, Artificial Sequence
  Description of Artificial Sequence: Synthetic oligonucleotide
  Target: ATXN1; (+) strand; PAM type: YTN; PAM sequence: CTC
acagttttgacagtagagaa

SEQ ID NO: 280947 - DNA, 20 bp, Artificial Sequence
  Description of Artificial Sequence: Synthetic oligonucleotide
  Target: ATXN1; (+) strand; PAM type: YTN; PAM sequence: TTT
tgacagtagagaaaaaccat

SEQ ID NO: 280948 - DNA, 20 bp, Artificial Sequence
  Description of Artificial Sequence: Synthetic oligonucleotide
  Target: ATXN1; (+) strand; PAM type: YTN; PAM sequence: TTT
gacagtagagaaaaaccatc

SEQ ID NO: 280949 - DNA, 20 bp, Artificial Sequence
  Description of Artificial Sequence: Synthetic oligonucleotide
  Target: ATXN1; (+) strand; PAM type: YTN; PAM sequence: TTG
acagtagagaaaaaccatca

SEQ ID NO: 280950 - DNA, 20 bp, Artificial Sequence
  Description of Artificial Sequence: Synthetic oligonucleotide
  Target: ATXN1; (+) strand; PAM type: YTN; PAM sequence: TTA
aagggaaatgtttcttgcat

SEQ ID NO: 280951 - DNA, 20 bp, Artificial Sequence
  Description of Artificial Sequence: Synthetic oligonucleotide
  Target: ATXN1; (+) strand; PAM type: YTN; PAM sequence: TTT
cttgcatgggctgcagtact

SEQ ID NO: 280952 - DNA, 20 bp, Artificial Sequence
  Description of Artificial Sequence: Synthetic oligonucleotide
  Target: ATXN1; (+) strand; PAM type: YTN; PAM sequence: TTC
ttgcatgggctgcagtactg

SEQ ID NO: 280953 - DNA, 20 bp, Artificial Sequence
  Description of Artificial Sequence: Synthetic oligonucleotide
  Target: ATXN1; (+) strand; PAM type: YTN; PAM sequence: CTT
gcatgggctgcagtactgtt

SEQ ID NO: 280954 - DNA, 20 bp, Artificial Sequence
  Description of Artificial Sequence: Synthetic oligonucleotide
  Target: ATXN1; (+) strand; PAM type: YTN; PAM sequence: TTG
catgggctgcagtactgttt

SEQ ID NO: 280955 - DNA, 20 bp, Artificial Sequence
  Description of Artificial Sequence: Synthetic oligonucleotide
  Target: ATXN1; (+) strand; PAM type: YTN; PAM sequence: CTG
cagtactgttttaaacagaa

SEQ ID NO: 280956 - DNA, 20 bp, Artificial Sequence
  Description of Artificial Sequence: Synthetic oligonucleotide
  Target: ATXN1; (+) strand; PAM type: YTN; PAM sequence: CTG
ttttaaacagaagggaaaga

SEQ ID NO: 280957 - DNA, 20 bp, Artificial Sequence
  Description of Artificial Sequence: Synthetic oligonucleotide
  Target: ATXN1; (+) strand; PAM type: YTN; PAM sequence: TTT
taaacagaagggaaagacca

SEQ ID NO: 280958 - DNA, 20 bp, Artificial Sequence
  Description of Artificial Sequence: Synthetic oligonucleotide
  Target: ATXN1; (+) strand; PAM type: YTN; PAM sequence: TTT
aaacagaagggaaagaccat

SEQ ID NO: 280959 - DNA, 20 bp, Artificial Sequence
  Description of Artificial Sequence: Synthetic oligonucleotide
  Target: ATXN1; (+) strand; PAM type: YTN; PAM sequence: TTA
aacagaagggaaagaccatt

SEQ ID NO: 280960 - DNA, 20 bp, Artificial Sequence
  Description of Artificial Sequence: Synthetic oligonucleotide
  Target: ATXN1; (+) strand; PAM type: YTN; PAM sequence: TTA
aacatgactggtattcacta

SEQ ID NO: 280961 - DNA, 20 bp, Artificial Sequence
  Description of Artificial Sequence: Synthetic oligonucleotide
  Target: ATXN1; (+) strand; PAM type: YTN; PAM sequence: CTG
gtattcactaaattttaact

SEQ ID NO: 280962 - DNA, 20 bp, Artificial Sequence
  Description of Artificial Sequence: Synthetic oligonucleotide
  Target: ATXN1; (+) strand; PAM type: YTN; PAM sequence: TTC
actaaattttaactacactg

SEQ ID NO: 280963 - DNA, 20 bp, Artificial Sequence
  Description of Artificial Sequence: Synthetic oligonucleotide
  Target: ATXN1; (+) strand; PAM type: YTN; PAM sequence: CTA
aattttaactacactggcat

SEQ ID NO: 280964 - DNA, 20 bp, Artificial Sequence
  Description of Artificial Sequence: Synthetic oligonucleotide
  Target: ATXN1; (+) strand; PAM type: YTN; PAM sequence: TTT
taactacactggcatcaaag

SEQ ID NO: 280965 - DNA, 20 bp, Artificial Sequence
  Description of Artificial Sequence: Synthetic oligonucleotide
  Target: ATXN1; (+) strand; PAM type: YTN; PAM sequence: TTT
aactacactggcatcaaagt

SEQ ID NO: 280966 - DNA, 20 bp, Artificial Sequence
  Description of Artificial Sequence: Synthetic oligonucleotide
  Target: ATXN1; (+) strand; PAM type: YTN; PAM sequence: TTA
actacactggcatcaaagtc

SEQ ID NO: 280967 - DNA, 20 bp, Artificial Sequence
  Description of Artificial Sequence: Synthetic oligonucleotide
  Target: ATXN1; (+) strand; PAM type: YTN; PAM sequence: CTA
cactggcatcaaagtctgag

SEQ ID NO: 280968 - DNA, 20 bp, Artificial Sequence
  Description of Artificial Sequence: Synthetic oligonucleotide
  Target: ATXN1; (+) strand; PAM type: YTN; PAM sequence: CTG
gcatcaaagtctgagcctgt

SEQ ID NO: 280969 - DNA, 20 bp, Artificial Sequence
  Description of Artificial Sequence: Synthetic oligonucleotide
  Target: ATXN1; (+) strand; PAM type: YTN; PAM sequence: CTG
agcctgtgagtgcaagtcag

SEQ ID NO: 280970 - DNA, 20 bp, Artificial Sequence
  Description of Artificial Sequence: Synthetic oligonucleotide
  Target: ATXN1; (+) strand; PAM type: YTN; PAM sequence: CTG
tgagtgcaagtcagaataac

SEQ ID NO: 280971 - DNA, 20 bp, Artificial Sequence
  Description of Artificial Sequence: Synthetic oligonucleotide
  Target: ATXN1; (+) strand; PAM type: YTN; PAM sequence: CTT
gcgcttattctgaaataaat

SEQ ID NO: 280972 - DNA, 20 bp, Artificial Sequence
  Description of Artificial Sequence: Synthetic oligonucleotide
  Target: ATXN1; (+) strand; PAM type: YTN; PAM sequence: TTG
cgcttattctgaaataaatg

SEQ ID NO: 280973 - DNA, 20 bp, Artificial Sequence
  Description of Artificial Sequence: Synthetic oligonucleotide
  Target: ATXN1; (+) strand; PAM type: YTN; PAM sequence: CTT
attctgaaataaatgtttct

SEQ ID NO: 280974 - DNA, 20 bp, Artificial Sequence
  Description of Artificial Sequence: Synthetic oligonucleotide
  Target: ATXN1; (+) strand; PAM type: YTN; PAM sequence: TTA
ttctgaaataaatgtttctt

SEQ ID NO: 280975 - DNA, 20 bp, Artificial Sequence
  Description of Artificial Sequence: Synthetic oligonucleotide
  Target: ATXN1; (+) strand; PAM type: YTN; PAM sequence: TTC
tgaaataaatgtttctttcc

SEQ ID NO: 280976 - DNA, 20 bp, Artificial Sequence
  Description of Artificial Sequence: Synthetic oligonucleotide
  Target: ATXN1; (+) strand; PAM type: YTN; PAM sequence: CTG
aaataaatgtttctttccac

SEQ ID NO: 280977 - DNA, 20 bp, Artificial Sequence
  Description of Artificial Sequence: Synthetic oligonucleotide
  Target: ATXN1; (+) strand; PAM type: YTN; PAM sequence: TTT
ctttccactgcaagggtgca

SEQ ID NO: 280978 - DNA, 20 bp, Artificial Sequence
  Description of Artificial Sequence: Synthetic oligonucleotide
  Target: ATXN1; (+) strand; PAM type: YTN; PAM sequence: TTC
tttccactgcaagggtgcat

SEQ ID NO: 280979 - DNA, 20 bp, Artificial Sequence
  Description of Artificial Sequence: Synthetic oligonucleotide
  Target: ATXN1; (+) strand; PAM type: YTN; PAM sequence: CTT
tccactgcaagggtgcatgt

SEQ ID NO: 280980 - DNA, 20 bp, Artificial Sequence
  Description of Artificial Sequence: Synthetic oligonucleotide
  Target: ATXN1; (+) strand; PAM type: YTN; PAM sequence: TTT
ccactgcaagggtgcatgtg

SEQ ID NO: 280981 - DNA, 20 bp, Artificial Sequence
  Description of Artificial Sequence: Synthetic oligonucleotide
  Target: ATXN1; (+) strand; PAM type: YTN; PAM sequence: TTC
cactgcaagggtgcatgtgt

SEQ ID NO: 280982 - DNA, 20 bp, Artificial Sequence
  Description of Artificial Sequence: Synthetic oligonucleotide
  Target: ATXN1; (+) strand; PAM type: YTN; PAM sequence: CTG
caagggtgcatgtgtgaggg

SEQ ID NO: 280983 - DNA, 20 bp, Artificial Sequence
  Description of Artificial Sequence: Synthetic oligonucleotide
  Target: ATXN1; (+) strand; PAM type: YTN; PAM sequence: TTC
tttttaatatggaagcacat

SEQ ID NO: 280984 - DNA, 20 bp, Artificial Sequence
  Description of Artificial Sequence: Synthetic oligonucleotide
  Target: ATXN1; (+) strand; PAM type: YTN; PAM sequence: CTT
tttaatatggaagcacatca

SEQ ID NO: 280985 - DNA, 20 bp, Artificial Sequence
  Description of Artificial Sequence: Synthetic oligonucleotide
  Target: ATXN1; (+) strand; PAM type: YTN; PAM sequence: TTT
ttaatatggaagcacatcac

SEQ ID NO: 280986 - DNA, 20 bp, Artificial Sequence
  Description of Artificial Sequence: Synthetic oligonucleotide
  Target: ATXN1; (+) strand; PAM type: YTN; PAM sequence: TTT
taatatggaagcacatcacc

SEQ ID NO: 280987 - DNA, 20 bp, Artificial Sequence
  Description of Artificial Sequence: Synthetic oligonucleotide
  Target: ATXN1; (+) strand; PAM type: YTN; PAM sequence: TTT
aatatggaagcacatcaccc

SEQ ID NO: 280988 - DNA, 20 bp, Artificial Sequence
  Description of Artificial Sequence: Synthetic oligonucleotide
  Target: ATXN1; (+) strand; PAM type: YTN; PAM sequence: TTA
atatggaagcacatcaccct

SEQ ID NO: 280989 - DNA, 20 bp, Artificial Sequence
  Description of Artificial Sequence: Synthetic oligonucleotide
  Target: ATXN1; (+) strand; PAM type: YTN; PAM sequence: CTG
acaatctaactctgacaagc

SEQ ID NO: 280990 - DNA, 20 bp, Artificial Sequence
  Description of Artificial Sequence: Synthetic oligonucleotide
  Target: ATXN1; (+) strand; PAM type: YTN; PAM sequence: CTA
actctgacaagcttgcatag

SEQ ID NO: 280991 - DNA, 20 bp, Artificial Sequence
  Description of Artificial Sequence: Synthetic oligonucleotide
  Target: ATXN1; (+) strand; PAM type: YTN; PAM sequence: CTC
tgacaagcttgcatagtcct

SEQ ID NO: 280992 - DNA, 20 bp, Artificial Sequence
  Description of Artificial Sequence: Synthetic oligonucleotide
  Target: ATXN1; (+) strand; PAM type: YTN; PAM sequence: CTG
acaagcttgcatagtcctag

SEQ ID NO: 280993 - DNA, 20 bp, Artificial Sequence
  Description of Artificial Sequence: Synthetic oligonucleotide
  Target: ATXN1; (+) strand; PAM type: YTN; PAM sequence: CTT
gcatagtcctaggcattcta

SEQ ID NO: 280994 - DNA, 20 bp, Artificial Sequence
  Description of Artificial Sequence: Synthetic oligonucleotide
  Target: ATXN1; (+) strand; PAM type: YTN; PAM sequence: TTG
catagtcctaggcattctat

SEQ ID NO: 280995 - DNA, 20 bp, Artificial Sequence
  Description of Artificial Sequence: Synthetic oligonucleotide
  Target: ATXN1; (+) strand; PAM type: YTN; PAM sequence: CTA
ggcattctatttctacctcc

SEQ ID NO: 280996 - DNA, 20 bp, Artificial Sequence
  Description of Artificial Sequence: Synthetic oligonucleotide
  Target: ATXN1; (+) strand; PAM type: YTN; PAM sequence: TTC
tatttctacctcctaacaga

SEQ ID NO: 280997 - DNA, 20 bp, Artificial Sequence
  Description of Artificial Sequence: Synthetic oligonucleotide
  Target: ATXN1; (+) strand; PAM type: YTN; PAM sequence: CTA
tttctacctcctaacagaac

SEQ ID NO: 280998 - DNA, 20 bp, Artificial Sequence
  Description of Artificial Sequence: Synthetic oligonucleotide
  Target: ATXN1; (+) strand; PAM type: YTN; PAM sequence: TTT
ctacctcctaacagaacagc

SEQ ID NO: 280999 - DNA, 20 bp, Artificial Sequence
  Description of Artificial Sequence: Synthetic oligonucleotide
  Target: ATXN1; (+) strand; PAM type: YTN; PAM sequence: TTC
tacctcctaacagaacagca

SEQ ID NO: 281000 - DNA, 20 bp, Artificial Sequence
  Description of Artificial Sequence: Synthetic oligonucleotide
  Target: ATXN1; (+) strand; PAM type: YTN; PAM sequence: CTA
cctcctaacagaacagcatc

SEQ ID NO: 281001 - DNA, 20 bp, Artificial Sequence
  Description of Artificial Sequence: Synthetic oligonucleotide
  Target: ATXN1; (+) strand; PAM type: YTN; PAM sequence: CTC
ctaacagaacagcatcagca

SEQ ID NO: 281002 - DNA, 20 bp, Artificial Sequence
  Description of Artificial Sequence: Synthetic oligonucleotide
  Target: ATXN1; (+) strand; PAM type: YTN; PAM sequence: CTA
acagaacagcatcagcaaca

SEQ ID NO: 281003 - DNA, 20 bp, Artificial Sequence
  Description of Artificial Sequence: Synthetic oligonucleotide
  Target: ATXN1; (+) strand; PAM type: YTN; PAM sequence: TTT
gtgatcatattctgtcagct

SEQ ID NO: 281004 - DNA, 20 bp, Artificial Sequence
  Description of Artificial Sequence: Synthetic oligonucleotide
  Target: ATXN1; (+) strand; PAM type: YTN; PAM sequence: TTG
tgatcatattctgtcagctg

SEQ ID NO: 281005 - DNA, 20 bp, Artificial Sequence
  Description of Artificial Sequence: Synthetic oligonucleotide
  Target: ATXN1; (+) strand; PAM type: YTN; PAM sequence: TTC
tgtcagctgctctgctaaca

SEQ ID NO: 281006 - DNA, 20 bp, Artificial Sequence
  Description of Artificial Sequence: Synthetic oligonucleotide
  Target: ATXN1; (+) strand; PAM type: YTN; PAM sequence: CTG
tcagctgctctgctaacaat

SEQ ID NO: 281007 - DNA, 20 bp, Artificial Sequence
  Description of Artificial Sequence: Synthetic oligonucleotide
  Target: ATXN1; (+) strand; PAM type: YTN; PAM sequence: CTG
ctctgctaacaatgagaaat

SEQ ID NO: 281008 - DNA, 20 bp, Artificial Sequence
  Description of Artificial Sequence: Synthetic oligonucleotide
  Target: ATXN1; (+) strand; PAM type: YTN; PAM sequence: CTC
tgctaacaatgagaaatttt

SEQ ID NO: 281009 - DNA, 20 bp, Artificial Sequence
  Description of Artificial Sequence: Synthetic oligonucleotide
  Target: ATXN1; (+) strand; PAM type: YTN; PAM sequence: CTG
ctaacaatgagaaattttta

SEQ ID NO: 281010 - DNA, 20 bp, Artificial Sequence
  Description of Artificial Sequence: Synthetic oligonucleotide
  Target: ATXN1; (+) strand; PAM type: YTN; PAM sequence: CTA
acaatgagaaatttttactt

SEQ ID NO: 281011 - DNA, 20 bp, Artificial Sequence
  Description of Artificial Sequence: Synthetic oligonucleotide
  Target: ATXN1; (+) strand; PAM type: YTN; PAM sequence: TTT
ttacttgtatatggatagta

SEQ ID NO: 281012 - DNA, 20 bp, Artificial Sequence
  Description of Artificial Sequence: Synthetic oligonucleotide
  Target: ATXN1; (+) strand; PAM type: YTN; PAM sequence: TTT
tacttgtatatggatagtaa

SEQ ID NO: 281013 - DNA, 20 bp, Artificial Sequence
  Description of Artificial Sequence: Synthetic oligonucleotide
  Target: ATXN1; (+) strand; PAM type: YTN; PAM sequence: TTT
acttgtatatggatagtaag

SEQ ID NO: 281014 - DNA, 20 bp, Artificial Sequence
  Description of Artificial Sequence: Synthetic oligonucleotide
  Target: ATXN1; (+) strand; PAM type: YTN; PAM sequence: TTA
cttgtatatggatagtaagt

SEQ ID NO: 281015 - DNA, 20 bp, Artificial Sequence
  Description of Artificial Sequence: Synthetic oligonucleotide
  Target: ATXN1; (+) strand; PAM type: YTN; PAM sequence: CTT
gtatatggatagtaagttcc

SEQ ID NO: 281016 - DNA, 20 bp, Artificial Sequence
  Description of Artificial Sequence: Synthetic oligonucleotide
  Target: ATXN1; (+) strand; PAM type: YTN; PAM sequence: TTG
tatatggatagtaagttccc

SEQ ID NO: 281017 - DNA, 20 bp, Artificial Sequence
  Description of Artificial Sequence: Synthetic oligonucleotide
  Target: ATXN1; (+) strand; PAM type: YTN; PAM sequence: TTC
cctgagaaggcatatctcca

SEQ ID NO: 281018 - DNA, 20 bp, Artificial Sequence
  Description of Artificial Sequence: Synthetic oligonucleotide
  Target: ATXN1; (+) strand; PAM type: YTN; PAM sequence: CTG
agaaggcatatctccaggac

SEQ ID NO: 281019 - DNA, 20 bp, Artificial Sequence
  Description of Artificial Sequence: Synthetic oligonucleotide
  Target: ATXN1; (+) strand; PAM type: YTN; PAM sequence: CTC
caggaccagtgttccgcctt

SEQ ID NO: 281020 - DNA, 20 bp, Artificial Sequence
  Description of Artificial Sequence: Synthetic oligonucleotide
  Target: ATXN1; (+) strand; PAM type: YTN; PAM sequence: TTC
cgcctttttactttacaatc

SEQ ID NO: 281021 - DNA, 20 bp, Artificial Sequence
  Description of Artificial Sequence: Synthetic oligonucleotide
  Target: ATXN1; (+) strand; PAM type: YTN; PAM sequence: CTT
tttactttacaatctaatgt

SEQ ID NO: 281022 - DNA, 20 bp, Artificial Sequence
  Description of Artificial Sequence: Synthetic oligonucleotide
  Target: ATXN1; (+) strand; PAM type: YTN; PAM sequence: TTT
ttactttacaatctaatgtc

SEQ ID NO: 281023 - DNA, 20 bp, Artificial Sequence
  Description of Artificial Sequence: Synthetic oligonucleotide
  Target: ATXN1; (+) strand; PAM type: YTN; PAM sequence: TTT
tactttacaatctaatgtca

SEQ ID NO: 281024 - DNA, 20 bp, Artificial Sequence
  Description of Artificial Sequence: Synthetic oligonucleotide
  Target: ATXN1; (+) strand; PAM type: YTN; PAM sequence: TTT
actttacaatctaatgtcag

SEQ ID NO: 281025 - DNA, 20 bp, Artificial Sequence
  Description of Artificial Sequence: Synthetic oligonucleotide
  Target: ATXN1; (+) strand; PAM type: YTN; PAM sequence: TTA
ctttacaatctaatgtcagc

SEQ ID NO: 281026 - DNA, 20 bp, Artificial Sequence
  Description of Artificial Sequence: Synthetic oligonucleotide
  Target: ATXN1; (+) strand; PAM type: YTN; PAM sequence: CTT
tacaatctaatgtcagcaag

SEQ ID NO: 281027 - DNA, 20 bp, Artificial Sequence
  Description of Artificial Sequence: Synthetic oligonucleotide
  Target: ATXN1; (+) strand; PAM type: YTN; PAM sequence: TTT
acaatctaatgtcagcaaga

SEQ ID NO: 281028 - DNA, 20 bp, Artificial Sequence
  Description of Artificial Sequence: Synthetic oligonucleotide
  Target: ATXN1; (+) strand; PAM type: YTN; PAM sequence: TTA
caatctaatgtcagcaagag

SEQ ID NO: 281029 - DNA, 20 bp, Artificial Sequence
  Description of Artificial Sequence: Synthetic oligonucleotide
  Target: ATXN1; (+) strand; PAM type: YTN; PAM sequence: CTA
atgtcagcaagagtattttt

SEQ ID NO: 281030 - DNA, 20 bp, Artificial Sequence
  Description of Artificial Sequence: Synthetic oligonucleotide
  Target: ATXN1; (+) strand; PAM type: YTN; PAM sequence: TTT
ttgtgcacacattacccatg

SEQ ID NO: 281031 - DNA, 20 bp, Artificial Sequence
  Description of Artificial Sequence: Synthetic oligonucleotide
  Target: ATXN1; (+) strand; PAM type: YTN; PAM sequence: TTT
tgtgcacacattacccatgc

SEQ ID NO: 281032 - DNA, 20 bp, Artificial Sequence
  Description of Artificial Sequence: Synthetic oligonucleotide
  Target: ATXN1; (+) strand; PAM type: YTN; PAM sequence: TTT
gtgcacacattacccatgca

SEQ ID NO: 281033 - DNA, 20 bp, Artificial Sequence
  Description of Artificial Sequence: Synthetic oligonucleotide
  Target: ATXN1; (+) strand; PAM type: YTN; PAM sequence: TTG
tgcacacattacccatgcac

SEQ ID NO: 281034 - DNA, 20 bp, Artificial Sequence
  Description of Artificial Sequence: Synthetic oligonucleotide
  Target: ATXN1; (+) strand; PAM type: YTN; PAM sequence: TTA
cccatgcacacagcttagaa

SEQ ID NO: 281035 - DNA, 20 bp, Artificial Sequence
  Description of Artificial Sequence: Synthetic oligonucleotide
  Target: ATXN1; (+) strand; PAM type: YTN; PAM sequence: CTT
agaaataaacaaggtgtgta

SEQ ID NO: 281036 - DNA, 20 bp, Artificial Sequence
  Description of Artificial Sequence: Synthetic oligonucleotide
  Target: ATXN1; (+) strand; PAM type: YTN; PAM sequence: TTA
gaaataaacaaggtgtgtaa

SEQ ID NO: 281037 - DNA, 20 bp, Artificial Sequence
  Description of Artificial Sequence: Synthetic oligonucleotide
  Target: ATXN1; (+) strand; PAM type: YTN; PAM sequence: CTG
caaattggttccacagagca

SEQ ID NO: 281038 - DNA, 20 bp, Artificial Sequence
  Description of Artificial Sequence: Synthetic oligonucleotide
  Target: ATXN1; (+) strand; PAM type: YTN; PAM sequence: TTG
gttccacagagcaaataact

SEQ ID NO: 281039 - DNA, 20 bp, Artificial Sequence
  Description of Artificial Sequence: Synthetic oligonucleotide
  Target: ATXN1; (+) strand; PAM type: YTN; PAM sequence: TTC
cacagagcaaataactgatt

SEQ ID NO: 281040 - DNA, 20 bp, Artificial Sequence
  Description of Artificial Sequence: Synthetic oligonucleotide
  Target: ATXN1; (+) strand; PAM type: YTN; PAM sequence: CTG
attcaccagatatctgtaaa

SEQ ID NO: 281041 - DNA, 20 bp, Artificial Sequence
  Description of Artificial Sequence: Synthetic oligonucleotide
  Target: ATXN1; (+) strand; PAM type: YTN; PAM sequence: TTC
accagatatctgtaaaagca

SEQ ID NO: 281042 - DNA, 20 bp, Artificial Sequence
  Description of Artificial Sequence: Synthetic oligonucleotide
  Target: ATXN1; (+) strand; PAM type: YTN; PAM sequence: CTG
taaaagcaaatataaaatcc

SEQ ID NO: 281043 - DNA, 20 bp, Artificial Sequence
  Description of Artificial Sequence: Synthetic oligonucleotide
  Target: ATXN1; (+) strand; PAM type: YTN; PAM sequence: TTA
tgtctctgtattgaaaaacc

SEQ ID NO: 281044 - DNA, 20 bp, Artificial Sequence
  Description of Artificial Sequence: Synthetic oligonucleotide
  Target: ATXN1; (+) strand; PAM type: YTN; PAM sequence: CTC
tgtattgaaaaaccataaaa

SEQ ID NO: 281045 - DNA, 20 bp, Artificial Sequence
  Description of Artificial Sequence: Synthetic oligonucleotide
  Target: ATXN1; (+) strand; PAM type: YTN; PAM sequence: CTG
tattgaaaaaccataaaatg

SEQ ID NO: 281046 - DNA, 20 bp, Artificial Sequence
  Description of Artificial Sequence: Synthetic oligonucleotide
  Target: ATXN1; (+) strand; PAM type: YTN; PAM sequence: TTG
aaaaaccataaaatgctcag

SEQ ID NO: 281047 - DNA, 20 bp, Artificial Sequence
  Description of Artificial Sequence: Synthetic oligonucleotide
  Target: ATXN1; (+) strand; PAM type: YTN; PAM sequence: CTC
aggacctttatgttaactaa

SEQ ID NO: 281048 - DNA, 20 bp, Artificial Sequence
  Description of Artificial Sequence: Synthetic oligonucleotide
  Target: ATXN1; (+) strand; PAM type: YTN; PAM sequence: CTT
tatgttaactaaagtatttt

SEQ ID NO: 281049 - DNA, 20 bp, Artificial Sequence
  Description of Artificial Sequence: Synthetic oligonucleotide
  Target: ATXN1; (+) strand; PAM type: YTN; PAM sequence: TTT
atgttaactaaagtattttc

SEQ ID NO: 281050 - DNA, 20 bp, Artificial Sequence
  Description of Artificial Sequence: Synthetic oligonucleotide
  Target: ATXN1; (+) strand; PAM type: YTN; PAM sequence: TTA
tgttaactaaagtattttcc

SEQ ID NO: 281051 - DNA, 20 bp, Artificial Sequence
  Description of Artificial Sequence: Synthetic oligonucleotide
  Target: ATXN1; (+) strand; PAM type: YTN; PAM sequence: TTA
actaaagtattttccttcca

SEQ ID NO: 281052 - DNA, 20 bp, Artificial Sequence
  Description of Artificial Sequence: Synthetic oligonucleotide
  Target: ATXN1; (+) strand; PAM type: YTN; PAM sequence: CTA
aagtattttccttccatgtg

SEQ ID NO: 281053 - DNA, 20 bp, Artificial Sequence
  Description of Artificial Sequence: Synthetic oligonucleotide
  Target: ATXN1; (+) strand; PAM type: YTN; PAM sequence: TTT
tccttccatgtgttagattt

SEQ ID NO: 281054 - DNA, 20 bp, Artificial Sequence
  Description of Artificial Sequence: Synthetic oligonucleotide
  Target: ATXN1; (+) strand; PAM type: YTN; PAM sequence: TTT
ccttccatgtgttagatttt

SEQ ID NO: 281055 - DNA, 20 bp, Artificial Sequence
  Description of Artificial Sequence: Synthetic oligonucleotide
  Target: ATXN1; (+) strand; PAM type: YTN; PAM sequence: TTC
cttccatgtgttagattttc

SEQ ID NO: 281056 - DNA, 20 bp, Artificial Sequence
  Description of Artificial Sequence: Synthetic oligonucleotide
  Target: ATXN1; (+) strand; PAM type: YTN; PAM sequence: CTT
ccatgtgttagattttcccc

SEQ ID NO: 281057 - DNA, 20 bp, Artificial Sequence
  Description of Artificial Sequence: Synthetic oligonucleotide
  Target: ATXN1; (+) strand; PAM type: YTN; PAM sequence: TTC
catgtgttagattttcccct

SEQ ID NO: 281058 - DNA, 20 bp, Artificial Sequence
  Description of Artificial Sequence: Synthetic oligonucleotide
  Target: ATXN1; (+) strand; PAM type: YTN; PAM sequence: TTA
gattttccccttatatgtgt

SEQ ID NO: 281059 - DNA, 20 bp, Artificial Sequence
  Description of Artificial Sequence: Synthetic oligonucleotide
  Target: ATXN1; (+) strand; PAM type: YTN; PAM sequence: TTT
tccccttatatgtgtagaac

SEQ ID NO: 281060 - DNA, 20 bp, Artificial Sequence
  Description of Artificial Sequence: Synthetic oligonucleotide
  Target: ATXN1; (+) strand; PAM type: YTN; PAM sequence: TTT
ccccttatatgtgtagaaca

SEQ ID NO: 281061 - DNA, 20 bp, Artificial Sequence
  Description of Artificial Sequence: Synthetic oligonucleotide
  Target: ATXN1; (+) strand; PAM type: YTN; PAM sequence: TTC
cccttatatgtgtagaacac

SEQ ID NO: 281062 - DNA, 20 bp, Artificial Sequence
  Description of Artificial Sequence: Synthetic oligonucleotide
  Target: ATXN1; (+) strand; PAM type: YTN; PAM sequence: CTT
atatgtgtagaacacacaca

SEQ ID NO: 281063 - DNA, 20 bp, Artificial Sequence
  Description of Artificial Sequence: Synthetic oligonucleotide
  Target: ATXN1; (+) strand; PAM type: YTN; PAM sequence: TTA
tatgtgtagaacacacacac

SEQ ID NO: 281064 - DNA, 20 bp, Artificial Sequence
  Description of Artificial Sequence: Synthetic oligonucleotide
  Target: ATXN1; (+) strand; PAM type: YTN; PAM sequence: TTA
taaacgtcagagctctttta

SEQ ID NO: 281065 - DNA, 20 bp, Artificial Sequence
  Description of Artificial Sequence: Synthetic oligonucleotide
  Target: ATXN1; (+) strand; PAM type: YTN; PAM sequence: CTC
ttttaacctttaaaaaccaa

SEQ ID NO: 281066 - DNA, 20 bp, Artificial Sequence
  Description of Artificial Sequence: Synthetic oligonucleotide
  Target: ATXN1; (+) strand; PAM type: YTN; PAM sequence: CTT
ttaacctttaaaaaccaaca

SEQ ID NO: 281067 - DNA, 20 bp, Artificial Sequence
  Description of Artificial Sequence: Synthetic oligonucleotide
  Target: ATXN1; (+) strand; PAM type: YTN; PAM sequence: TTT
taacctttaaaaaccaacac

SEQ ID NO: 281068 - DNA, 20 bp, Artificial Sequence
  Description of Artificial Sequence: Synthetic oligonucleotide
  Target: ATXN1; (+) strand; PAM type: YTN; PAM sequence: TTT
aacctttaaaaaccaacaca

SEQ ID NO: 281069 - DNA, 20 bp, Artificial Sequence
  Description of Artificial Sequence: Synthetic oligonucleotide
  Target: ATXN1; (+) strand; PAM type: YTN; PAM sequence: TTA
acctttaaaaaccaacacag

SEQ ID NO: 281070 - DNA, 20 bp, Artificial Sequence
  Description of Artificial Sequence: Synthetic oligonucleotide
  Target: ATXN1; (+) strand; PAM type: YTN; PAM sequence: CTT
taaaaaccaacacagtaatt

SEQ ID NO: 281071 - DNA, 20 bp, Artificial Sequence
  Description of Artificial Sequence: Synthetic oligonucleotide
  Target: ATXN1; (+) strand; PAM type: YTN; PAM sequence: TTT
aaaaaccaacacagtaatta

SEQ ID NO: 281072 - DNA, 20 bp, Artificial Sequence
  Description of Artificial Sequence: Synthetic oligonucleotide
  Target: ATXN1; (+) strand; PAM type: YTN; PAM sequence: TTA
aaaaccaacacagtaattat

SEQ ID NO: 281073 - DNA, 20 bp, Artificial Sequence
  Description of Artificial Sequence: Synthetic oligonucleotide
  Target: ATXN1; (+) strand; PAM type: YTN; PAM sequence: TTA
tattgcaaagatatctgaca

SEQ ID NO: 281074 - DNA, 20 bp, Artificial Sequence
  Description of Artificial Sequence: Synthetic oligonucleotide
  Target: ATXN1; (+) strand; PAM type: YTN; PAM sequence: TTG
caaagatatctgacaaccca

SEQ ID NO: 281075 - DNA, 20 bp, Artificial Sequence
  Description of Artificial Sequence: Synthetic oligonucleotide
  Target: ATXN1; (+) strand; PAM type: YTN; PAM sequence: CTG
acaacccagagtaatactag

SEQ ID NO: 281076 - DNA, 20 bp, Artificial Sequence
  Description of Artificial Sequence: Synthetic oligonucleotide
  Target: ATXN1; (+) strand; PAM type: YTN; PAM sequence: CTA
gaaaaggattatttctgcgc

SEQ ID NO: 281077 - DNA, 20 bp, Artificial Sequence
  Description of Artificial Sequence: Synthetic oligonucleotide
  Target: ATXN1; (+) strand; PAM type: YTN; PAM sequence: TTA
tttctgcgcccccttctttt

SEQ ID NO: 281078 - DNA, 20 bp, Artificial Sequence
  Description of Artificial Sequence: Synthetic oligonucleotide
  Target: ATXN1; (+) strand; PAM type: YTN; PAM sequence: TTT
ctgcgcccccttcttttaaa

SEQ ID NO: 281079 - DNA, 20 bp, Artificial Sequence
  Description of Artificial Sequence: Synthetic oligonucleotide
  Target: ATXN1; (+) strand; PAM type: YTN; PAM sequence: TTC
tgcgcccccttcttttaaat

SEQ ID NO: 281080 - DNA, 20 bp, Artificial Sequence
  Description of Artificial Sequence: Synthetic oligonucleotide
  Target: ATXN1; (+) strand; PAM type: YTN; PAM sequence: CTG
cgcccccttcttttaaatag

SEQ ID NO: 281081 - DNA, 20 bp, Artificial Sequence
  Description of Artificial Sequence: Synthetic oligonucleotide
  Target: ATXN1; (+) strand; PAM type: YTN; PAM sequence: CTT
cttttaaatagttctcaatt

SEQ ID NO: 281082 - DNA, 20 bp, Artificial Sequence
  Description of Artificial Sequence: Synthetic oligonucleotide
  Target: ATXN1; (+) strand; PAM type: YTN; PAM sequence: TTC
ttttaaatagttctcaattt

SEQ ID NO: 281083 - DNA, 20 bp, Artificial Sequence
  Description of Artificial Sequence: Synthetic oligonucleotide
  Target: ATXN1; (+) strand; PAM type: YTN; PAM sequence: CTT
ttaaatagttctcaattttt

SEQ ID NO: 281084 - DNA, 20 bp, Artificial Sequence
  Description of Artificial Sequence: Synthetic oligonucleotide
  Target: ATXN1; (+) strand; PAM type: YTN; PAM sequence: TTT
taaatagttctcaatttttc

SEQ ID NO: 281085 - DNA, 20 bp, Artificial Sequence
  Description of Artificial Sequence: Synthetic oligonucleotide
  Target: ATXN1; (+) strand; PAM type: YTN; PAM sequence: TTT
aaatagttctcaatttttct

SEQ ID NO: 281086 - DNA, 20 bp, Artificial Sequence
  Description of Artificial Sequence: Synthetic oligonucleotide
  Target: ATXN1; (+) strand; PAM type: YTN; PAM sequence: TTA
aatagttctcaatttttcta

SEQ ID NO: 281087 - DNA, 20 bp, Artificial Sequence
  Description of Artificial Sequence: Synthetic oligonucleotide
  Target: ATXN1; (+) strand; PAM type: YTN; PAM sequence: TTC
tcaatttttctacaatttat

SEQ ID NO: 281088 - DNA, 20 bp, Artificial Sequence
  Description of Artificial Sequence: Synthetic oligonucleotide
  Target: ATXN1; (+) strand; PAM type: YTN; PAM sequence: CTC
aatttttctacaatttatag

SEQ ID NO: 281089 - DNA, 20 bp, Artificial Sequence
  Description of Artificial Sequence: Synthetic oligonucleotide
  Target: ATXN1; (+) strand; PAM type: YTN; PAM sequence: TTT
ttctacaatttataggcgga

SEQ ID NO: 281090 - DNA, 20 bp, Artificial Sequence
  Description of Artificial Sequence: Synthetic oligonucleotide
  Target: ATXN1; (+) strand; PAM type: YTN; PAM sequence: TTT
tctacaatttataggcggac

SEQ ID NO: 281091 - DNA, 20 bp, Artificial Sequence
  Description of Artificial Sequence: Synthetic oligonucleotide
  Target: ATXN1; (+) strand; PAM type: YTN; PAM sequence: TTT
ctacaatttataggcggact

SEQ ID NO: 281092 - DNA, 20 bp, Artificial Sequence
  Description of Artificial Sequence: Synthetic oligonucleotide
  Target: ATXN1; (+) strand; PAM type: YTN; PAM sequence: TTC
tacaatttataggcggactg

SEQ ID NO: 281093 - DNA, 20 bp, Artificial Sequence
  Description of Artificial Sequence: Synthetic oligonucleotide
  Target: ATXN1; (+) strand; PAM type: YTN; PAM sequence: CTA
caatttataggcggactgtg

SEQ ID NO: 281094 - DNA, 20 bp, Artificial Sequence
  Description of Artificial Sequence: Synthetic oligonucleotide
  Target: ATXN1; (+) strand; PAM type: YTN; PAM sequence: TTT
ataggcggactgtgcaaaag

SEQ ID NO: 281095 - DNA, 20 bp, Artificial Sequence
  Description of Artificial Sequence: Synthetic oligonucleotide
  Target: ATXN1; (+) strand; PAM type: YTN; PAM sequence: TTA
taggcggactgtgcaaaaga

SEQ ID NO: 281096 - DNA, 20 bp, Artificial Sequence
  Description of Artificial Sequence: Synthetic oligonucleotide
  Target: ATXN1; (+) strand; PAM type: YTN; PAM sequence: CTG
tgcaaaagattttcatagcc

SEQ ID NO: 281097 - DNA, 20 bp, Artificial Sequence
  Description of Artificial Sequence: Synthetic oligonucleotide
  Target: ATXN1; (+) strand; PAM type: YTN; PAM sequence: TTT
tcatagccatgaatcctatt

SEQ ID NO: 281098 - DNA, 20 bp, Artificial Sequence
  Description of Artificial Sequence: Synthetic oligonucleotide
  Target: ATXN1; (+) strand; PAM type: YTN; PAM sequence: TTT
catagccatgaatcctatta

SEQ ID NO: 281099 - DNA, 20 bp, Artificial Sequence
  Description of Artificial Sequence: Synthetic oligonucleotide
  Target: ATXN1; (+) strand; PAM type: YTN; PAM sequence: TTC
atagccatgaatcctattaa

SEQ ID NO: 281100 - DNA, 20 bp, Artificial Sequence
  Description of Artificial Sequence: Synthetic oligonucleotide
  Target: ATXN1; (+) strand; PAM type: YTN; PAM sequence: CTA
ttaaagatacattgggagat

SEQ ID NO: 281101 - DNA, 20 bp, Artificial Sequence
  Description of Artificial Sequence: Synthetic oligonucleotide
  Target: ATXN1; (+) strand; PAM type: YTN; PAM sequence: TTA
aagatacattgggagataaa

SEQ ID NO: 281102 - DNA, 20 bp, Artificial Sequence
  Description of Artificial Sequence: Synthetic oligonucleotide
  Target: ATXN1; (+) strand; PAM type: YTN; PAM sequence: TTG
ggagataaaataaaatcact

SEQ ID NO: 281103 - DNA, 20 bp, Artificial Sequence
  Description of Artificial Sequence: Synthetic oligonucleotide
  Target: ATXN1; (+) strand; PAM type: YTN; PAM sequence: CTA
ttccaattcgcaagaatatt

SEQ ID NO: 281104 - DNA, 20 bp, Artificial Sequence
  Description of Artificial Sequence: Synthetic oligonucleotide
  Target: ATXN1; (+) strand; PAM type: YTN; PAM sequence: TTC
caattcgcaagaatatttga

SEQ ID NO: 281105 - DNA, 20 bp, Artificial Sequence
  Description of Artificial Sequence: Synthetic oligonucleotide
  Target: ATXN1; (+) strand; PAM type: YTN; PAM sequence: TTC
gcaagaatatttgaaacgct

SEQ ID NO: 281106 - DNA, 20 bp, Artificial Sequence
  Description of Artificial Sequence: Synthetic oligonucleotide
  Target: ATXN1; (+) strand; PAM type: YTN; PAM sequence: TTT
gaaacgctgccaaagggaat

SEQ ID NO: 281107 - DNA, 20 bp, Artificial Sequence
  Description of Artificial Sequence: Synthetic oligonucleotide
  Target: ATXN1; (+) strand; PAM type: YTN; PAM sequence: TTG
aaacgctgccaaagggaatg

SEQ ID NO: 281108 - DNA, 20 bp, Artificial Sequence
  Description of Artificial Sequence: Synthetic oligonucleotide
  Target: ATXN1; (+) strand; PAM type: YTN; PAM sequence: CTG
ccaaagggaatgtttctcca

SEQ ID NO: 281109 - DNA, 20 bp, Artificial Sequence
  Description of Artificial Sequence: Synthetic oligonucleotide
  Target: ATXN1; (+) strand; PAM type: YTN; PAM sequence: TTT
ctccaaacataaagagagta

SEQ ID NO: 281110 - DNA, 20 bp, Artificial Sequence
  Description of Artificial Sequence: Synthetic oligonucleotide
  Target: ATXN1; (+) strand; PAM type: YTN; PAM sequence: TTC
tccaaacataaagagagtat
